United States Patent 9,487,797 (GENOMIC PLANT SEQUENCES AND USES THEREOF) - sequence listing, part 50

SEQ ID NO: 66775 - DNA, 90831 bp, Oryza sativa
  unsure (1)..(90831): unsure at all n locations
caacatttcaaagaagtaaagtaactgtcgctgatgtgtgcttcctttcttggcctgaattgtgaaggtgcatggctgagtatcttcctaacttggaagaaaatcttaaaatccaggtactatagctttaagttttgcatgtaactgttggtcttgactgcctgctcttattgttgatagtattactactttacatcgtagtgtagttgtcatgttaatggaatgactaatcatcctttgaaaaatagtgtgcggaaaataagtgaggattgaggaataaaagaaaaggatagacagtagatctgatgctattgttgaattgtttaggtgattcaagcaagaaaaaatttcctgtatttcaatcttattatttagtggaagtacctttatgcataaaatgtacatcctttcccattattttaagcatactagacttactggaaactagctactactgaatcatttatcagttagatgaggtattgctaaaggtagcatggcatagcattaatcgtgcaactcgtgtctgttatacaaaacttatgtttctaatctataccgaaggttgtggaagcatcagcttcaattggttctagaagacgtttcattgaagcattggctcctacttttggaaggccattagaggctgatccggtacttgtttgccattgttttcgtatgttattgtctgctttgccaaattgtctaccaacctgtccacacttcagattttttgcagaaaagctacgattctttccatctcagggattttcacttttctggtatgtcataaaatttgtgaatctagtgctttctctgtttttccattacatgactgctatctgttttccaatctgaccagcgatctgatacagctttagaactgtaatgaaaaagtactagtggaatatgactttaattttctaccagttagtatattactaacaatatatatcatgtaactgctgcaggtccactttgtcattcccctccaattccctaagcatcaacctgtgctgacattagagagttctcaggtatttatttggtttgtcactgcttattgctagttgtaacttacatgctcaatagaggtcttgttgttgatatcagcatttagagctgggtagtcagtagaagtgaacaaggatgatacctatagcccatctacccaaacaaaacacacagaaacacagacacatcgtttttcttttttggagatcctatggggaggcaaaaatgagaccaacagctgttatactattccatttcatttcaccccttccaattcacctctctaatggatggaccattttcttcctgaaaatgataaaaaagtaaacatgcaagactatgatgtgttaaccttcttttgttattgattgacttgtagtgttgatttagcatctactggctagagagggcaggtgttgcccttgtaagttactctgtatgttaaattgttctttcaaggtgtggggaaataaccttttttgtggtgaatcctccgcagcacttcaatgcccaggggttacctatcatgtcagctccagtaaatgactatccctggagccctagatgggatccaacagaaatggttgaacgcatctagtaagtttctagttctcctatattgcatctacagaagttttcatgagtccaatttgctgatttgtgccaaaatttgcagtgactttttggttgacgagtgccaaactttcaagaagttttgcagcgattctatccctcaacagaagtagctgataaggtgattttatcaagaaagaacttcttgctactgttaacccatgttcctttcactgattgcataactataaccacagaccgttttttctcatatggtgtatcaggaagcatctctgttactgccggcttgctcggtctgctcgcaagttgcaacctgtattccccaacctggcaagtaaatttgtaagctcaagaagaagcctagtcaggcagtagaatccataagatttggataggtgcgcttctgtttgacaagtaaattgtgtacactagagcaaagctgggcatatgttttgttggttaaccccattgctgctggtcctagactcctaccttgtgattgctgggataaatggcaacccaattgctcctgccatgtacatacagataccgcacgtttaccaccggccgtttctttcactgtaaagtttgatgcaagtgacctctggctgctatggtttactgtacttaatgatttactagtactacattcatttcggatggtgaactggcaacttggtcgccccgttagaatgttcgttttggcgtttagccgcttgccttacgagtgaaaacagtcgatcactattaacttcttccttgattcgagtagtatttaatttgctcatcagttctgacttctgagctcgaatttttccctctgcccgagttgctctctcttgttattttaatttgggttaattcgtcgccaagttgcgtttttttttttctattctactaaaatactagtagtagtatgtatgctccacttgtgctatgatttggttgtttatttgctttgtgggggtaagttgctgttgctgctaagaaggaagtgcagatgacgacatgtatatcctgcttgagaagcagaagcttggcttatttttattttgctaagctgtgttgctcgtcttccatgactctgatgctcttcttctcagtagcagtatccctcactgctacctccggtttcctttcctttttttttttgttccgtctattggtctttggctctctaatctgagttgattcttgatacagactaacagacatgagaggcaggttttgtgcactccttcagttaaagttttccgggtgtgggatttcttgatgatggattatggtttatggttctgtttcttcttcctgattttatatctataaaattactccctccatttcataatacaagagtaggtattataacagactattagccagctataaacatattttaatgagataaaagatgaaatagaagagcagtggactacggatctgtagccagctgtagcacgaactatgacatgcatgtatgccattaactatgacatattctaaattaaattactacctttttaaattcttctctcacattctctaactctattgaatgcatgcattatatttattaggatgatccaaattataatatgataataattatttctttgtgtcttatattttgaaatggggagagtaataaagaacagatgtaaaagcaaataaggcctaatgactgaacgtcaggacctgttaaaggcccattcaaaagctaatcagagcatcaggcccgtttacggcccaagaaggcggacgtttagttgcgcattaatgggcctaatgccgcgtggagtgacgtcaggacattaacggccagtgacatcatacatgatggacattctacacggcgattaacaagcagttccgtagtattggggatttgtcagatttgtaacacgaatatgttacatcccttcaaaatcacttacttctatatgagagagagtgagtataggacggacggagggagttctcaacgtcattagaaacggaaaattgaaagaacgcaggaaagagagatattacgggctggtttggtttgaggtctaaattggtcttaccaatatttagcaatttcaatagtgttaattgtttatttggtttggagccaaattttggcttgcctaaaaaaataggccatttcaacagttaatttaggctttggcttcaatataaacacaattttacctttgccaaaattagccatgccaaaagttactaaaatttaacattcacaaaaatttttaggcccctaaccaaaccagccctacaagccaagcctattacacagtgggtatatataactgcaacatactccaccagagggaaaacacacacacactcttcattccatagaagcagaagcagagcgtaccacgatacagacagaaaaccaaaaacaaaaacagcagagcgtgtatatgtatcattccagtattttctgagaaaatcccagagttgacactgcaagtatgcaactaataaaaatttatgtgattcagcatctctcagatcgaacttatgttattcggcatgtcacagatcaaataagatcagagatcacatccatagcatataccttgaacaaaactgtgtttttcaagaaaaaactttcatgtaaaagtacacaacaaggtcgaaatttggtgtcaacaaacatgtgcagcagccacgaaactacggtttaaaacacctccattttctcatctatcgtctgcaaaagttacttgtgaagggctaccctcaactgtctcattctagatcctgaaaatgattaactagagttcaagggcctccaatctatttcttcttcttggatttgcttccctgtgcaaatgcagtgccctgccacatcaatgaactcaaaagttaatcttctgcatggggctcacaataatcgatcaatatgatgttcggtgagcagcgaaacaaacctccagccactcatccatgttggcatcagtagttccagttcccagttccaccttgggggccttctttgttttctacagcacgcagaaatgattgatgagataaacgtacacagctcaaatgtccagctaacctgtatcgcaacaaattagaaacatacctttgagagctgttgtacttgaccatatgcccacaatccgaagagaccaagaagggcaactccaagggtaataaggaacacagactcaacgctgagtaaacctccagcctcaacaacctctacagtgccattgtaaaagacattctggtatgggttctgatcaatctcatacactatgtaaccaactagatcatatgctccaggctgcaaggagacaggcattaggacgtcatgaatgcaaaatgtacacaacttgatcttatagttaagattgtttcaatggttagcgttgtgaattaacaaacctgcaagaacttgctcacggcgaatgtatacggaaaggttgcttgtacagagacaggaactgatgcattgaagaagttctgcaaaaaaagaaaccacaaaataagcatagttatgaattagaacatagcattccaagaatgtgtgcttgactcaataaattgtgtgattcaacttcacttaaagacaaataacatataatactactgagaagcagaaatacagatatctaatgaaaacataacagaacaagatccgaacagttatttctcggtgttcaaagttaaaacaaaatacattatatctctagagcaggcaggattaaataaattatcaataaataggaaagtttgatggtgcacacatcaataggttaatttcagaagttcagctgttcaggtagtaaaaacaagaacgctcccacatttcctcacctgaacagtaaggttttgtccatacatcttatggtcaaaaggaagatggagagttgaatggatagcaacaacattcaaagttgattcacctgtaaacacaacatatgcaaagggtgtttgactctaagcaaactaagaacaaaacatttgaactagcatggtaaaaagaatattaaactattgaactcagaatctacattgccaaaacaagaaaaatttgctcgtttatgaaaatgtcatgtacggtaaactagtgatctctaacataaggttattccttattggacccacatattcttggcaacaaaagaacacactaatatggctatgcatctgctctgacgcatcaatttacatgatataggaaaatacatgaaagacacatttgcatcaaaggcagctgaaaaactagtgctattaagggacgtgaacatatgcatcttacaactcatattgcccatttggtgatctgttattagttaatcctatatagaaaacatggcagtttcaaccaacctagtacatattgaaacaatctcatgacctggatatgatacttaagccaaatggacatgaacttgcaataacttactacacagaaagcaaataactgagacaaatatgcatggcctgtttagatgaagtgcaaatctactggtcgatttaagataaatagagatagcccaagccaaacactaatcatagctaagtaactgaagtggcaaccgggaatatttcatgaaagaaacagcatgagttaccctcgttttgcaggccaaccagtagttcagtttcttcacctgctagcacaactacaataaaacaagaaaagggaaacattattgcttattgaagtcaacaaggatatgatgctgattttaaacaaaacatgtttccaaacatggcatgcaaatattaagaatagacaagatcctacagatatgcatagaatagaatcctatcagatgaacagaactagcaatttagtttagaatatttcatattaaacattaagggaaatgattgcaaatgaattacagtactagcgagtgaatttcaaataaatgattttgctgagattgtgatttgacactcacttttgccagcgtttttgggaaaaacacatactgtctccacaccaggagccggacttagaggcccatcgctggaaacttgtgtatcatcactgacgattcctagatcagccccatcaacaacttcagctgtagcagcttcttccatggactgagctctggcaactgcaggaaaattcagttcaaaggagcatagcagagaaaacagtaccattttcagccctagaacctcatcggtaaatttagaatatacgtcatcacttggttggctattctaaacagagattctgctaataatacatcccaattttccaattatgaaagagcttgtcggaggcttggagcagcatggtattctcaattttaaccaatcttaaatggcatggttccaaaattttacagtgttaaaaattaccatagaaacctatcctaccaatctaccatcgttaaccatacatgaaaaacccgtctcaatttcagaaagctccagcctcagatggctgcgttactttgataacaaatatgcaaacgcagaaacatttttatcatgaaaattgcacaccaacaaactcttcccaagacgtcgcgtctagaatcccgcccccacacaccgatctattcatataatacccacctaaacttgctccaaacatcaacctcctccggtgcaacaccacagagcccgatcggctcaattaccacacccgcggaggggcaaagcgcgcagatctaccgctgccccgccgcgaattatcgagatcggcgctcatctacgcggccccggatctacgcggcggggcgcggggcagagaagagaaagggagggacgaatcggtgcgcaacgagggtgtttaccttggacgacgggggcggcggcgaggaggaaggcgaggaggagggcggagagccaaaccctagtcgccgccatggctggctctggctcagatcggatcgggtcgaggcggaggaggaaggggtcgcgtgggttttgcgcggtggctgcgtgtggctcgcagtacaagtagtagtagtgaagccgtcgcctactacccttcaccaccacgaggtccacgacttgggtggggcgctgcgccgcgtgcccgcgtaggcttcagggtcgagtcgcagctgggtttgttactgtacatggattgtttgtttggcacattcaattacgatggtctcgtgatccgagctgtaaagcgtttataggattaatctcttcatccactgatccactgacagtggggtccacaaccgtataattagttgcaagatcacttcagcaaccagatgaaattgtagctggaaagatgcaaaatatacgcgacaactttcaccctgatggaaatgcagcgcaactagagcagattcgatgaattgcagctcatttttcagaggatttatggattcggacaaatgtgccctggtttttttttttacacaaattccaagttacaagaatacaaagatgtcaggtttacagtcccaacacatcacacctacattaaggtaaacaatttgtttgcagcagcagcaatcagagtgcctggaacggactcgccagcagttggcaccatccgttgtttcgccacatctatctggagctcttcttcttgttgcaacaatgcagtgacggtaattcgtaagtggcatcattgaacaagcgtaacagcttgtcatatgtactccctccgttccaaaaaaaaacaaaccctggtttccgtgtccaacgtttgaccgtccatcttatttgaaaaaattatgaaaaaaataaaaaagacaagtcacgcataaaatattaatcatgttttatcatctaacaataatgaaaatatgaattataaaaaaatttcatataagacggaccgttaaagttggacacgaaaacccagggtttgcctttttttttgggacggaggaagtatccagctagttgggacggctcagcgccatgaacttgcactgctcactcatcgcctgaagctgcgcttccttcttatcaatcatcgcacgcagcctcacattctcctccaccaccttctggacttcggcttctttttgtgctttctcactctcaagttggttggttcttgcaactagcctgttcacaagaacacaaaacttaataccaaattgattgtttggaatgaaaggattggataccacttgcttcaccaattcataaatcacccatgagtacgtacttatctaggcgattaacagaaggaacactataagtcaatgctatgttatgtttacgaatatgtagtttcatatgcgactgttagggaacttatttgaggtatcatgggttttacagcagccttctctgcatgattccaagaccatgaaaaatgattatatctgtatcaagtggaaaaaggagacaaaaagatgagcctacacagcatatgattttcccctcagccaagaatgtaattttctatgtttttaatcagtcatgggcatttccttaacattaggatgcgcatcactcaaatcagaaggtgaaggaactggaactacatgtttagaggacagcaagaaaaagtgttttggactaagtgctgaaatgcaaaccagtagaaaacatactgagacttagtcaattctatatccacaaaagcatgcatcattttgacaactgaacatccatacgaaattttggacatgatcaaaacacacaatttttctgcagttaaatgtgaagttggggaccaactcctagacttgatgattcgatttatactacactaacgtaacaccatatcagctgacaatagtctctatgatatcaaaaggtgacaaagtatttaaatactctagatgactcatttcaatgatatttagcatgattaaaagcaactatcaacaaatctgacaaaacactctttaccattgatcaacacagtggggataggtcatagttgttacaaaaaagaaggcttctggagatgcagtgtaaactctaatttataacagaatagatgtagctttgtgccttgaggataaaccatagagctctcctagtcaatgacagcccaacgttattaccaaaagaaaaacacttgaatgcgtgacatagtttatgtcaatcatatatgccagcaaaaaataggtttccatgctgtgttttaatgatactagtgtatatgcagtgtcacaaggaaagttcaaggcctgcagagcagttggtttcatgagctgatgagcatatcattaagcggctcgtgctttacaaaatgcattagaatatgaaatgttgtcttaacaattttctcagcagcatgtcctagcatgaaggtgttggcagcatcatcaatttacatgacgaatagggattacagtgcatgtgcaggatttattgtccaattaaactacagcagcatgccctaaaatgatgattttgctagcagcagtgtttacataatgacaggattgggaagatgaaagatatttttgcaaagctctgaaaaattaatataaagtttgcactcggaaatgaatcctgtacaacccacttcatacaaataatagttactaaaaatatcatgatacttgtgaagttacctgtcgaagagtttctccattgtttcaaactgcttctctgatgaaagaagagtttctctgacattaacgagagtgccgacataggttctgagagactcgaagtcatgcttcacacgactaagctcctgctcattttcagccgcacgttgcctttgtcgagtggtctccaacaccatgtcttcaaccctctgcctcatctcattcagcataccattcgtacccactgcaaatttctccatttcctcaactttggccgacatggactcaacctgtatggtcttcctcctaatctcttccagacccatcctcaccttctctttctcgttagcggcttccgattcagcaacaatcactctcttcacaagggtctccatgacatcggtcaccacatgtatcgacttcagaatgtcttcgacatctacatccccctcattggcatcgccatgttcggcaacacgactactatccgccgacgtttcatcatctaaaccctcgcaggaagcggactcgccgcccttggaccaatcagccagtggcaccccgttcctgtcgacgtaccccacgccatcctggtgcctaatcccgcaggacgtgtgcgcgaggtgcggtatcgccatgatcctggccttggatttgaggtaggccagcagcgtggcgatggtcttcaccctgcggcagaggtgatccagctccttcctcgagtcctcctcggagcacttcatcccgaccttgacctccacgagcctctcccgcagtgcgtcgacctgcgactgctgctgccgcagctcctccctccattcgctctccccctcctccgcgccactccgatcagcagcggcacgctccatgaaaccctacggaattcaaaccccccttaaaattgcatgtaaaatcggctagaaatggatctattcgtccccccaaattcgaccggataataaacgcgtaatcagacggatttgcgagcgagacggtggggatattggggagccatgtaccttcggtataggaggcaaggagcgcgtcgccggcggcgaactcccgctgcggcggcgctcctcgctttcttcgccgcgggttgggttgggttgggttgcgctctcgcgtcgcgtctcgcgaactagtcgctcgcctttcccctttcttcccccaacccaaactaatgaaatgaaatcattttgtttgcttacttatttcctaatccgatgattagattaggtgagtacgctaatggcaaaaagaaagattaataaatgcggacgcgctaaagcatccgtatgggccttgggcctcttctgggctttttttccaaaaaattgagcacatttgtaacacaaaaatcaaccattgtttttgtgcccgagaagcattgtaaggcagcacaacaatagcaactgtaaaagagaacgtcaatatttgtaggaagagtttttctcgtatccttgaagagatatatactttctcacaatttaagaggtaaaaactgtactaccagttgaactgattagaaaatatttaataaatgtgtagtcgagtggtaatgtaaagggtaggtgaagtaaagcatacccttggattccacttccccacgtacccaagttactggactatcaataatgagggcattatggctaccgacatctaaaaatgacatgcattaatttggcaaacagaaaatttaaacctgttttttttttctcaaaagtgttttggtttggtaatgtacgtctcctgaacaattgagatttgagagtcggtggttaaaactaaaccgtgagataaaccaaccggtgctttaattaattttgcacccccaatataagcaacaacgaactcctacgtggcggatggtcgagacggtcatggcgagcctctaactccccaccaactgccgcctctcgtcgcctcgcctcgccggcgccacctccgcattccgttccgaccagccgatcggtttcttcctcgccgttgcaaccttcgagcgcgatcgatcgaggcggttgaccgccgattcgccgcgcggcgttgcattgcacgcggctttccagttgataaatcaatcatcatccccttgatcgatgcgagtggcgttcttgttcgatcgagaggaggagatcgtgatcgcgagcgatccgggcggggcggcgcgccatcgatggcgaactgcgtgcggtgctgctgctggctcctggtgctgatgctcatggcgctcgcgatcaccgccgccgtggtgttcgtccgctacaagaacggcgagggggtcttccccttccccggcgtgcccggcgccgtcgaccacaagtacgccgacgcgctcgccgtcgccctccagttcttccaggtccagaaatgtaaggaattattctcaactttgcatgcattttttttttttgcgtttgatctcgatcatggaagttcttgatcgatgaagccgggaagctggtgaacaacacgatccactggagaggtgactcggcgctggacgacggcaaggaggccgggattgatctctccaaggggatgtacgacgccggcgaccacatgaagttcggattccccatggcgttcacggccaccatgctctcttggtccgtcctcgagtacggcgacgccatgcgcgccgccgaccagcgcgactccgccattgacgcgctgaattggatcatggattacctcgtcaatgcccacccctccgacgacgtcctctacatccaggtgatcatcatcaaatgatcgaataatctttatccaattcttgggaaatcaattaatttcttctggcattctgatctccaggtgggtgatcctaaagcagaccacaagtgctgggagcggccggagaagatgaaggagaagaggccactgaccaagatcacgcccaagtcccccggcagcgacgtggcggcggagacggcggcggccatggcggcggcgtcgctggtgtacaagacgatcaacaagacgtactcgtcgtcgctcctggaccacggcgagaggctgttcgccttcgccgacaagcaccggggatcctacacccggacgttcccggagctcagcgcgttctacaactccaccacgtaccaggacgagctcctctgggcggcgagctggctctaccacgccaccggcaaccacagctacctcgcctacgccaccggcaagaacaaggacttcgccgacctgggcaacccgagatacttcagctgggacgacaagcgcgccggaaccgaggtgggtgataatgaccgtgacaccgccactgattcaactccactgttcatggcaaattttgaaatcttgggatggttatgaagtgaatttttgtggtgttttgtttgagtttcaggttcttttgtcgagggtgagcttctttgcttcgcaaggatcagacgttgcacaagacgatgttcttgggatgtacaagcagactgctgatgccgtcatgtgcattctcctgccggattcagagaccgccgctttcagaacagaaggtaaatattcacaagattcagaagcaaaaataaaaaaagcaatctcaggttcaccatttgtgtagctggtaataataataatccagtagtatttcagatagcttgcaacgatttatttcaggtggtttgctgtacgttgccgagtggaactcactccagcacccggtggcatcggcgttcctcgccgcggtttacagcgactacatgcagagctccgggaagacggagctgagctgcagcgggcagggcttctcgccggccgacctgcgcaaattcgccaagtcccaggtagtaacaagattcagaatcatccatgaaccagagttcacaattgttcagactaacatatgttcagagagaacagaaatgttcagaaatacagtacgtaacttggatgtgatcacgcactgatcagtgatctttgttcttggcaggcggattacttgctaggcagcaacccgatgaagattagttacctagtcgggtacggcgaccggtacccggagaaggtgcaccaccgcggcgcgtccatcccggaggacgtcgacaccggctgcgacggccacaagtggctggagacgtccaagcccaacccaaacgtcgccaccggcgcgctcgtcggcggtccgtacaagaacgacagcttcgtcgacgagcgcgacaacgtgatgcagaacgaggccaccacctacaacagcgccctcgtcgccggcttgctctccgccctcgtctccacctcctccctcgcgcgatccttgtcatgatctgcattgctcggattctgacggtttaccactcattagatggcatgcaaatgctggctcaaactgatgaagaaatggtagggaggatgttgtatcatggatcgaagaagtcggtgatctgtatgtgaaaagggtaattagtactgtactagtacttatacttactaacaaaaataatcattagaaactacttttgtttgttcaattggtgctcattatactatcattgaactctgaatcattttagcacattcagttctctctgttacacttaagatgttacatatatcccaagttcaattgactgaagaaaaataaaaagaacgaagcatggttggaacctgcacggtgagatgagattaacaaggaattcagcatgcaggagttctcgcacccacacaattcccagcagaagatctgaactttctaactccgaattgtgcactgcaatttatacattctgattcctcgatcaatcttcgccagcacagcaacagtagtttacatcctctgcatcctcgaccaaatgatccacatttccttaatcatacgctacactaggtaactaagaacatgcaaaaagtgaagataaccagggaggaacacaacaatttcctggttaataattgtagcaagatagcaggaatactcacacccacaattcgcagcaaaatatctcaaacattttaactccaaaattgtgcagtgcaatttatacattctgattcctcgaccaatcttcgccaacacagcaacactagtttacatcctctgcttcctcgaccaaatgatccacattttccttaatcatctgctatacactaggtacctagaatctagtagagtactcgatctcgatggtaatcaagaacacgcccccggcgacgcgctcacggcgagccggcgaagacatcggtgggcgcgagcggcggcgcgtcgagctggtagaggccaatggaggggccgacgaagcggaagaggatccaggcgccgaccatgatgaagatggaggcgtaggcgaacttgttgagccagaagaggagccccttctccccgacgtacagctcgccggccttctccgccatgctcatctcctcccactccttcctcctcgtctgcttctccctgcgcgtcgccgccgaagccgaagccgacgccgacgacttcgacgcagccggcctcgacgacgacgacgacttggatttcatggtgatccccaacggcgccggcggagtgaactcctggacgcggcgagcttggttcctcgcgcggaggcggttcttgacgccggtgggcttggcgccggaggagggaggcgtggcggactgagcgtccgtcggagcatcggccgcggtgggggaggggtcgccggatgatgcccgggggatggatgggcggcggcgatggcggaggaggaggaggaggggttgggaggggcggtgggggaggagagggagcaggaggtgctccatggcgacgatggcgaggtgaggctctggaaggaagacgatggggtttgggtggcgcgggattttcaggacgggatgatcaactgcacgagctgtggaccgtccgatggtcaattcaacggttcggattaatccactggtatggaaaatcgtaacctattttatctgatgaataaaatactttttttttcaattccaaatactacaaactagaaagtaataaaggggatttgtcctattttcatttatttttatctttcttttttcttattttacaaacttatggttatattatatctcacgacacaacttgaaaatatattccatttccattattcaaaagttacaaactagacacccgtataatgcagacatgagcgcgtacttatcactgtaaactaatataggcaataatatgcttgtggtgacttcgttaattccaatatatactgggctagtctttcaaatgtactcatacggatagatgtgcgcgtgtgcgtttaaagcggagagtgtgcaggaaggatcaaaagatcgattttcatccttaggttaggttcttcgcgcgtgttaattgtcatatgacatgttctcagttccgcttgagaaagtttctcaaaatttttcctccggttttataattcttgatgttttatataaggttgaggtaaaacttaattctagctttaactggcaataactaatatttagttagaagcgctataataacatatattgttttgtcttaaaatataatactataataaaactataaatatatttattatatatattataaaaaatatagttaatgatatattttcaagacgttatcattatctaaaagataatatgaaagcattgcatgtggatgccacaattgtaaagacatggtttggtagcaagaagaaaaagcgaaatattgtttattcatctcaatgttatgctggtttcctcacctttaacatatactccatagtagtaagttatatcctcttttttatttggagtagtttgaactaggggaattatgtttctagagttctagtacctgattagtactaagtgattagttagtttagacacgatggtcagctaaaacagcagaatttccggggttgcttgatgtgatgttagctcatgctaggttggattggcaccttctaccgaccgtgcacgttcatcatctccaaaaaagaagaacacaaaatgtcaagtcaaccaagaccagatccattaccctcataaaggacacttataaaagagtgcaaacattttatcttggaccatgtgtaaatatatctttttaataactgttttacattctatttttcagaattgtgtaaatattcaccagctctgttgtttacttgcttcaccaacataccgcctgatatatcccgtgaaaacaaaaacggtaaaacggaaattcagaaaatctttcagggcgatttgattgatgctgaccatctcacctcaaccgtcggatgcagatcgtacggccgagagagagagagagagagaggatacgatgcatcagcaacaaaaaatggtcaagaaataattccagcatcaacgagctagatactagtggtagtagtaaagcgaaagcgaacaaaaaggggaaaaaaaaaagaaaaacaagagcgctgtgtcggagaccaccgccggaccaccaccgcgacccctcgatcccggcgatcccacagcattggtcggtccccgtcgatccggccgccgtggggtttggtctggtactctctggtggtggtggtggtggtcgccgtcgtgaacgattcctttttctgcttggattttttttgttgcttttggttgttgtgatccctgtggggctcgggttccggccggtgtaggggaggggagatggatttggagtcggtcaacccggagctcgccgagatcgacggccagatcggcgacatcctccgcgcattgcagtaagctccgaatcttttccgccgtgttctgaaatccgtttctccattttttccatttcaaatttcgatcgcttcgcttgtggtttatgtgtgtttttagtagaggtaatattcattggatctcttgcttgcttgcttgctgtaatgtttgcttatgaaatgcgagcctggaaatcagactgttaacctgcaaaaaataaaaataaaatctttgtagtgtaatgcggcaaaaagacgggtttgacttagatgatagattgataattaatctgcttcatttgtccacagaaatgggttccagaagctggataagatcaaggatgccaatcgacggagcaggcaactcgaagagctcactgataagatgcgggattgcaagaggttatccattcttttcacacatattacgctgcttagtgtagaacagcatcttttgtacagaatgtgggcagttgaaaactatgattacaaatgtgtcacttggaaagagttgagatttggccatagccattgcattactgaattcagtattatacaagttctgatgctgatcagtatctccaaatgcaattgatttttgttcttttgggaaaggatggatctagcagtggcggcatacaatcatacagacatttggttgcttaattttctctgtatacatttttaggcttatcaaggactttgagcgagttgtcaaagatatggcaggaagtaccgatcctgagactgctaggatgcttcatgataggaaacagtcaatggtaccaccgcagaaccttatactatgatataattttatacattcagctttcctgagtcctcaactccctcttaacctgactcttcgtgttttgcagatcaaagaattgaactcctatgttgctttgaagaaacagtgagtttatacctatcccgtgatgtgaaaggctcatattaatggacatgaacctataaggggttgcccttgaactaataatcacttcaccaaattagtctttattataaacttgacagatactgctttggctaacattacatgatacttacatgcaaaagatcgtttggacttcagatatgcaagtgaaaataagcgagttgatctttttgatggcccaagtgttgaagatggctttggtgaagaaaatgtcctgttagcatcaagtaagtagcaactctagggcccttttaagtgcatatggaggtggtctattttttctcaggtgaaatgataagaatattctggcggatatgccatcactagcatgaatatatgcacctctttagatttaatggtcaattatttcttttgtagatatgacaaaccaacagttaatggatcaaggaaaccaactaatggatgagactgatcaagctattgcaagatctaaacaggttatctttactatgttgtgcaagatctagacaagatctaagcaacttgatatatcttcgaaagagaagtgcataatttttttatttcttattggatcaactaggcattttcttgcatttagtatcatgtaatttttctgtgttttgtccctcctataggtacaaaatgtagcttctttcagtttatatatatggcttctaactgagcttgttgcatcattttccaacttagcacgtattgatctttttttgttatttcagttcctttagcttatacaaaaactctttattagggtgtaattttaagtcttacagcaaattgatgtgctctttcccacaaactaagtcacatcattgctttctggcactgatttgttgctgacttctgcagaccgtccaagagaccatcaatgtaggtacagaaactgcagctgctctcaaatcacaggcaggatttctttgttcttctcaaaccagccaatcatgctgtgtaacctggatataccagagctaacttcggttatttcttattgaccagacagagcaaatgagcagaattgttaatgagctggattccattcatttctccattaaaaaggcatcacaaatggtgaaagaaattggtaggcaggtaagtaccctctcaacgatatctattaaaaaggcaccgataatctgtcaaccccattattgtttattcatactgttcttaaatgtaggttgcaactgatcgctgcatcatggccttgctttttctcattgttgctggagtcatagcaataatagtcgttaaggtgagtgcttagattttccatatatctgcttacctgacagttaattttggcattccattcttccactcttggaatcccttcacacaatcttaccatttcactgcttattatatatttttttaaaaaaaaacaaaaacaaaatggcgatagaagtgtgccaattaagcagttcatggccccactgtcagctatggaacagacatttccatttattctcaatataacggtgtaaggtttttagatgagatcagtcaaccatttctcgatcaatttatccttggtgaacttcccttatcatggtgtctatctccgtcctttgtggattgaacttttttgtacagttagtagtaaacaaagaggtcataaggcgagatgaggggatgagagaactacccttgcatcaatattatttttgctttggtgaacagctgttagccctcccctagtgagaagctaaaaaaaaacccagaaaggaaaaataatttttggccctcttctgggtttcttctggtcggaatattcagtttttatggtgaatggttcatgatcatagtgtttcactgcagattgtaaacccacagaacaagactatccgagacattcctggtctcgctccaccagttagcagaaggctattgagtattgtagaagacatctgaacttcatacatgtgaacaaatcaaccaagagcagcttgtgctgtttaactcgaaggtcgcaactactacttgaacatgatgcacagtgttgtaatactatacccatgggatccgtgtgcgaggtactgtaaaattgtacgagtatgttatgactctgacaagcaggtttgcttgtaagaactgtattctgtgaacattcacatatgtacacgagcatatcaatcttttttaagagtgacagcagcgtatggatcatccaataatacagcgttttttgcaaatagattacaggatatcggtgtgatatgtattatgtttttgttacgatgggtttcgattatatcgtcgtttccatacccttctcatcggattaccagatcgggtactttacacaacagatttgttagcaaagtgtagcttagttaggacgttcatttctgttttaggatttctacttgcctctccttactatgaaaactacgcataggcaacctttgtttcaaatttacataacctagattctctttaacacagcttccaatccaagatttcttagagctgagtattactagcttcacaaatacaaattcatagatctagtttgcgattagcatttggataaatcatttcactctattttagataaaatttaaaattttaaaccgctataatttaacatagaaatatcaaatctacagttgatttgatctggagctatgccatacaaggccttatctcctatatttcccgaattgtttcagcacaatattgtaggaaaatagaaaacattccaaaccattgtaaagaactgaaaagaaagtgactaggcacaagaaagctcacaacagcagtaaaattaaatcgtacctccttccaataaatcagcactaataagtagtacatcaagaaaaaacaaagaattactaacaagtgtaacaagaagagtaagttgaacatgcaaactatttctcatttattactcatctatttcctgtacaccaagtgagcacattttacagtgacaaatccatttatccattttacagtgaacatatcagcaaagaaaaaccttaactcatctgtgttctggaaaacaaaggtgcttgctaaaaatagcaccaaccgcttctggatttagccgtaagcaaaactctcacagaacttcaaatatgtttctgggactaaattaattagaaatgtactgctgtgactggacaatagtagtcagctgcttgaggttagctaatacatgcctcgggccaagactttcagcaccaatgtgattcagaagttgttcaatatcctgcaaggaaacagaaggggagggatgaccaaatgaaaaataaccatgcacaactttatcgaagttgcaagaattttgataaccaattacgtataggaattacatagctgactcagaattactcacatgaaaattccaattttaaactgctaactgcattatcgcataatgatttgttattaaaagggtgcactgatatttttgttcttcagaactatgcatgttgtcatacaacaagccaaaattttcacaagctgacacttttattactttcttatgctgtcaaattcatttgagctgatcatttatcctaattagatcaacatagcaaacacaactaatggtttcttaggaataggattctaaatcaccaacgtgaagctaactcaagggccttagaaaatattctcttagaaaatagacttacatgcgacttttcacaaataatcttcgcttgattgtagttagcctccaatttttctagtgataatgtgatatggtgatttgggaaaacaatttacagatcttcaataagagggcatcaagggaaaggcatatctttccttttgccattttactccatcatggttatagctattcatgttaatcaaacactttttcattaaataaacgcgcaacttagcaagaagaccaaccttgtttagcaaaaatattgcatatgctgatcttgttgtctcctggctttcaaaaaacagagggaattccattgttcgcatggttgtactcagaggagcagaacttatagcagaagctaaggacgatgactcaactgaaggcgcgcgatcaagaacatatgaccgtgaacctcccaaccgcagcggatatcgaagaggaacatcaagatatgatgcaataagggacactgcctatgatccaaaaatgaatgaataaaaaaacagcagtaagtaaaaagaattgcatagcgtagtgccacgtctatcactgtaaaattctaaaatgtgtatgaccagcaatattgggttatatatatgtcaaattggtctaaatgtctcttcatcctatcaatctataacagaatataacctacaaaattcagagaacttatagaaagaaactggaatcaaatttgaatgcctaaatcaatctccaatggacatatatttcagtttcaattatacatacatgtgcaacataacccaatgcggtggcagaattctgaatctcagtcttgtcactaaagtagccagtctttttcatcgtaagcttcgatagttggagacccaaaattgccaaaggtgcctgtccattttgagaaccattcggagccattgattccgcatctcctgcaaaattctgatgcattcaaatttttgacaatagtttcaagattaccatctcataccgaagaatctaaacattttgctatgggagaaaaaagtaagtgatcactccaagtcttcagcttgtttggctaaggctcatccattgtagagttgtagactagtatagttgccagaaactggaagctaaaaagtgcaaatgacttcatgtttgatgttatcaacaggtgatatctcaacaaaggtaaaattggttttctatagttatcttcacatcagagatacagccagtagcctagcaacgaaaatctaaggactacttcatgactaaccaccaatgatacttatttctaacatataatggcatgcattacaatagttcatggcagaccttaattctggttcttactactgaaaatgaaaaggggcatctcaattgttttaaaaaaaataatttaaaaatgtgtgacgacgggcctgtgtgtgcaatattgtttggacaaaattagtaatcagacaaatattctcaaagtgcttcaatgctattcaacgatagaagaaatatgaatctaatgttgcagcatcaggtgatgaagaacattgtcatcatacagagcatgtccaaataaatctgatttacatcaactacaagtgaatgttctggatagcaagattctgatgttatcaagcataggcagcattggatataaagcaggtataccaacttgacagagcttggaagttgtaacaggaaaaggtaacatactggttttgagaatactggagttcaagaagctaggcttgttagctggagatcgctcaatcaagggtctcacaggatataaatgtgctacttgtgctgtcatatattgctgtcttgtgcgcaacatcctttccacagttttaagacggacatggagaccattttcccctgacagcaatttatcagcttcctacaaaaataggttcaagaaaaattagttaaatagaaaaaggcacatcatatacagtttaaaagcacatcgtatctttcttgttctataaaccacacatttagatgtgataattcttatatcataaggaacagtcattactactaaagggcactgggacaatatggatgaagaggaggaattaagagaaaaaggagatgatacagcatttgaggagaaggattaattcattgttcttctagcttaatcataatgaatacaagagttatacctatatagaggatgaactaggatgcctaacaggaaaccaaccttaacagttgatattcaaaatgcatgtcaccaatctagccactgatccatctcctatgtggaaagtaattgtaccttaagtttatttcgcgctgtgctaagagtattgcttgttgttgacaaggttcggatcttgatgcggagttcctctcttcgatcatccacatcctcggtcattttcttagtgtgcattttcaaatcccacatgaaatcagcacgtgcttgcactctttccctgatttccgccaactcattatcctgctgaacggaagccttccttgcctgctcaaaaacacatagcaggtcatacatccatgcaaggactagtaaccgcaatacaatccatgcatccatagcatctcatgagacatgtagcatccagaatttaaccctgaactcctgattaacaataatcgtaacacgacaccaacattaagaaaagagcaccacgcagcagcacagctaacaaattatcccccagagactactactcgagaacattaaggtaaatcatcgatcgttccggttccagatcaaagttagaagacacctagggttcctactatccgcatagaatgtgaattcggaagctatagaacgcgcccagtgatccgcccattccatcaggagttataaacccaaattaatcgagcaaatacctcgagcgcggactggaggcgcgcggcgagcagcgccttgcgttccctggcggtggcgagcgcggcggagaggctccagacgcgtgcgagctcctgctgcaggtcctcccagtcgatgaccttgggcgcgtcggctcccgggacctcgctcgccggcacgaccacccaccccctccccccctcctcgtcctcctccggcgccggcgtggggtgatccgcgcacgcggacgacggcgacggcgacgaaggccccggctccatcggcggccgctgcggtcatgccagcgggcggggatccgcgcgtgagctcgccatgggcggctgctgctgctgctgcggctagggtttggtggccgcgtcgtctccgacagcggagagggagatcggcggcgactgcggatgcggggaaggtggagatggttgggaagaatggaggaatggtggatgacgtggcgtgacgtcacgtggatccatgcgtgtgaagaggccggcccagcccgggagcaccgggcccgttgaattcaaattgggccgaattttgtagcgatgcgtgtccggcccattagcaggagaaggcctaattgccatccggagatgtagacttgtccttccccggcaagcgcctcaggggtagagaccaaagtgggtcaacccacataggtcaaataaatagtaaccggtggactttcgtttcaaagtctggtttgccataccgagttgacctgaactcacttatatcaatctattttttttaaaaaaaattagctaataattaattaatcacgtattaattcatagttttgttcttcgtgtggagggtacgggtttcttttggagaacataacctaaatatattagggaaaaatggaagctgaacagataggaggaaaatattatgaagaaaaaaattgaaaggtgagccgatatggaggggaaaaaagaaaggtgaaacgattcgatgcacatatcatataaaaatatttttttctaacattaaatttaaaaagttattagagataatgaaattgcacgtaatgttcaacatgggcatattactagttagtagttaactcacccgtcaattcgtgggttacccattatttttttttaaaccccgggttacccactaaatatgtctgtaagtagattggcgggttagttcccatgcatcccagctcaagccgcaggcgtggtggtggccggcagagccatcgcggaagctgccagagtccggggggacgaccaaggcggcggccggaaatggcgtgtcaacatttcacccgtcgctgcaacgtcttctccggcaagcgtatccatcggtgacggttgagtttcaaggttctatcgttgaatcattgtatctgaagagagaattaggaaaggataatacaagaagaaattggcgatggatcgagctctgaagatgacgagagaattgtcagagttgtcaccaaactcaccacgctttgccgccgggttctacatgaaatgagtagcacaaatggcgaccgacgacagctcagggggatggtcctcgttgcaatctccacggcgaatattcttctttggttaattagtggcttattattcgccgtcttagaattaataatcacatcctgtaattaaatggccaaagacagtacagtacactagttctactgctcatgacacaagtctcaacaagtcggcaaatcttgtttgcatcgtccactccaccgtcgtctggaacgaagaccatatgccatcttctcctttgactactttcttcagcttcaattagcatcttactcactacactaatcccatcagaagaaggttctaatgcacattaaggaaaaaaaatattggatcaccaagttgttgtaggggaagaaatctagagcactgatttttaatctggttcggtggagatgtggctgtaaagtaagttcagcaggtcatggcttgatggtgacttgtctgaaaaaaatctgtttttcaggagggtttacttgtctgcttctgtaactgcaagcacttgaggttcagacgattggatcaggttgaggttccaactgattttcagatcatgtgggacttttggttgcaccatgaccatactacaaggtagactagtgagtgctattactttcgatgatattaagatgatgatgatgcggcaagtgccggctactgcaactgaactctgaacactgaaagatgaagatgtgccctgcgattacacaggagttttataggatttttcacgtgaaatcattctactttccagtgttccaaaggacccctaaggtagtacaactatgattcagacatcttttgaacaatattaggccccaaaatggtcacaatttacttagtcagatacaaataccatgtttcatttgttatccttcagcttcagctataagggttttgttttgagcttcctttacctattgttagccaaatcgaattgcataattgatttcagaaaaaaaatgaaaaagaaggtgcagaattagtgcgacgtgtggcctcgaattcttgagcgcgccaaggactgtgatgatgtgaatgaacgaaacaagcacaagactgtccacataaacaagtcaagctgccaagttgttttcgtccccgatcgacaggagaagatgacgacgatggcgagagtggcaaaaaggtcagacaaaaaaaattcaattctgctggaaggatcatcagctacatctcctaccgtttcacacctcgcgtccttggttgccgcttgttgaatcaaatccaattttccattttgtcccaagcctggtcaaaaatcagttttgcaggtaaaagatcaacatgcaccttccctttcctgtaaagaggcatgagcatattttgcacactcagcatttagattgatggcccctttgtttctcaggtagaagaaaaagcttttggtttgaccatttcaaccaccaacaaacactttgaattttgacccaaacagttattactactactgccgagtttagttccaaaatttttctttaaactttcaacttttttatcacatcaaaacttttctacacacaaacttacaacttttccgtcacatcgtttcaatttcaatcaaactttcaattttgacgtgaacacgttgaagaaagaaagatgctgatatgcagatatggagcaatgaatcaggtgaggtaagtatattcattcctccatgctatgttgattgtaacaataaatttccttattattttatgattttatcctaagaaaaaaacaattaagaacagtacactctctcttcattgatcttgttgactggtgtacagttagtgtgatggtacaagtgggagacgcggcgtgtgcgttgggatcgccgcgaacgaacgacgcggaagcgaggcgaggcgaggcgacggtacgtgtcctcttttctctctcgattgattccacgcgagtcgtcttcttcttcttcttcttcttcttctcgccccccacttgttcatggattccaaccacatgatccatatgacgtcgtcgtcttcctagttcctcctcgtgttaatttttccatgcaattttagctgtctttatcaaagctaatttgagctctctctctctctctctctctctctattctatttgtttccttgctctgctctctgaatttcttctcttcttccttctaccttcttaatttgcctctctgaatcataccatctcgtttctactccatgaacagctttagcatcttgtcactgctcactgggattaaaagtgtctccaattagtagagttcttggtcttttttttcggatgctactctccaaagatttggttcttggtgtttttaatcagcaaggaggcctcctctcaggtttaatttgctagcccatcagatatggggtgcttcgcgttcaagagcaaggccaagaaccagcgggcggcggcgtcgggggccaggtcgccggcgccgacgtcggacgggcagaagagcaaggcatcatcggcgtcgacgccgacgaggagcatccaggagctgtcggacgagaggggcgcgcagcggctgcgggtgttcgacctcgacgagctcagcagcgccaccaacggcttcagccgcgcgctcaagatcggcgagggcggcttcggctccgtctaccgcgccttcttccgctccgccgccggcggcggcggcggccgggtcgtcctcgccgtcaagcgcctcaaccagcgcagcctgcaggtcagtacagtatcagttagctgtactcccatctctcctccctctgatttgcatttgctcctctcgaaaattcgccatggtgcatttgattttggctagatttgtcaaaacgtaccgaatttgttcatcaggacgattgaatggcaaaagaagaacttgaagattttgtcttttcagcttgggcactgaccacatggctgcatgttttttcagagtttcaaaaaagaacttcgcttttactttctctagactacattcaagactcgtagcgtacaatcttcacagaagattcagaaagacggcatgcacttaaatatatatttttcggattcacacattttggtatgctaacactacagatttactactgctgaaaatgttcttcaaccagcaatagttaccaacaagcgatcctgatttggatttggatcgagacctaaaatcaaactcaggatattgttcttttgcaccgaaatcatatgaaattcttagcctcgtgacaattccaacaaatagataaacacatcccgtaggacaaggacacccacacatgtcaacttcaaccacagatcacacaccaaaccacgtgaacaatggtccggacagcatcccaagtcaacctactaaattccagaattcagaatcacgttataaacaacgtaccaagcttaatcacgccaaaacttgatgccagattgccagtgcataggacaaaatccatgcaattttcaattgttaaatcaaagattgcatttttttttaaatatcaacagattgaaagttatgtttttctttttttttctgatttcaggggcacaagcaatggctggctgaggtccaattcctaggtgttcttgagcacccgaatctagtgaggcttgttggctattgtgcagtggattcagaaacaagcaagcacaggctgctggtctacgagttcatgcccaacaagagcctagatgatcatctgttcaaccgagctcatcctcccctctcgtggagattgaggctgcagatcatgatcggcgccgcgcggggcctagactacctccatgaaggcctgcaagaagttcaggtgccctccaaagcattgtcctcctctctgaatccataaaactcaaaatatagatgcctcacaggatacattgtctgaattctgaaactctgaactgaaccattagtttagcacctgcggtagctagtagtaagccttgtcctatctgaattctttaatgttcaagtatgatatgatcaatctggcatcttcccaatatctgaattttgaactctgaaactctgagctggaccattagtttagcacctgtagcagctagtagtaagcattgtcctatctgaattctttattgttcaagaatgatatgatcaatctggtatctgtcccaatatctgaattctgaactctgaaactcttaactgaaccattagtttagcatctgtagtattgctactagtaagcattgtcctatctgaattctgttaggttcaagaacgatatgatcaatctgaaatctgtgccaaatatctgaattctgatccgtagtttcttagtctggcaggtgatatacagggatttcaaggcagccaatgttcttcttgatgccgatttcaagccaaaactttcagactttgggctagcaagagaggggccaactgaaggaaagacacacgtctccaccgcggtaagtgtaaaatccattgcgaacaatcaattcatcccatccgatccatgagcccgagtgatgatgatgatgatggcgatctcgccggcggcgatcaggtggtggggacgcacgggtacgcggcgccggactacatcgagacggggcacctgacgaccaagagcgacgtgtggagcttcggcgtggtgctgtacgagatcctgacggggcggcggtcgctggagcggagccggccggcggaggagcagaagctgctggggtgggtgcgccgccacccgccggagagccagagcttccggtcgatcatggacccgcggctgggcggccggtacccggcggcggcggcgcggcaggtggcgcggctggccgaccgctgcctcgtcaagaaccccaaggagcggccggcgatgagggaggtcgtcgaggagctcgagagggtgctccagatggagccaccgacgacgacggcggccgacaaggacggcgaccgccgcctgccgccggcgaagaggtgacgtcagatcagtcaccggaggaggctgcggtcaacgacggtcaaccagtgcgtgaggaacaaattgtggagagatcgatcattgattcatttgtattgtagagagagatgatgatcaatgcgaataatttggagcatgcaaagtgtttcgattgcacaagatttcccagtttgctgcaagatataatcttacagttctgtagagttcttatgaaaaacctataaatctacgtaaaccgtgtgaaattcgtgcaaaccatgtgaaattcatgcgaacttgaggggaagtgggaacattcgtttctacgcacacttttgaactttagggaaagtaggaacatataatgcatagtaattcgtttctaggacacttttgaacttcagggtgttttttagaaagcttttctcaaaaacttgaataaaaaaatttccccgaaaaaaaaagaaaaaaaaggtaatcccaatcctgtggagaggttgggccggccgacggcccaaatcgcaatggcaaaccgatcggcccaacacatggtctccccgtgggccttaaccccaaaagcaagcaaacccccctcgccggcgaccgcctccctgggaaaccgacgcatccgccgccgccgccgcccggctccctcccgcgcttcgccgcttcagctcctctcgtgccagcgatgccgccggcgaagaagatcacgctcctgcagacggtggcgttcgccggagtcttctccgccgtctcctgctggtaccgtgattgatctgtatactatcccgtcgtcgccaaaatctgcgtcccgtaggttagcagcgtcttagatttcattccacccctctttcgccgctgcaggtatggattcatgtttgggagggagtctgcgcggcgtgagcttggtggaatcattgaagacctccgcagcagcggcggcagtggctgctccaccaactccgcggcttcccccgattctgacgctcattccaaaccctagctcggtatgctgctttttttcttttgagtaaatttcataaaactacatgttttatgattcaagtcgcagaaaaccacgcatattttgacacttggcacttaagtacatatattttggtagtttagtttcacaaaactacactatcgatgaatagattcacccgtgagatgacgtggttgttccatctagaatgaggacgtggcatctcattaatttcgcgcgatggctggtaatagaatgccatgtcctcgtcctaggtgaaacagccacatcatctcgcacgtgaatccatttatcgatagtgtagttttgtgaaactacacaaccaaaatatatgtactcaagtgccaagtgttaaaatgtgtgtggtttttttttgtaacttgaaccacaaaacgtgtagttttacgaaatttactcttttcttttcttttcctcgagattcaagagtatggatatgcctaaatgtgctcagatttttcggagtgatctgctagtaatgtcaggggtgatctgtgcatcactctttgggatagggtatttgagttttagtttttttgtataatgcctacatagctctactaagacacatatatggactgcaataacaaggtgtagatgcagtaggatctaggttttggttcattcatgcttgctgccttttgtgggtgcgtactgagtagtgagcctaaccaattttttgctcttaatttagcaatatgtttaggatgaaactacaactttacatggtaacattttgaactgggacctaagggcttgaaaattaagtttgggataatggcattgtgatggacaagcatgggaatataactacatacaaattaggatctaggagaagaagttcaatcaagttgggttttgatatgtgtgttcttgcggccaataggacctcaaaaactgaaaaaactcagacttgtaagaacaattgcttggtaattagatctaaggtttgcttgtggttatgattattagggtggtaatttgtatgacttctaaaaatcactaaggatatttgatgttcatcatgttaggttagggttactccagcttattcaacataatattttgcttccataagtgatgcagattaataaagagtaaagactgctagagtttacagaaagactaatttggtcacttttttatgtttacgaatcctgtttcacaatatccagaacaagaatgtatgttcatcataaatgactaggtgagatatcagaggagatttttagggaggaactctgttaaagatttaaccaagtgaacttctgttatcctgtttagtaggtttctgttttaccatggctgttcttcaaatgcctgaaaacaagttatgatttaagggattttaggcttctctatttgtccacaaatctaagggattttagagtactactttctcaatccatccaaccactgcatttattgctcaccagtagtttcatccttaggcgtgatctttcccaatcaagtaaactcctagaggcatcgaagtaattccacctcaaccttaaactctgctaaacaacctagaatccatctgtccatggctgcctacacaagcaagaataattttagtatgaacaagccatccataggtcgagagatatcttgtaagtacctgcaatcttttttctgttctatgggctgtacccttttaaatacagatcttgtcttcaggacaataatttgatcttactcagtttcttgtgtagctagtggagcttgggaattttgttctgattcatgctctgtgtaccttttgtcatctttcttgctgaagtgttttcctatgtgcttgcttgagcttgccagttggacttgtatgttgtaattgccacagcccacatgctaaagcctttagagatataagttgccactgttatgatttggaccattgagtgcagatcaaaccggcatggttagcggcttatcaactagtaggttacagccttacaggaatatatactatgttcccatggcccatgttaaaaggaccttttagtctttctagtgagctacagctgccttatagaaattcctgctttggaacttggcctttggttaggaaatggactagaatcagggaccgaagcatctagttgcttgttcatttagatctctgaacttatttgaaaattctagaaaaattgaccatgttgtggcaatcctagccacagaaatccaatttgccttatgttccttggataatttcatgattatacaccattttgaacaaattaaaacagctgaacagtgctgaaattttctgctctggataaacatatcagttcttatctacatcgttttctcttggattagaaaggagcttgactgggccagaattggatgggttggtactgaatagagcaatcttgtgttacctttttatcttttcccttttggttttggcctcataatcctaaaagcgcatgattgtgtcctgctctgctgttattgtttcattgttcatctgttatatatcaacatgtgtaccactaccacattaccatatagtttgaaaaatcttctagctaacacgattctctcatgctttcttcatacctctcttttagcatacactaagaactggagttctgttgtcaacacacacatgattaaagactgagagatatatgtaagttagagaaactacaggcagtaagtaacctagttaaatctgattacagagaacgcgtgatactttctgaaacttctagttcttctgcacagtgctacagaatcctagaatgggactaccaccaatgaagaaccctcaaatgtccctctcttgaggtgataacaaggccaaccagagataaccacttcataagaaaaggtttgaataaagaggacatagctatcagtagaggaatctcttgctctttaatctctctctttctctctctctctctctccctattgatgtgcactttcagtcctctccttttcaagcacttgatacaaccttgataggctctcttgtccttctcatggtggtgagctcatgtcaggatgggcccttgactttgctcttttcttgcagtcacactacatcttttggaataatctccagtgccgtggcactatgcagaattcgcatatgtcactaaatataaattgtcaatggcccatcgatttgtgatctagctctgaagcatccatgagaccatgacgcattccgtaaccttgtttagttgtatctgcttctgggacttccagtaaatatatggtttcttctcctttcttttgtgtgtgtttgttgagagttcattgtcttcactcattggctactaggatgtcttgaattagactattttggattatgcataagattaatcagttgcccccagaaaaaaaagagagtacaaaatgggtgtgccacttacctattattttgctgctaatttgtgcatggaattctctagtcaaaacccaaaagtgcaactgggcaagtaataggatcatgaacgtgtgttagttttgttccattatctcttccggcacaatgatttattgtgttgactgccaaaacactggaaaattactctcctaggatttctttggaaaaaaccaaaatgacgtgctaaatagtctaactgatggataaaacatgatgtcaaagggaagaaaaaaagtgcaattagctagataagacatcaactctacctctgcccatgttattgattgctctaggcgatgggacgtaaagtgtcctctctgttttagttttttttggaacatgcaagtcgtgatcatgaaatggctggttggaacatgcaagattgctctctgcttaatcagtttgctgcaaaatgaaggcaacatgatgcgtatatacgcaactttggtatctcgtaccaatagtaccttgattgcagaaatatcttggtgcgatgatgagtcatgggaaagtaaggacataaaacactggcaaattggatgtgaagtccgggagagaacatgactgtagagtggagactagtcttccaacataagccttagaaaaagtgaccaagttgtacgatagttctatgataaagttagttggcatcgcccggacttgaaggccaagtgtactgtgccatctccatccttagtttgttgcataataatcgtacttaagttgatcaagaaatgaaaagtgagaagagcaagaacttaaggaaaacaagagcaatcttgatctcataatctctcgtagcatacaaaatttaagttgatgatttgtagtagtatgtacaaaacgaatagtacatgcaagttaggagttgctcctggtaacatgcatggatgaaacagtctctatgatctgcacacatatcgatcagaccacgtccaagattacaagttgttcatacaacatgtccagttattcatctgataatctctcaccgtagctgttgctgcaattaagtggtaatttcatatccctgcagatctctcttccatctatctgaatatctcttgtgtagaagagaaattaacaaaccctgcatatgtatatgcaactatgcaagatctgatcccaaaatctaattaacaatttaccaatccatggccgtagctagcctcaactgatcacacatggaaccgtgtgaaaaccacaaaacaaacaaaatgaagatggcaaaaaaacacggatctatgtaatattccatggatctacaactacctaggctacatacatatatatatgccaatccacactgtttaatttaactttggcgtttgatgatgatgagcgatgcgtgcatgcatgcagttgatcatgaacgcagcggcagattcatctctcgaccatgttagtataggagtacacaacactagctggtggcggccactggagtgcgtgccgcgaagttggcgatggtcggccggcggtgcatcatcggagacctcgccggcgccgccgctgctgcctcggcggaagccggcgccgccgacgaacggaggcgatggcggcgcgccaccgcctgcagcgcctcgtccatgtccatctgctcctgcctgcagtcgtcgctgcagaacgctgcatcccctctacacatgcaaattaatcaagatcaattccttgttgaactttgaacacacaaaatttctgtgaaatttattaaggatatatatcaattgatttgcgaactgaattacctgtacatgaagatgtcgcggtcgccggcgatgctgctcttgcagaggaagcacgactcgaggaagtggagacggcggccgccgccgccgccgccggcaccgggcttcacgcggtagaacctcgacgccacctccacatacctctcctcctcctccatcgccggcggcgagccaccaccggcgatctcttccatctctaatcaactgcacgtcgtagctaatcaaccatgcaaccagctctagctagcttattaatttagctagctagacatggtgatctcttcctgtcttgtatcgatcgaacttgcacatatgtgtgtgtgtgtcagtgtattaaatcgttaatggtcctctcctggtagctagcgagtttgttggcagatggaggccaaatgcaatgaaagatgtgtgcatatatatgggtatatatgagcattttgtttggcacatagctgattcgagggccgaaggtttgagagaaaaccgtgggtggagtagcaaatgggcccttggaacctattggctggggctggatgtgtgcgagtgaccttggcctaggggggactaacctactctgcaactgcacccaacttgcagaaatatcatttatatatgtattcatataaatatcacaacatcaattaataatgcaaaagtaatcactctcctgtgcgtggaaaatggaaccagattactgattagcagtgttattaaagtattttctgggtcagtcatgcgagctctgcaggtgcttaacgacaaattaagcttttataaactctgcctttgatccttgcgatagaaaaatgttttgtaccacatcggccagcgaggcggcatgggcacggcatatagccgttctcatgcggcatccgtttgtacgaccagggcccatcaccatctctcgctgcatttacagtttttttgggccaaatgtagtgatccatcttttggcccatataattcaacaaagagaggcccatgtgattccactgccccatgagaagcgctgcgcgatgcattcgcagatttgggccgtaagttgggccacggctatcattttgggccaaatttggatcgcagaccagaccattggtagcgatcgcattttgggccagatttgggttagtatgttttgggctccaatttcaatttcgatttgaattgcaatttcgattttactatagttaaaacttcgtcatatgtaaatatatatagcatcattgtaattacacggtaactttcatataatttaatccgttaaatcgtagattcattttaagattcgtgcaagcgagaaaggaaaaaaaaatcatagtgtccgtacgtacgggtgagggctgctcgcttcatgaaaatagtgggtttgccgtacaatttttaaaagctacatataagtacgttatatgcaatttataatacaattacattataattatagactatattttacatctataaaatttttaaagaaaattttgtccacacatatacaggtagcgtgtgacgtgtgcgtctccgactcctccggccggtccatcgcatcacagccacacatcacgccgtagtaggattagccaagccaagcgataagccactcatttcgtcgccgtgtcccgcgtggctcgccgccatggacgccgccgtctccctccacctccacggggcgctcccgctccccgcctcgcgcgcgctccaccatctcaacccggcctcctccgccgccgccgccgcctcggccaagcagcatcagcagccgcgcgcgcgcctagctgtcacgaccgcgcggcccagcagcaggacacgcgcgcgcgccgcggcggcgtcggcgccgccagttccccctgtcgttcatcagcagcaccgcctgtcgtccagccgcgcggcgacggggtacgcggcggcgctggccgacgcgtcgctccgagccgggacgctggccagtgccgcccgccacgcgcgcgcgctgctcgtctcggacgccgccgccgccgtcgacgttgctgaggattcgcgggtggtcgcgctggtgaggatgctcgtcggcaagggcaaggccgccatggtcgccgacgtcatggccgagttcgtcgccatctgcgaccgcctcctcctcctccccgcgcgcccccacgccgccacctcttactaaagaattacattactctgtcagactctgctacgctgcaattaaacctcgcatgttcagaattgctgcttgttcattgcaacacttgcatattgccaattcatttctcagtaaaatatcagcttaaatctctactcttttttttttgtcgggccatacatgctacgtcccaaaatatagtaatctaggatcggattggatatatctcaatgctacgaattctagattgatgtattttagaacgaatggagtaatttacataatgttattcctgaatcatcatacatcatgtaccatgaccttcaattctaaatactacctccgttccaaaataaatacagccgtggatatttgtgcccaacgtttgaccgtccgtcttatttgaaaaatttgtgaaaaaattgaaaatatttagtcacacgtaaaatattattcacgttttatcatctaatagcaataaaaatactaattataaaaaattttcaaataagacgaacggtcaaatgttgaatgtgaatagtgcataactgcacttattttgggacggagagagtatgttgtactgtggttctgcagttcttctgctgcaaaaccgctgccaacctctaaataattcagggaccttgatctttattgcacagaaaaaatttgaagctagcaagctgtttcatctgtcacagccttggggtttataaatgagttcacataataaaaaggacaatcatatattggtttggatgatgcactagccacattatgcataatgccaaactcataattctcaatagaataattgagtcataaagttgtggttgtgcaaccaactgaaacaggaaagcagaggaacgtgagacgccatgggagattgacactgccgcagcgtgatggaaggtacgtagtagcagttgagaacctgtactgtatattaattgagcagttgaatgatgttaacgcacacgtaatccatctctgcaatgtactacatattgattgagcagttgagctataagaatatatatatacagtagcgtagcatgagctgcatatccctgatttcattggattaacttttgtgcttctgtaagacttgacaaatggagtatcttttagttgtatacatacgctgctcatacactattgatcctatgaaaactgacataaggcatgattcatgaagcacattacaagcactaattgatggatatatgtatgtacgcgagtgcaagttcatgaaaggaacgatcaatcttgaaagagtaacagcagtgctccctttgcttgtgacacactactagcttagctattagcacgtactcaggtactctacaaatgaatgatgaaagggagagtacatatatacaggagcaagagagccacaacctgtctaccattagtaattagtaattaacccccatgactgacagccaacaggaactgatcttttcaatcttgttaagttaattgatttgccgcctccgatcgaatccattaagaaattaatggaaagacaatatacatccacagtaggagcaagatcaaccactctcctctacatctccaatctccatacgccagcatcttaattactctacaataatcaatcaatatcaacgcatgcataccgcatacgtgatctcagaagaaaggtacagctccatataagcacacaatacctcgctcagctgtgcatagtttgcatattttgatcaatcaatcaagctaagcaagctagtgattagtccattgatagatatcgatggaggaggaggattatgtgttcaaggtggtggtgatcggggactcggcggtggggaagacgcagctgctggggcggttcacaaaggacgagttcttcatcgactccaagtcgaccatcggcatcgagttccagacgcggacggtggagatcggcgggaagcgggtgaaggcccagatctgggacaccgcggggcaggagaggtaccgcgccgtcaccagcgcctactaccgcggcgccctcggcgccatgctcgtctacgacgtcaccagccgccggagcttccaccacgccgcccgctggctccacgacctccgcgcccacgccgacaactccatcgtcgtcatgctcatcggcaacaaggccgacctctcccacgcccgcgccgtcgccgccgacgaggccgccgccttcgccgaggaccagggcctcttcttctccgaggcgtcggcgctcagcggggacaacgtcgaggaggccttcctcggcctcctccgggagatccatgccatcgtctcgcggaggtcgctgctggagatggacggcatcaacggcgacgccgccgccaacgccaacgccgcgctcatgctcaggggcaccaagctctcgctctccgacgagctctccatcatggagaccagcgccatcaagagagtgagcaggtgctcatgctcttaattacttactttagacgtcatcggctcatcgccatcgagagagtactcatgctcttgacatcatcatcatcatcgcaagttcataatatacatggatgacagatcttactgcagaagctgagacatcttggtttccaagacacataattgaagggaaaagtatatattaattcagctcttgggtgacaagcaagcgttagtttcatctcatcgtgtatctatttcaagtcacagcagagtgctccgacaaaaaaacaagattgtttgtaaaccatgcaagcgggcctttcttttcttcgttatgtatagagtctaccctaaagtagtttaattaaattaaaatacaaggtgatgataacaaatttcacagaaccatagaatcctgactcgggccatataattctgaatttaacttataacatcagtgcaaagcattgccagctgccattaacttcaaaaaccagcgcagcctcgcgacgctaaatgaatccatacaaaccctgaatcttgcaagctgcattagaaaacctaacgatatcgaggtaatgcctgcgcttactcctttggattttcatgagatctagcaaaaggattagattaaggtgaagatggctcttgcggttccgactgactgttctgaactattcgagacatcagcttagatatctcaaaaattgcgctctgtacctgatcgtcttctgaatcagagggccgaatccacaccggtgactgcaaccccgtagatgttccattcgcggcccttttcccctttctagacgttgataaagctttctccagatccgattgcctcaagggtcttggtttctgaaccagcaatcaggaggcaagatagtcagaaccaacatgtaatgggcaataatcaatctgatgttgtttcagttattactgtatcattaaagtccaactagaaactgtaaatgaaatttgaccatgaaatccaattaaacagaatcagcggctatgctggcacaagtggattcatgcatgaggtttgccgttcgcaaggtcaactggtgtagacaaacattacccaaaggaagtaataatgaactaattaatggtggtagtaatactaaaaaaaatcagcagtgaacacagtaagcaacaagaaggaatgaatactcacatctgcttttcgcccatctttctcattgttcaacagctccctgatagggtagaatgctgcttgcttgcacagttctagaatgtctgatccagtaaatccctcgcatagaccggcgatgtaatcgtaattaatgttaggctcgacattttctcccttcaatacaaccctaagtatcttgcttctttcactctgaacaggaatcccaatttcaaatatctgagtaaagcgcctgaggatagcctcatctagctcagagggtctgttagtagcagcaaggaccataacacgggcattttctgcaaagccatataaataaatcataagatgttgcacaggagtaaccaggaaacttgtttgctagttacaaaataagttgctccctatgtttgaagagactatgtctggcaccctaaataataagacatgatcaaaacaaattacgacagttgatacatcgatttctatttcttgagagagaagccatgtgacggtccgtgtattgtaaaaaaaaaatcgttttctcatgtccagcttagacataattagttatttcaagaaaaaaacaaaagctaaaaagattggaaaaaggtccaactcaattaatttcgttgaagtttatatgtgttgatttcaccaatttgacattatattcagattgcatggtaactctatacactaacggtctgccactttgggtgcatggttatcacaagcaattgatcagattacaacaatgcccataatagcagggatatgtggtaactggaataattattagtactaacttccagttcgaaattctaaattgtaacaattgtttccccttatgaaccactgccacctgtgcctgcaggcagcgattttcaaactttcttataaaaaatcaccccaattaacaatattgtgcacaatacatcattgtatgtttgtaagataacctatctaacaattaacttacataacttacatatgtttgaactaatgtgcaaggtttaagaagaatattctgtgctgaatgccaacaatgaaatatgaatttgttcagacttcaacgtaacaaagcattaagcatgttgatattctaacataagaaaacttgagcataaaattgaaggttatgagagataaatttatatataggttggaaatgggctcaagtttgatacaacacggaagtaaagctttggacagcactgtttagcaagaatccatatgcgatgcaagaaacccgaactaaatagcatatcgatgtcacaatgcacagtggaatgtcatgcggcatcataagcgagctgcatagtgcacttgtgtgttgcaacatactttttctcttaggtaatggagcacactgaacagtattccagactatacatggtctttttgatatatcttatatctactaatataaaaatcgaatgtagatataagtccgcgttgtggggaatcaggggcatattgagagaacgagtaacatggaattctagaaccaaccctcgtggccgccaacccaaatattcaaagtggcaaaggtatatcattacataataaagagaataggatatttgcatagttactagcaatttggacatggaatatgttcatgtataagtttgaagcagagtgtgtacttacgatcagtggtgaagccatcccagagggacatgaactcagtcttcatattagtcatagcttcgtggtccgttgtccgtcgctggcccaagaaactatcgacctcgtcgataaagataatagccggctgcagcttgtgtgcgagactaaatacagcagacactgcaagatgtttcataaatcagcagcgataacaacaaacaaatgaaaaggagcggcagttaaaccgaaggatttgcgcgcggagctgaccgagcttctgggcgtcgccgaaccacttgctcatgaggttggaaatcctgacattgatgaagacggcgcctgactccttggcgatggccttggcgagcatggtcttgccggtgccgggggggccgtagaggaggacgcccttctgcgggctgaggagcttgccgaaggtgaagagctcggggcggcggagggggaggatgacgagctcgtagagcgcctgcttgacgtggtcgaggccgccgatggaatcgaactcgacgtcgatgtggtcggggttgatgacatcgcaagcaatcacatcctagggtagagtgagattgcataggtgagagaggagaaccctagaatcgaatcgatggattggggattgggggtggaaacaatcgaacctcgtagggggtggtggagacgagggggcggccgaggcgcttggcgatctccttcttgtgctggagggccttctgggaggcggcgcggttggggtcgagctggcggaggccggcgaagaggacgaggcagctgagggcggcgctggcggcgtagagcaccagctcctgcacgaaccgcgacgactccgacgacctcatccaatccaatccaacccaatccaatccaatctgcgggcggcggccggcggcgagggagggaggagggagaggttctccccccacacaccggatggatctgcggccgccggagccggagcgggaggaggggaatcgatgggatgggaaaagaggaaaaggaagaggaagagacgaagggggattagtcggtttatcgggaaggcgtcttggggaaggggtttgtgttgcctttgcctctcctccgatgcttctggtctctcgtctgtttgccgcccctcaaccttcacggaaacgagtcgccttgggccattggattggattacgattacacctgtccttttttttctcgaaggaagatcacacttggtctcttattccgtggtagattaatagttaattaattgtatgtatccttttttttatcagaaatacaacaaaatggtagtactccctccatccacaaaagttacacctatttcacatttgatttttttttcaaataagttgttcctatttgtagtctttatgcattcaagacttaaatgaagagataaattaaatgttttattagaacccaaggagtcatctaaatacttattagttgcatgcttgtattcactccttaattttgtaacattcaaggtgatttaatttctccttagtcttggtgttaaaagtaatatgtgtaacttttgtggatggaaggagtattacaattcaacgagacaacttacatcatattgaatctgatatctatatggtatcatatttggtatcgaatgtattagatcggtatctacgatatcgtgctgacatcaactattccgttacaaaccgttctgaagtctttctcttattttatacttctattttatgaataggacagtcaaaagtttagactcgtagtattatatgcatatataatagtctattcaagtatttttgtacatttactatatattttaggagaatagagtattatgtccttactaatactactctcatgtaacataatagaggtgtgcagagtatattttgtttgtggtcttataaaaatttggcaaggataaaacttgaaaattatgctcccaagttcagattttctacaggaataacatcagttcgagcgattttgaagggagaaaaaaaaatacagtgtcagagatgacactgggccggccgacgacaaagatgcagatgtgctccacgtcggcccaatatggccgtacaaccgaataaacagaggcccatgtccgctcacgccatctccaggacatcccgatgggctgattgggccgtttgatctccaactgcaccggcctagccagcaacggcccattaaacgccaagcataatcagccgtacagcatatgctgcatctgtgtggcgtgtaacattggagaactaggaacataaagctcatgctactgccatagcaataagtagcatgatagagcagcatatacattttctggacaggaacgaaaagaacaacaaaaacagaatcctaagttagttaggactcccttcgtcccattttaagtttatccataattattttccgtgtataactttgaccgtccgtcttatttattttttttaaaaaaaatttagaaaaacataagtcacatataaagtactattcatattttattatctcataacaacaaaaatactaactataatttttttaaaataagatggatgattaaagttgggcacggaaagttgcacttaaaatgtgacgaagggagtagtacaaatttcccatatatatatatatctagctactgcctagctagtagcttattcgatatgcgattattggtctacttaattaattggtccagtacaatgctgatcgaattgaattgaacttttaaccacaaaccgttatggaatcatataatcattcaagctagctatagctagagtacatatgacattactgatcgcgtactgcattcgatactcgcgaagacgaagaagaagaaaagagaggaaatcatcatcttgccaattggtcgatcgagaataaaaacggacagacgcccagacaggccatgcaatgcgacatgcactctccaaaaaagcagttcgatgtcatgtatgtaaggacaaacagctagcagaccaggggaagaaccccatcatttgcgtccatctagctagctaaccctttgattgccagccagccaattaactgcctagctcttgatttcttgagaaaataaacaccatcaattaatattaattgttgctttctgaaaacaggttttgctgctttctgaaaacatgttttgttttgcatgcatgtatgtaatgatcattaattgcaatattaattccacgctctctcttctgaaagaaagaaaaacaagaatgtcacattttcagtaaaggaattcgctatacacgatatatagactgaaagtctctgaaacccaactcctgctgagaactgaagaattaaactactgtttaattaatttatcgcggattttaatagggcgtaggattgcaacctctctgatatagtacacgtctgtgatcgatctatttcagggtctttgcattccttttgagacgaagctagcgcatgcagctgaaacattgctaaactgaaaaggaattgtcaagtcagccagcagagcatatataatgcccgtttttttttcctgaggtactagtatcaagcgatgcatgcgttcgtgatgcggcgaaagcaagaatctggtgccgaatggagtacagattctactccattatgatcatacacagcctcctgcatgcaagaaattcacctgtaaccatccatgcactgagtctgatcgatgcatacatttcaggcaaattaaagtgtggcagcagcagcagcagcacgtagcagcatgcatggcatccagtgcaagggaagaaggagatcgatggacgagtgactcgtgagagcagctggcctagctctgaatgaatatactactgtatatatctgcagcatgctgccatgagaggagatagctagctctgaaacgaatatatttatctgcacacatatcagtatatatatatgctcgtgtgtgagcagtgcaaggtatggcagtttggcatcagagcgagcttggcatctgcatcaggggggctgcgtcgcatgcgttgaagtggcaatggcgccgcggccagctcgccggccggccagccggcgcagcagcgcaggcatggggcttcgtcctgcgtcgtggtcacatccatcaacttatcgatcgatcagtctctctgacggaaaaacaaatttgctttgcatttgccattgcgtattcccgtttctctgcatctgcatgcctcgtccgagaagaaagcgatagagattgcgctttactactccatgtgtgtgtcttctctccttttggtccacgaaaccacgaatatatttctggagtacaaaagaaaaaacatgagaaaaattggcagtaagatcatgcaatacccggccaggccaggccatggccatggcgtcctgcccctcctcgtcctgtcttttactgcttcgtcttctttccaaccaggcacaggcccagccggcccccccccccccccccccaaacacacccaaatactcttctctttctctctctctctctctctctctctctctctctctctctctctcaatcatgtccttcatcataaactctgcatttaaacttgtgtctcaactctgaagaaacagtagagggatggatgaaaagctagagaaatggatgaaaagaaaaggctgcactaactttctcaagtgtatagtatgtgagtcatgggtgcatgttccctctctcttgctagctgctgccatggatggacctcatggtgatcttttttcctctgaaacctttttcttggcctgtctgacagggtgggggtcaggcatggggttagagcttgaaaatgtgcactgattacatatagcctttttctctaggattaggaaaggtttatatgtgtagactgtagagtagagatgccttttttgaatcttgaccatcgattgcgtggcggtcagcaatcatccatcccccaaacaaatgaccacaagcttctaagctagctaatcctatggttgatgcaaacaggcgatagtgataacatttctttcttggcttttcttaattacaagtggtatacatactcaagattagtctcaagtaagtgctccattcatggagttttataagacatatatattttaatcgtagaaagtcattctttattgattttcaccaataattcgtcgaattgtaaagtacatttactttataaaaactatgctggtagattcatatttcaaaatactttcacaaatttggctctaaagctattaggagaacattttatgaaaaattaaaaccaaatcttgatgttgaagactttttaaaaataaaatgtttcttatagttaaaaatcaagaaaccaccattgatcatgtgggcaaaggtatatatccatgcatcatatatctcgtgtatgtttgaaagtgatgatggatgatgaactatagatgaaattaagtgtttcacaattattcgagggctcaaacgaacgaatggaagattagaaagccaacaagttatttttttaaaaaaaatctaagaaatattgttaaagaaaaaaattgcaaaaaaaaatcacactgtttaattatttggagctaggaagcatgcacatgataatctagtggtataatcagaaaagaatagggtcatatatagtgttgacaaatctctttaattgtgttattgagggagttctagttcctacaaaatccatatgagaaatccaatttcagacatgcctaattaataattccatcagttgtaaatttcaacacattaggtttgtaaataatggaatagtagacaagagaagagaaagtagaatggaaaatgcatggatggtaggccggcttgggggtgggtaggtgaagatagcaattcttgtgggcagaggtccactctaactgccccaattaaaagaccattgatcccctcctccccaagcagccacagacacagccaccacactagctttggacacctctacctagctccatctgcaaccatatgcatctccaccctctccatttggaaccagaaaaccatggcttctcctgcatgctcactactcatccctacacagaaagctctagctgctgctagtttcattctagtaatgatacaaatatcaagagaaaaagtgagagtcaaatagaggtgtgaggtgaggaagatgctgcaggtagaagaagctgagagaaagatatgatcaagcaagcaagcaagcaagcaaaagttatctagctaaagagggagccttttcattttgaggggaatgttgtctggctcggggctacttttaatttctctctcttttgatatcttcttttctcgatctcctagcttgatcttttgatctctcaaatcgatcttaagaaaaagatcagtcaaagagatgagagtagatgtctgtagatctcggaccaggcttcattccccccaaacagaagggctcccatgcatatcgatcatgagctagcttattaccccctgcttttgcctcttccaaatctgatgaactgggtaagttaactgaatattgcttaactaatcagctttttgtttcatctgatggatagataggaggagtagatcttggtggcatgaactgcatgagatgcagattggtgtaatgatggggggaaagactgcatgactgtacaattgcacacttatcagagctacttgggatctcttctcttctcttctctctctgcaataattagcctttgatgagatgaagggtgatgaggaaaaggctgtcatcattaaaggcctttgttccatgcagatcctatccttcatggttggaactagctagtctgtattcatcaggtacaaataccttgcttaatctttcttctttcatatgtatgttcatctgatctttacctttgcttgggtatcacaactcttagctagcttgactgatctaaaaaatgcttttttttttatagtttttggtgatctatttttcatcttcgtttttcttcatgttctaccttgcctggtaggataatgaaacatgaagtacatatatcatgctctgtagtacactccgggagaaatatatggatatttacttcctgttaatttgttgcttggagtagatctagagagaaaaaccaactctttgcactgtgcgtggattctttacctttttctccttcaatttttgtctctctccaaataatgttgcattgggacatattaatttgattccagtttaagggaattaataggtagctagcagatttccatttatactttggtcactgaggttaattaattaattgcctataaattgttccgataactgattcacactgttcaagagaaaaggcaagctagattcatattcttcagagtaatgctccggtgcaatctacttgcagtattctactccaagtagaataatcttgaccgtttattttaaagagcaggtaagtaatctcctaatatcgtttaggggtaattttggcatgggatgttttcttctgttcgcatcgtatcaggtctgaactccgttgcacgcagtcacctcgctattcctcccccggcctagccgccttgtccgccccctccgtcgccatccgtattccccgccgtcgccgccttgtccgcttcctcagtcgcatcgtccgtctgggagcggacgagtgtggtggcgtccgagcaagtgacgatcttgagcaggagttctggcggtagtaaaaattccagcctaggcttcggcggcagcgtcacgcacgcacgcaatgtcatttgcttggcagcgtcgtctcggctcattcgtcttcttgccgtttccgatcactgtgttgtttcatggattacatggatcgattaagatcttgcacgaccaactccgacgaggatgacatggtgatcgatctatggatcggaaaacaataataccccttcgcgaattatttttcctagacaaaaacacccctccacatttcacttccactaattctggtaggagtaaaactagatcttaaccctacaattaaatatgatcaagggcctagattactttttactccgagtagaaagcaccagagtaggactctattcttcattcatggtcaaatcatgacaagggtttgagatcagcagagcagatatatctttattaatttttggtggtaactatatataatttcagctaaaccggccaagtagttaattactgtgcctttttttttctcttctgtttactttatgatccagtagctaccataaatgctgtagaaagaatatactgcaaagggcacgtagatttttaccttctaataaatgaaatggaactgcgggaaactattctaaactctcgagtggatgtcttctcgttgtgcatatatacgagatcatgatcttaccaaacaataacaagttcatatataagatgtgcatttctatgacaatatatatactacatattgattttttatattaatttgcaagctacattcatgctgatcatgatgatgagatttaattttgttcattcaattcttagaacactaatcaaaagtaaacatcggacttttgattaatctgaaaacttaaatattatcgatatagctacagtatatgtttgtcagggcactagctagctgattctcgatcagctagctgcaggggagtatatttgacaccagtgcattggtgttggtgtaaaccttgttgttatgtatcaactctgagttgtttcctgtttgaagccttgagctctagcttccccatacagtactacacccattattttttgtgtcgagatgctcatacattgagttatgtagtgcgtgctgcatgtacaaaatggtgtttccagtgatcccaaatccctaaagattctcttgttatgttgtacattgtctttgattgctatagtagctcttaagttttaattactccttttttataattctttcaggatctctcatgttcaaatgttttcagaaaaaggaacctcccttttgcctctctgttggcagttttgctctcctttttttcttcagactgttagctgtactagtgaacatgtatatagttcttcataaaaaaaaaggtaatcccttttgtagctattgcaatataatatgaatcaggagtggtgttttaattagccccatatatacatgcatgctagctaggcagctataacagccagctaatacgtgtagttgcaaattatatatgaaatcaattaaagggacgctaaatcattcagtccagggaggatgtatatataatcgatcagaaaaattaaccaactaattaatctaatatatattgattgcgtctatagatatatccacatctatctctcatttcagagaggtgataattagcgatataagtgtacaaaaccggttattacgtctgacaaagagaggttccgttaattgcagagaatgactcgtgtgagcactgaccagtcaaagcatgtacagctcgttgagtagggcacacgtgtgaatagatgcctttgcatgcgtcgccatagctacttaattacaattataatagtgtagtacatgattacatctaaattggtaacctttctcctctctgttttgtaaacaagtacatctacacgttgacagcagtaagtgcgtgtgtgaatagtgattcttaaaaaaaaaaagactactgactactgcatgtatgagcaacaggactggtgttttctcaagttggtttgattgagtatgcatttgtatttgcagataacaagtggattccacacgcatctgttaagttatatttacgtgtaattattttacgcgttcgtgaaaaatacttggttttctttgacagatgattcgctggattattgttatagcggattatctagttggttataagaaatctaaatattaaatatttttaaaaataaacttatgaactacttcctccattttgctttaactttttctaaaatcaaacttaattagttttattaaactttacgtatgtttgtttgatgttgaaaatatatattgttatatttttctatagttataattaacataaaagaaattcaaatttagaaaaacaatgcatcttatataattaatgtggaacggatggagtagtttataataagtgatctaaccaacatagtagttttttttagaaaacatatttttagaagcgtagagcaaataatctacccctccgtgagaaaaaaaaagctcacttatagtgcggttttttttaaggacggagggagcgtacatcaataatccaatgaagtagtccctctcttaaaagaagttcaattcagaggatgaatactcatccctaatattgtgtttctagagggagtagcgtaggagtacatatggatgatgcatgcaacactaatcagaaaatccattccataactatagactaattcgcgagacgaatctattaagcctaattaatccatgattagcctatttgatgccacagtaaacatgtgctaattatggattaattaggcttaaaaaatttgtctcacgaattagctctcatttatgcaattagttttattattagtctatgtttaatacttctaattagtgtccaagcatccgatgtgtccctgatccaaacaccacctgagtacgcagtagtattactccgatacaagctgtgtttagatctaggggtgtaaagttttgacatgtcacatcggatatacagacacacatttgaagtattaaacatagactaataacaaaataaattatataatccacctgtaaaccgcgagacgaatttattaagcctaattaatccatcattagtaaatgtttactatagcaccacattgttaaactatggcgtaattaggcttaaaagattcgcctcataatttacattcaatctgtgtaattagttattttttcgtctatatttaatactccaatactctatacatatcacgtgtccaatcattcgatgtgatatggtgtaaaattttactatgagatctgaacagggccatactatctgcgtacgttgatggcagtcttgacatgaggtatcatgcagatgctgagatgcagaaggaagcagtagcaacactcatgtcagaagccaatttttaagatgtgtgcatgcaacagctagcagcttccatatccatgcatactgatctggctgcctctttcatgtcaccaacacagttcatggctgttgcatgcatgcatccatcagctactccagccttttctgctttagttttgcatatcctatgcttgcatttgcatacgctcttaataactggcccatgaagcaatccaattcatatacactccagcaaatgtgctttaatttgcaaccgcagaagcaaccaatttatactaaatgatcaatccgcacttgtagatcgtttctgtttggagtactgaaaaacttgatgaaatatactgcacgtcttcagagtttcacagcttcagattcgcacagttcaatctgcgccttacggagatgatatacatacatctagaattgtatttatatttcagcactaaattgcagatcaattagtccacacatatatatatacgatcattagatacagtatgtgtgtaagtgtgttgctgaatataccgctccgtatatgacaagtaccaaagatgaaaagatcgaaaggggtcggagttttcttctccgaacccccatgaattgccattttctcttacaatttcttttagaggctctttaattttattttgtcttctccactttagttcggcccataaaaaaattctaaacacaagcgtacgtgtcaaaaaaaaaagaaaaagagaaagatcgctagctacctgtagcttgttaatcatcagaggcaaaagggattgtcttaatttggttgatgcatccagtaacactagatttattaatttgcacatgtacggcttacagaaaatggtgccgacgtcgttaattaatgtaagacgatttgctgatgtaaatacgtaaatttgcagtttatccaaataggttcggagttttcgtctccgtatcccctatggcgttctccatttcctgcagattgtatatattgatccttttcccttgcttgatttctacccccttagatttctcggattcatttgccttcgatttctcgaatatgttttcgccgaattacaaacggaagccgatcaatgtttaaacacgcgaccgattttcttctgcaagggggttcggagttttattttccgaacctcttgatctcggcagttttgaaatgaagccccgaagtaaattcggcccatttaaccgttcgggcccaaaatccttgtggtatggatcgatttgcctggcccagctaaaaagaagagggaaggactgacgcgataatctgtgccgcacatccttgatcggacgtctcactgagatccaaagggtcggagtttttttctcctaatcccctcggatcaccatctagctctccgatttagccattgagttaatccggcccacctaaagacttcggcccaaaaagaatgtgtgtgtatatacacaaaaatgaaaccagatttgcatacatgttaattagtctgtaaaatgtgtctgttatgttcgtctacgtacttatcagaacctaacgagcatgggcatgggcatgccgcccttatctgaacctgattgcattgtgtaactaaaactcttttttcttctaatatattaacgtgcaattcttttacgcgtttgcgataaaaaaaatatccgaagggttcttagttttcttgtctatccccttgaggcctttagtaaatttggcccgtttaaccattcaggcccaaatgcctcgtaaatggatcgagttaccccgattttcaaggcccatatgaaaaaggcggaaattcatgatacgcaaaggaccaatgtgaaaattttgtctcctatctaatctctaccgcacatccttgatcggacgtctcacagagatccaggggaggtcggagttttcctcaccgaacccgcgtgggcatggtaacgctgacacgtgggtcccagccgtcagcgcaacgggtgacttgcaacggcgccactccgagcgccgccgtcgccgctttctctggagctctatgcatcattgcttccgatcttttcctttttttttcgagaaatatcaatcggatctcgtccagtattttctcatgtttgcattcaggctcttacgtttcttgatttcgttcgctcaaatctggattctgcagaccagtctaaaaaaaaaattggattctgttgaatgaacacaggtcaatcagatctctaaatgatcgatcgatgcaccaagcttcaagttcagaatgggcaatccgatctacagaaggtactgattcagatttgagattcagacttgttaccatttcttctactagtaggtagttaggtaccctaccctctctgaacttctgaaatatgatccacaattgatagagagattgaattactacatgcttaattagctatagcatcatcatgatcccacacctcaacgttccatttgcagtgtctgtccaaaagaggatggaataattccaaggtttttacaacggtttattaaccatccaatattagtcagacaagaatgcacacctgatcatgcagagatatcatgtatgatcatattttttttcatgcgaaatccatcacccaaagtgctccaattatgcattgacctttagttcaaaaaagatctcccctactcccccagataaatcgaatcgacgatcatggggaggagaaaaggtgtcgtaatctcaatcggaacagttcctgcactgtatcagaaatgcatccgcgcgtcaggctatactccactggaggagccagcaagggattatgggctaaagataatcaagtaaagaattgtcactgttgagagtttgattgagctagtagcttaggcaggcagccatgatgcagatgcagtactagtactggtgtgctagctagttggtaaatggatggctgggagcttttgctttcctagccattatttccaaagttcagatcaaaggcgaagaccggcaccatccatggtgacaatggtcaggtcccattccatgcttaatacccttgctcattattagattgatctcccttttgctaccatatcgcaattgtcctttctggcaatctttcaaattaagcctgcagatttttgtccccaaagttttagggatgtatattgtagtactgtgcaagcaagatcttcagaattcagatatggattgagttcagaagctgctagcatctttagagatttgtatcttcagccagaattattgggataaaaatatttccggatatgctacagtaaaaataagcatcttatatgctatagataaccagagagcaaatttcattttcacggtttcgccaatccataagtaataaccactcaattacaatttaattagcatccctgcaatttactttcatgaagacaaacgcaacgttgttttgatccctcttctgaattctgtacggtaagccggccatagtagtcctctgtgtactttctgtacttgacaaatttcgcaaacgaaagaggtgtgcattgacaaaaaagactttatgctatacagttccaaagtccacatcctgaagagaataattccattttgttgtcactgaggctttataataatggaggccgcatgaggggagggctggatgtttgactaccacccaccatggaaaaaccttagctttctctatgcagataactttggctaaattattggagccaaagcaaagcaaagcaaagtgattgtgagtgacctccaagccgaccatactaatggttgttggtgtgcacggtggcctgcagtacaattcaggattccatctttccttcaatgtatttctagtttggagttctttttcagtaaatgcaaaaatatgatttgaaatcatcctgcatcatattctcacagtttcattctgttgtggaggaactgatggttacagcaaacatctaactaatttggactacctgtgtgcagagtctgaaaggttttcctgcatgatgcagtgtttatattcagagagttggagaaggtgtccctatcgacaagaacaaatttcatacttatgtcggcaaagacaagttaatatgctctgtattgatgctagattagcactagcattatgcaacagtttattggcagaagagaacgaatacataaagctcattattagtgttgaaagtagcagaagcactgcagctagctagtgctctatatagcctctaccacatcaaagaatcaaaggtagccttcatcagccggttcacgagccgttggaaatgatgcattgagtcccaaaagaagccatttaagaagaaaaagaaatcaacggtgccaaaacattaattgtgtcgggacataacaaacctgcttcttttccaatttgtccttgctgtccttacttgttgatgagatcgaatccgtggcttcagctccgtcctcctctgcctgcatctgcatgtccctactgagtaaacatatggactgccattagagtggaattaatcaagaaaaacatgcaatcatttgtagtcatgcaggttagctagcaaattttgtatgggtcaattattgccaatatatatatggtcataggtcataactagtctgcattgtaatttgctttgtcacctatgtacataatttaactatcagctagctataaatatatactttctctagttttaaaaagatggcgtcgttgatttctagacatatatttgatcgtcagttttattcaaaagatttatgcgaatatataaaatataagtcatgcataaaatacctttagtaataaactaagtcttaacaaaagtaataataattatgacgaatggtcaaatatatatatatatatatatatatatatatatatatatatataaattaacaacacaatctattaaaaacagagagtatgtaacaatctacatgaagaactagaggatatgatattctatatgtatatccaaaatatatatgcatccaggaatattgctagttattgctacgaccgtggtgcactcatacatggttaaagtagactgcaaatataaaattctgcgcttatggctgcatatgtaacacttacatcatggtgttatacagaggatcacacatatattttctgtacattggatccatgtaccatctcatgagacggacttaagcctagtaaccttatcaaccagtattcttagacactcacgattaggagtaacgtgctcataagttgtaataggtcagtctcatgtaagtagagatgggctataagtgtgatagattgggagataaaacattggatctggtgattacgtacatatgttacacgtgtgcacggtggaaggaggggagagaaggaagacgacttcgctattaaggtagtagagatattgtgtatatattctagtagtttttaataaaattttgggcttgccatatcaccgcctatgttgaggatacacacactacacgttgagtgttaggtgtaatatatgacgataacactcatgaaatcttatctttcttccatcatctataacctgtaaatatctttgtaagtttattgatgatttgtctaccaacacatagagataatataatggatatataaaatgaatattcatattacttagaattaaccatgcaaagcaaataaaaatagtatctacctaccacaacaaaataatgttacatatttttctttggataacatatgagtccatataacaaggcaatatagtaaattacacacgggtatgagcttttggttgcatgtaacatgtatatataccatgggttatgcagattgcaagcaatatgtataccacatgtattctatcgccttggatagatttaaggcctgcgaccttggtcatcggcgtctagagacttccattgcgtattttgctaggctttaaatttttttatgcttgccagatcactacttatgtcgtttgtgagagactgcacagatacaatgagcgagcgtttggtgtaatatgtgacagtagcatacacgaaattctatctttcctatgtcgtttataggaaccacagatgtctcctaaagttgaccggcaacatctctagtgagagatagagatatccgttactaccaggccgaggtaggtgtaggtgggtataataaatgtatgaattacttcgaattaacgaagctataagatatagatattacctacagtaaaaaaagatataaatattttgctttgaataatagagttaatatacaacatggtaaattgattctaactaattctaatatgtatggtaccacattctcaaatctcaaacacatggtgttctcactgacacttgtaagcacacaaagcctaggcaacaccagggcatactggccagctacactctacggagggatcagatgccctctccgctgtagctaatacaaagctgtagagttagtgccttgctctatctccaacagctagctacacacaaaaaaaaaacacatttcttttaaacatcccaaagagaaagctaagataaataattatttctggattaattaatatcactcctgaaatggtggagtaatatttatggggagagatatgacatttatttctcaccaggaaaatcagcagctgcaggaaaagaaacagtagaagaaaaaggaaatcaataaatcataaatagtaaaaaagagtaaaaaaaaaattcacagatagaaacaaaagggcgcagtcaccggcctcctcatatacacgcgcaccctacgctctcctcctccaccaactcctcctcgagccaagaaaccatcaagctagcgaggccacctcaccggccgccatggagatcccgccgctctaacggcggcgcgttcttgctcgtcgtcggagctagagatcgatcgaccaagctagcgtttcttcgattagatatagtcatatctatataggtagaaggatgggtgtgcacttgctgaagaggcagcagtcatcggcgtcggcggggggctcgtcggcggggggagggatgccgccgaaggggtgcatggcggtgagggtggtggggcccggcggcgtgggcggcggcggaggaggagcggagggagagaggttcgtggtgccggtgggttatctgaagcacccgctgttcgtggggctcctcaaggaggccgaggaggagttcgggttcgagcagaagggcgccatcaccatcccctgcggcgtcgaccacttccgccgcgtccagggcatcatccaccaccagaagcaccaccacggcggctcccatggcgccggcggcgccggcgccggcggcctcctctccggccacggctcgtcgggacaccacaacaacttccacatcgccgcctgcttcagggcctgattgagatgatcatcagatgatgatgcatggtgtttctttggctagcttctctctctcttagatcgatggattaataatacttagggttttaatttccttttggttaggaatttagtcatggtttgtgatgatgatcaaaaaggatcatgcatgcatgagcagatctgtcatgcagctgcgggttgttctctgttcatccttataggactctctctctctctctctctctctctcctagttaagttagattgtgatgatgatgatgatgaaaatggagatcaaaggatctgttcaatcaaaacaaaagatgttccctttcttctttttctttatttgtgaattccgtttttttttcaattttttgagatgatatatatggttggtagtattctctttctattcagaaagagcatcctttttctattcagaaagaacatccttttcctaatggttgttgatcaagattcatatatggtatagggatgaaaaaaatatatgaaatttcagaaacaaattaaacatgtctatctatatgttggcttccaaaagagtggagaaaaagaacctagctccatagacaagaacaaagagggccagctaactagctagatagcaaatgttgttttttttttctttcatctcttctaggattctagcttactttcttggttttgtccactctcagtactaaacaacaatcatcagaatttacttagtgctaagctagctactccagctgttagtgctactcatcgttattctctaaaagaaaacttactaggacaataaatcgcctactgatcgacaggcgccagcactacccaatgcattccaacacattcagagtttttagttggtgaaagttgttggtgaaacagaaaccgagaatgaacgaatggctaaatagcttatttatgataattattataggaagttggaaaatggatttgtaatattgtttagtttgaaaaacgtccggtttaatccattatccgttcatcacgaaggcagtagtgcaacagttgtcagagcttcttgtggcagatagacctggcactgtcagagatgagatgagagagagtgagagaagaatctcgagatggtagtagggagggcggcgccgcagtaggaaatggagaaggggatggatatgaacaagcaaaggacacgttgtttggccaaaaggacaggcagtacgagaaactgagaagcattgcagatcacacacacatgtaccgtacacattcagaagattcagacagataatctagtttaatttattttcttggtgattttctccccttgctaattactcccaccatcccaaaatataacggattgatacatgttttagttaattgcaaaactacctcttattatgatccactgaacatgccagattagattttttttttcatctcaacgtgcagtgaaaagtaaaagtaaatcaaactgatcagagtgctatgcggtcatcatgtttatgagaggtgtatagtttttagcattcccgaaattcggagaaatccaatccagatcattcccgaaattcggagaaatccaatccagatctagctagtggcaccaaattaagttttcacaaataattaagcaagaattgatactctagtactagcagctagttagtggtaggtcacttttggtgatcaatagggaaagagagatgtgtatgtgtgcgtaggtcagaactccatgtaatgtggagaatgaaatagaatcgtgcttgatttttctttttgaaagttgtgttcgatttggatctctccatagctgctattaaaaccctaggccattgatgtggcagcatacttgtcctcagagatgtcattctacaagctacacttcattattcattagtgttcatcatcgattaagcatgtgaaattaggaactagaatgatgttgaacccaaaatttaaggctatgaccggttgaactatagctgaataagctgtcaaaaaatgaatgacaaacataaataatttatgatttttttatatttatattattagcaattttaaaaataaggctgaaaaatagactatatatggtagaaaaacccaaaataactttcaaaattcaaattttggttgcggctaataagtcaacaagctgacaatgaagacctcgtcatccatccatatgtttcttcctttctttatgtactatattctcttcatgccttctctttccctattcataagaggtaaaataagcaaacatctactcacagtaaaacattcttgggcgatcaaggtaaggaaagaattttcttttaagaaaaggtgagaacagaatatcatcaattcatatagtaagaacatactctaatagtataccatctcgccgtatctaaaatgaaagaataaagagggatgctctatatttgccaatagttttattgacctctagaagtgcacatgagacacagtcgaatcgagtggtttatcgacggcaccaactactttttccttcgaaaaatcaccaattattgggttcaacacatcgggagaaatagaataaaactaaagatgattgaaacagccaatggtgttagtacaaagcatgaacagtggtagagatgatggaggggatacggagagcatccttttgtgtacggcaaaagaagcagcaggtggacaaagcgaaggccatagtttttttcttacaacaagacaaatgcattgtgtttttgcctgaaaaaaaggacaaatgcattgtaccatgcgtgatgagactatcttgtgtagtggagtattccatggattccattctggactcttccattcccttgcaatctttgcctctgccttggaatggcctccactgcctctcctttcaccacctggatgttgactttgaggcaatatctctgaattttccaggcttgtataaaaactgaacaattttcgactcaaattttataagtccatgaccatgacaatagttcagaggaggttccaatatattctttaggacagcttaattgagtcatgtatgggaatttgtcaccgtttgtataaaaaccgaacaatttcatctttttttggtctttgagaggagctagaatatttttagtgtaaaagctggtacctccgatatctaacactagaaaacgtgacacccatcggtaccttatcaacaaccgtaataaataaaaatgtaagtccatgacaatagttcagatgaggtttcaatctcttgtgcagttagtcatggtctcatggacttgcagtccagaagagtttgatggaaagtgctgaattcaagatgtcccttctatctaatttagtgtgtggttggcaatttataagaccagcttgatcaaatatcaatctatcatgaatgattgtgttaaagaactcaacaacgcgtcagctatagatagaagaaaatgaacggactgactcactaacaccctcgtgtcgacattaccacgtcgacctgattaagacggggtttcattgacaggtttgtattcatccacgttagttgcattaattctcatccaatctgatcatcaccaaacattttactttacaagtttcttcatcgtcactgtcagacaagtttgataaggtacagttcaaggacggttccattgcacggacacggactatctgttcctaatggcagaatatcaatcgatcagttaattctcctgtaaagatgctgtcattctctgtatatacatgcacaaaaatatattcagtgatcatgaacagtaacctattctttgcaaaatgctgataaagaatgagtttttctctctcttttttctttttggtttctgaagcagataaagtagggttgaaattggaggcttcagtttcaagttcaacgattgctgcttggttcatccaagctgatgacctagcttctttgtctgcgtctacaaaccaattagtaggttcaggctatctgattcatatggtccatttccatagatgtgaactagacatagtttttagctgaggtagggtcgcaatttggcgattggtatgaattcccaagagtatattcatccaaacgccaagcgagtaatcatcacctaaacaagtggttagattttttgaatcttgcttcagaatttggtacagttgttcgatctttctctctctttcagttttgaccttgtgaagaagtcgcaatatcatgcgtgccaaccttgtcaagcgacggtacttttgcacagtatttagatataatcatttttatttaagaaagagatggcattaagtacaccctttgtcccaaaataagttcatttgtaggtttctttgttcaatgtttgattgtccgtcttatttttaaaaagttatgattagtacttttgttgttattagattataaaatatgcatgaatagtattttatgtgtgacttacatttttaaaaaaaattatattttttcaaataagacggacggtcaaacattgaacacaaaaacccacaaataaacttattttgcgacggagggtgtagatgatataatcacttcaattgatagcaacgcaccaatcatatactgtgacctctagactaggaatttgggatatgtatgctttactgtgcataatctggttcagaaatttcagaagttcagatgaaggagagggagaggagaacaactcgaaagaacaaaatacaacaaaagacttgcatcttgtttcctgtgggctgaagcctgaaaggaccacatcttttttatgacaatgaaatcatcattaaaaacagaccatctttgattaatcggcccgtttcttttctcatcgaaatggtttcattaacgagaggaagtgagctccttcatgaacaactgaagcagcatcaccgatcgatcgagtaattctgattctaactgtaattctctcgcttgagtgatgatcagtttgacgcgatcgataggagagatcatctctgtctgacatttacaagtgaaccgagcacgatctgacgcggcattgcagctcacggtgacagcaacagagtaagtgggaaagcaatttggtgtataattcaattatataatactatataagatgaacagacaagtactcctactccctccgtaccaaaaaaaaaaaacaaaccctaggttttcgtgtcaacgtttgactatctgtcttatatgaaaattttttataattagtattttcattgttgtagatgataaaacatgattaatactttatgcgtgacttatcttttaaattttttcatatttttttcaaataagacggacggtcaaacgttggacacggaaactagggtttgtctttttttttttaggacggagggagtacgtcgtagtctgatgagatgggtgtgtgtagccatctcccagctggaaacacagtaataagttgcagaattaatcccatttccggtcgatttctggaacccatgaaagcgaaaacgagaatatgtactcagtgacagcaccatgagtaggacagcaaacttgttcttgtttcttcatctcgtcagtacacaggcagcagcaagatcgatggcgagagcagcatagagagaaaaaaaaaattctctgctccaatggcattgcaggttggagatcgcagcgatgatgatgatgatgatgatggcgatggcgtgcagtggatggagctgagttcttgcagagataatccgattccaagaccgtgtttggcacgacgagaattttgcgtgtagaactggacaccatgggagaaaactttgagatgtcattagtatctgaatagtgaatactatagtaagcatcagttttagttttgactgacgacagagcgtgtgatgaagatggtgccatgagcagaagggagttcgtagcaaccaggtgcttcgtcagagattcagaggaggatcacacacgaacgtggcgttgctgagatgatgccttaagcagcagcttcaggattcagacaattacccccatcgcaaacgaatgtcgcggtttgtattctcagcgcaaagagccaacccagttaccgaaagaaagtactccccggtttcaaaacataggacgtattttatttcattagaatacaatttgatcgataattagtccattatgatattatttgtgtgataaaaaaacataattacaagtatttatgtgatacaaaagcataatataagtaagtacttttgaatacgaatataataattttaattttatgttaaaaaatatatccagacagagtattgttgattgaagcttgatctaactaaagtggttaaggggctgttcagatttatgtcatttcaaaccataccattttttgtaaagttgctaaaaatatacatacattaaatttcttgctaaaatttagtaaatacataagaaatcctgacaaaattttgataatattgacaacttaccaaaatttggttagatttattttggtttcaatatgaacagccctaagagttggtgcacttcgctttgccatcttcaggcccatttgcaatgctgcaatacggccatagaagaatctccctttgggctctgcagtctgcaccatggctcgtttgcaacagaatatgaagaatgacagcttaagagagaagattcagctaacaaatgtatcgacaatgatgcattcatggacaaatgatttgtattttgtaggaaggtctgaaattactgggcaaaaaagaacaacatgacactatatttcttgaacaaacatatcattcgattcattacaaaagatctttacatgtattctctacaaaaaactatgatgacaacagccgacagcagcacgaacaagaataatgatcatattgaccagagggataggagcaggaggggaaaacatcaatcagggtcacataatgagcggctttaaaattagaagagaaaagaatacattttcttttgcaaatcgcttaatgccgtcttgtatttgagccccttattgtgacaccatgtaaaaatttggtaaacccgagaaagtttagcttgccatcggattttctgatccagtcttgaacgatggagtaatgagttggagcaagatttaattcctgtacagagaaaggttggtcagggtaaccgttatagttacgagaaaaaatgttacttctccatggatcccacaaaccatggtagtgaaattgcaacaatattatccacacaaacattaccctaccaactaaggcagctgtggtgtcagatgggatcatggaaatcatcataaatacctgtgctaattcctcaactgatatgactcggttgccctcttgttcaaattgctggaaagctgttccagcaatctcctcccacctttccagtgcctcaagctggtaaggactgattgctgcggcacagaactcttcaaagtccattcttctgtatgcaagtggttccaactgggatagaatcaatatacacaacactgagatcagcaacttcaaccaccaatgagatgtattttaagaaattaaaaaaaaacacaggatgcaaggagttagaaaagaaacaaacaaagcaataatggccatcagttcatcataatagctttggttgtatggctttgcaacaaaaaaattcagtatatggctttcagcattaaaggtaatgatggaattcgtatagtaatataaatatttaagcaggtaccatagaagggtgatagtacaactcttgttgtgcatcacaaattaatcacattatggtcaatatcaatcaaaatatggttaatttctactacatgtacaagataaacagccatccagcatgccaaatgagcctttgcttgacaactggaaattatgctctctggtaactttgcatgatcttgtactttgaatataggtcaatacaaattgaacattctcctagtacttaaagtcgtcggtgaaatttccttaccgcatgcaaaaattcaagaaccctcgattccttcatagcatcagttaaatatcgcgttagtgcctgaataagatagtgaattaagaggttaaaactatgatttacttacaggtaatgtaatgcacattggatgacaagtgtcatgtgtgcctttatctcaatgaggtagtcagaaataatatggtaaactcaccgtccgaaagttgtcaagtgatacaaacccatctctaggttcgagcagtttaaactgcagtttgagatacaaaagttcatcttcccttaaagccttggatagtgcctgtgacagtactcagatttcagtaataaacaaatatatggttgagttgcaccacaatttgctggcatcagcaaatttataacaaggacttttaacgcacaagtttgagcaaaaccatgtccactaattgataccacccccacagtaacacatggaaaaatgcaaggccataaacgaaagacacaacttgactatcagtaaaagcttagccaaagcacatgtaaggacaggaaagggatccacacgctttataccacacataggaatgatactgcaagcatattcagtttttccacttggcagagttaatagttaacacagccttcatcttttatttttatcattttattatttttctcccaaattagtctagggagactaacttgggaacttgacagctccttaatatatgaacatccctaacaacctgacaatagtatataacatatgcaccgatgatgctgacaattattttgcaagagataagatatgcagtcctaaccaaactaggcccttgcatcttacatacagccagccagccatgatcttgtgcatataacaaaacatttagccagtccatgcaaatttattagccagagtacatatcagtaaaatcagtgaaacatcaaaataataattacagatgcagagaagatcatgataatctataacgaacctttaatgccaaccgtttaagaggtgtagcgcggaggtattgcttaattaatctgaagatgagtatgtccagcgggatctgcctttgttcatctcgcaaccaaggatgagctgccaaagaaaacaagtgtcatcctctcatatacgatttatgatagagaaataaaacaactagtgccatactacacaacagttatagataataatgttgacaacttactcagtgcttgaacagcggtcattcttttgcggtaatctttgttcagaaatctcttcacaaaatccttagcttcagctgatactgtaggccacggtgaatcatcaaagttgggatcagctctcaacacagatcggaatattcctgattctgttcgtgcccagaatggccgactgccacagagcagaatgtacgttatgacacctatactccaaatgtctgcttccatactatatgatctgtgtaaaacctctggggcaacataatatgcacttccaacaatatcattaagcctttcatctgcattatatagcacaaaatacaaagaacaaggtgtctggtcagctaatgaaataccaagcaacagtgaagagaaaaatagttagccaaagttcattaaaagcatcaggacacaagccacaaaaaatgaatgatgcattgtcaacctggaatatagataactcagattaacgtaaaatgaattagcccaggacaggatgccacagcacagaatgtaaacaataggcatgaacaacaagccaaggtagtctatataaatcaagattatccacaagccatacctaatacggaatgcatgttagtacacacaaagatgaagactagtttattacctggtctaatgaaatcagagagaccaaaatcaatcaacttcatgggagcattttcatccctggttgtgaaaaggaaattctggacaaaagaatagaactatgtcataaaaatagcctagcattctacaagtataatttacaaatgtgactgcatacgtatacgaatgtaaactacacataaattagttccaagatttcaaagcacacctctggcttcaaatcacgatgcactaccccctgaagatgacagaaggctactacgctcaaaatctgtacaacaatcgctttggcatcttcctctgtgtatctcccgcctcttcaatagttcaggttagcataattggtaaggattaacaaatatacagagatagtattagtttactactatgcataaagaaaaatgtagaaagtacctggctaatattctgtctagcaattctcctccctcacataatctgttaaggaaaaatgattggaaaatacttccttaacaatattaaataaggtgcgacaaatagtgattttctgcaatggtaggtagtagactagtagataacacaaacatcagtagatagaataggaaaaaagcagataataataaagtaactgtggagctcatagacaagatattttgcatgcgtgtcaagtaatctgagatcaaatattgcctgtagaaaaatcttaagtatattggttaaaattacatataaaagtcataaaaaaacatactccatgacaatgtagacattgaggccatcctcacatgcatcatagaatttgacgagattattgtgccctgataacgctctcaaaatttttacttctctacgaacatcctcaatggatattgccgttgtcatctgccaaacacaagagtaaattgttaaaagtaagttgctaaaatttttgtttcagttcgaagaactaggcactgcaataaatttataggtgccgttgtgaaggtacttgcaccattgcagttcacatcaatgaaaagagaacaaacaaatcaaataatacgataagtaggacccattctactacattgcatgctttcatttataaattattttataaagttggatcaagggaaccggagcaacaataggacacttgacaattagctgccctgcggaaatcccattatttatcatgttaaactgctgctaggttgagttgaagactgattataagaaacttgcgctgcatagagtaaacttaatttctaaactctaaggaaaccatttgtgtgttaaatatcatgtcggtttgatctttgacccaagaaagggtctcctgagatggttactaattgataagtgataacaagattaaccgtatgagcctcccactagggctactggacgtgctaccgaatcttccagttagtttaaaaatggtttgtcattatctcaaggtcccagatttttggcatttaatgcagtctgccagcaaatatttagcttgtgatatatttaactgtttagacaacaaacatccagaatgtattaaaaatatttctaaaaactatgaaacagttttcttcaaataattaaatgatttttctgaaaggctaaaagtaaagcagatgcctattgatgttcagattccataaataaaccagttggaaccaccgatactcagctatgacatatctgatatcctaaaaagcaatgtgaatatctgttgtggtggtagacaatcaggccaattcatattcagatcatgaatcatttcgaattatgtagtgcctgatccatgaagcccctgacaataaataacaaccaaagggcactctacccatttttgttgtatcactcaattaagtaacagtaccatatgccatgtgtctcctaaatcaactctaagctctgtagcctccttggatctttctccacttcaaatgtctttagtacatgtcagcctgcagttgctgtgacactacctcccactgattgtgaattgtgactggcaaatggtgacacccaaaacctctctttcctatgatgtgcttttcgaaactaccgtctcatatggactaaaaataccgataattgatcactagaccagtgtattcatgtcagcttttccccagatgtgtcacatgaaaatccacctcaaaatcgacaatccttaactaaaagccaaaaaggacagataaaaaaggtaggttaggacatgtactgctgattggttagaatatcatttatcactagcaacgattggctaagtcaccaatttaatcaatgtactagctgcatccaaaagcctcttcacaccacaaattaagacttgggtaactgttcgtccctcacaaatgcaactatcttcccctactgtttccagtcaaaaaagaaaaacaaatgtaactctctaaaggaggaaaatgcagaaatatcctggttcaaccttactgtctatttctctgaaagacaaactcctcaaaaaaaatgaaattgaatgagataatcctactccagaaactgagcaagattaaccaatcgccaatgtagaactaatgtggcaaaatccgagattcgcaatcttccatttgtgccagtatccttggggggggggggataatataataagacaaaattcctaaatctcagttacttctatccttcaatctcgatcatacgaatcataacactgacctagatttcagttatttcttcaaaaatggcgcgacggcaacaactaaattttgaattcatgaaacaaaaaggtgaaccagagcttaaaaaagcagcttatcaccaccagcagcagcgagctctgaccttagctttggcgatgatcttgacggcgacggtctgtcccttgtactcgcccttcttgacgacggcggagcaagtgtgtccgaagtggcccctccccacctccttcccgagctcgtacttcgcgccgaagttcttcgagaacccgaacgtcttgtccaatggcctctccgtctccgccccatccgcggcccctccaccgccgccgccagcgcccacgcctccctcctccggtatcgtcccttccttgggcttccccccacccagcctcttggcgagcgtggcctttatgtgcttggccggcgacggcggcgggaacggccgcttgaagaacctcctgggcgtcgacctcgccggcgacggcgacaccccggccggcagcgggctcgcgcccccggacgggtacgggctcggccacgccaccccaggcgtctggtgccccggcgtcgtcgatccggacttactcccacgccgcctcggcgtccccacctgctgcgcctgcgcctgcgcctgctgccgcggcggcgtcgacggcagcccgttcgccggcggcggcgactggtgctccgtcaccaccccgccctcatcgtccgccgtcctccccgacgcgcccttgccgtagcactgccccatggcaacaacaacaacagcctgtcggcgcgcgcgggcgcgggcgcgggcgcagcggaattagggttagggtttggggccccccgcaccgccgcctcgcgaggtggaggtcgaggaggtggaggcgagtcgctcgttggggaagaagaagaagaagaagaggagagagagagagaaatcggaaatggcgttcgttaccaatttctctctcctcccccacctcacctcgggcttacattacatcactccagggaggcgactgtcaattccacgttttcccaggggccaatgtgcaaaagtgccaggaaatatttttttattgtaacgcctttctggtggcgggtcccacgagggggtgggcccacgcgtcagtgacccgttcgtggcgccgcgtacggaagccgtgcgtgggaaacggaaaagggggagaaaggggaggtggcaatgaatgagtacggggtgaatgacaggtggggccgtgtggactcgtggcgggaggtgggtggtggggggagtgggtgtttggtgtttgtgtgtgaggtggggtggtttggggggcgctccagaaacacggcgggtggccggggcagttgatgcttccgttgtccacttgtgtgtctgtaccccgtttttattacacccccaaaacctgcctctctctctctctctctgctatcaaggattagtttgtttcttcataaccttgattagtttataatgaaatggatcactagtttattttccagtacatttgaccaccatttcaccgtggctttaacctctcacagtttgttctacggtttaggtggttttcttttctccagaaaatgaagatgatgaagattaagttttttacgtaaaacgaggtggtatttacgtatgatttattaagtataaattattacaaacttgaaaatagattaatatgatattttagagaaactttcatatagaaagttttcacacaaaacacaccgtttagcagtttgaaaagcgtgctacaaaaatctttaacttcatccgactcttattggagaaatgaacaggaccttaatgaaatggattactagtccttaaaagatgaacgaggcaacgagatataataatatatgggtaaattattatacatgtgttcttacttcttagcgatttactaaggggttgttcggatttatgtcattttaaaccataccaaattttggtaaagttgccaaaactttgcgtctatttagttttttttatcaaactttagtaaacacataaaaaatcatgccaaaacttggcgatattaccaaattgccaaaaatttgacaataatgtttattttgactataatcagaacaacccctaaatttcaatgctgaaaaataaactacgacgaaaaatgcttaaaattaactctaaaattaggttcgaaattcaaatttttgttgcagctgatgagcccacaaacaaactattcctctagagttctaaaggagctcttggattaaaaatgaggtattcagatattgctctgaaaattcaggttcaggcatgtactgaaaattgcatgacctgaaaatctttcagaagagtcagtgttgcagtaatcatttcgagcataatacgacttcgttgagttcttttcgggaggagtaacgaactgcatatattgatttctaaagtgcattcaaagaccggatcaaatgtgttcctggaatttgaccgcacggtgagtcttgttcgtttctgaatcttcctctccatcttttccatctttcgatgtgttcagttcatgaagacacttgcagtgacgtgccttcgatgcaagcgtgttgacatttctatctgctattaatcaaagatcggtttttttgactctttcgattcaaacacatagagctatgttttgctggactcgccaacaattgtttgatccgttgaacaatttatgttttaaatatatgataccaagtcttgagagccttgcctccttggcaggttaggcctgaaaacctttgaattgtcatgtaaataactcttgcaagatgaaaagttcaactgtgcaaatgatacaggttttgaatgtgtccatgcaccacctgacatttaaaaagtaaataaattgtatatgacaatttgtagcttcttcaaagaatcatatactcttttatgtttcataaaagttagggattccatcccctaaacaaaatgatttttgccatatagtagtagagtactagattgcaagctttgtctgataagatggtgtctgacgggattcgattagctttcgctaccataggagtttaggaatatcacagaagaacaggttgatagaacaagtaaaaaaaagaggcctgatagattgacagcggcagcttgacctgttgcaaccagtgatttcatcttttgctatctactgtggaaaggaagaaccatgtgccttttcaaaagagattttgcccttcttcaagacaagatcatctcagatgcttacagcgccattgattttcaacatatgtttaactatttgttttattaaaaaaatatgtactcattatttattttgttgtatattatttttggcatatctgtaattttttgttaaatagatgaatggtcaaacgtatatctaaaagtcaatgatatcgtgcataaaaaactgaggaagtatatttttttttacttcgtgcttagcatcgcgtgtgggatcatacaacaggagatgggagtgaaaaataagcagaagtggcaaaaggttttatattctgtctgcatgcttttctatctttatccaaaaggcttgattattaccatatcattgtcagtgtagcactgtacttatctccttttttttaggctgtcagcaaaagcccctttcattgccaaatgacaagcttctgtgcattaatctgaagaaagaaattacaggagaagatttcttctgctgctaaccagggcttagaggatcattaatatcctttgggtccaatatttcttctcctctggaatatctctgaaatttttaattacagagtatgcaccaagcctttcctgatgactacatttaactgtagatgaacacgacctcatcttgtttcagaatacatattctttttgtacttttatcttggtcagaatacgctgcaggacgaactaatccaataaaaaatatataaaattataaggactattaattaatcaaggcatgtacttagatactttctggtgatgaatactagctaagcacgtgtgtaatccctgtggataggttgatgactgacggtgacacttgagcacttgtataatactacgtagttaagattttgtatctaataatgtgtcatccatgatgcaattggcatgctttttgtatgcctacctgaagcttttgatgctaacacatttcttaatcttgcatatatataattgcagctgcaattggatcatatgatcgatatctgtgtgcatatttaagcatattcatgtcgcctaaccgcgtttaggtatagtatttgaaggctttggaaattttctttcttttggatttgaatgcggactgcgaagctgagctgcgccaacctttgagaagtcataaattttgctgacctaccctctcgttatgaatcagatcaatgtttgtctctgtaatgtagtccaaaccaagcttaaaattcattatttcacaccatgtgactatgtgagccatggccacctcaccatgaatggtgccagcaaatttgtcgattgagctttattgttttcttttagttgacacttgccacactgtacaattgattagtaccatgtattgacagacgatcaatgatattatgggaatcaaaattgtcgagtgtttccatttttggtttttaacgaaattattattattattattattactcgaagattgttatgtaatgtgttaaattattgtgccacaagaaggagcgaaattacatgatcttcaacaacttatgcagagttaggatgcacacagctaaacatattcacgcttgatgtaatagtgcttcctagttcaattagcccttaacttcatttctgctctcataaatgactagaggttttctgactagcttcacaaggtggtgggctaggcaacttgggttcgaagcctcaccccttctaattatttgatattagttctttccctaatattcacgttattttgtaacttcatttcctctctccccaacccctatggccgccgctgagtggatcacatcatgtataattaatagtacaaaattttcaatcctcctaatatatcaacacacaagccttttgtccattcgcgaaaaatgtaattatcatgtctggagagtttaaatccatgataggcacatggctaagttccatcagcaattaggttgagagcgtcttttcgcgacgaaaactcgcacctttggcatctgcttcaggaagaaccacagtgtatagtttgaaaagatccattctgtcctaatattttcttttgaaagatccactctgtcctaatttcgaggaattattagccacagttgtccattctaacagccacaacttttttgatcagttgagttactgaaactgcacgaaactggactagacttttttttttctagcagaagaacaagttaagcgtcttaatcagtggctgctcatttcagtggccaaaagtaaatcttgcgactacatatccagccgtttgtttttacctgctcaacagatttttcacaccagtgtagctgcaataggattactacctctgttctcgaaaggatgaagtcttaaatgcgtagaaccaaatcttgaactcttaaatcattaatagattacaaatattaggatttaatgtgtgaaaatgcactaataaatttgtcaggaaaaactctttcatacggttatattttcaataaattttataaatacataattagggaaaatgataatgataagacatgcgcattggagattgcttcgatgtccaaaagaataagtaaaaaagaatagaggtagtaataggataatttgtgcaataatttacacaactgtagctgcctcagtccgttttctgcatcagggaccacctgcatcgatctgtacctcagttaatctttttcttctatttaaataattttccaggtattctgctgatgattcatggcttgtcattttcagtgaacagctatcaacattttaatccagagaaaaagatgcacgcagcaaaatctggagaaaagctgagatgagctgctgataatggattcagattcaggcagagtcagcagtgttagctggaattctgaatttgtgtctgaactgtgaggcaaaagtacagttgcattgcacccacaaaactccagcaggaagaggcgtactacgagaagacgaactcgaacgagtaaagaaatcacactatcacaggcaggaagagaaggaagcaggtacacagtctacagattacagaagcatctatctcctcgtctccatctgcataattaacaaactgacactgcaaccacaccactccatataatactcctactgctccattggatgcagtaaaaaaattgtcagtgctagctgctcgtaattggcgctcattagcagttgcagacactgacagatgaaggttccaagccattaaacaagacccaacctgcagcaagattcagaagagaggagcctgtggtagttaatttttctcgctgcttattcagagcagatcatgaaaggtccgggagttaaatctcccacacccaacttgccatccacagagtaaatgcagcgatggacaatgcgaaatatgcaatggcatccttgtctgaacttgtttttggttggacaaacagagctagctttgacacttgctcgagaaattccttgcatgccagtctgccagcaatgaaccatctcataggctgtatttagatcgtgtggtgaaaatttttaccgtgtcacatcggatatacggacacacatttgaagtattaaatatagtctaaaaacaaaataaattacagattccgcccgtaaactacgagacgaatttattaagcctaattaattcatcattagcaaatatttactgtagcaccacattatcaaatcatggagcaattaggcttaaaagattcgtctcacaatttacatgcaatccgtgtaattagtttttttatctatatttaatacttcatgcatgtgtccaaacattttgatgtgatagaatgaaaaaaacttgacagggatctaaacaggcccatagtagagtgaagcagtacttgccacaagagtaaatgttgctactagatcagagaagaaaaaaaggcagtgctgctgctcataaattgggctactggtaccatgtccattctgcataccactatgctgcactgtatcatgagctgtagtactgcaagtctactaccactaccttagtaccatgtacacatatgtacgtttgaatcatgtataaatgtacattattctcctgctagtgattgtgaaggtgaggaagatgaacactgaacaaactgcactaactgaaaattgctctcaccagggaaaaaaaaaagagacagcaactgaaatactacaagtcacattttatatttttttttgccggatgtgctacagttgtttttcctattgcctcaccttcctagcttgtactgttcataactattttcatcttgatgggaagtgcagatattctccttccttaacttaaaaaagataagtacacaaactttcagtcaattgaagatgacggtgcagccgatctcgatctacctaccatatagatctgctcattattataatctttttctttaaacatagaaggattgaaaaaataattgtgagaccaaagaatttgtgtttctcatctaaatatctctcttgcagtacaaataagactactggcatatagtcaaaggttagcatgttattaggacttttgtttattcatcgtgctacatacgtagtattatattctggagacaacaacctcaacaagtattcaccaatactgccaagatgactatgaagttgagaaatttgaagtttctgtcttcaaactatcaatatctgatatctcaacatccacgcatttacaataatagggatgtccaatgaacattattgtacgaaaatagcataattgtctaagagcatttgatgtactaaggtcaacttgactaggtcaaaactttgacttcaacagtacattgcatcgatcagctatattggtttcatttttccaattcacagtacgttttttcgtatgtcaaacttttcgacatctgcacaggccacatgcagttcagtacacatgcatctaaaagaaaaaaaatgtgtttaatttgacataaattttgggctgtaagattttgtttcctgtttagacttagaggcaccactgtaaaaggcctcttagccttaatggtatattttctgtaatccggttgaaaattttcatgactgttcaatgtcatacgacatatccatcacaaaagaaaaaactgactttcattccttcgatgggagaaagctaattctaagttttctaacatcaaacttctgcatcctagttaaataggcatccagaaggattagcaaaactattttactcgcagacaatgagtgaaggctataccttaacattgccttaattatttagttcatcgatcgaatacaagtgagatcaatatcattgtacgtaggtgatttggaagagagctagacagctagctcctcttatgttgcattgttgctagctagtcactgtcacagcaatctcaatctcctggctttgtctgtggtgttaatatataggttaggctcttaactgtgctccttaattaaggtttgactaattggaaaagctaataatataatataataaaaattaggcgagactaactaatctccaagtcttcagacttcgaatgggtggcctgtctataattaatcttgtttcatgctttctgcacaacatgtacatcaaacttgcagttgaaggtttgaaaatttgaacttgttatacgcagaatcatagtctagtcaagctattctgacttgacctatcatcctatcatctcgaactatatgaagactcagcgggaaacagcttagttagtgtgtcgccgtcttttttcctgacttgtaaagaaaagaaaatatttaacctcaaatctgaaaattgttgaaacaagctggcactacatagaaatccgagacttaccgaagctttgcttgataatttaggctgtgttcggacatccattttcccaacctatctccctcgttttccgcgcgcacgcttttcaaactgctaaacggtgtgttttttgcaaaaagttcactggtggagaaaccatctttcgttggtcggccgatttccacaatagtcccggatgcaataaaaaccggggcaaaagatgatctttagtcccggttcaaaagggtaacgggcatatttgatctttagtcccggttcgaatgctgtcaggacctgtcaggcccccccgggatctttagtcccggttggtagcaccaaccgggactaaagatcttaacttaccaaccgggactaaagatcccggtgatctttagccccggttggtgctactaaccgagactaaagatcttaactttagtcccggttggtaataccaaccgggactaatgatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatattaaataatagaaaacaaactaaaataaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgactggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaactagctgctgatggtaacgacgttgcggatgatcttggtcagatgttgcaggacgccagggaagactgcgaaagtgaaaaggaggcccataaattggacaagatgttggaggaccacagaacttcgttgtacccaggttgcgagcaggggcacaaaaagttggataccactctggagttgttgcaatggaaggcaaaaaatggggttagtgacaaggcatttggcgatttattgaaactcgtcaagaacattcttccggggggaaacaaattgcccgagacaacgtacgaggctaagaagatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacagctaaggcgtttgttcaggaacaaggggaatgctagaatgttgcgatggcacgctgaagagcgtcaacaggacggatgctgagacaccccgccgatggttcgcagtggcgaaacatctacagaaaatttaannatttggaaaggacgcacgaaacatacggtttggtttgagtacggatggcatgaatccttttggagagatgagcagcggccatagcacttggcccgttacgatgtgtatctacaacctcccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaatagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgtcgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttgagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgctcgtccagaggcaagcatcgccaagggttatggaacagaggaggtcatcgaattttgcgtagaatttatcgaagaccttcgcccaatcggggtacctgaatcacgccatgaagggagactacggggaaagggaactctcggaaggaaagcaataatgacggtagacaacaatttattccgtaaagcccatttcactgttctgcaacactcttcattggtagctccttacatcgaggagcacttggctctagttcgcgccaggaacatcggtaagtccgatgcatggattacacggcatcacattgatactttccccgcgtggctacgacaacatctcatgggtaacgagtcgatcaaccaacaacttgccttcctggcgaggggaccgtctgggtctatcgcgacattccagggatatgagatcaatgggtacacattctacacgagagcccaagacatgaagagcatgaaccaaaacagcgttgttcgtgtcgatgccatgggacacgatggaacaactgccacgtattacggtgccatcgaggacatatgggaacttgactatggtcctctcaaggttcctctgttccggtgccaacgggttaggttgactggtggaggcgtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcggttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacattaatatcttaattagagtttttaccaatataataatatcattcatatatatgctaagaatatatatatattggaatttttattaattataagtcatatatttgcttattacgatttatccacttaatttattacagacaaaaataatttttcgaagtaattgtcatcaatctttgtactttaaataatgttaatgcattaacttctattttataaacacatatgtaagcgaaaatcatatgcagtgctataatctttagtcccggttcttaaccctaaccgggtttaaaaagaatttcgaaatagcgggaaaagatatttactcccggttgttgagaacaaccgggagtaaagatccaggggtatatatattcccggtgcgccctcgtcttcttcaccaacacttaaaagtttggccgatcgatctctctcggcctctgtccttcgccgccactgcctagggcaaatccccgcgccgacgccgccgtatctcgccgtcgtctagagctagtcgtcctggccgccgcctccgcctcctccgctgccgccgcatatatggggtgagagcccccgcatctcccttcatgcatctcgatctctccgatctcgatctctctccgtcgccttcaacgtcgtcgcgttcgacgccgccgctttggacgccgcgcaacgccgccgccgcatgccaatgccacgccgccgccgctgtcgccacgccgccgccgctttcgcagacgcgcgcgcaataccgccgccgccacgccacgccgccgccgccacgccacgccacgccaccgccgccagggccccacaacgccacgccgccgccgcggtcgccacgccgccgcgccaaccgccgccccgatgccgccacaccgccgttaacgaacgaaaacgagaacgatcgaacgaacgagagccgagaaacgaacacgtcaaacgtacgttgccgcgacaacgtgaacgagaac

SEQ ID NO: 66776 - DNA, 17695 bp, Oryza sativa
ccaaaaataccatcgccgtcaaggtttcgtccattttgcgccattaaaacacactgttcatcatatagaacttaacagcacggaatggacggaaacctaacggcgatggtatttttgagacaaagtcgtttgtacgatggcatttcttgaaactcacacttgtcgatggcatttctgggatttgaacgcttgtcaatgatatttcttggattatctctataatcaaagagtaaataattcaaccaaccaagtggatttaatgaaaaataatggcatatgtggtgcataatcctagttgataatacacaaaacaaatttaaaacgcttgaaaactacaaaaaaaaaaccataaacagcatgaagccaaaggtattgctcataagaaaagagcacacatatgtggctattataaaaacaatggcagccaactgcattataaaatatatgctaaacagttcttattctctactattataaaatttgaagatgtttttgccagtagtttggtacatcatccgtgtatgagtcagtttttaagtttgttcgcttttgaaaatacatatctatattagagttggattataagtttgttcgcttttggaaatactttttaagaaatctttttaaaaaaactcgcatgctaatttgacatgattttctagaaaaatatatattcaagcgaattctcacagtgaatttcacagtgagtaataataagattaaatagcattcacccgttgtaacacacgggcacttttttctagttaacttcaatatagaaaagttatagtataagctgtaaagttcactgtttgcctcctctttgaagtgcattataccaacctttataaaaaaaattgtgtaattactaaaaagaggatttgaaaggtattggacacgtatccactcacatagtgcaaaaactaatatgcttaaaccctaaaggacacgtagtaggccacacctgaaaaatgggttttaaattgccaatgggcctcaacccaaagatagccatttaacgatagccttaaaataatcgcagcgccgtccgtcgtcgtcctcgccagttcatcttctaaaatttcccctttcgtactcatattaaccgccgccgccgccgccatcctcaaatccagagcaagaaaagaaacctaatccaagttcccactcatttcacctttgacaaaggagagagaaatcactttcgatcatagggtagtttcatatgtcaatgagattaccttgaaggaagtggtgaaagaaggcgtgatcccggcaaaagaaatcatcggatggcgtccagcccatggtgaggagttcccgactccaaacaccatcgagattgtggtatttacccctttgttctctagtagcttctgtcttccgacatctaaattcttccgtggtcttgtttacttttatgggagtaagatatatcatcttaaccctaattttatcaatcactttgccatctttgttcgtctctgcgaagtatttcttggaatccatcctcatttcatcctcttccgtggaatgttttacctgaaagcccagtcgactaaagaaaacccttgcatcatcggcagctcttgttatcaactacgtggagctctccgcaaacgcaaagactatttttcccttcttcgaaaacttgcaagaaaggctggcattcctgtatggctaccttaaccaccgcggctttcgtctcgcacaattaacatgtgtccagagatgggcctagcgagcaactcaaaagctagctcgagctgcctcgttctgtctaacaagccaatcccatcgcacagcttgcgagcgattctaaacaagcctagccgaatgagctaacgagccagttatttttccagccccagcctcagccttactctccatggttcgatcgtgtcattgcttatcctgaaccataataatgttctgatagttttctgctcattcccaacgaattgggcgtgccaaagagcactgtattacagctttagcatttgcataatatgccaagatctgtggtgttgtagaggaggagaataacaatatctacgcgtgacacccatccactactatagaaaagaccattggttccggttgggaacaggccgtaataggcgtcagatttctcaactggcacccggtatacggtgctgatgacttcgtcaacaataccggttatagaacttccaaatgaaactaaacagcagtaaaggatgatgtcgacggggggctacagcattgccacgacgaaagcatccaaaagcctctattaacgatgtgcacatcgcttgacacactgactttaccttctcgggaacgacacaattcgaggttttctgatgagtcgtagattctgcttaggcatcaccggactcaaaaacatttgacatggagcactccatcaaatctgaggagcacaaattgcaatcctgtcgccaagagttaaacaggcggtctgcgttcaacccgaacggagtgctcaacattgttactgctacaagtaaatttagaagaagtccccacaatccagccaatttcaaacatggtcatatttggatggaaacaaacttctgcattgttacatccagccggaacataatagaggaattttttttaagagaagcataatagaggaatttgaggagatgacctgcaagtgtccccgacgactcatatctctgcatgcctggcctcaagcatcaatctagcatatcctgcaagaagcaagccttggaatctacaccgtaaaccaacgctagcactccaagtataccagcatattaagttgtgatccaaattcatttgtacataataaaggctagcttatgccggagcgaagcgtagggtttgtgcatttggggatgcccgggcccatcgttatcctttagggtttcaccttcatatataccttttgtaagccgttgttcagctgtaacctcatcctaatatagtgaagatattttgatggctggcacccgtggtgttttttcttctgctttggagggttttccatgttaaatctcgtgtcttctgtcattgatctattattatttatcgtttatttgcgtatcgttttctaacacctttgtgttgcaggaggagaagaacaatgaacacgtgacaccattcactgcataggattcaggccgtgttaattaaatttcaacttttttctacaaacttctaacttttccgtcacatcaaatgtttggacgcatgtatggagcatcaaatgtgaacgaaataaaccaattgcacagtacgactgtaaattgcgagacgaatcttttgagcctaattacgccatgattggacaatatgatgctacagtaaacatttactaattaggcttaaataaattcatctaacagtttatagacgaaatctataatttgttttattattagtctatatttaatacttcaaatgtttgtacatatattaacatacgatgtaaacacagaagaaaagggagtatactgcatggtggataggaggcgatacctgaccgaaatttgtcaactcgactgtcaaataaacagtatatctttgacgtttcttatacgcgtgagattctttatttcggccgccaggcgagccgatctgcttctctactagtactactggtgctacattcttactgaaggtgtgtttaggctgtgtttagtcccacgctaaaattagaagttcaactaaaattaaaaatttaaagaaaaaagttaaaagtttatatgtgtagaaaaattttgatgtgatagaaaagttgaaagtttgaagaaaaagttaggaactaaacaaggccttagttcacgtcaaaatggaagtttgattaaaattaaaacgatgtgacgaaaaagttggaagtttatgtgtgtagaaaagttttgatgtgatgaaaaatttgaaagtttgaagaaaaagttgggaactataccaggcctgagcgagtaatgctacattagtactattctctcgaatctatttatctattaaaatactttctcgtttctaaatatttaacaccattgactttttaagcacatatttgatcgttcgtcttattaaaaataataattacttaatttttttaataagacgaaccgtcagacatatttaaaaaagtcaacggcgttaaatatttagaaagggaggaagtattaagttaactgggagatgatattgattggatccagagaaattgatgctccaaacgttcattctcagtgttagtaaagtaatgaatttaatggatggcgtgatagtttcagctatatatggaccttatcaagattgatttgcacagtacaagattttggatatatataattatctcaataatagtatatgctataaggagcgagagagatattcacaagcattggttgatggtaacgtctaacagaatgctgccttgtattggcaaggtacattcttttcttttttaattaatcatccgtatgttcaatttgatttgcatatacgtatatgctttaattggagctcatcctaatatttctattccgggattgcctcggtatataagaatcaagtttcaacatcacaatatctatcaagtgcttattactctcttcatctatctcttcatctatttttgataggcatatttctaaatctgtaaaaaaaaaattgataggcatatttttaatccaaccacctgtcctcccaatgactttctcgaatttaatgcgtgactcttcattctttcacgtaagattggctacatggatatcgaaaaatgtaaatatcaatgaatcgcttatttacgaggaataactagtagcatgtttaaatggatgatatgtagaatttcttatccttgatcattgtattacgatgaaatatgactatgaaaaataaatgatcattgtattaagatggaatatgactatgaaaaataaatagagggagtactaattaacttgcttccataacccgaataaatgtcatcacataacaactgtgtcagagcatctttaatggcccacaacaaaaaccatataaatcacgccacataccccatcaaataaaaacttttaagttactcgggggacaacatccacttatttattatacatgctaaaatgaatataaaagaattgaaaagatatattatttgtacttcgtaatattccacttaaaaaatatgcaagtttttttaacttgagcttctaataaaaacaacatattgtaccatatataaatatttatatatacaagttatagtttaatttattttttaattgaaattaaatctcgtagtgatatatttcaagtaatatatatttttttagatttttaataaccacttagttataagatgccataaaaaagtggaccccacatccatttgtcgcaacagtcaaacctcagcgcaacgatcttatgatcagcatgcaacacgagaatgctttacgtccacactgcttacactgactgacacatcgacgttgccacgcacatgacgcatgccactactcatcgccaacgtccgatatttcgtcgtcgtcgtcgccgccattcgcagcgcctcgcggcgacggcgagcacaccctcgccgccgtgaacaccttccccggccggcagaagtagcccttctccggcgcgcagtgcgagtcgtcggagcacacgcagagcccctccatggcgcagccgtcgccgacgatgaccgggctcgccccgccgacgccgagcacctggtcgctccactcgctggagaagacgccgtcgggatcgaacctgtccttcaccctcatgaacttgccggcgttggggtacctggcgatggcgccgtcgaaggcgtagttgcggttcttgccccagtgcggcacgccgccgtgcttgcgcagcgccatctgctcgacctcgtcgaacacgtcggcgtgcgcgcgcggcgcgccgcgggcgtagctccggtagtaggtgacgtcgaagtccaccgagtcctccgccttgccgaggtacgccgacgacgccgcgacgtagcgcatcagcaggcccatcttggagtcgatctggcagaacgccgccgggttgaggtcgcggagccgcgcgacgtcggcgacgaacgccggcgcgcgcgacagcgcgatgctgaagccggagttgtagaagaggtgtccccggaggcggccgttccagaggcaggtggaggtggggatgtgcccgtcgtcctccatggcgcccgtgcacaagctcgacgcctggatgcggtgctggtagcccaccaccgggtaccccgtgaaggcctcgccgtcgttggtgagcccgtagttgaggtgctcgagcgtcgccggcatcacgcgcgacgccgcgcaccgggcggcgtcgctccctgatctctcctccagccactcctccgcgagcctgctggcgacgaggggtagcgtcggcgtcggccggaacgccgggtagtcgctgcggccgtcgccgggcgtcgcgacgtcgacgcggtcgtcctcgcggtacacggccacgcgccgccgcggcagccacgccacgtcgccgaactcgtggaggcggccccacgcggcgaccgtgtcggcgacgtccgagtcgttgcgggtcacgaacgccaccgaccgcttgaacagcggctgcagctcgagggtgacctgggagatggcgccgaggacgccgagggagaccttggccgcgtcgaggtccgggtcgccggcggcgagctccctcaccgccgcgaacccctcgctcgccggtgccggcgtcacgatcctcatccccaccacgtactcgtgcacggcgctccccttcccccacagcgagctcccgtgcgcgcccgtggcgagcacgccgccgatcgtgaggcccgaccagtacggcgagtgcggcagcgcgagccccgccgcggcggcctccctgatcaggtcacgcatcaccatgccgctctccaccgtcatcagccgccgcgccgcgtcgacgcgcaccgcgcggtccagccaccgcgtgctgatgacggtgccgtcctcgccgccggggcacgccagccgcgggaagctgttggagtacctggtggcgaccttcaccttccgccccgccgccaccgccgccgccacggccgcgacgagctcctcctcggtgcgcgggtacgtgacgttggcggcgcggcagatggcgcggtcggagaaggagccgtagatgttcgtcagcgtgcagccggacgtcccgttggcggcgcagaccaccggccccggcggcggacggtcgccggcgaggtgggagacgatccacagggcgagaatcacgaggaggccggtcagagcttggaggagaatgacaaggagacgtctcaccattgttgcttaacttggtggaagctctgagtttgacctggaaagtttgccgggtagctgcagcttaaatcagcaagcttcagcttgcccacttcatttctgtcggtggaagcatcagaattcagaagttcaccagatggagtactattaatattcagaagttcaccagatggagaggaacttatttccgtcttgaggccagaaccttctgcttgaaacatttaataaacggagaagcgttactttgtacgcaaatcgtacacacaaaatcgtacgaaaatcgtacacacaaaattgtgaataatcgggaggaatccctttttcaccggttctgggactgcccatttgctaggtggatttggcagaaattggaagagcatcgaggtgaggacattccacaaccgccagctgaatgcagaaacaataaaatcttatctgtttggctactggatcaactatcaatacagacacaagaaatctcttcagtgctgttagttacaatctacattatgtggtcagcacggaatgatgcacggaatcaacagatcccaggtaacccagacaggatggtggagagaattttgttcctcctggaagagtgggcaagtttgtttgaaaaatctgatcatactgttcctagtccgacaatgcactggaggttgccggaatcaggatggattaagctgaattcggatgggggatttgctgcagacgaacagatgggaagtgggggagtgatagcgagaaatgatcggggtgagtttatgggtgcgagcaggattttcttcagggaagtgttaagcgcaacgcatgctgaagcattggcttgcctcgaagcgacgcgggtgggtgcaagacttgcagcaaccagagtagtcttcgaaacagactcagctgaagttgtgagtttggtgatgaataaaagttttgatcggtctgaaatcgggcctgtaatccaagaactgaagaggagaattcagtcattccaggatttcaagctcatatggaccaggagatcggcaaataaagtggcgcaccgtttagctaaggaaagccttaacgcgcgtgcttcttctagctggatagtgtcagcaccggagtttttattttctctgttatcagaggactgtaatctggatgctgtaatttgagtttttctttgctttccactctcaaaaaaaaattgtgaataatgggaaacaaggttctgagaagataaatggctcggaaacgtggcttttaaagacaaatatccatctttatacgctattgtcagaaagaaaagttctactattgtcaatgttatcagatctattccactgaatgtttcctttagaagagttttagttggtcagattcttgcatattggcataaattgtgtgcgtctattgtacatattcagttgaatcaatcctccgattgttttagatggaattattatcagaatggtagattttctgttagatcaatgtatctagctctgattaataatggttatattgagagaaataagattatttgaaagcttaagatgtcgcttaagattaagatctttatgtggtacttgcttaaaggagttgtactaactaaggacaaattggcaagacgaaattggaatggcagtttaagatgttgtttttatatgaaaaagacaccattaaacatctttttatagactgccattatgcaaaatttgtttggagagctgtacagttctcttttggtttataccttcctattaccatatctaatatgtttgatagttagcttttgaggtagataagaagatgactaaactcatacttgtaggagcatctgccatatgttgggctctgtggttgagtaggaatgatatggttttcgacaaatcaccatctatatcatatatgcaggtaattttcagggcaacttattggctccggttttgggcacagctgcaaaagtgtgaagatgatggagagcttatgaaagttgcatgtcataggcttgagacgacggttatgcaactttttacaaactatggatggagatttacaaacagacttcaataaatgtgttctccttatctttgtttggtctttttattttattggatgtgtttaatttcgtttgaactacatcttttgttagagtgatactttgtaataattggctgtagctctgatgagcaaaggccgggatgtttattccattatctaaaaaaatgtatagcggtcctctcaatgctagacacttaattacactcgctcacttattatattgctggagtccaaaatactcgctgatgtatccctctgcatttagagtttgtttggttcttggccacgttttgccaaacctaagcttaggcatgcaacaagtgcttaggttggtgtttgcttttctactaaccataggcttgccttaacttgataggcatgtttctgcttgctcgctgtgtcttgttttgccaaatctgtggcgttctttttctctgccacaagtgcggcaactagcttaccttaggcgtggcaattttagtcccaaaccaaacaggcccttagtccgtccccctaggctcctagctatctctcctaatcctatatgtgcactttgtcatttctcgtgtttgcatgagcgattggtgttttgagttgatgttttatttatttctctatcaatgagataaggaaaatcttttatctatgtttggaaacagtagcatgtactacggaattgtctattcatcacttgagggaatatccattcatttttttaaggtctatgtgctacaccatatacgagttatatgactaggtctatgtttcgcaagaatattatattgcttaatgcctcaatggcgcatagtgcagtggtcctgtacctttcaccatctgttgaaaaacatgaaaattaatactaaaagaccagcttaagttggcctggtttcaaaaatatatacaaccaggcttgtctcaatgtaatatatatgtttacccactcagtatgggtgggcgttcagtctggaccggaattcttcattcccggttattcggtcattcagaactttggtctttcgaaacagaaaattgaggtaggcaacaaaaaatatggttgggagtgatagttcggttaaccggatagtctgtccggccttcggtttccaccgaactaactgaagcgatggtgatggcaatggcgcccacggcagcgatgacggatgggaggatgctagtggcagcggtgaccctaccctccctctctcatatccggtggtggaccgacaacggtagcatcagcagagggaacgaaagcaacgacccttcactcctctcccctcctagaaccaagcttcgggtgcatcgtctcgtcgacggcggctccttcctgcctcgaggtgctcttggcaacggcagccatgatggcatcgacgatggcgacggggggcggatctagtggcggtatggttggagaccaccggtagtggaaggagtagatggggcaccgcagtggcttccccactcccttccgcttgcctccctctcccaaatctggctgtagggggcgactagggtgtggcggcggcgatagcagccgaaggggttggtttcggcaatagctcgtccacggcagcttcagcaacctccaaggtcaccgatgatgacgacgaccagttttgatgtttatttgcatgatatttcatttgcatgtgttaatcttggatgtcaatttgaatctagatctctgaatgttgattgattttttttttccttagtgatgttgcctataaaaattaattttctcaggtgatcatcttaagtgtttgcaaacaaaaaatctattttcgtaagcggatcgcaacactgctagtcaaaatcatttattttcaatagcctttaggtaattagcggctaacaatgccgtcactaaaagccgctatcactaaaaatcagttttgaccgccgagaaaacactttatgaagtgtacaaccatttactctccccgtcctaaaatataggaaccttgtactgaatgtgatacatcttagtacaacgaatctggccagagaccctgtccagatttgttgtgctagggagtgtcccatttagtacagggttgctatattttgggacagagggagtagaaaaccagtcgcatgtttatctgaaccaagctccatacattgagggcggaatatatataatcgattgggagctttctattaagtcaattagatcaatcacaatcgcagggttgagtagattaatttatttgattattctatactatagaagacaaattataatcatttttgttgtcgaaatgataactgcatacgtcgaaagacgtggttactcaacagtggttggaaggaaacgaagtgtattgaatcttgaatttcttctttttttctggatccccccattacatggccctaggggactatttatagcccaattacaggttcttactactagggtttaggttgtacaggggaatttacatgattactcttacaaaagggacatttacaggggtacataatgttataggggctcatgggcccctgatgggccgtctggcgatcgccggccctatagcccctaggcttgatgggccggaaaggcttcttcggccctcgcgggggcgaacttgccatggcaaagtcgtcttccttcggcagatagtcttcgccttgcacctttcgcttgagacgcctctggtctggcaaggcactcgtacgactcttcgcctcacgccgttcttgctccatagccttcgccacgggtttcagcagatgtggtcgaagggtctcatgccatccgccaacaagcccctcatgggcaagggtgagattggagcttcggccgagaccgtgcaaaccatgtggtatggtatgcggcgccccctttcgaccgatgctcctgccgaaacctacattattcctgcgaatgaagtttgttacttgtgcggctattattattttgccgcgcttcgcctcctgcgattggtggttatatattttcttttcccgggccgaacggaacagtattgggctttcccttcgtgggctttttattgtgccgctcggtcggtgggaatttaccgtttcgcctacccttgcgacacgtggcgctttattactggtgggtaggcgaacggtcgcccaggtgagctatatattcccactgctctttccttttcttccacagcatctctcaacccctcaagcgtttcgcccattctctttcttcgccaccgcaaacgcaccgttcgccatggcccctcgcaagccaaaccctgcttcggcgaaagggccggatctcggccgaatcgatgacgacagcaccgcctttttgggggtctctcttgtggacgacgtcgagctggcgaagctggtcagctttggggcgttggtcgaggggcaggctttctccccagggaaagccgtggtgccgaaacctatcgacaatcggacggtggtattcgccgtcttttttgaggcagggctacggtttccctgcaacgtgttgttgccggagatccttcgcctcttccaggtggaacttccgcagctgagcccgttggcgcttgtttggatcgctatcttcgactaggcgtgccggatttccaggtttcagcctaacgccgagctcttcggcgccatatttttcgccaccgtgaactcgaagacggtgcgtcccagctggaacgaagaagacagtgttcgggagcgtgaactttaacgttcgtcccgagcggtccgatctctggccggtaaacgctgccatgtcgaagtgggactgccattggatggctaggtggttctatcacaccatccccttcgaggctggcactgactcggcgaatgcccaccgttgccgacgtagggcgatcgcgcctaaccggaaacccaagatcaccgtggacggcgctatggaggcgcggttcgttctgctgcggaaggtttgctcccgccttagctgccgtgacttattggaggaattctgtatgcttcgcatctttcccctctcccagtcatggcaagtcagagttgatcaaggcgaagaggttgacggtttgccgaacctggttcttcctgaggggacgaacagtaagactgttctcgtgctatacactgttgtgctttgttatcttgccttatctgactgttaacatagctacacactttacttttgcagcgttgaccctcgaccaggctgaaaacgaggcccgcaggatgatcggcgacgtgtcggtcatcgagtaaagccagttgctaacacgacaagcggctgggcgggcgaaccgggtttacaacggcgaattgcctcctcgggcaaacccccacaaagctgatgacgatgcagggccttcgcgaaagcgaatgcgcggacacgtgaagcttgcccctaggaagcgaagggttcctgcttcgtcggactccgacgctgacgacgaggacgacgccgaagaacgcgacggcgaggaggaaggagaggaggaagaggaggaggccgtggccgataaggccacgaacgacgcgatcgaagaccgcgtcgacacccccggctacactcctaccccaagtccctatcacaacgagaccggggtggagtcgaacagctccccccttcgacggaaggatttggaaggggcgaaggccctagttgcgttctcctcgggcaaggcggcgaagggaggtccggtgcggaaggtctctaaaaagaaaggactcgtcgacatcgcccgcgttttcagcgactacgaatcttctgacgggactccaacttcgcccgttggccgcagtttggacctttcgactgctcccctcgctctgctcggcgttgctggggcaggcggtaacgccgccgccggggcttcagcctccgccgaacggatcgtgtcggctgcggcgagggttttcgggagccctctgcgtgagctagctatttcgccgctagtcaaggcgaaggggaagtgtgcggccgccgaagcatctgcctcggagtattcccttgcggcgcccaacttcgcccctggtgatttcgagactcgggcggaccttattccctttgtggagggggtgagcaaccttgtcttgcccgccggcaccccgagcttgttcaccgaacttaatgagttcgacgaggggtgttccgccattaaaagcctggcggttcgggtatgccttttctttcgtcttcgttttcctcttcgtccccttttttttcgtctgacaattaaccttttgttcttttcgcccgctcctatctttcatctaggttcttgtggctcactgttcgacgaagcgaactgtacgggcccgctttgatggttttaagagccgtcttcgggccaaggatgacgaaataagctgcaagaacctggaggaggaggccctggccaacaccctcaaggaggcgaaaactgaagtccaacgccttcagtctgagctggatacggggaaagaggctagggccgaggttgatcgcctcaaggccgaactggagaaggagaaggcccattcggcggtgctgaatgactactacaaccttactgagccgaagatggaggctcttcgcctgaaggctagtagggctgaagcgagcgccgcggaggagttgcagcggttttcacaggagatggcgaagaccaccgaatctgcgagaacggcttgccaaacgctccgcctcgcccttaccgacatgggcgcgaaagtgcggggggtccctgctgaggatgcatcagccttcgacttctccgagtggacctagcaggctggcggatcggtttcggactgcgccagcatgtacggcgattgctgtgcgcgtgtatcggcggccttcaccttaggcccatttgcaacagttcggttgtgagcacgtcgccgaatccctacctatgtgaagggggactgggagattagggcgcaaaacatttcgcctgctcttcgcgcgtggcgaaaacagttctggcagaaagacggccggtccgctgccaaggtgcgccttctggagcaactagcgaaggcggaggcggcagatcggtgcgaagaagagggcgcagtgggcgaagaggttggaggcgatgcccgggatcacccagaggtgtgaggccctccgccctttctttagagttttgtagttttccaccctcttttgcgtttgcctggagaggcgaatgatgtacattcggcaggctaccaccaatccttaaaaaaggcttttttgtacatttggaatatatgacacaatcttaactactttttgatgatcaaagtctttggcatattattatttcgctcatctcacattatgccatacctcccccttcttccgcctattcttactatgtaagctgtgttttgctttttctgcactatccatcagggggttcgccgaaagtcgtgcatccggcccccttccgggagctggcgaagtcaaaacgagaaatttgtggcagtgaagggtctgccgaaggtgcgatgtccatttcggccggtttatcgcgaaatggagataaacggtcgcagctataaggttttcaagtttgccgactagctgcgggcgcaccccgagcgaaccttagaagattacgattttgttcattcaagacgtttggaggatatggctcgcttttggcgaaaccatcagaagactaaacgtcaggaaacgatctttcagcgtcgttacagtttagtctgtgtttcgccccctactcctcttaaggttgtgtatgatattagtagtgatgacgaacctagttcgcctgatcatgccttagggagggatagtgattatggggacgaagatgtaatttacttgtaaggtgaattgtatcgtgttgtgaaacttctattcttcgattattttttttgaagttaataaagacgtgttttatttccttttcgctattgtttgcatcgtcacattttgtgcttttgttaggtcagaacatgccggtccctttgcatatattagcgaaataggtgtactgacttttcagcttttcatcgttcgttttcgatctatagcgttctgtgtcgagagaaacgcttttgcttttatgctgatcggacgtaacgtcattcggctatttattttccgagacaagctgttgcggtttcaacgttcggcgagcgatgcttcggccgattcgtttagcctccctggcctttttcgctgatcaggcgtttgccttggggtttttccacaaattatcaatcacacgagaaataaaaagaaggcggaggacacagagattttatactggttcgggcctccatggtggataatagccctacatccagtttttttttctttttcctctctttcttctttttttttcttgccgaaaggctttcatagtgccgaagggcttacatagtgccgaagggcttacacgacagtatgcacatttttacaagttggcgatttgggtgccacccattctagtgggcttacgtagtgccgaagggcttacatgactgtatgtacatttttacaagttggcatttgggtgccacccattctaggcatagaagcgcttgagagaggcggcgttctaggaatggtcgaactcctcgccttcgagtgttgctaggcgaaaagatcctatcctggacttgtgtttgatgaggtatggtccttcccactttgattcaagcttaccaaccgctacgcggttcgccttcttccttaggacaagatggctagacatcagctctgtgggtcgaacttttttgttataagttgtcaaagtgcttgtggcgtacttgtgcatgtgctcgagcgcttcgaccctcttcgctcctagagaacataacccttggtgagttagcccctagctctgctggggtcattgcctcatcgccataaaaaagcataaacgggctaaacttggttggtcttgtgggggtcgtccgaagggcccagagaaccgatagcaattcctctggccatttgcctttcactgccccctcgagtcttttctttagtgcttctaggatcttgccatttgtacgttcgaccgccccatttgactgcgggtgcgtgactgacgcgaacctgatttacaggttaagcccttcgcacatttctctgaacttatcagagtcaaactgcttaccgttgtcagtaatgaactcttttggcactctgaaatagcaaacaatgtttttccatacaaacttctgtactgctgccgaagtgattgccccaaggggttcgacttcaatccatcgagagaaatattccacagctacaattgcgaatttatacccgtttcgccccatcgggaagggcctaatgatgtccagtccccatctggcgaagggccatattggcgcaatgggctgcagatcatactggggcgcgg

SEQ ID NO: 66777 - DNA, 9718 bp, Oryza sativa
  unsure (1)..(9718): unsure at all n locations
cctacgctgcctacggtctactgccaaacggccgcgccacaaaaccttacccacggaaacgaagacggtgaaaaccagacgacgacggcggccacggggcggggctgctccgcctgcagcctgaaggagaagagaagagagagtaaagaaaagagaagaggagagaaggagaagaaaataggagaaaaaagatgtgaagctgacatgtgggccctatgtgtttttttaattttttttttgctgactaggatggcacgtcagcaaaaccgggcaaaaatactaccaagggacctccggtgaatggtttgagtgagtttaggggtatacatttctagttttgtggttaagggaccttaaaaaatctcgctgttaagttgagggacctccggtgaacttattccttttttctttttccccaaaatatggcccatattcttctcaaagaaaaacgaggcccatgttgcgcaatacgcacactagtattttttttctttagtttttttttcttcaccagattatccccactttcttaggtcacgagatcctaacaaacaaaacaaattctaggttggtagacttctatctgttttttttaaaaaaaaatgagctttggtcaaaccagatattcaaacaacccgttgctgtctaggacttcagttacaatgacacagaaagtgaaatttacaggattttgaggccgaattcttcgagctcggtatttggcaatcgttagacaagcagtcaagcggatagtcgtgtgcatgaacatacgtgtacgggggcaagtatcttatgttggtgatgacatgggcatgatgaacagttgaggacatctgtgacgatataaagtactgtagtcctctcaccgtaccaaggctttgttcatgcgagagaagaatatttgcgaaacgagaaaactcattaacacataattaattaaatattaattattgtaaacttaaaaaagagatttatttatttttttaacaacttatatatatatatacacacacttttggaaatgtgctaacgagaaagttgaagtttataattggagtatagaatggagcccatgtaggcaatttctgtgcaagaatccggcattaggttcgtgtttctttccaaaaataccgagtcttttgtactgtctagcgtagcaacttactacacactgaggttgactggtcaagtacatgtgcgagttttttaatttttaccccctttgcaagggaactacataatttgtctgagttagttaacgcatttaaatggttgaattgctatagggagacagctaattcaacacacaaatgcattgcctagctacccattttgttgacagatgcaatactagacatgtagatgtagtcaactatgatttggaatgaactatatagagttaagtgtttgcatgaacactttagccatagaaacctctagctaaagagtaaatggcatttgatctttttgctagtgggaagtggctagaaattatttatacggtctactttattcaattataattaatttagaaacgtatcctatgtacacaagttttccgtacgcaccaactagtaaatgtcgtaaaaaaatatataaaaggttggactcatactttcaatagtattacacctatgtgtgaaatcttatcttaaaactattatatttttcacttttttttgttacgactaaaatataatgaatttgaatacgagactttgcatatatgcctaatactattagaatacatgtccatctttttgaaaaaaaagtcatgatatttgatagttagtgtgcacggaaagctcgtgtgtacagtatatgttcccaattaactaagagtgtgttagaatgtgagtttgggctgggctaatacgcacttaccgtgagcacgcttcccaaactataaacaatatgtcgcgtgtaaaaaaattatataacagttatattaaaaaaagataaaccctttaatttagaataatcaatacataattaatcatgctctaataattaatcatgctctaatgactctcctctttttcgtgccagtattcagcctattcttctttcccaaatgcaacctaaatatcaacataaaataagtctgggcataatcactttgagtgtgagctagataaactatgtaggtaatgacatacgagtaaagcctaaaaataataaacgccaaacaaaaaggtaattatatgtgtagcatcccacctacaatacaggcaactaacctagccacccaccaacaaaatagatggtgcgagaccgacaaaatgcaaagcgccagtagcctcagatgctagcaacaacggttagtgttattgtcagcaattccaaaaggcgattgacgtagaaagtaaagttttaagtacacgcaagcaagagataatcacaacacaataagagtaatgtgtgcgcgcaccaactttcctatcagaaaacaaaatgctccaagatataccttttgctacacaaatatcagtatacataccaaactatcaacgtacatcctacatcctgtattgttctacatcattccatcatatatataataacatggaaatttcatagtaatatggagatgttctggaaaaaagttataaaatggagatgatcaaaatggctaaaacctatgtagtgcattcaggtaggaaaaacaacccaaaagaaacttgtaagaaaaggaaaaaactaccctaccctagggtacgcatagcaattctcctaggaccctagaagttgccgtcacctaggccaacgacgaggctacgcaccacaagcccattccggtcatttccccctccccaatccttccacccgcccatccctccccgcacatatctcaaaacgagggaaacaaacccgggattttgccataccattctcggggtggaaaggcagaggagggaggaagcggttagggggtttaaaaagggggatgcatgcaacgccttctcccccactcatctccacaccacggacaaagtagagggaggagaaaaacaaaggtagcaaaggagccaagaaaagcttagtgactaagagataaaaagggaaaggggagaaagagagagagggggtggagagcttggcggtgcgaggtggttggagtggggcacgcacgcaacacatgggagaggagggagagagagaaggatggaactagcggtgaaggcttggtggttggtcatcctagggtggcagtgcgccgtcctgtcatcgcaggggggagaggagagagagaagggtggagctagcggcaaaggcttggtggttggtcgtcctacggtggcagtgcgccgtcctgtcatcgcaagggtcagcgaaggtgaggccttgtttcctctaactcaattatgtgaacaacacagtttttatgtctataagacggtagaggtaggcattaaattatattgcacccatatcaaaccaatgtgaaaggggtggggtcagcaaaggtgagagtaaggccttggttccctaactcaattacgtgaacactgcattttaactcaattatgtgaacattgcatttttatgtccattttatgtgaacggtgcatttttatgcctataagatggtagagacattttttggaggcattaaattataccacaatcataccaaaccaatgtgaaaaatataataaaatattttccttttctattaccaatccttgaactcaagaccattggcaaatcattttatgttcaatacgctaaccaactcaatcccatatcattacttatatgtttgtgcattgtgttacttatatttagtcccttagtgtacattatcattctaagaagtgtctctaaagagtttaaaatgtctcaagaaaatacctttacatattagacacatttcaaagtactaaaaaaatgcctctacaaaatgtctctaaaaaaatgtgctgaaaaaatgtctctaaagtgcctctagagtgaaatatttttagacatttttcatgtgcctctaaaaagtgtctctacactataaaactcatggttttagaggcaattagcaaaacgcctctataaaagtgcctctacatgagatttttgttctagtgccatatcaaagtaaagcaagtccggtgataatcacttcaactatgaactagataaagtatgtaggtaccgacatagaaatgacaatgaaagcttaaaggtaagaaacatcaaacaaaagataattatgcatgtagcagttcacttgcaaaataggcagctagcgttgccacccgcaacaaaacaaatggtgcgagaccgacaaaacgcaaatcaccagcagcctcggttgctaccagcaacggttagtcttatcgtcagttccaagaggcgcttgtcgtggacagatgtaagtacacgcaagcaagagataagaacatcaaaacgagagtaatgtgagagtgccaactttcctaacataaaaacaaatgctctagggtatagctcttctcgatgaaaaatcaatatgtgtaccaaattactgatatatacatcgtacattatctagtaaatttatgttgttccatcgtgcaaataatagtatgggagttttatggtaagacggataatcacatacgaatgacgagtaaaacctaaaagtaaggaacgcctgacaaaaggtaattatacatagcacccacctacaaaacaagcaactaaccttgccgcccaccaacataacagatggcgcaagatagacaaaaatacaaagcacaagcagcctcagacgctagcagcaatgttattgtcagttccaaaaggtgcctgacttggaaagatttaagtacacgcaagcaagcgataaacacatcaatacgagagaaatgtgagagcgccaactttcctaacagaaaaccaaatgctatatggtatagctcttctcgatgaaaaatcaatatacatatcaaattaccaatatatacatcgtacattctctaatagccttgtgtcgttccattgtgcatataatagtacgagagtttttatggtaatacggagatactcttgaaaaagttgaaagcatggagaggataaaaatggctaaaacatacttggtgcattgagattgaaaacaaccgaagagaaattattttttttagaaaaaaagtgaaatatagcactaccctgcctaccctaccatggggttcgaatgcgagtttgggttgggctaaaacctcgcttactgcgagcatgctctccaaattgttaaataacacatcgcatgtaatatatatatatactgaatgtagcaatccacccacaaaacatgcaactaaccttgccgcccgctaacataacagatggcgcaagaccgacaaaagaacaaagtattagcagcctcagatgctagcaatagcggttagtgttatcgtcagttccaaaaggtgcttgacgtggaaagttctaaatacgcgcaagcaagagataagtgcaataaaaagagaaaaaaaataagcgtgcgccaactttcctaacggaaagaaaaagctccgagatcgctacaaaaaaaaaggtacacgtaccaaaccattaacacatgcatcctgcatcctataccactctatatcattccatcatatataatgataacatgaaaatttcatagtaatacgaagatgttcttgacaaaaaaaaaggttatagcacggagatgatcaaaatggctaaaacctacgtggtggtgcattcagatcagaaaaacaacccaagagaaacttgtgtgtctaaaaaaaaacaaagaaagaaatgtcactaccctaccctggggtatgcgtagcaactcccctgggacccaggcagaattccccctgccgtcgcccaggccggcctaggaacggccagggatcacaccgtacattaacgacaaggcccctcgcaccccacaggcccatcccatcccacccgcccatccctcccgcacgaatctcaaagcgggggcaaacccgggattttgccgcgccccattcccggggcggaaaggcggaggaggcgggcgagaggcgaggagggaggaggaagcggttcgagggtttaagaagccttctcccccaacctctcctcggactcaaagcagagagaggagaaaaaacacaaaaggcagcgaagcggccgcgaaaagctcgactcggagataaaagggaaagcgagcgagaaaaagagaggagaagcattggtggcgtgaggcggttggagcggggcacgcgcgcggcccaaggggggagaggagaaaagaagccggggtggccccgacgccggcggcaaaggttggttgtcctagggttcctgtcgttgctcgcgggaagggtcagcgaaggtgagggcctttggttacccctaactcaattatgtgtgaacagtgcttctccgtttgtgctctgtttatgtgtgtgtgtgtgtgtgtgtgtgtttattgaggctttgagtttttttttcttgagggggttgcttttgctgtacaggagaagatgatgtttaagtttaatttaatttaatttattttttttactcgctgcggtttgagcgttcgtggagtggtatgtgttgcgagcacacgggtgggtttgtggttatgaatgtgtgtgtgtgtgtgtgtgtgtgtgattctgtgcaatgcttgatcaggtggcgagttcctcacttcggtatgttttaaatttatcctttttcgggcttcgtttgatgttgctctgcggtctgcaccctctagcttggtttaggcatgagattgtatgcaaggtgttttctttttaaccaatttcgtgatttttgggctagttggagacttgtttctgttcagtaataagtatttggggcagtaaacttttcttttttggaagatgtaatttctgttttcgatgggcgaatgtgtgcgtgatctcaccagcaagtccccgcctttggtgtgcttcacgtggtgtcctccatggcctcatggggcaggtttctctaggcggtggattttatctgctgtgctggatcacaaaaaccatgggtaaaaactaaaaaatcgcatttatttggcattttgctatgatgatttcgatggttaaagttcttgagttttttttttctttttgggtaatggagcttgcatatttgcttgctttgtagcattacatgtgtagttagtctgtactcgtataggttctaaaattgaactgaacttacagaattcagttgagaaattatcactaaaaatgatcaccttttgttgtccagcaaaatggctacagagagtgctcggccgttgagtggaggaactggagcagggaagtggccaccaagcaaggacacgggttcctatgattctattccagctagcctttcagaagatgagttagcggagttggccttcatgccaaatagtggcggcatttttgggaagtggaggggttctgtcctggaacgcagtggaagcgctcctcctaccatggaaggttctttagttgcacttggtcacctcacaggtcaaccgagtggcaaccttggggccatactgccaaacttgggcactgaagctaacaattcagagtctaaggagaatatatattatgattcggcatgcgtcaaatactatatgtccaaggtgaatttgaacccaaggtttcctccaccactcgtttcaaggaaccagtttggcaagtctgaagaacgaaagccgttctcccttgatgacagcagcagcaggtccttacttcttggtcatcctactctgccaacacacaaggaagaacctgaggacgaaaagtcaccaagtttggattcaagttcagcagacgatgctcaatgtgattctgcccaaagcacatctaacttagggggccacagtccaaatcttgtagattcaattaaggtaattcccgtattaattcaagaactagctctgattgttttttccacatgcactcaaacaaacttcgtggcgctgttcggttgtgggttttgcagcagctgcacctggtttctgcggctgtggtgcacagctgtggctactagtagcagctgcagccgcagccaaaaaaatggcagccggagaaggctaatgttttcatccgtgacataactccatctttgtatcctcaaatattaaagtcaagaaatctttatgcacggctatacagtagcagtcggcttcacagaccacaagaatggcagtcagctaagacttagtaaggtgaaataatacagtacaacatatgattaatgccccctgtgatatacaaacaaacatttccaatattcagtggctaagacgttttccaaaaactcacttatttgaaatagtaactggaaattctgatttaaactaattgatctttattatgtagtatctgctaaataaaatcaaaacatgtttttgtttcaaggaaatgtgatgggaatcgcactaaaccttgcaattccttaatacaagtacgacaagaaaagaagtattgattgtactcctccataaacattgttatttaccaactctcatgcatgcagatgaactccctaatatcttataatcatgttctgttttgctacagagtttgttgctgcagtctgcagatacttattgataatgatttctttttgtttaggaaaactttcatcggagcaatggtttgtatgataattcttccgatcttttaaatgcaaactctggtgatggagggtcgatttattctggcattagttcattgaagaattcctcactttatgttgtccagtcatcagacttgaatggatttccaccagatgctcatcagcgttcccctagacctattaggactccagtcagtacaaaacttactagcgacagtctgccagcttcatctcctcccacttcatcctgttctgactacagtactattactgaagcttgtcagcaaagaaatccaagcatggccgttaaacctggtgaaccagttggtaccatgcttgatagttcagacttcagtctgaagaatttgaatattagtccggatatcctaagtagttcatatgtcatgcaacagtggcagaaaaatgccccagtgtggaatggcctatcaaatgtagtccatggcgatcatgtgccaatgattcctccaggaattaatcttcctcaagttccatttgtggacaattccggttttggtcatatgaagttccctggtgatgttcaactgatgtcccagatcgggatggcaacacctttttgtacaccaaattcttttgggataccatgttatcctaatttgcagtcgcctagtgtttgggttcctccattcggaatcggcggctatggtttgcctggtccatttgtcccacctgttataactaacttcactcctcaacttcctggttttccttcagcagtaaatcttgctgcagcaactgacttatttcacccatataagatgtatgagcatcttggggtacctatgccatcccctgttcctgatcagagccttacgcattattttcaacagccccctatccatccgtatggtgttggaaatccatatgatacaatggtttcaagtaataattttgtagggaatcctgctggcgtttttggttcaccaatcattcacccatcagagcagaagtttcagataccggttactactgtagctgctaatgcctctactcccatcaaaggtggaaaggggatcctctagagtcgncntgcaggcntgcntgggaggngttntcagtcaatcaatgacac

SEQ ID NO: 66778 - DNA, 11321 bp, Oryza sativa
  unsure (1)..(11321): unsure at all n locations
aggtgggttagaatcatcntcacnccagcacgccngcaggtcgactctagaggatccccgcaggtccaacattacatgggcaacctgcttctggaacatctcctcgtgacaaaaggaacgatgtcaagggattccaaccccctcgaaaaaatatgcctgttagttccgagatacaaggtcagaaagggagggagaagtttgatgatcccaaggcacacttttctgttgaagaactaatatccagcagaactcatagggttgagctggctgacatcaaaggacagatagtgaaatacaggttagttttgattttggttgtttcattcactatctagatgcacataacccaatgaaaagcttgagatattaattgttattatgttcttgtcctcagctcggaccaaaatggtagccggttcattcagcagaaactggagaattgcaccattgaagaaaaggatttactttttgccgaggtccttcctcatgctttggaattgatgactgatgtattcggaaattatgttattcagaaggtatagtatttccttttcttatatgattcattttatggtaatttttttatgaatagtacacctattgaacttgaacaattgtacccccttttaagatattacagtatcatagcagcaattatgaaaaataatttatatttgtatgaaatgaaaataacatgtagtacatgcagttcttcgaaaaggggagcccacagcaaaagagagaaatagctaataagcttgccggtcatgtgttttctttgagccttcagatgtatggatgcagagtaattcagaaggtagtcttgacttctttatgggaagtataactttatttctgcttaatgttttggataccatatcatgaaaaccttttcagtggcacactatagcatgtattgtctgaggcggtctgagcaaattttcttcacactgttatgctatccatagacttatttattctcaatatcagttggcaaagtattatctgagtaaaatttcttcagactgttattctatccatagaattgtttattctgaacatcagttggtaagttttaaagtggttagcctgtgggacatcatttctcatattatgcatggtaatcagcatacattcttttaataagttgcaatcccactgtagccagctattcatggattagcatgtgttggaaatgaaaaataatgtgacttataagttgcaatcccattatatcccgttattcacacattttacttgctatattcctggagaactcattttcagatgagttttgtgttattctcatatataatggatacatagaaatgctctcttactaccacacacagactaagtggttgcacattaatgtaattaaactgaatcacaactaaaaagatgaggaacacacaccagacaagacaagtagtcaatgtcaggttatgtgtgttcgcattttcatcattcgtcgtaagtttttattagcaattatgctatttagacagtcttgtgaattgtttgttgacactgctacactgtcttttctggacgttatcgctatttgaactcaaatgccaatttcactgcctacttcactgctacaattgcaggcccttgaagtaattgatcttgaacagaaaattgttcttgttggtgaactcgatggacatgtgctgcgatgtgttcatgaccaaaatgggaatcatgttatacaaaaatgcattgaatgtattccattggaacatattggttttctggtgtcatcttttcagtgccaggttgccaaactgtcaatgcatacatatggatgtcgtgttattcaggtgaattggtaacgatgttgtatttttgttaatttcttgtcattttcttgtggtgttgatcatattcacattctgcttggcagagaatcctcgagcgttgcagcaataattctgaatgcctttgcataattgatgaaatcttgcagtctgcttgcatcctcgcacaagatcagtatgggaactatgttgtgcaggtgattttcttcttattctccaaaacttagtggctgatttgactaaattttcattaatataaaccatcagcatcttgttgctgtaatacggatagctattttgagttagagcaagtgtaacttaagtagctgatgttgaatttggcaacctgcagcatctttgcctttattataaccatgtgtattttgcagcatgttttggagaaagggaatgaacatgaaaggggccaaatcatcactaaattggctgggcaggtagtgcccatgagccaaaacaaatttgcgtctaatgtcatagagaggtgttttgaacatgggggcagtgcagagcgggaacttttggtcaaggagattctgaagcaaactgagggcaataactatttgctggtatacattattactgtaactcaccttttgttttttttcctttgccattccatgctcttttgagccaaatagctaaaagctcttgtttgttcaaaatttgactaatgttaaactcaattaaaagatatggtaggtaccttcatgatccaaataattgagtaggagttttacttaaattgaaacatataacagaagcccgtcattttttttggataacagaagtaatcctcataaaattctggcgcggctactgtttctaaggctacttggtgcaatacaaataacggtgtttccagctatttttgtttcgttatttgtgttattagtctaaatctttactcaagtaagcgatttacgaattacctgcactgctatacaggtgataatgaaggaccagtatgctaattatgtggtacagaagatgcttacaacatgcaatgaacaacataaggagatccttcttcagtcgtgtgaaaatccatttgccattattgaagaaatacacctatgccaagcacatcgtcagcctagtcgagcgcctctgcggtgacggggagtcgtccgcgtgccactcctccagccctgctaaatttctcctcctgatcctctacttcaattggccccaaaatttactgctcccatatatgccatttttcaggagctgtgcagtccgaatccaaaaaaactgtaaccaagggctgctgaattcgccacaggaaagccgactcttttctgccaaccctgtcaagttcagcgtagaaggcctatcagtcgcaaaagtggctaacaaagcaaccaaaaaaaaaaactgtcaacctgtcaccatagatcatcatcatacagatatagtcgttccaagcggtttgtccgtgtatttaagctaggaaatgatagtgtcatactataggaatggtaataatcatctgtgtgggctgtggctgtggatgctgcgtctcacagaagagagtctgagtgtggtggtgcgttgccgtacagtacatatcccgtagtcttgagtcttgtacccctgcttggtgatgtgtagttatcgccgcatccagcttgcttggtcacttgcttctgtgtgcttccgtgcttgctcactggtgcgcgtgattgcgcctaccacctcgcccggatgcaaatcctctacagcactgtcgatgtagtaacaatggctgacatgtgggtccagacccatacgttaatatctagtgcatgagtagtactgcagacaatcccggccggcaggacgatctctcctactcccccgtcctataaaaaacgagtctaggaccggatgtaatatattctagtacaatgaatctggacatatgtatatccagatagtactatatatgtcacatccggtactaggtgccggccaatctctcctactccctccgtcctataaaaaaacgaatctatgaccggatgtgacatattctagtacaataaatctggacataaatctggacatatgtaccggatatgacatattctagtacaataaatctgtaccggatgtgacatattctagtacaataaatctggacatatgtatatctagatttgtagagggagtactttccatttcataatacaaaatgctttgacttttgtaagtcaaattttcttaaatctgaccatatttataaaatattatagaacatctataatactaaattagttttatttaatctagcactaaatgtgtgtttttttgaacactaaatgtgttttgatattgtattgaaagtgttgctacattattctataaatttttattgaaattaaagaagtttgactttaaaaaattcagaacattctaataatataaaacagagagagtacccacgcagccacaagcttggaacggagatttgagagaaatttcacaggatttgatagtattcacctgaagatcaggtagaggtacatgccaacattttcagccattctcgtgtgtaaaccccacggttaacacttagacaacatgtaattaatcaggcattccaaattagcgagaaacaacacatgctctcccagccaccagccaaaaaaaagaacagcgtctcctatctagccactttttcggcgtcatccagggtgggactcgaaaactgggaaaagatcaggaatcccaccgatacaagaatcttgtaactcattattgttttctacgttgcaaatatgcaatgcgtcaggttgcagttgctcgatgccacattccccttaagctttgcgcttgtccttgtccgccaaaaggatgtccttacaggcctcgtagaacatccaggtgatgccggaattgggcatcaccttcaggcagctggccccccacccgcggtagagccccgggaggccctcctcctggatcacttctgccagggccgcgatcatgtggggtgggcacttcccttgcagggcacccaccatgagccgcttccgcgccacctccagcgggaagctgattgtgcttgcggtcaggcctgcagattcaacagccagatatgagcaatgcaaccagctgtttggtcaaatttcaagctaacattttgtttgaaggagcagtagttttgcatcttcattgtatgtagatagtagagaattgcacaagtcaaaacaggggataacctggtacacagattttaagacagtgctgaaccggctaatgaagatggtgaaatgatatagatgtagatgaagcagaatcatttacctgacagagctccaataactagaagctcaggccgagtcaaagacgtcttcttatgtaagcggcagtaagaagtcttgattgtgtcgtacataaagtaatagcatgtgctataaggaagcatcccaattagtgttggacagaggccagcatagagaccacgaattccatcagttcggtatatcttgctgaaggtgacgctaatactaggatagacttctcggttaatagttaagcgatcctgtcataaaatatggaagatatcaggcgaagttatactgttccaaagaaaatgaatatatggaatgacaaatagtttttattttcaacaggtcagttcagcaatcaccttaatgacttcaagaggatgacacaccaatgtgccagctattccagcagctgcaccagctacagcaacaggagataaaaattgaagtggaaattcaattttcactttaccaatttgtatctttgggcatccatcttctttccatttctcttgcgcttccgccattgtccttttgacacactcgaatgttccgagctcaattgcttgagttggaataatacggatcatgttgattgtgttacctgcccaaagcccttgccatccattttgttcgatgatttctacaaagctaccaccgatatgcctagatcctactcctacaaccattcttgtcctgaaattaataacataccaacatattacgacacaggtacaaattagtctttgatatgcaacaaactgcatgcttgaacaacacagttgggaatcatatatctaaaatgatgtatgcatacagagactacaatctccactgctcataggaaagcaaacaatcctacaaatactggttatgttatgcactaaacaaagaatatgtttacacgtgaaaatgtgactattgaactttgagactagaaatatttcctgtttaactattaaatggtgaaagttggttacaacattaaactatatgcctcaaggagttaatttacagatgatgaattttggagcatatcattgcgatggtgtttgcaaaggttgtagcacgttatatcttttggtttttaagatttacatctaagttgtaagaccatgctcaaatgctttattagagagagagagagagagttcgatagatacctgatagtctcgagaggagcaagaacagctttagacatagcaccagctaatgctccactggcaaattctctaacctctcgactcctaaaaaaggcctgcaatgaaaatgaaagggaacatctcaaaaaacagtgtatattgtataggcatcaaaatcacccatggatattattaaaccatgcatatctgtgtgataaggacagattcagagccattcagttaagtacttggtcaaatttgttttatatagacaggcgggttcagaataagaacatttactacgttatctaagcccatcatcaatcatcaatattacagcaaaatctctaccaaaggtttggttggtcagtggttaagaatgaaaaaatggaatgctgaaacaagagctagatcacaataaaggtatctttagtaaattcatagtcacatatattataacacaagtatgcaactcaattttgtagttggaataagtaattgtaaaaaggactaaaagacaattgattttccacatgtttggacgcattcaagatactttggatgaaaatgacacagaactttagcaccgaagaagaaatattgttccatctgtgaaaggaacagctttgtccaaacctgtcgtcgtggagaataaccccaaacatagtcaaagttctttatatatgttggctaagcgtataaaattagttgactgaatcaagtataataaaacaaaatcaatattgaagcttgtttttttccatttgactctttgaagccccttaatctttcctaacattttctgtctccataaaccagggtataaagtggggattcgggattcctctgccgttaattgttcagtatcactcccgcttgtagcaaacactacgacgacacatcgctatctaaaattctgaaatcagatccgattttcacctaaccagcaacgtaagttaacaaaaagaattgggaaggaatatggccacaggagtacatgacacatgcgtgttggttgtacacatcaatatggtcctaacaagtagtaaagtctcatctgcatctcttacgtgtcaacattaagtcggcagatgatgttgggtctctcaaccaaaagaacaggatagaacttgcttttctttatgaagctagactgatatgaacgcctatataagcataatagagagagaaaatgaactacgcaacatgagaccactgccgttgacgagattagagatgcttgcttgttcgagagtaatctctggtaagaacagataatcaaccatggatcctggtcgaaatctttcacatgttctgcagcaaaacagctcgttcatgccacgaaacctgtgaatcccgagcaatgtttcgaatcgtcgtaacaaaaatcctaaaaacgaagcaaacgcgtcgcatgggggggaacagcgccattcgccctctcaatcggattggagataaaaaaataatcaaaccgagcaaaactgccaagatttcccacctttcgccgcacgagcaaccaagaaacgcaggcagggatgggcgagggctccttaccctcacggccccttccacgtcgggcagccggaagccgaggacgtcggcgaccttgccggcgtcgaggtcgtcgtccttgggaagcgccatcacgagcagctccttgtaacccccttcctcatcttcttcttcggcttcttcctccaacgccgccgctccccccgcccccggcgccggcgaggccgacgctggcgagcagcgacagcttcccgcccccggcgccgccgcggctcggcgcgtcgtggagacccatggcggatggcggcgcgcgtgcgtgaatccgcttgcctcgcggggcttgccctttggatttgggagggaggggcggggttattaataggaggatcccgagggggcgaggcgcaaaacgctgtcgctgactcaacttttttggctcggcggggtggggggagtgacatgtgagagtgtagagagtggaggggtgagaatgtaaaagggatccagggctacggttttgtgggaacgggaactctggacgaaagcgtatacgtacagtacagtggtggggcggacgggcggtgtatttaccggttttacatctatatatactccctccgttgaaaaaaaatcaattatctctcttgatgcaatgaatttgaatatattgaatctgaatagaccatatgtccagattcattgtatcagaagatgtcatatccttttataggttgttttttttaagaaaatatatacttactgtatctatcagatgtatttttgtttatgggccggtcccatctgtcagcccgctttaacaatccagctcagtgtgccaccgtagcaaaatcatcttgggggttaactagtttaaattgagactgaacatggctataaatagtatttgctataaaagttatatttttttctctagaaacttaatggattatccgttaacgagctcggagagctgcacgtagtaatcgggcgtaagtggcgtcacttcagcatttgatatcttttgcgagttgtgtagacttatttcttcaatctattggataataaatttagccataacgtaagcatgttttattgtgctaaaatttgattagcgatgtggtatgcaaaaccataatagcggagttatgccatgtgacaaaacctcgtggtttactaacttggatcgtaaactctattttatttctattacacgaaagatgcatgcactttgtactactatacatgtgtcatactcacacatatgtgaatgtactttctaagatcatctccaagagaggcctaatcctgtttctaaaagttaaatttcagaaattaatggtaaaaccaaccctccaacgcgaaaaggctaagccctcctccatgtggtttccttttttagcaccgcattgcttttctactttacgcacctaaaatttgtacacctcaagtttacacatctaaagtttagagacctaaagtttataagtcaaaagtttatatattcgattcaaatttgaatttaaattcaaatattttttatatatagtatttctatatatctaaagtttgtagacccaaagtttacaagtcaaaagtttacatacccgattcaaatttaaatttgaattcaaatattagtttatagacccaaagtttataagtcaaaagtttacatacccattttaaatttgaattcaaatacttttttatatatagtatttctatacataattttttccaactttgttttttatttttttaaaattttatagtgtagtaggaagagaagaaactgaggagaaagggggagaggagcgtataggaggggatagggggtgatcgctccaagtgatcgatcgcccgttaaccacacccccctccaacaggctcccaaaggaggtccaatagttaggtgcatccaaaatctatccaaatatgagctaattctgggcacctccatgcactctcaactggagaaaaatcagtttaagatgacccaccagtgatgacatggtagattttaaagttctcttggaatcaagtaatgggatactgttggagatgagggtgatttttgagcctaatatttttggttagtcctaacacatgtcttttaggtgcctaattttagacatcttttgagatgctctagcacatatttatagagctggggattagcaaaatctcttgccgaattatccgcaacatcatcattatccttaaaaaaaactaattgtaatatctccaaatataaagattgtgaatcaataagttttcattattgcgccgtcatgtaatgtaatgtagtaaatactagtaacaacgatcgaaaaatccaatcaagagcatataagtataccatggttcaaggacttgttcagtttgccactagtattatttttcaacccaaccaaaatttagtacgcgacactgacgccaaaaaatgataatgaaacaattgaatcatattcaaataccttatcataccattccataacaaattttgataatttcctaaaatctcccacaaaagaattggtaagacatcaaaccgaacatcacaccacgcacaacataccttctaaccttactaatttttttcatcatcaaactttgctaagttttgggtagggtcaattttgccatcaaactgaacccatcctataaatgtactccctctgtcccataaaaattgtatttctagatccaagtctttatcccataaaaattgtatttctaggcatgtggggcccaaccaattgattcatctatataactttccttccatcccacgtaatttgggctgctaatgcttgtaattttattaagtatgctaattatatgggttaattctctcaaacttctttttaatcatttgtatatatggaatgtgtgcatacagtgggttcattaaataaggttattgtggttattttccaatcctactattttgtcttaaattagctagaaatgtaatttttatgggacggaggtagtattatcttgccaaagttttttttccccacttggtgctggctgagatacggtcatattaggttgtgtttggcagctgagtttcttaatttatctctctcgtttttccatacacaccttttaattagttaattgatatgttttttaaaaggtttatatacgaaagctgttaaaaaaacgtattttcattaaaaaaatacgctaataagtcgttctttttgttgtgcgcaggagattagatcccaactaaaagaacgaacgcagccaaagtatatacggaaccccggcgtacgatacgatcatacgggcatgcggccatacccaattcgtcttctccgcccgctcctggcgcgcgcgagaacgcccgcggcctctcgcggatttccccccaaaaattgcagcgcccaaaatccccggaaatctgctacgcgcacccaacccncactaacccccttttccccttccataaattccccggggcgcccgtttccttttcccctttcctttcccccgtttagaaattctctcttcctaaatatatcgcctcctttctctct

SEQ ID NO: 66779 - DNA, 2082 bp, Oryza sativa
caatgcattttgttttctataattctttgaaaattaaggacctttattaggtgtagggtttgaaatctagttacaagggaagaattgatagattgggcgcagatttaatgtagttcggaggttatcaaaccatcacagaatacaaaatgcatggggaattttggtggataggccagtgtagtccatgcacggaaccgacctagacaccaaaattctccatgcattttgttttctgtcataatttgatgattaaggaaatttgcagattatctaaacttgttgatttatataccctttttgtctatgagtaggtcaattgtatgaattgttgtttatatacatgatttatatacccttgctgctgctgccacaatgattgtgggctgttttattatctagacttgcttgaattgaatggatgaattgctgtttacatgaagttagtagtactgtctccttttttatctatacccctgctactgctgttattgtgggctacttgttaatacacctgttccttgttttatgttgttgctgcccctctccaagtatctttgcccctgcttctgctgcccaatgtgttccttgttaaatggccagtgatgaattgctcaataagaacagattatctacacttgttcatttttttatctattcttctttttgcccctattgtggctcaataagtgatgaattgctcaataagtgaatcttgaatgtggatttaagtgcaactgctgctgtctatgtttgcccttgctgtctatgtttgcccatgctgctgcctatggttgcaactgttagttaagaacagattttctgcacttgctcttttcttctggattgataagaggagtatatctagacatgttgttttagttaatttgcccctgctgttgctacccctgtggcatatatactcctcctgctgctgttttatgtcaatcatgcaaattctgtacccttgctgctgctgttttttaaatttgcatgattgattcagtggttatatatctctacacttgttctttttttatgcataagaacagattttgtgcacttgctctttttttatgcataagaacagattttctgcacttgttcatttttttatctacaataatatatgcatgatttatataccactgctgttgttgcccctgtacttcttgttaaatggccaaggatgaattgcttaataaaattctatctatacctgttcttttctttatggataagaacagattatctacacttgttgatttatatacccttgctgtctatgtgaatttccctctgctgttgctgtttatgtgaatttccaccctgctgttgctgtttatgtgaatctccccctgctgttgctgcccctgtggcatatatacccctactgctgttatatggccctgctactgctcttattgctgctattatatggccatgctattgctactgctctaatttcctgcacttgctattttctttatggataagaacagatgaactacacttgttctattttatggataagaacagatgaactacacttgttctattttctttgggttgctttttcctcctagtagctgatttcctctttttatcccttcatgcaaatgattgtaattgatgcatatttctcagcaaaactgaggccatatctttcatagtgtaccccgtattacattggatctaatgctatttagtctaatggtaggaaatttataatctttttcgcgaaagttaaaccatgtcaacgcccggcgcaaacccgccctccccaacacctgcgaggatccaggaagaagcaaacccagccacagaggcagttgccgaaggtcatcccacgacaacggtggtccaacaacccgaaattcatggtaatttataggataaattttcaccacatgaccacataaattttagctagcaccccttagcaaatattgccttctgtttgtgctgcagaattgccgcaggaacaacatacgtcgatgtcgggcgggacaagtgcaagtaggtctagtagaaatccgcggtcacaaaatatatggccgaccacagtgcaagttataagagagg

SEQ ID NO: 66780 - DNA, 23614 bp, Oryza sativa
  unsure (1)..(23614): unsure at all n locations
aggctgtgcatattgtgattgtaatgtctcaggtcattttcattanagtatcccacggacggctcgttgttcgctctagatattctatgtgcacgactgttttttccgtccttaaggactgtgttatcttccttgttttttgttgtgggtgagccacccccactaaccccctctccccctcccataacttcgcgcggccgccgcttccctttccccctccccttcccccgcttggaatccccccctcccccactcgcgcgccgccgcctcgtcggaaccctaggcccacccgatcggtggcgcggcgatggcaatgacggcgcggcgggttcagctcgccgaccggtggcgcgggatccaggaggccgaggaggccgatgacgacggcggcggcggcgagccgtccgcgcccaggcagcgccgcctcaaccaggccaaggaggaatggtacggccacgccacgcatcgctctccgctacacatcacttcgcggcgatggggggcgtaacgtactctacgcggattagcgcgggtttagttagtgtttggtgtgtgggtttaggactttccgctgatcggagcgagacgacgagtaacgcctgtgctgacggggaatcgccgaatcgggcagggtagctgcatgttagcacgcttgttttgtttgcgtggttgtttgattagataatgcgaatgtaggttgctatgggccgatagactctcaccttcgtttcagacaacagagtggattgatatattgggtggaaacctctgcagggctcattatcattttgagcgtgagcactgttatgcacttatgctattggtagttttgtcactccgtcttgttaggggtatgtgctatcgatatgcagaactgagcaatcatttgattacaatgtagacttattgggatgtcaacagcatttcttggagtaatgttgattagaaatgtacatagctgtgtgaagtccgacttatcatggaccaaatatatatcactactcccttatggtcatcccatttgccactatttcttacactagcgaagtacccatgtgttgcaaggacgttgaatatgttcttttttcttctctctttccatagcctggggaatgaataatctacatgcttcactgttcaatggaacccacatgtcagtttatagtgggagttggtggtggcagattcaccaatttcaagtccccacatgtcggtgggtggtggtagattcaccgctcaccaccaccattagagtttttttttttttaaagagtgtagattactggcttgttgctgtacgcctccaacgctgtattgtactttgtagtcatttggttgaagtaacttttagttaacaatgatgtgagttttcaaatgtaaggcatatagaaagtcacagagtattattttgcttgaagtttttacaccacatgaaatgtgatataatgtatatgtttgtgtctaaaagacatttagtttatttggaatttagctgtgttggaacatcaaaatttatgtaaatggacagttgctcttcttgcaacatgccttgtttctagagtcaagagtcaaagacatgccctaaaatttcgcttgacagtcctaatgagatttgatgtttgtgtaaccacctgcaggttttcacattgttttaattttctgggaagtttgccaaaagaagagcatatttggtgtggatatgctgatattatgggaccatttctggagaccttccttggttactttgatgaccaagaggaaaactcacctcctaggacaatatggaaacggatttctgaagagctgaatgtttgcgcacaatgtgtttgcgaacaccaccaggcacagaaggattttgattctgaatatcggtctggcgttgacgccctcctgaaagtgttacggcttctcgatgaagagagggttacagaacatcttaggcagatgaatgcaaaagcacaattaaaggagtacaaaccttcatgccatgatgcagaagttagcataatgtttgaagtatgtatcgtttatgtgatactttttagttttccacatatacctcaaataaagatactaaattccttctaaaacattttaatttcttccttttctgtttatgttccttttgcatgcatatatatttataacagcacactacggctaccaacgttgtacaaaatctctcggcactagtatttatttgacccttttcaccgtaattgcttttgtagacatgtagtggcttacagaattgctcttagagtgaactgaatagagtgctctttttatctatcaatataatataatggcatttgtccagttgagttagttgggcttattttgattagcaggatgttggtatccattgaatcatgtgcattcctgttctctgaattctcagaatcactttgctaatactgagaatacaagcagcacataattagtctgcccctgtgtttctgatcagtaatggtgcagcttattttctttctttctttttcctttgatactttctgttatcaagcaatttcaatatcttaacgagtcacatttgttatatataccatcacctaggaaccagaaccctaagtttcatgcagccatgataaaccattgctcttctatatttgcaggttttgatgtatcccattttgttagatgacctgtcactggctaatcagttccagacattcattgaaagaattgatgaaatatttgaagtgagcctttctactaatcagcaataccctgtaagtcacttctttccttgaagataaacttagttttttaaataatcaagtaatccaggatactattttttattaaaccaggatactctatttacttctcaccgattggtttttgggctgttgctcaaaatagtatatattaagtttctttcctcctcatctatcaagttcacctgtctcacagtatctccgaacttacaattgtagggtgtttatgcattacttttcttcaaaagttgtaaagctcgagcaattgggcttcgcttagcccggtctatggggaaattgaggtaatgtgcttgccactttcctgttcattttgaatcaataaagttaccaattagatccatacacggaaatgcatctacatagtgtaccatgtaggaatagttaggcaatgtcatagaactgtgcctgaaggtggaagcttccaaccatgtgtttgatgatgctgtttgactttgtcatagtctgatatttgttaatagcatattacatttacagcttttaaacctatacaccgaacatttaatttgctaccatatttaagcaggatcccatttcccttgttttccccagatcattacaatgtttgaacaaaaatacttgccaatctgactactgatgttttccgtggccaaaatttgcattaaaccatgcatgccctatatggtcatgaaaacatgccaaaattatcaaaatgccaatcttttcttctttttctgctttaactcctacatagtgtttgtgcaacagcaaaattaagctttggaaagccagtcaccttgtttcatagacacgtaactctttagctcttggcaaaataagtaagataagagatagaattgctaataggggtgggcgttcggtttttccggttttatcggttcggtttgttcggtttagtagaagatcggtttcacataattgctagctgaaattcctcctagaaaaattaaaaccgaacctttttaaaccgaattaattcggtgcggttctttcgggttaggtttataccgaacttgattttgaccactccatcagttcatcacgctgccaacaataatcaggaatcaacaacatataaaaaaagaagttccatcatccatcttaggggaaattaagagtattagtatataccattggccatagaaccagaacaacagcaagatggcagcaagatgtcagagaatcgaaaagccaggagtccaagattagcacctgctggcctatgaaggaggaattgatcgatatctgactgccaccgctatggttggctgagccgtctggccagtcgtctgcgagggccgaggagccaaggacgagctcgttgggcggtgctagggttggataaagttgcgctatctcttgggctggatggaaggggatgagttgggccttgtatagttgtattaccttgggctgtcccttcctcggttttctcggtggaccgatttattcttttgaagaaaccgacgcgatgaccgaacaccgagctacgttaaaataaaaaccgatggaaaaaccgtagaccgcaaaacccgccactttggtgcggttcggctcggtgtccggttttcggtaatttcttgcccacccctaattactaactacaggcctagagccttatttaagatatcttagcaagatccaaaacagtgattacatgcaaaaacgttgcaattaaggacatttgtttgaaagattgtggttattttttcttagaaagatatgatggttttaggaaacagaaacggaagtctgaaactgtgggtataatacataatgccgtgaaaaagcttcaggatggaaaccacgattatatccaacttgtaccattaatggacttgcttctggctttgacttagatagtggttggcaactattaattttatggaccaaaaactgtttcacgccacaaggtggtgttatgtgtaataccttagctgattactcataagattttcagattttgcacccttttaatctacaagaagaatcaaatgctttgttctcatattggataatataatgcctctttccatatttaacactggaaagttctccctgccattccttttacatttgattcaatcttcaatgttccattagtatcacttatattttttttgtttagtaagaatattaagtatgttgaaatctgtagtaggatctgacctctataattcaactcaatgtacaagttgtgttcgatcaagtgctctaatatcatgccaggaggcatgttgagattggtttagccttgtatggctttaacacatttggtctgatttgtctgctttaatttcttataactgtattaacattaacagtaatatgcaggaaagcagttgacttggaccctttgcaacccttactgcaaaaatatattaattttttggaagccgaagttcttccatctacttcagaatctccaaggcctagggtgcagctcaaaagagccgatatatggcttggatttaaatcactgtatgtaagtttaacacatgtattacatatgacttaccatgttgcttcttccaattttttacctgtcaatgtattgactttgtttttgcagccttggatttcttgatgcacctgctttcgaagatggaatcttggagagataccctatattcctgaatattgtacttaaccatgtcagtgatgatagatctgatttatcatgtgctgttagttgcctgaaagcatcatttgaaatgcttggtaagtgtaactactatgagtttttgctgtcctatgaggctatgatgaacttttcctgttgcaaacttacacattttcttgttttaggttgcaaactttggttgagaacaaccctatcacctaatgtcatgcggaacacattgttgggccattgttttcatactagagatgagaaaagccacaaagaaatttttgaccttttcctcccatttctccaggcatgtttgttgttcctttgaatccaatgatattcgcatatactgatcattagtgcattatgatgtgctcaatcttgtatgcagtcacttgaagcactgcaagacggtgatcatgaaaagcaaaggaggaacatactgtattttcttctttatcaagtaactcggagtagtaacttcagttctctgatgagaaaaaccgctactaaggttagcttcttttgttgctaactggatattcactttagttatttgacttcccatgtaaatgcttactaaaaataacttgattgtattcccttatttttactattaagtacagcatatttgggacttttaaccatttgtaatatcgcacattgtttgatatcatacttcaaatcttaaagatgctagctgtataaaacagtacaagacctatacccacttcattagttgattacatatattagtcatcgactttgctacagttggtgatgaggtgggtgagtagaagtattcatggaaagccattagagccttctaggttttgtggtctgttattccttcagtgctgaaaggattattccacataagttaaatattgctgtcagtactactgttgtacttgtggtcatctttgttgttgattttttcactcaccatgattggtgtgcttgctgctctccatcgcaatcactggtaacagttgtcgttggcagctccatgggttacaacagcagaggacacgcaagggggagggagggaaggagagattgcatttccctctgtaattgctgctgcatgctgatttttttcctgctgtagttgctgattcatgctgtttatatgcttacatggtgtcgattaagatggcttctaaatcgcctagatgcccaggcagtgttgcagtgcctccctgcgctcatgattatctaagtactacatttgtattgcaaggagaaaatgcaacaaatcattttgagtagttttgtagtgcgacatggtagttgacagttataattgtttctcctaagttgatgctgtgctttaagcctgtggtttgaactttcaaccttttggtaggttacattgaaaatatcatgtaagtccacagtgttagaatgcattctatcactgtttctaggaatattataaaaactacagatttcctttcacattaatattttcatacttatttataactaactaaatatgaaattctgaccaagctatgtacaacaaaagaaaatagcctttttctacatactttatactgtaccaatcatcaacctccccgcagtcttggtttactggaatatttattatgcacacttgccatttaatgccctgatgtttttccgtgtttccttccagattgctcttcttattgtacaaagagggtacacaatgaaccctccttgcccagcatctgaatgtgtccatatgtggtaaggaccaaacatacttctcttcacaacgtggcaaatatcctactcgttggatgacaataaacaagttttactatacaagttttactatggtggctgaaccgctgaagtcaaaactgcttctatattttattaaaacttatcatgtatgaaaaccattgttggaagttggcccacttctagatatcattgtccacatattcgatatcttgtattcttgtttctagctaacctccgtttttatttgctgctggatttccctatttaatttctattatgaggttacatttatttctctactgttgcatatcatcccctgacctggattctgtacaggggaccatctttgattggctcattaaaggacaaatcattacataattctttgcgtcaacctgcactcgatctcatcaatatcctcataatttctgatgcttctgctttgatctcttttaaaatgaagtatgagtctttcacaaagggcgatgtaatcaattctgtcatatttgttgatgatgacgatgaattgcctgtcttctgtgatgctgaagagatggattacggctgttggaatgatttcaatgttctgtacaagttgacatgtcgggaatgcaaggattggagatgtgtccctttgttatggtacctcataatggttcagttggaaccttctgaactgcccatggccttttcaaaagcagtgttttgggctctatctcatatttctgtgttggagcctggagtatctacagagtcttcagtgcctgtgaatgattggttgtcatcacatgctgaagaagtattgccaacattttcatggcaagtcccaaatggtgcagatgatggtggagttggaaaggagtgtatcaatactctcaaggtgtcacaatcttgtaccctgctattaaaaatatttaaaaggttgactctattttaccagttcctattcatcttaaaatctttccatgccatatctcgtacttattgtaatccataaatcctgaatttctccagtatattgcacttgaattctttctagatttgccattcatgtcatcatgcaaattgagcaacgtgggcttctaaagcaatgggcttgggaatcaatgatggcggaaagcttgattttgacactagttgatcataatgatgtaagggtattgctcttgtcttccattctaccccttgcgcatctgagcacttagtatttcttcttcttgctatacccactgtagaatctgcggcaagttgggcgagctgtcttggagcttgcgtcacaaggacggggtttgacatctgggcttcaatttctgtgctcgagtgcatcttccctgactgccacatttttgggtctaagatatgcagttcaatcggtaagattttgatttttttacatttatttttattgatgttgggaatttcctggttgctggctggtgggtacaggtttctggcgctggcaggaggaaccccaccaggaataatagttaaaagttttaggctcaaatttgaataagaaccaattgcctgatgagactgtccagttatcaactacaaaccaatgaataccatgaaagatcagagcacagagatttgcaaacagatttcacattgcagttcatttgatgattcatctttgctagtttctaatggttcattcaataatagttccgcaatagatgtcatattagtgtctcatattgtttgctttggcaccaatttttttagcatgttttttttagacagaaggccaacggcccagcttatattgaaagctagaggttttacatcgctgggggttacccagttcaacagctacacaaaaacagggggggtagtgatccttacatcagctttatagctgagaaaaaagattgcacgcaggccaaaacacaaaaaaacaaagccctaagaaccgtgataacatgtcatcccacaatcaatcttagcaactgcacggcagccatcatcttctcttccaactgctccaactggttccttggcgccttccttagtctacgccactgtctcaaaaagaaaatcactcgaaagatcagcgtgagaggcgtagaagggatcttcttattgaaaatcatgtcattcctgggtagccaaagtgcccaggctgacgcccccaacaacattagtaacaggttattagatttatgtcctggtaagccaacaaactcttcaaaaaactgttgaaaagaagagggaggggctcccaatctagtgcatctcttagaatacaccacaggaaagtggccaaagggcaagtgaaaacaatgtgatcagcatcctctgagctgtggcacagggtgcagctgtcctctcccccccattttttcttagttaattgcgaagtggactgaattctatctctgatggccagccaaagaaagtgcttaactttcagatgtaaagtagcctgccagatgtctccacacacgtgatcgtcgcctatgtcttgcatttccaaatattagtcacaaatctttctgaaaattgcaaattggcaactaacttgttgcagacctccttgttatggctgtcaaaactcaaaacaagaaacagtttccaacgctcacgtccaaattgtctgggttgagcaaagtatttctagtcacaactgttataatacatattgtgcattatggaacttaatgcctccaaaatccatttgctaaacatgcacccaagtaatttgctaagcgtgatttgcaggcaaaacttggcgatcatttcctaatggttgaactaattgttgttatatcaagtatatgttccacaaattgaagaagtgggtggacatggactgcagactttgtattctaaaataaaaagattcagacttaaactttaaatagactgccgtgtaagcattccaaatctagcccaggaaatccagtttgttctggttatcactatgccaggaaactgatcctttgcatgaataacacagaaacatttatttgatattcaaagcttcatttatttacctgggtttctgaaggaaaatagcattgctcattttaaggagtgaggattatcaatctctttggttccaatataagcatggttctctgagagggtctaaaaaaatattatttcaatctctgtagctgttcagtccaaacattttttcctttaaactggaattttttttgagaattttctttaaactggaaataatcatgttctaccttatttgaaatgttcaggtggaaacaaaatcagttttggcagattttcctagtcttcatcacttgttttttgtcatatgcaaactattaaaggatgttgttgttcaacaaccttcagttgcactgcaagcaaaaccttttgaagggggtttcctgcgccagtccttttcaaatgtatcagtcaacctaccacaacattcagttgacattatttcttgggagaagttcagcaccttgctttcaggagctctctggccttttattttcacatgcctgcgaaagggagatgatctaatcaataccaaacagtgtcaggtacatctctattgctttgacttactgtattattgctgtgcacatcttcatttctttgtttcatcatgatctcaattttatttcagatatcatgtgttcgattgcttgagttggttccccttgtgtatgaaagggtttcttcatattcttctgccaagtcatgtggcgtgccaacaatggttctggaccctactgatattacgtggctttttcacttgattaattggggcaaatcatcactccttgtaatcattagacattggaagcagtgcatgctatctctaattaaaatattaaaaggttcacttggtggtactgttcaacactacattgaagatcttggtagtatcatttcacatggttagacctctaatattttcagttctgtatgttgtttagatgtttcaagaaatgtttggtagcaacttatataccattctttcagatgcagtcaatatcgatgaactcagcgagaaaatttcagatctcaaacttgcattgtccaaggaggcttctgcaaaatccgaaaggagagtggtagctggtgtatcaatgttcacagaaccaattgctggtattccttctccagctactcagacggctcaggagagaaatactggcagggacaatgttgaaaccatgaagtcttctcgatcgacatgtactgaacatataattcttctgtcagatagtgaagaaaattcattgacagctgatgtgtctggtgaggatgttttgtcatcagttaaagatagtgatggatctggtacttcagatatgcagaaagaagtcgagcattctgaaccaaggatgcctactgaagatagacacgtgtcactaaaacaacagatttgcagcccggccagtgatattgtagcatcttctaaacctgtatcaaaagatagaagtataattgctgccaaagaaggattgggtagagcaaaaattccaactgttccagtgaatacaaatgatacttcccttttaccaaagaagattaaaccacccgctagcaccatttctcagccatcgcgttctaatttgtcatctggtgctgaaaaatttaaatcaatcttcagagatttatctgatgacgaagatgatcctttagaacatgcacttgatagctgccgaaagccacaaattcgtttaacaaagtcatgcttattggttcctaaaagacaagtagtccagcttcctttgtctgctgaaaagagacatacttctggaagaccagatgctagttctcgaagactgaaacctcctaaactggacagctggtttaagaacatcttggaaatggattattttgctgttgttggtctaccttcttctgagataataaagaaacttgctttgaaagaaattccggtatgctttgattcacaagctcaatatgttgagattttccagccacttgttctagaagagttcaaagctcagttgcagaatgcttatgtagaaacccctgctgaagacatgaattgcggctccatatctatcctctcagttgaaagggttgatgagtttcttgttgtacgtggccgcccagataaaaacgactgtctgaaatccaaaaactgtatggagaatgatttaatattgctcagcaaggatccactgaatagctctggacagcaagttcatgtgcttggaaaggtatttttgttgcccatgaatatttgttgccccaacaaagtatttttgctattgcgtaacacatttactatattttcaggtggaccggcgtgagagtgataaaaccaaggcgttaattcttgtaataaagttctttctctctaatgagaatgcacgtctaaataaagtgaaacgtcttctcgttgaaagaagtaagtggttcctgaataggattatgagcatgactcctcaagttcgagaattcagtgcgctttcatcattgaatgatataccagtgcttccagtaatcttaaatcctgtttcttgtaagtcaatccaccatggatctggaaaagtgcatcttgataaactttcacaccctatgcgaaaagttttgaagtcatcatacaatgacagccagcttgaagctgttagtattgctatcagatcaacaagcttgaaagcaaaattcgatctctctcttattcagggccctccaggtttgtcctttagttacgtttaccagcaatttgtcacaattccaggcataaacaaaggaaactttacacttgtgttttctgcaggtactggtaaaaccaggactattgttgcaattgtgagtgccttgctttctttacatgcagccaactcctcacaaagaaatgaatccttcgctagtgctgaatttaacaagccaagaccaaggctaagccaatctgttgcagtaactagagcttggcaggatgcagcccttgcaaaacaacttataaacgattctcagagagaagtcccaacagatcggctttcaaaaggaagggttttagtatgcgcgcagtcaaatgctgcagttgatgaacttgtgtcaagacttagcgaaggattgtatgacactgatggaaagctgtacaagccttatatagtacgggttggcaatgcgaagacagttcattctaattcagttcctttctttattgacacacttgttgagcaaagattggcagatgagttaaagaagaataatgatagcaaaagtttatctgatactgaatcctctagctcacttagggctaatttggaaaagattgtagacagaattagatactatgagttgaggcgaaaattattggaggctgataaaacagaaaatgactcacttgttcccagtgattacgagacagatgaagtttctgatgatgcaattggtgcaaagctcaactttctgtatgcacagaaaaggaaagtttctgccgaacttgccactgctcatgcacgtgaaaagaaaatagctgatgaaaacagatttcttaagcacaaagtgcgaaagtcaattcttggagaagcagaaattgttgtgacaacactcagtgggtgtggaggtgacatttatagtgtttgctcggaaaccgcttcagctaataaatttgtgaatttttctgagcatgctttgtttgacgttgttgtcattgatgaagctgcacaggtattatcgcaatactaacttttttcttctaaatgatgatcgcactatgttttattgaattaaaactaagtttgtttgggcttattctgtaggctcttgagcctgcaactttgattccacttcagctactcaagtcgaaaggaactaaatgtataatggtaatttctgttacttcttttcctacaccttcatgcaattgtatggcacttgcttttgcttactgatgtcttgcttgaaggttggagatccaaagcagctacctgctacggtgatgtctggattggctagtaaatttctttatgagtgtagtatgtttgaacgcctacaacgagctggttatccagtgattatgctcaccaaacaggttattttccgtgatatgctccgtgatttctatagtatagattttttatctgtaaattttgcagtgtggaagtaaagattagtgaagtaaacaggaaattttgcaggttatttttgatttggtaaaatactatatcgtagctcagtgatgcttggttacttgtgtcagattgcatggtcccatgcccttgttagactggttcctgagatttagttctatgcgctaattttgtgcatggactcattcctatatatgagcaaaccttagcataccatttttacaaaacagactcagttgttaacatgattaaaaggaaccaacatgattttgttttttttcgtatgttaaaaatatatccatacttcatagttcatacagagttccaatgtcttttagtatgcagctacgtacatctgtatgtgagaagagcagtcagtgtaaaccatctgctgatttatgccaattattatttttgactgcagtaccgaatgcatcctgaaatcagcagattcccatcgttgcatttctatgaaaataaattgctggatggtgctcaggctgctgacaagtcagctccattccatggtcatgactgtcttggtccatacatgttctttgacgtagctgacggccgtgagcagtgtgggaaaaatgctgctacacaatcgctctgtaatcaattcgaagcagaagctgcacttgaaatactgggatttttaaagaacaggtaacaatattttcttcttcaactacatgcttaaggattttcattctgtagctaagtgagactttatacttgcttcatgaacagatatccatcagagttctcctgtaggaaaatagggatcataactccatataggagtcaactctctttactgcgttcaaggttcaattccttttttgggcctgaaattgttgcagagatggaaataaataccgtggatggatttcaaggtcgtgaagttgacatcttggtgttgtcgactgttagagcctctaattcatcagacagcagacatcacactggtgaagcgcgcagcattgggtttgttgcagacgtgagacgtatgaatgttgccttaacacgtgccaggttttctctatggatagttggaaatgcaaagacattgcagaccaattcacattgggcttctttattacagaatgctaaagaacggaatctgttcatctcagttaataggccataccgttcgttgtttgagaaagttcgttcacattcagaagatattcatggttctaggcatacctactatacaagtcattgtaagaagaaggaaagtggaaaaaccagtatgaccaactcacagaaaattgatgcacgaccccacaaagaacatgcaagacatactgtcaggactgtggaaacagcaaatgaacgtttaccaaatgaccaagcaaaaagagcatcacgctgggatcggaagagtccaaaagctcatgaacccttccatagaaaatctagcaaggaaaaggaaccagtaattcaggatactgaccaggacaatgcggtgagaaaggaaaaggaaggagaagggctgactatccataatgataatagcctggagcttgctaatgttataaggcagagggaactgaataaacctgtcaaaccgaatattcatacagatgctggtaagaccttatgtaaccaagattctcttcagaattctgaggttagaaaggatgtcaacaaaaaatatgataatggaaatgtgaagggctcacaaaatcatgatacaaaagcaacagtcatgaaaattgatgcttctccaccagcacaagacatgcagaagttaatacaaaaggctaaaggagcaaggaagttctctgaaaaaccaagatttggtaattcgagtcaagttgattcctcagttaaacatgaggcaactctggaatcagccaataagaatggtggtgcttgtacaccaacaaactcagaaatgaagaaaatggccggtaaggccaaaaaggctaggaggttctctgagcacccaagatctgggaactcaaataaagtggaccattcacttccgtcttttgatgaagaaagtagccaaatgccagaactaaaagaaaacaacttaactgcaactcgtcaaaatcatctgactgcatctaggaagcgacaacgggaggatattgagtcattactttcatcagctcttgtatcatcaaagaagccttcttcaaagtgtccttccaagaaacaaaaatgagatcctgcagcaaaggtaagtttttcatgctaccttcaatttgctgtattataacaaagttaatctgttctgaagttagtgtttgctcttttttttaacctgatacagagggggaatccttccatttggaagtcagtattgttgactttagaagtttatattcttttatgcaaacgtttcttgcactctatatacaaaattccatacctgtggttgcagtacatttaaggactataaaatagaattggaagaaatcaccgaagcttagctagtagtggtagtagcctgtctgttatgagctacttcctccgtttcatattataatactttctagcattatccacattcacatatatgttaataaaatctagacatatatgtgtgtctagattcattaatgaatgtgggcaatgctagaaagtcttataacctgaaacggagggagtaatagttagtaccaatcatgttcctggtctatttggatttgctattattttcttctacatatatccccctctaaatactcgtatggaggctctacttaccctataactgttaatcagctattcctactaatttgaccagcccccatacagttggatatgcgtttgtactttggatccactaagctttatatgctcagttagacatgtaaatcagtgatcctggaacctcagcttgtgatacaatttccactttttttggaacgcatctgcgttccacctattggtggttcacttaattgctgtgtgctggatattttgacatgctatcgattcaattatctgaagctaatactcttatcttcaaactcaggtggcagcagatcatttatccgctcatggacccttgtagcttttttgacatgccgacgagttcatctcatgagttctgcggttgctgtaatgtgatttctccaccgacgccatggaggcacttggattttgagactcataagctaacatagcaagtgattttcagagagcaggaattcttctgacattgatagattgttcttcggagcttttctccctgccgaccaccgcccaatctggatgtgaaaaaccaaacaagacaacccatttagacaacatagaaggtcatttttggatgctgcttgtgtcttttgcctagttcagagatgatgcttgtagatatgcaagccaattttgcgctgtaaattatctgtacatagtgcacatatagcatgaacatgacggaaccatacacatgcttgtccatgtccaaaatgaaaaaaaaaggacgtggctcatcttccgaccagggtgaaagcttgatgcaatgtagctcctcttgtttggactccaaattcatcagtacttgtagtactttacaaactttaaaatgattgcgttccttaacatggtaaagcagtacagaataagcacaggataatcagtgtcaacattttcccagacagggtacggccttcagctcagtcccaaaacggcccatgggtcatcagaccgtcagctcagtcccaaagcggcccatgggccatcaggttaactgcgtgggacatgatcaggcatgcagtcagcacatgagacaggtgcattatccaatatctgggaagaaacttggtgcttaagtatatcactgacgtagggacatctcattgtacgtacaccctaaatatgaatgaaaatatgatccagacaggggcatctgattgtacatcctaattttgaaaaatagagaattccttgatagacataataggacgagtaaaaaagcttgagactgtcatgcactttccgtctctttgttttttctctactactttacaatgtcataaacttatataagaggggaaagaccagttcggttgtttcgaaggccgtgtttagttcacctctaattacccccaacttttaattttccatcacatcacatcacatctaaaacttttctacacacgtaaacttctaacttttttttttaaaacttccaactttttttaggatctcaccatctcaccatctcacgccgtatattcttctgaggtctcaaagtcgaagcccttgaagatcagagggatacaatattttgcatatttcttcaaacctttcatttcccaccagactgaagataaatacatgaagaaaattgccagcctgcgtcgcatggttaacaggaactgcgtaagcaattaggcatgaaataacttcaactgcatttcgcgaacgcgccattacttcaactgcatgcttgacatgtccaacaacatcacaataagtcaataagaacacaaccttcctccctccaaaaatgtaaggcgcataagctttttttacgtggtctctaacttaaaattttgattattgatttctttcataatatatcaccaatataaaaagtaattgcattagtgatatacaaacttattagatgtgtgcaatttaatatacgaacttgtaaaaagctcattttgagacacaaacctatctaattcgtgtgaactaggacaaacatagcttatcaaggttaatattaccaagttaatcttgattagtagtgagtatgcataagacatgctatacttatacttggtctctactttccttcgtcatttgaaatgctgaatttcatatttttctatcccatgtatcatagttctgttttcatatcttcctctgtaatcacaatgcctatctttttattgaacaaatatatatctaaattgcaacctatatatttatatagtatcctaagcaacacctaaataagattagcgattaatgttattttggccctagttcacacacactagatgagttcgtgcaccaaaacggacttttacaattccgtgcactagattgcactcatctcacaagttcgtgtatcgtcaatgcaatttactgtaacataaaaacactttaaaatatgacgtggtatgcatagtttaattattagccaaaagttagaaaggttgattttcttaaaataaggatgcatatgaggcaaatggattatagtttaactgacgagaaaatatactacaaaatgagttttatcacgaactttaactataacgaagatagatatcatatggttgtctggttggtttgggatatataatttgtgcacattttttttatgtaccgcaatatactgtatgtagtaggggtcgtacacacgtgtggttacattggtgtgagtgttgcgtgtcatgcatgcatgcattgtcttactccctctcccaatcccaacaaaaatgagttattctttttcctgacggaaaaatggagttgacttataaagttgtactgacctgatataatcaaggggaataatctttttgtggaagtccttgatgagcataatgatagtgattactgcaattggagcacgcgcatgccgtcagagatcttaacaaaaaaaaagttaaaataccaaatgacatgcatgtgttcactccgttctacattatagttttaacgtactctttactcttctaagattcactaatattcatatatatttaaacatacatacatgaagcatatatacatataaatacatatataaatctatgtattattaatgtattaaaaaaatcatacattttataatgtgaaagagagatgtggtagtccgctaggcttgattacaaagctactcccccgtttcatattataagtttgatttttttacttgtcaaactttgattaaatttatagtattaataaaatatgaagcggagcgagtaaaaaaaaatctaatatcgccattgtccattgaggcattggatcatgtagtacttcgaaatcaatagcgatcatgaactcaccgaacttaagccggatgagcaggtcgggggagaagccccgtcgccggagatccgacgccatgacgctgagcttgtagaactcgtacgccatcgcggcgtcgaggcacacggccggcgcggcgcgccacagctgccacagcgcgaggcacgccatggccgcgccgaacactacaccagattctcacatctctgacgggatacctgtgacgggcaaacgaaatggtcactgatgaccgtcacctttgacgggtcatacgggatgccgtcatcggtgaggcatccggctgcgacccgtcacaggtaactagtcacctatgacgggttgaaaatagaacccgtcacaggtgaggttacctcacctcaaacgggtttaagtcctaacccgtcacaggtgactagttacctgtgatggaaacatcataaaagtcttacataaatgcagcggaaagaaagaaagacaacaggagctaagccttgacttgaacggcagcgggaacaccactccacaggcatcctcgacggcacggacaaagcctactcctcggagaaaccttcatctgacccgaactcgaactctggggttgggaaaagtagagcaagactgagtactacccactgtactcagcaagtcataccggaataggggtatgatgcagggaatcatcaaagaagagctgaagtggttcatttgcgtaaagcgagcatttataaacagaaattgaaagatttaaacagttgtaataattaattaacatcaactatccactgtccaacgctaacccatgttgcgacaggcccaaccgtccacctgaactatccaaattcaaaagattacactaaggtgagactaatcacggtgaatctggttgaccgcccataaccgcgggcacggctattcgaatagttttactctgatcagaggtgtacaactgtacccacaagacacagccccacgacacgtttccgtgcgccgacatgtcaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgtcggctagaggaaagctacgctacaagcccagccgttgcccacgctggcttgtggtaagtacgataagttcttccagggcatcccgcgaaccggtccttaactgccatgggtgcgaccagcaaaaccatgcacccacagcccaccatgtgattcattttatttaaccaacaccagagcggtggtactaatccaacattatcatataaacctatagtctaggttttaaatgagatttccccatagtgtgctagttgaactaagcatggctaagcaattcctagtccaaagtctaatcatgttataacccaagctaacaaggagcatggtgtccaaaaagcatggctgtaacaaaaggtaaccatcccatagtataattgcaaaacaaatgcggtatttgaaagaaaacattaggacatttgcaatataggatcaatatgatcaagtgacaagcatgacttgccttgctctgctgctggaggaacctcggcgactatttcgaagtacaccggagcgtcggaagagccggaatctagcgacatacaaggcaaacattgcaaacaggctataagactactgaaacagggaacaaaaccatttttaatggattctacacatttttcttgatttactgagacttgattgggcttaaacggagctcggatggattagttatgatttttagaagattcactgtgtttattactatacaagaaaaaccttaaactatttattgcgcaatatattccagggctgacgtcagcacggagggggtgcggcgccgacatgcgggccccactggtcagcgactcaagggtggccggtctaccgtggaccgggaccacgcgagtgatccaccgccgatccacgggatcgacggcccggatcggcccggggccgatcggacggtgcggcggcggtcaggctaggctcagctcggcacaaagccggccgaccggtcacggcgacggcgcgcgcacgcgcacgcgcgttgccgacgacggcaaccgacggcggagacggcggcgcaaagncggcgccgaagggcggtgatgctaaagcgacgactaatgggcggcggcgctaaaacggcggctaggagggagaggaagggaaaaagagggaggggggtgcctcaccgagggtggccggcgcggaggaagacgatggcgaacagcgacggcaagccacgggaggacgacgtcggcgggcggacgagcttcggggtgccctaaggaaggagaagagagggattagagagagggagatgagccacggagaccggaagccatggccgaaggcggcggtagaggtggtgctcacccgagtgcgagggaacgagggctccggtgacgaacctcgacggaggaggggtggacggggtggatctcggccacgcgaacccgacggcggcgacggcgcggcctggcggcgaccctaacggcggctagcggcggccggagtagcggaaaaggcggcggcaaggggttgcacggcgcgggagcgatgggaggctcgagagagtacggcggaatggggaaaaagtgagagggagcgacggggaagcttaaatagggagagagaggaccgggcgtggccgggagaggcgggaatcgccggccgacgtgggggagtgggggaggagagaaaggcgggattcgaaaatcgaatcccggccatctcgggcgcgggcgcgagcgggagagaaaggggagtgggcgcgggaaacgcggcgcacgcgcgggcgtggtcgacgtggcccgaaggaggcgaaaacgtgggcgcggcggcggttgcgagcgcggcggcgcgagcgagaccggcgggaggtgggggaaggacccgacaggtgggccccgcctgtcggcgaccccgaagaggagggcggcgggacggcctggctgggcctcggcctgcggccggcccagcaagggggagggggacggaaaggggagaatgggccggcggcccattcgaaaaaaaggaggaaaaagggagggaaaagaaaaagaaaaaggaaaaaggactttccctggaattacaatattgcttgctcaattttaattggttaaaattatttctagagctctgaaaattccactaaaaatcctgttaatgaatttcgacatgtagaactcaagaaaaattccacatgtcaaatccgattattatttgcattaccttcttagggttttcttttgatttgggtaccgagctcgaattcgcgctatagtgaatcgaggtcgtcatcaaccgtc

SEQ ID NO: 66781 - DNA, 2983 bp, Oryza sativa
agcataggagtagttgtgcatccacagaggtgccggcccctggtctcccgatcgcaccactagctgcagtggaccacatcgaggtaattgttgttatccgatccatatctaataaaagacatgtacacattccaatattaaattcaaactttcaccttatgcagggcgcagcacagtgtgtcctactagcgagagtccacccaactttcgctcctgaagtcgctgagggcatggctttcaagccctcggttacagacaaggtccacggcgcagacctgctagctgggtatgccaaggtgtccatcgatacagtaaaggacacctggtcaggctatccgctgcccgtgcccccaaatgatgaaatcatgactttgggcgatgcgcgcaagacgttcatacaatggcccaaagaagacatagttgtgaagatgactcctcgtccaagtcgaccgacggagcttacacctcccaagtctaagctatcaattgaggctccccgtggaccggcattgtcagtacctcattctcccggtggagctgatatggacttggcagatatagctcaaagcttggctccaataaagaccacaagaaaggccgatagctccccaccacttgtcaagggccagaagcgtgaacgcggcaaggggaaggtcggggagttggcgccggagccaaaaaggggcaaggctgcgacgtcgatgccggtgagcaaatcggggaaggtcgtgagggcgccagcccaatttgagctaggcatgccattggtggaggacaatgtgttagctgtgatgggtattgcttgccgagagctacataagcaatacatggagctaagcaatgccaagcggaaaatgagggagtcatccatagtaggacatcacgaccaccagccgttcctatcgtcgcctgcctatataactataggttttgatgacctcttcgaccttttcaggatccggaagttggacactggtcttctaaaatgctactccttgtaagtgcataccttctatacttgtgatatgactggactatatctcctaattaaattagttctaatacgtaaatattttaaggttgtgttggatcgagagtcgtcgccatggtaatcaggttgggttccttgatccatccatggtgaatgaggttaatttacgacagagcttcactgaggtggttgactatgtcaaccggtgtttatgggcccatcaagacaaggagtacatcatgtgcgcacacaaccaagagtaagaggacaatacccttcgtgtctattgtttttgaagttaaggttcttagtactaacgctacataaccactgcgcaggcgacattggattctcctagtcatcgtacctaagtggagtagggttacctaccttaactccaataagtccaaagattatgatttcagtgaaatcaccaaggccttaaatatggcttggggcccatatgtggaaaagggtggtaggcacaaggagggcaagaacgaactttatcatgacaccaagtttgcatgcgcacaacagatcggagaccaatgtggtttccacgtgtgccacaacatgtcaacacttctaagagaggtgaaagatttcgaccctgaggttgttgctaatggcgaataagctcatttcaatatctacattactattcaaaacgtgctaattaacctcttatttattaaacagaaaggtagagctggcttcaagatctcacccatcaacccccccactatcagaggcgaagtgtgcgcctttattcttgcagaaataatgaacaagaaaggacgttttcatgccaaatagactcatgaacttggctagataatttattgtgatgtaaaaaagatgtttttataatttctggcgatgtaaaaaattatgtttttatagagtgcaatgtaatttactttcatatgtgcaatatttatggtactttactaaattgtcatcacatttgatcaactacgatttatgttgtactattcatctgtttttgtcacgaccgggaaaattgccttttcccgaacgccagtgtattaatccccgtcccaggaaaagccggggtacaccacacaaacatgatataaaagacacatctttattatatcgataatatttacattattacaaaggcacttcaggcctgacaaacaaaaataaacagcagcggactagcgggcctacggctccatcttcataggcgctcaactggggtataagccaggactccacctaagacttcttctccaaagcttctcttactgaaggggggaaaagattgagcaagaatgagtacaaccacagtactcagcaagccacaccggagatgcataattaatgtaagggggtacaaggggtgataatataagggttaggttttgcagaaaacagcattcaaaagtcacttagttgcccaaagccatttcataaagacgatcctagagctacacagtattattaaacaaggccgtgaaccctcacgaacctgccttaacccaaggcctacgatgattcagaccgaactggcaacccgaccctgggtcccagctcgtcccaagccaacccaggccaaccattccacatttttgttgttgagcaaattttaagaattaaaacactgacttgggtacattgctcggcttgcccataaccgagggcgcggctattcgaatagattatactctgatcagaggtgtacatctttacccacaagacacgtcttcctcacgtgtaaccacgtgccacataccaccacggtatacggacggaagacgtgacatagttcccaacccatcctagccataaacaagagtaccgacccaatcccacctacggccggaacctccgggacaggcaggcaggactgagcccctagcagcagggcaccaaccctctgccatgacatctcgactaccgggccgcagctcgtgtagccttcatttgccctggagaatgtccatcgacccccgacttcat

SEQ ID NO: 66782 - DNA, 2310 bp, Oryza sativa
tagccccaaattttagttggtaaaaagaaacacgaatattagaaaatgacctaatatcaaataataagaaggggtgaggtttcgaacccaggttatctagcctaccatcttgtgaagctagccggagcccgaaaaacctttaggtgtttctcaaattatagttggtactcaactgatttatgcgcccaggtggtcagatgctagccagtcctcaagttttaattgaagtctataacaaatcctaatcctgttatccaaggttcgattaagaagacaccaaagaaagaggcaaacaaattgtggacgagccgacggcggcacatctctgagcttgttcacggcaagggtgtagagattggaggaggccgagcgctgccgaggctgtcggccgggtggcgatggcagtgtctcggaggaggagaggctaggaaacccgctctcgctagtccgggcgccatttctttggcttctcgagggagcatggttgcgcgagacataaggcagcctaatcaacacgttacgtcagctaaaactgtcgtagaaaccattaggacccccaaaaaagaagtaaaaaaaaagtaaattacacccacagtacaacaacttgacatatggatgcgatatagtgcaagaacttgataattgaacgtccgagtgcaacaacttgacaagtggttgcgttctagtacaagaacttgacaatttaatattttggcgaatcaatttggctaagcatatgctaggtaaggtttttcacgatgtcaatatgccaatacacagtaatcctatggatattaccttataatattgagtttaatttttaagaattatattgcacatacaatttacattcagttacctttaagaatttttttgttttcttcaccttatcaaatatcaaccgaaatataatagtttctacatccagtttaattgactttcagttattaattattaggataaaaatataaatatgtttatacaaatccacgctagtatattgtcaagtatttaaaattttgaatttatataaaaaaatgctccaaataattaagttatcacaacttcttaatttattgtatcaaaatcgtacctatcttgcaagttgttgcatttatacgatcacttataaagatcttatactaaattgcacattcttgccaagttgttgcactataacgctcattttttaagttattacaccaaattgcatccatctgccaagttgttgtaccgtgggtgcaatttacttaaaaaaaaagtctctttcataatatctcgcagaatttctacatttctgttccccaaaaggggccatgaaactggcatgcaggaatccttcttttatgccaagcaacacggaacgcgaaaaagtaatcacaactcacaagcgcaaaacaagtgcttcattatttgaggaacaaagatgatttttttttgggacatggctcgttcaaagatgtcgtcatgattggtttcaagtgcagtttggtcgtaggatactttagcctaatctaaatcgtcgttgtccttccagccgcaattatcctaaattcccaatcaaaattcaaagccttttcggaagcgacactgccatccactggaagaagaggggaacaaaacaaaaaacaaaacgcagcaagattcctcgcagtctgcatcatcagcccatgccgagccaggcagctgaacccaaaatcattcgagcccgtacgcatcacgcacagcaattgataggttctcaattccagcgaaaactggtcggatcagttcaataagacaaaccactcaatatcctgttcatcttttttaaaaaaaaattcaaactgtttttcttgttttgacaaaatctatccaactctcaatcttgttttgccggtttaccaatgttttccgaaaaaaaaacccggagatatcggttcggtgaccggactgtcaatcctgaacccagctcaccaccaccacttgtaggcttgtggcagcaacaagctgaaaatgacaaggagaaatggaagaaaaaggcagagtctcgctgtgatcacagctcactgttggggagaatgaaaaacggttgtactcccttcgttccataaaaaaccaacatattaccagatatgatactccctccatccaaaaaaattaaactaacctagaagttggatgagacataatcttatgtcccatcgaactcctaggttaggttttttttttacggaaggagtacctaaacatatatctatattaggatatgtcacattgatactgatacgttttttatgggatggatggagtactaaaccatttgctagg

SEQ ID NO: 66783 - DNA, 666 bp, Oryza sativa
agaattgtgggtattcccagctttatttctgtagatgtttctttggacattatacagtaccaggaagggtatgtgcactttcatgttcttttctcagaagttatggaacaataggtttgtagacatgtaacattcatacttgtttgtttagatcacgaagaaggaactggatacagctgtaggcatacttttgccaggtcatatcccaagggctcaaaaaagactgatggtcaactatgagaagacccaagtagatgctgcagtattgtcaccatcaggaaatactgcaaggttcagtgtgcatcatatttttggcattggttctgttggaaatgacctggctctcccacaaataaaaaaggctcttcctccctcgcaaagaaaaaggaaacaaacttgtgacaagtaaggtaatgtgtttttcatggtaatcaaatagcactaaatactagtaatttactttatcatgatttaagtttctgcatgaatgtcgttgtctttagatactagtttattttgtattataaaaacagggaatgatataatttttatttttttttgtaaaatttggagggaaccttttaggaatctaacatttgtattggtatatatattgaactgaagttatgattgttgccaagttacgtttgcttttaaacttcactt

SEQ ID NO: 66784 - DNA, 5393 bp, Oryza sativa
  unsure (1)..(5393): unsure at all n locations
ccgtggattcgcatgcnatcaggtcaccctgcctgcatgtccaccgccggcactagcacccacgctcgcccgccggcgcccgttctgcctgcttcgcagccgcgctatcccgccgccgtcgcggcgactgctgcatctctctccgctgcgcgcgaccgccacgcccgctccgccgtcggccgcacacacgcatatgcctgcctgcgcgtgagaagttgagaagagaagagaaaataaaagaaaaaatagatgtgggcccacatcattttctctcactgacatatgggccctatatatttattttgatgctacgtcagcaaaatcaggcatctatactgtcttggaacctaaattagacagtttttgtatagtttaggggtgaagatttccggttttatggttaggggattttaaaaaatctcgctgttaagttgagggacctccggtgaacttattccaaaaaaaaggtggtgatcaccttgggccaagtgggctttgctcattgggcctccaaggtgcaaaccaagctgtgcctattcccctcctccggtcgtcggtgtgtcgccgccgccaacccatcgcctcgccgcaaccgcgaccgcgccggcgagctgcaccgcccccgtcgaagtttcccgcggagctcgtcgttctcgagcctcttccgatgctttctgcacggcgagccggcgccggcggcgccgccgggaagacgtcgcatgctcgcccctgcaaccctggttacccgcggcgctcgtcggtcccgatgaccggcggcgacgcgactagaccagccgtggcgagggcgcttcgccttccgggtagtgggggaggggcgggtttccagcggcgggagccccaccgatggctccgtccctgctcctcctcccggagtggagatggcgccgccgccgttctcgcctcgcgatccgggagcagcgacatgggcctcggggtttcttctttctcgccgtgctcgcttccccgccgcgtcgacgctcctcgccggcggccagtggtaggtgaaagtttctctcggatttctctcccgatgcagaaatgctgagttgctgcctctgcagtggtgttcgccggctgctcctcctcctcctcctcctcctcgtgtggaggtgcagagcgtccggaagaggcgaatgagcgaggaatgggaggcgttgaaggcagccatcgccgacatgttccggcccttgctgcgaaacctagctgacatttgctctctccgcagcgcctacgacttcgaggactatcaaatcggcatgctctttggtgtgtttgagttgagttcttaccgcaattaacaatgccgtcgattgtatatccttctgatcaccagaccacttatgttattcggtgaatgtgtatcaacatttgcaggtgcgtttctcggatatgtcgggtgctaccagctgtggaaggcggctccttccgtcttcgttgatgctgcccttgcctttgtgttttacaagctcagcgttgtgtcctcagagctgcaccggcagcgcaagacaaacagcttgatcacgcggcttaaattcggtattcattttcttcgtatttgatcagcagtttaagtcatatgtagaattgcatctccaaaaaaaatagagacataacattaataacctcaagtaagaagctggcctttttccaaggtttgatcactcattttgagtattgatgaatcactgatggaatatttaccctgtttggatgggaggatttccgtagctcaacagtgctatagtatcaagttgatacatcatgtagttggcaaaatcaaataaaagaaatggtataaacttacagtcccttttcttagttagaaggtggatatgttttggagcttgggtgcaagtagttctcagtttagtttgttctatgcctagaaattataacctcaggctatcttatttattgactactattcaatgcagggaccatacttatcatggttatgaaagacatcaagaagaactatgtactcctggacattattaggtcagtatctattttaaaactttttctttgtgagagagaggtaggaattctatcgaacttattaacagatgaaaaggaggttcaaagttgcaggacaaaatcactgctacaactgacaggtcaaactaaaatgaaagcaattgacaggcctaccatcaggactgccaggagatggttccttgttgcctgatactaatgttggaaagccctttgttcttgttatactacaagaatacttggtggcagtcgctagttatagactgataggagaatgctggcgctgatagtagcgtagtgctgtagtttcatggtggttttgatatgcttcctgcttttgttggtttttgtttaggcagtgaagccagagctggagattgagaatctgagataatattatgcccctgtgtttagaaatgaacttcttctcctaccatttggagctccttgcccctgggatctgaattccgagagccctcttaaacgatactttctaggactaaatatttttcaaaatttccagatatcctctaactatgaatttcaaatgttaatacgaaattacttattctctagtgcacatctatctaaattccatgtgtgatgctgtggataatagaggttatgttatgccatacacacagtggttgctagctctttctggcatcagtaaaatccttatttgcgaagattatcaccatcctagaagcaatgatggaaaattatgtttgcaaagagcagaccagaacaacacaattttttattgaacattttgtataattcaaagaggaatttacataaaagagcaccatatgctgtagaaagtgttgcatgtttcttagggccaaaaaagtgttgcatattgaggtcatgttacttttatactaagaatatgggtgacaaaagaagttaagttactgagaggacttacagcatactccctccaccctgaaaaaaacgaatctaggactggatgtgacgtattctacctctatccagattcgtagtactaggatgtgtcatatccagtactggtagtaggcaaaaaagaaaaaaagggatgggaaaaaggttaaagaatcacagggccatagggaagtagctggagtgttagaattttgccaattaacttgtgaatttcaaagagacaatgcttcttctacagttctactgcaataatactggggctgttttctcatagttattttatttctcttgttgatatttcattcgctgctaactaaactttgtttcatgatacagaatgccggttttcttcctctacatttgtgcgttcgtattcgatgttgctggtatgaagaagtatgccaggcgctcacttatttcattgtttaatctgctgaaatctagaggtggcatacaagaaatatataggattatgtggtatcctggttatatatctccatatgatgattctgctgactggtgatgcatttgtgtgagtggttcccacttaggagcttgttctaggaaggatggagcttgttctaggaaggatgccctccccttcacaaagttttgtaaagtataataacgaataaatagctatgaacgtatggtgagtctctacaaaagaaacattcttcactgtttaaacatcgacctctcgttgattagtactgcatctgtttccctgtggagtttccttcttgaaaagcctttttagctgaataagttgtgcttaagcttggaataaaattagctcagaatttgtgtgaccatgtgcgtatatatatatgcaatgttaaaaggaaaaataattactagtgagaattctgaataaattgtattgagtcatttgaagatccttaagcttgatactctcttttgatagaccgcgaattagattttcaagtaaattaattgcacattacactatctattactctatagctagtaccaagtatcaaagaaccttaggataggacagtttcacatgactccgtctacactagttttggagcaatttggtgcagagaacatctctcccaataggcgtcgagggaaatatccagcgaaaacccctaaaagctctctaaataaatgaaaatattacagatatagatataggcaggaaatccattaccatcaaatctccaaatcttaagtacaaacttgatttgggagtaagaaaaggataaattcaaggtgaataaatcaagatgaatacaaatagaaagatatattaaaagtaactcgtgcatcttccttctcatgtttcagtcttcactacatatcgatatatataagtcagtttcagaaacacgctggtagatcctccatcaaagctggaagagcatattttgcgtatttcttcatcccggacaagtcccacatgaacgaaagataatatatgtaaaacataggaagcctgattgcacaaagaaagcatggtcaaagcttgtataatacatagtgcatgcttaagcaaatacggcataaaaaatgcaaatccctcaagaacccccaaatgccgagatagagtttgagtggatgatttttttaaacacaaacctgataaaatcaagaggggatatcatattgcggaagtccctgaaggttatgaaaaagaggataactgcataaaagaacacattagatcactcgtgcaatttgaacatcatctgagcacttacgtagtttctttatatcacaataacatgagcaattgtatgttgattgttgcctttgtaatatttcccttttacatttttcacttcctccagttataaataatattgactaaattatactttgcactaggtttagcgcatatttctactttacaccagagtgttccctcgaaagcttaaaatatattcccacgatatatatgccttataggtacactttgcttgatataaagtgtgattattctaaatattttgtgtttaggacaagattatttgatcaaactcctgaaactttaacgagcaataatttcttaaatgcatggttaaaaaattgatatgcatagatttgccttgaagggcaccattataatgttataagcatattagactaagataaaagcaattaccaatatcaattccaaaatattcaatattatgactagatgaaagatcttgtaacccaaagaagcactacctccatttttaatgaaaccgtcttattaaaaaattacaaatcaataaaattataagtcatgcttaaagaacatttagtaacaaattaaattataataaaataagtgatatttttttaataagatgaatggtggaacgtttctttaaaaaatcaatggcatcatatattaaaaataaaagagaagggagtacctaatttaatgcgtatgaacantcggcgggtccaatccatttgcattcatggcacct

SEQ ID NO: 66785 - DNA, 8022 bp, Oryza sativa
ttcaggtagcggaactctcgttttctcagtgtgatcattcctgcgggaacatgtgatctcttgaatacagatgaaaactcgtcccaggtgatggtatgtccttctggccgtgatgcttcgtagctatcccaccattctgaagccagtccaaccaactgatgagttgcgaagacaacccgctcctggtctatgcactgaatcaaccccagcttcttctcgactgtgcgcaaccaatcactggcttccataggatcgacggcaatggcaaaggttggaggctcagttttgagaaattctgataacttgcactgttgctggactgtaggtacttgaacgttgtttgcccctgctgggttgttccaattctgtaatagttgaaaggctgttgccaacatgttggtttggttaaccacaatttggattagctctggcgaggtttcgttgatgcttttctcattcccattggcttgggttcttcatcttgtacttgatttcttggctgctgtgctggaacatccaaaggtacaatgccgatactggcctctatcttgtcaactggtggctggggctgaaattgagcattgacaccttgtggtaatgcactcgctggagttggagctgttgcaacggggactataggactgcttcgggatgcatggatgacaattcgctgaggagcaagcttctgattgtcgggagttgcttgaactgacgtgctggcagctatgtttctcggttttgggcacttgtcggcgaaatgaccccttccttgacaattgaagcaacagatatcttcccgaactcggcattttcttttctcattttgattcctctgtcctggcactggagttaggctgaaactgtaatcttggcgaggatttgtgttgccttgatgcttctctccgttggaactggcgggttggttggccatcttcttcgtcagcagaaaactgaattgacaatcttttggtacatgatcagttccttcacagaagaaacaggtgatcctgctcgtttgacacctgtcgggtggatggtcttcctcacaatgaacgcatgtagtggcacacgagctggcaacatgaccgatttctccacaacgagagcatgccttacgttccattttattctggttgaaactttggggagacttctcatcttcatcatctggggagacttgatctgaatcttcactatcagacactctacctccattagctaaaagatgctctgtcaactgtggtgcacctcggaaggtatttcttctctgacgtttggtcattcctggtggaggccattctgtgctggtaatgatcatcttacggacttcatcttcggttcgcattggtgtttttcttttctgctgaggacagttccttgcatagtgcccttgctcatcacacataaaacaaatgatacttgcttcttttgagtcaacatgtggcacgccaccatgggtcttttgggatgctggcggcatgctgacttgtggtgtgagtgattggactgcctccaactgcacttgagcttgtatctgactcaggttcagaattggcgtctgatgctgctgtagtatctctataagcaatcggttctggttaatcaggtgttggaccagtgtcacacaactggtgtctggtgcttcattcactagggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacacgctacacacacaagcaaggaaacacacgactaacgaaaccctagagggtggcttaggttctgcggctggttctccaagatcttaacttcggcttcacagctgacttcactgcttcctccacttcgctagcagaccctgcggtcttccggagcttcggcgaacaattggcgacatctttttcttcgcaaaaccaaccatgtagtactagttggaaatccgaagaaggaagaaaggagtaaacattttgcaaatagcattgaggaaaggagaaaaagggactttcgcaaatagtttcatttataaaataagtccttaggttttatctacttggcttatcctacagtcgagatggctctgataccatcttgtcgcgaccgggaaaattgcattttcccgaacgctagtgtattaatccccgtcccaggaaaagccggggtacaccatacaaacatgatataaaagacacatctttattaaatcgataatatttacattattacaaaggcacttaaggcctgacaatcaaaaataaacagcagcggactagcgggcctacggctccatcttcacaggcgctcaactggggtataagccaagactccacctaagacttcttctccaaagcttttcttactgaaggggggagaaagatagagcaagaatgagtacaaccacagtactcagcaagccacaccggcggatgcacgattaatgcaagggggtacaaggggtaatgatataggggttaagttttacagaaaacagcatttaaaagtcacttagttgcccaaagccattttaaaaagacgatcctaaagctacacagtattattaatcaaggccgtgaaccctcacgaacctgccttaacccaaggcctacgatgattcagaccgaactggcaacccgaccctgggtcccagctcgtcccaagccaacccaggccaaccattccacgttttagttattaagcaggttttaagaatttaaaacactaacttgggtacattgctaggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacctccgggacaggtaggcaggattgagcccctagcagcaggacaccagccctgtgccatgacatctcgactaccgggccgcagctcgtgtagccttcatttgtcctagagaatgtccatcgacccccgacttcatccatctccatccgtgtacttttgtttatgaccgggctgagccacaaactaagccttacccactagacatgtggaagtacggtagtgctttgcaacagaggcccgaagaccggtccttatgtggccgaggtgctactatcaaaaccatgcaccccgagcccagcctaaaaccattttggggattttgaatagagggggcggggtgaatccgattccacaataaaccaacaattccaaagtgtccaggtgatatgaatatcccaaagtctagagttgtaaaaccgcctaatgttacctaattaatcagcgaagcatctacctaaaatcatactagtggtaccatgagtagagtgtccactagttggggttttgtttattctagggtgaacaaggaaataataacaataacaataataaggtcataacaaaggtaaataggcatgactagataaaacagtgatatcgcgggaatttaaataaagcgataatgcaataatttaaatcaaaataattttataaactgggattcaatatgttcaaggatgatgtgacttgccttgctcgctttcccaaacgtcggcttcaacttccacgaagagcggatcttccgaagctgcagcgtctacacgaccaacggaaaggaaaaaggcttttactctaataaactccatataacaagcagaaacaaagcacaaaaatgggttcttgacttcttaaggaaaaattagagacttgaacggtccaattccgagttcaaatggtcaagttatggccatttgaagtttatatgctctttaaatggatatttgcgaatttcttcatttaaattttaatttaaaatcggatttattgcgtcagccgaggggaggggcgcgcggaccgggtccacgggagtggggcccacgcggcagcctcacggtccacggtggaccgggtgcacgcggcttacgccggccggcgccgtgggtcccacgcgtcagccgcacccgggggcgcgggcggctgacggccgggccccacatggcagccgcgggacgcgcccgaaggcggccacgccggcacagccgacgggaggcggcgcgcccgcgccccgatggtcgccgccggcgaccaccggcgcggcggagcggcgcccgagagaggggagggaagggggaaatgaagcggcggtccacggctcaccccgggtcgacggcgacgacggaaacggcgaccggagcggaggaaagcggcggcgcggctcgggtcgacggggtcgacggcgttccggcggtcggcgaccgaaatggaggggtggacgaggtcggcgaggatgcggcgaagctgaaggaggcggcgccgaggcgggagaaggtccggggcgacgacggcggcggaccggagctcggcggtgacggcggagagagagagcgacggcgcaagctcgattctggcggagagagagagcggcgagtggcggaaacggtggagggaggcacggggagtgtttatatagggttgggagggggagagagcggccggagggaaaggaaaccggcgtgacgctctcgggctccatcaatggcgccggcgggattgggggagggtttccaaacgaatccgagggagagagggagagaataatggggggaaagagggagggaatcacggggaatatttcccccctcttgattgcacgcgggacggacgggagcggcgggattcgcggcggcggcggcgctagggcacgggcgaggcggcgggagtggcggaaggtaggggatgacgggtgggccccacccgtcagcgagggtggcgggcgggcccgcccgtcagcggcgcgcgcgcggggagaggccggatgggccgcggggaagaggagagagagggaaagggatgggccgagccggcccaagagggagagggggagggaaagggaactttttagggtttttctttttataaaatcattttaactttgtttatttcttaataattattatttgtgctctgaaaattccactaaaatttgagggctcctttttgaccaaggagaatttaacaaaaattctccgggccacatttgaatttttcttgtacgtattttaatgtttgccaatttcttttcgaattttaattaattctattattccttttagaaaatgatttttatttcgggatgaatttatcaggacgtgacagatgacctcgccgagaaggctaatccctgtttgtgaatcgaagaacacaaacaagaacaaggtataatacaacaaaaattgcagatgaataattaagctcacaagttggggtcttacaaaccgatctagtggcgaaactgttctcgatagaataatctaaccaaaacccaaaccctaaaggtgacggtggctactgatatatagagtttagggttgtgcaaccaaccctttgatgcaaccctaatgggttccaacacgatacacggcccaaaggcccaaatacggtgacgcagcaccgggacagattctggacgttaatttgttcggtcgattcctgttgactcagaaataatttggatgtgggaccaaaaccattggaaaggttatcttcttagctttccatccatataaagaagccccaatccaagcacgtatgcgacctgagcgcccgttttagtgcagactggttctggactccgaattgacttggtttgggcctccaccttgatttggacgtcctcgatgatcctacatgactctaagtccttctccaagtgtttacttgtccactccattgttcctaatcacaatataatcattaggtagcaatttattctcaaattcgtacaaagaagaacataggaacgaactcacctctaaatttaattgtcgcacgcgagctcgtgttatcggtccttgaatgaccattggatgattgttgtgtgtatccgtaggagtgatgtccacatcagatgaaaccgacgagatcgtggtcgagaaattcgacgagatctcccggcgacttggctccgcgtactccggcttcgtaaactatggggggtgtgttggcggtagaattggatgccttgtatccctcccaaggtgtcctttttatactttggatcatcttgacccccaaggaaggtttgaggatatcgaacccggtacggtataacagaaactctatcccttccgagtaggactttggaaatcacttgactcgtagagattttttccataattcgggacattaacttagacttttgaaaggaccatcagcgcgaggcatcaactttgactttcccaattctggaaatctatcctttctcaagtgcaaccaaactaaatcacccggttcaagcttaacttcttgcctacctttactaccagcaattctatacttttcagtcatctttttaatgttgtgcttagttgtctcatgcattttcaaaataaattcagcacgtgccttaatatcattataaaccctctcactagtaggtaaaggcaagatatcaataggagcacgagggttgaaaccatacactatctagaaaggacttaccttggtagtagaatgtgttgcccgattgtatgcaaactccacatgaggtaaacattctttcaacatcttcaaacttttcttcaaaatagccttcaacatggtacccaaagtacggttgactacctccatttgtccatctgtttgtgggtgacatgttgtagaaaacaataactttgtacccaacttgtccatagtgtgcgcaaaaaatgacttaaaaattttgcatcacgatatgaaacaatagtagaaggtataccatgcaagcgaacaatctcatggaaaaacagatcagcaatatgaacagattcatcacttttatgacatggtatgaaatgtgccatcttagaaagacaatccaccacaacaaaaatgctatcccttcccctcttagtcctaggaaatctcaagacaaagtccatagaaatatctgcccaccgaatagaaggtataggaaaaggcatatacaaaccatgtggattcaaacgagacttagctttctgacaaatggtgcaacgtgccacaacttctcaacatcttttctcatccttggccaaaagaaatgcaaggccaaaacatcttctgtcgttttagctccaaaatatcccatcaatcctcctccatgcgcttcctgtatcaacaaaagatgaacggaaccaactggaatgcatagacagttagctctataaacaaatccaccattgatcacaaatttgttccaagtacatccctctttgcaatccaacatcacttctttaaaatcaggatcaagcgcatattgtttttaattgattcaagtccaaaaatccgacaatcaagttgggacaagaaaatatagtgcctagacaaagcatcagcaatcacattatctttccctttcttgtgtttgataacataaggaaaagattcaataaattcaacccattagcatgtctacgattcaaattattttgagagcgaagatacttaagcgattcatgatcggaatgaatgacaaattctttagaccactaataatgatgccacgtctctacagaatgtacaagggcatacaattccttatcatacgtggaataattcaaaacaggaccatgcaacttctcactaaagtatgcaacaggcataccatcttacccctaatgccaactccactagcatcacattctaactcagaagttttaccaaagtttggaagttgtagcaatggtgtgtgtgtaagcttgtccttcaaagtatcaaatgacttctcctg

SEQ ID NO: 66786 - DNA, 15992 bp, Oryza sativa
tttaaaccctccccgagctccgtctttcgtttccgccgctcgccgctcactctcgccgtcggaatcgtgctcgcgccgtagcaccttctctccgccgtcgccgccgtgcttcggttagccgccgccgccgctccgctcctcctcccgactcggcgacacctccctcggcatcgccgcatcgccgtcgacctcgtccgcgcctccgtttcgctcgccgaccgtcggagcaccgtcgtcatcgtcatcccgagccgcgccgccgtctccctccgctccggccgccgttctcgtcgtcgtcgttgtcccggggtgagccgaggaccgccgttcgccttcccccttccctcctctctctcgggcgccgctccgccgcgccgatggtcgccggcggtgaccatcggggcgcgggcgcgtcgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccactccccgtggacccggtccgcgcgtcccctccctcggctgacgcaataatccgttttttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagtctttttctttttccgttggtcgtgtagacgccgcagcttcggaagatccgctcttcgtggaagttgaagccgtcgtttgggaaagcgagcaaggcaagacacatcatcttgatcatattgaatcccattttataaaattatgttgatttaaattattgcattatcgctttatttaaattcccgcgttgtcactgttttatttagccatgcctatttatctttgttacgaccatattattattgttattgttattgttattaccttgttcaccctagattaaacaaaacctcaactaggggacactctactcatggttccattagtatgaacttaggtagatgcttcactggttaattaggcaacattaggtggtttttacaactttagacttgggaaattctcatatcatttggacactgtggaattgttggattatgatggaattggacatacacctctattcctctttcaaaacccctaaaacctgttttcggtggggtttgggtgcatgccagttatgggaagtggcaccccggccactataaggactaaagctcgggcctctgttgcaaagcactaccgtaattccacatgtctaatcggtaaggcttagtttgtggctcagtctagtcataaacaaaagtacacggattggagatggatgaagtcgggcttcgatggacattctccagggcaaatgaaggctacacgagctgcggcccggtagtcgagatgtcatacggcgagggttggtgcccaatgctaggggctcagttctacctgcctgtcccgggtatcccggccgtaggtaggattgggtcggtactcttgtctaaggctaggatgggttggaaactatgtcacgtcttccgtccgtataccgtggtggtatgtggcacgtggcaacacgtgagggagaggtgtcttgtgggtaaagatgtacacctctgatcagagtaaatctattcgaatagccgagccctcggatatgggcaagcctagcaatgtacccaggtcagtgtttcaattcttaaaatttgctcaacaactaaaatatggaatggttggcctgggttggcttgggacgagctgggacccaggtcgggttgccagttcggtccaattcatcgtaggccttgggttaaggcaggttcgtgagggttcacggccttgtttaataacactgtgtagctctaggatcgtctttataaaatagctttgggcaactaagtgacttttaaatgctgtttactgcaaaactgaacccctatattattatctccttgtactcccttgcattaatcatgcattctccggtgtggcttgctgagtactgtggttgtactcattcttgctcaatcttttcccccttcagtaagagaagctttggaggagaggtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacaagctggtatcagagccatctcgactgtaggaaaagccaagtggataaaacctaaggacatattttataaataaaaattatttgcgaaagttcctcttttctccttcccccaatgctttttgcaaaaggtttactccgttcttccttcttcggattttcaactagtactagatggtcaggtcagtgaagaagaggacatcgtcagttgtttgccgaagttccagaagactgcaggatctgcgagtgaagtggaggaagcagtgaagccggctgtgaagcaggagtgaagatcttggagaacccgtcgcagaacctaagccaccctctagtgtttcgtttgtcgtgtgtttccttgcttgtgtgtgtagcgcgtggtttgcatcggtgggtggtgatgtaaccatgctaggttgtttgcttaatcaacttgcagaataagcctaacatacatcataacagcaaaagacttagatctgttaaggtcctatccttagtttctaatctgtctctccccttcgttttccctctctccctctccaaacctttgcaacagatggctgacaatgagaaaggcaataaggtcaggagtcaggacattggtacctcaagctcccgagtgaatgaagcacaagacaccagttgtgcggcagtggtccaacacctgattaaccagaacaaattgcttatagagatactacagcagcatcggatgccaattttgaacccgagtcagatgcaacctcaggtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaaggtgaagttcgtaagatgatcattaccagcacagaatggcctccaccaggaatgacaagacgtcagagaagaaacaccttccgaggtgcaccacagttgacagagcatcttttagctaatggaggtagagtgtctgatagtgaagattcagatcaagtctcctcagaagatgaagatgagaaatctccccaaggtttcaaccaggataaaatggaacgtaaggcatgctctcgttgtggagaaatcggacatgttgccagctcgtgtgcctctacatgcgttcattgtgaggaagaccatccacccgacaggtgtccaacgagcaggatcacttgtttcttttgtgaaggaactgatcatgtaccaaaagattgtcaattcagttttctgctgacgaagaagatggctaaccaacccgccggtttcaacggagagaagcatcaaggcaacaccaatcctcgccaagattacagtttcagcctaactccagtgccaggacagaggaatcaaaatgagaaaagaaaatgccgagtccgggaagatatctgttgcttcaattgtcaaggaatgggtcatttcgccgacaagtgcccaaaaccgagaaacatagctgccggcacgtcagtccacgcaactccctgcaatcagaagcttgctcctcaacgaatggtcatccatgcatcccgaagcagtcctatagcccgcgttgcaacagctccaattccaatgagtgcactaccacaaggtgtcaatgctcaatttcagccccagccaccagctgacaagacagatgccagtatctgcgttgtacctttagaagctccaatacagcagctgagaaatcaagtacaagatgaagaacccgagtgtaagaaagttattgtttgtcacaactgcagtggagaagggcattactccaaaaactgtccccgacctccacattttcgccaatttacacgaagcagacattccaatcgtattgtggtcactggagcaaacgccgtacccgtaaggcctcgtgttaatcagaacccatagcagaaacaatgcaccaatgctccacctgctgcacctgactcggcaataaatcttagcaaccattctctgcaacgacagcctcagcaaagaattgtcgtagatggaaggagttgtgtctctccccgacctactccaggccgagccaagggcaatcaacctccggagggcgataccaagcagaagaccgtcatccgctgcaaccaacaatcagaaggaagcttctcctgtgaatgatagcattatgcagtcctatcacatcatcacagaaccaatcaaggatgcagtcactagaacaatgccagctatatctctccagaatcaaaatgagcagccatgtttgtggttttcagtccgctacttatcatggtgtaatcgaaagtttgcagcaatcatgaaattcataaatataatcatgtctgtaaacagtgagcttgctatgtttagagatgattcatgttgaggatacaatgtaccgatgttaagcaccgtcccttttcgtttaaggcagtgcctcgtattcatgtaatgagggagaaatgtgtaatacagacaagttccatgaggattcgtttgaaagatgcggatatgtgatcatgtgtataattgtttactgacataggagacctagggtctcatttcagaggaactgtgttccaacctcgagttaataaccaacctgttgatggaaaagaaaaccaattaaactgtgttgggttaaaaagccaacgagacagtagttgaggataggagttcggatacgccttttacagatcaagataaggattgttggaggaaaccccgaagggtactcgtcatgcctctacgttgataagatcggatatacctgccaacagataaggagatccaggagacatcaatatttgagaacataatagtcgatggttggtaattagtttacctggtatcagaacaaggtcaaaggtgatgtggcagaagaacaatttggatgctccccatctcgaggaagcactaaagatgaccatcggcaattaaaccctagtggtatagatacagatagcaggcaatgtatttccctgaaggtagtcagtgcagctttttgacgaaccacatcaaggtttcaccgaaaggcagcaagccaaaggacctcatcgtccccagaagcgtccgcaatccacattaaagaataccacctgttagagataagccgaaagaagattgataaaagggattggcaaagatgctctctagcatgaaagaagtaggccgaaaggtgattgataaacagaagcatgctctgcatcgctcacggaagacccctgattgtaattgccccgcaacagtcaccttgtcattaagtaagcaagatgacctaggtaaaagtgtttctatgaaggcaaagagtgaaatcttccactcggtatcagatgctacacggagtgaaaaatgcaagcaccggttaccaggcaacgccacgtcctgggagatgatccaacgggaaagaactcatcaaggttaaaggtgtaaaggaatacgttgagtgctaactgatgacaacatgaagagaatagcggaaagtaaactgaacataaagaaagtgaatctgagttgcttgtttgtgggagctattcccagttatgaaccaagtgatatgttcgaagatagtctacagaggtcagattaagatcacctctaacaacgaagcttcagatctggcaggatcacgatcagacaataagaagtccagcagtaagactatttggggagacgtcaaagtatgtcaagtgggataaattggttctcttgggaagcataacttatagttagagtggttgaccctcgcatcgcatagcagaagtacctagcaccggagaccaggaaagctaatatgagacagttgatggcaagttagaagtgaatgacaagcatgatattcttatgatgacaaacatagtatcctagtaatgacaagctagtgttgacgcatgacgtgaagtggtaacttgtctgaggttgactccgaagatatgaatcatgagaagttctggaacggaagcatcactggactaccgcaacctagtctgagtcagccaaaaggtgcatcctggtccaagtcaggtgaagagaagattccatccgcaacaggaggtcaagccaagcagttccgagtggtaaagttttgctggaagttcgtcaagacgcaacggaagaagtcagacaagaagagaagaccgcccaacctatcttcttgctagcctcctcgaatctcggggacgagattcttgtaaggggggtggatttgtcacgtcctgataaattcatcccaaaataaaaatcatcttctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagtcgaaaaggtttataaaaagaaaaaccctaaaagaagtcttctttccccccccttcctctcttgggccggctcggcccaactctccctccctctctctcctctcctccgcggcccatcggctccccgcgcgcgcgcgcgccgctgacaggcgggcccgcccgccactctcgctgacaggtgggacccacctgtcatctccctcctctcgccgcgcccgccgccagcgcccgtgccctagcgccgccgccgccgcgaatcccgccgctcccgtccgccccgcgtgcaatcaagaggggggaattaatccccgcgttcccctcccccgtttccccctctttcccctctctctctccctcggattcgttcgaatcaagcccgtaatcgtcgccggcgcaatcaatggagccgaatcttccgcgcgcgattcctccctctccggccgctctttccttcccccggcgctatttaaaccctccccgagctccgctctttcgtttccgccgctcgccgctcactctcgccgtcggaatcgtgctcgcgccgtagcaccttctctccgccgtcgccgccgtgcttcggttagccgccgccgccgctccgctcctcctcccgactcggcgacacctccctcggcatcgccgcatcgccgtcgacctcgtccgcgcctccgtttcgctcgccgaccgtcggagcaccgtcgtcatcgtcatcccgagccgcgccgccgtctccctccgctccggccgccgttctcgtcgtcgtcgttgtcccggggtgagccgaggaccgccgttcgccttcccccttccctcctctctctcgggcgccgctccgccgcgccgatggtcgccggcggtgaccatcggggcgcgggcgcgtcgctcccgtcggccgcgccggcgaggccgccctcgggcgcgccctcgcggctgccaagtgggcccggccgtcagccgcccgcgcccgcgggtgcggctgacgcgcgggacccacggcgccgaccgccgccagccgcgtgcgcccggtccaccgtggaccgtggggctgacgcgtgggccccactccccgtggacccggtccgcgcgtcccctccctcggctgacgcaataatccgttttttttaattaaaatttaaatgaagaaattcgcaaatatccatttaaagagcatataaacttcaaatggccatatcttggccatttgaactcggaattggaccgttcaagtctctaatttttccttaagaagtaaagaacccatttttgtgctttgttcctgcttgttgtttggagtttattagagtaaaagtctttttctttttccgttggtcgtgtagacgccgcagcttcggaagatccgctcttcgtggaagttgaagccgtcgtttgggaaagcgagcaaggcaagacacatcatcttgatcatattgaatcccattttataaaattatgttgatttaaattattgcattatcgctttatttaaattcccgcgttgtcactgttttatttagccatgcctatttatctttgttacgaccatattattattgttattgttattgttattaccttgttcaccctagattaaacaaaacctcaactagtggacactctactcatggttccactagtatgaacttaggtagatgcttcgctggttaattaggcaacattaggtggtttttacaactttagacttgggaaattctcatatcatttggacactgtggaattgttggattatgatggaattggacatacacctctcttcctctttcaaaacccctaaaacctgttttcggtggggtttgggtgcatgccagttatgggaagtagcaccccggccactataaggactaaagctcgggcctctgttgcaaagcactaccgtacttccacatgtctaatgggtaaggcttagtttgtggctcagtctagtcataaacaaaagtacacggattggagatggatgaagtcgggcttcgatggacattctccagggcaaatgaaggctacacgagctgcggcccggtagtcgagatgtcatacggcggagggttggtgcccaatgctaggggctcagttctacctgcctgtcccgggtatcccggccgtaggtaggattgggtcggtactcttgtctaaggctaggatgggttggaaactatgtcacgtcttccgtccgtataccgtggtggtatgtggcacgtggcaacacgtgagggagaggtgtcttgtgggtaaagatgtacacctctgatcagagtaaatctattcgaatagccgagccctcggatatgggcaagcctagcaatgtacccaggtcagtgtttcaattcttaaaatttgctcaacaactaaaatatggaatggttggcctgggttggcttgggacgagctgggacccaggtcgggttgccagttcggtccaattcatcgtaggccttgggttaaggcaggttcgtgagggttcacggccttgtttaataacactgtgtagctctaggatcgtctttataaaatagctttgggcaactaagtgacttttaaatgctgtttactgcaaaactgaacccctatattattatctccttgtactcccttgcattaatcatgcattctccggtgtggcttgctgagtactgtggttgtactcattcttgctcaatcttttcccccttcagtaagagaagctttggaggagaggtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttcccggtcgcgacagcgtttgggtgggttcgcgtattctgctgcgagaacttctgcttgagccttccttttcccactcttgcgatttttcttcttgcttgactcaggtgcgtccgtggctggtttcttttctcccccggtcttcggcttgtcgttcttgcgtctcaacgcatcgtcaacgtgggcacatcgctcaacaatttcgaataatctccgagtagttcttatgcgtcttgtcgccaactcctgggtagtatagtgatctcggacaccggacttgaaggcgcgaattacagaagcatcggtgatttcggggattgtatttctgcactcgttaaagcgccaaacatattccctcaaggattcacccgagttctgtgtcaacgcatgtagatcgtcttcgatcgcgtggcgcttgtaagttccttagaaattggcgacgaactgctgccacaggtttgcccacgaagaaatcgagtagggcgggagatgcatcagccatgagcgtgcagagccttttaatgcagttggcaaataatttgccaacgcgttgtcgtccgctccggcagcgtagagtactgtggagtagacttgaaggaattcttctgggtcagtactcccatcgtacttctctattgctctgggtcggaatctctcaggccatcggacatcacgcagggaacgaccgaaagctctacacccagtgctgggggcagtgggttgtcagcgatcatgtgtccttcgtggatgtctgtctgacgatgaggatgaagaagaagatgacgatgacgatggatcgcttggttccggtgtgggattacgaggtcgtcggctgggttctcgagaatcctgtcgtcgccctccgttgttgtcccggcgccgatctctgtcgtcctcgtcgttatagcggcatcctcgaccagtatcgccttgcgtccgcctctcgcaatcatcatgatcgtggcgattgtggcgattagtacggtctcggtcttcattatcgcgatgtcgtgaagagacgcgatgtcgggagcgattcccatcgtctcgtgtgcgtcgtgcctctcggcgaccattgaggtggtcacagagatcgccggtgccgcgaggtggaggggtagctcgagggggtgactcccgctgttcgggatttttgccattgacgccgccagttggtggctgttcctggtgcgtagcagcagcggcctcttcaaacgcgtggctgaggttggttactgattcccgtagccgttcctgccaccgcgcgagatcatcgttcagaacgggatcgtaaggagtctccctcagtattgtgttaagggtcctgatgtgttgggccggtgtagtcacttgattttccgcttccgcattagcgtgtgctgacttgctggtcccgttgatagctaatagctcgcttgacgtactcattggtgatgagccgtagtcctcgagtagatgtagaactgatggtacgtgggaatcgatgtcgataacgccaacgaaccgatctgagaccagcgttccttgttccttgtcttcatctctaagggatatgcctgactgctggaccttaggagatgacgtctttgtggtgctgagaaagaccttgcagcttgagaggttgtgattctttgtcttgtgaataagacaatagacatgacgagttggagaaatacgctgaattccacgctctttgcaggcacgaatttcggcgcggacgttgagaaaaacccagcatgcttgcaaagtgtgtttcctggttttgtggatagggcactaggaccttgtcgcgtcggaagttattctcgtcggctcgtggttcttgtcggaaagacaaggttcggccgcattagaatccttctcgagctcggatgttgtcaacgttccgttctccgcttcggcgggaggatctttcgacacggagtcgtcctgggttgtagctactgtgttctcgtttccggtcattgatggaccagctgagatcggcatcgtggcgtaaaccgggaataagatttcaccgacttgaggttggtgctgacgctgttgtcgacgaagctggatgacatagtagtagaaccttgagcaccaagttctcctacctggcgcgccactgtcgacgggtgatacccgtagactggatatagagggtattggggtacgttggtacaaggatctacgtaatacgacatcaagcaaacaaaaagacgaggattatactggttcaggccccttgataggtaatagccctaatccagttgatatgggattataagatggaaaatcacagattaaagggaacgatggaactcgatgacaccggcgagattgtaatcgagttagttcgactagatctcccggcgatttggctcctgcaggctccgacttcgtaggctgtggtcgttgtgttggctatgacattcgatgccttaagtcctctcagggggtcccttttatatcgcaggtcaagcggtttccaaatagaactcggagacatcaaaccctacacgatacattgacgacccagtcttgtccgagtaggactcttattttctgcaaactccgtcaaggatttccttagtgtatgtagagaatgtccatatatgcgcgggcatgccatatcgatatgtaacgtatatcgaacggtaaagggtctacctaacccgtaaccctgacatacatatacatgtctagacgtatataaagtttgtatacgtgtataaaagtttatttaaaaattgaaaaaacagaaaaagaacctaaaaaaaaggaaaagaaactagaaaagaaaaaaaaaggaaaattgtgccatcctccatccgccccctctcctctctctccgcgcgcgccacgtgtcccgtcgcccgaattaggaaatttcatagaatgaggggatattgttacaacagacaatgcggccttccatcccacgacaatccatcgagccttttgaagaggaacagcacatccgtaggacaagcccaacaacagcccaacagcccaacaacgtctcctagcccagacccatctcgctgtctcttcttgtgcctttgctcgtcctttcctcctccccaaaatcgatcaccggcgcacgccgattctccaccgcttacaggttcttgagctccaccatagttgccaggtcgctgggggatgggaggctgaatctgcgcggggaaaactgaggaggcgtgatgatggatggggctgctggtgtgtcgtcttcgcctctcctctccagccccctcatcgagtctcatcctccccccacggagcattcggcaatggcgtcaggaaggatggtaggttgcgtctgtggcgatgaggaggaggaggaggaggaggggtcgactagtcgccggcggcaatggcggaaagtgcacgaggagagaagtgatttttttccctgactcgtctagttgcatcttttcagtttcattttaaccattcatctgagccgacgtgtatgaccatctccctctggctagtttgtcgttttctgaatccgatggccaatattcattgcatgatgtggcacattccaactttcacttagagagatactcccttcatctacttttgatctacttttgatattaatattttatcttttttacggatgttgtcgaaatgacaactgcatacgtcgaaagacgtggttactcaacagtggttggaaggaaacgaagtgtattgaatcttgaatttcttcctttttttctggattcccccattacatggccctaggggactatttatagccccattacaggttcttactactagggtttaggttgtacaggagaatttacatgattacacttacaaaagggacatttacaggggtacataatgttataagggctcatgggcccctgatgggccgtctggcgatcgccggccctatagcccctaggcttgatgggccggaaaggcttcttcggccctcgcgggggcgaacttgccatggcgaagtcgtcttccttcggcagatagtcttcgccttgcacccttcgcctgagacgcctctggcctggcaaggcactcgtacgactcttcgcctcacgccgttcttgctccatagctttcgccacgggtttcggcagatttggtcgaagggcctcatgccatccgccaacaagccccttacgggtaagggtgagattggagcttcggccgagaccgtgcaaagtatgtggtatggtatgcggcgccccctttcaaccgatgctcctcccgaaacctacattattcctgcgaatgaagtttgctacttgtgcgcctattattattttgccgcgcttcgcctcctgcgattggtggttatatattttcttttcccgggccgaacggaacagtattggactttcccttcgtggggtttttactgtgccgctcggttggtgggaatttaccgtttcgcctaccattgcgacacgtggcgctttattactggtgggtaggcgaacggtcgcccgggtgagctatatattcccactgctctttccttttcaccgccacacttgccattttaccgtgtgcgctcttttcctccgtttctttcttccacagcatctctcgacccctcaagcatttcgcccattccacgcaccattcgccatggcccctcgcaagccaaaccctgcttcggcgaaagggccggatcccagccgagtcgatgatgacagcaccgcctttttgggggtctctcttgtggacgacgtcgagctggcgaagctggtcagctctggggcgttggtcgaggggcaggctttcgccccagggaaagccgtggtgccgaaacctatcgacaatcggacggtggtattcgccgtcttttttgaggcagggctacggtttccctgcaacgtgttgttgccggagatccttcgcctcttccaggtggaacttccacagctgagcccgtcggcgcttgttcgaatcgctatcttcgactgggcgtgccggacttccaggtttgagcctaacgccgagctcttcggcgccatatttttcgccaccgtgaactcaaagacggtgattatctcggctggaacgaagaagatagtgttcgggagcttgaactttaacgttcgtcccgagcggtccgatctctggccggtgaacgctgccatatcgaagtgggaccgccattggatggctaggtggttctatcacaccatccccttcaaggttggcactgactcggcgaaagccctccgttgccggcgtagggcgatcgcgcctaaccgaaaacccaagatcaccgtggacggtgctatggaggcgcggttcgttctgctgcgcaaggtttgctcccgccttagctgctgtgacatggtggaggaattctgtatgcttcgcatctttccgctctcccagtcatggcaagtcagagttgatcaaggcgaagaggttgacggtttgccgaacctggttcttcctgaggggatgaacagtaagactgttctcgtgctatacactgctgtgctttgttatcttgccttgtctaactgttaacatagctacacactttacttttgcagcgttgaccctcgaccaggctgaaaacgaggcccgcaggatgatcggcgacgtgtcggtcgtcgagtatagccagttgctaacacgacaagaggctgggcgggcgaaccgggtttacaacggcgaattgcctcctcgggcaaacccccacaaagctgacgatgatgcagggccttcgcgaaagcgaatgcgtggacaagtgaagcttgctcctaggaagcgaagggttcctgcttcgtcggactccgacgccaacgacgaggacgacgccgaagaacgcgacggcgaggaggaaggagaggagaaagaggaggaggccgtggctgataaggccgcggacgaggcgatcgaagaccgcgtcgacacccccggctacactcctaccccaagtcccagtcacaacaagactggggtagagtcgaacagctcccctgtcacgcccggaaattcactaataatttccgaactaatttgtgcataaaatcctcgtctaggaatcagccgaggtacacaaactgacaatttaatatacaaatccatcataataata

SEQ ID NO: 66787 - DNA, 7100 bp, Oryza sativa
ccctgtggccgagctcggcgaagccgtgcgccaccttgttcccgccgcggcgcacgtgggacacagccatgtcgtcgagctgcgggagcagcgcggcgatctccctgcacagcctcaggtcctcctccgactgcacgtcggcgcggtcgcacaccacgtcgaccaccgccttggagtcgccctccgcccagacgcgccgccacccgttccgcaccgccagctcgagccctcgccggagcgcggcgagctccgcgacggagctcgtcgccgtgccgatccgctccgcgtagccgagcaggaacgcgccgtcgtggtcgcggtacacgccgccgatgctcgcgatcccggtcgagtgcttcgacgacccgtcgaagttgagcttcatccacccctcctccggcttcctccagatcctcgccgacgccgacgagtaggcacgaagacgcaagatccgccgccctccgccgccgacgaggatgcaacccagaacggggttgcgccgccgcagcacacccagatcagcgcggtgcacgcgcagcatcaccgatcccctcgcagaaaaaatcgcaatctgttcgtgtatttagccccaagcggacccaccaatagggcaaggttgggaaatggctagacccaccggcgccggcgaatatccgccttccccggacttgttcctcttgagcgccgccgcggcgcaggcaaagctcgagcagcgctcaggcgcgccatggcggcgccggcggcgaaggagaggagaagggtttgcgttgcgtgtgttgctgtacttgataatgggctatagtcctatgggctacatgtggatcggcccatgatgacccatatttgtacccaggcccaggcgtcaattcattcatgggcttcattccaggccgtgtttgtgatcggtacgcagccatctcttccttggggcttttaactatttgccatttttagatttggcaaataactatttgccaccccctatctcaatgatatgtgggtccacatgtgtctatgacatgtgagttcagtggtaaaaaattaattacaacatctaaatgtggcaaatggtcaaatgcactgttctgactgcagaacatcacaaatcgtgatgaaacattgaaacacacacattaatcactggtgttggtagtcagcccactacacggtccatccatccttggacaaaagccgacgctgcggcccactacacggccccgtctcctgcgtactcaggtgactcggctacagcctacagagcagagctggttactctgcttcgtagcaaaagacgctttgcactttgcagcttggtgagcgtttacgacgtacgacaacgcgtcgcacgaagggaaactactaccgtgccgccgcgcgcattcctctgccaatttctaaaggcgacgaggaggctgtgtgttgcagtctcccggttaagtttccaggcctttttctgtgtcgtgtataacagctagatcaaggctgaggcagcctgcaattccaattcgccatagagagagaaaaggaggtttggctttggatagctaatatgctctctaagtaagcgattaactgatttgtttatgaacaagtgtggatcgtttcctgcgtatcagatgatcttggggataagaacaagccagcaacgctattttccaagcatatataacccagatcaatcgactggaatcagattccttcgatctcaatgcgtatgcatgcgtacgcattggaaggaacctttgctaacttcgaagagaagaagcacatcgtagcatctcgatctgcaactgtgtttgcaagcagacagagcagctagcacaggttgcgcaagcagcagtttgctgctaatcaggagacaccagactgaaaatgttgtgcccctttcaccggctcttaacccctggagattctgcatctccaatcccatattcatattcttcaacaacttgacactccataacactagttagtccagtatcgccactgattgatctagagcatggagagaccaacctagctgtgagatgagacatgcatgcattgcatgctccgttgctgacctaggcagctcgtgatccggtaccacacttaattaacaagctaattgattatttgattacagtactagcacttaattaaatcagccatggcgatgtaaccacgttgcagagaagaatcctagaagctagcagcagctagtagaaatgagcacagctgtgcctcctcgcagtggacagctcacctcaatctgtagcacacaaacactacgatccccaacaatccaatctacccaatttgcagcaaacaaaaccgttaaatcttttttctcagggagcaaggctcacgtgtgcatcgacagatcacagcgtgaagccgtggagaaaacaccaagcccagcgtgcagctgctttgaccgggcgtacgtgcatccgatcgatcgatcgatcgatccgagcagatgccgctgcggctgcgccctgtcgcgggggctccgcggcgcaacccgcgggcgctgccgccaccggcaaggggacatcgtgccgagaatctcaggcgcaggggagaggcagcacggcagcagccagtaggcaggttgcagttgggtttttttttctgaatttctgaactggccgtggatggaggttggggattcagaggggagaaaaaaccgagaaattgccaggcgtgaggtaggtgcacaggcagcacagctcagtgccactgccaatcatccgatgaattgataaaatatttatcatttgaaggcgtggcagatcagggcagtaatgaacgaaacattactacagctcatgacctggctacagttcacgatggacacctcatcagctaagaagcatctaccaagaatcttacttccatccacatcaatcagttcgatcaattctcaccggcaaaattcctggagatataactgatgaaccagttcaagtgcaacgcacacagatacatcatattaattcaccgcaccgtgcactaaacttcacgacggatctccgcccggttcgttgcaccttgcagacgtctgattttagtgattcgatctccaaagtctccgtcggcgctggaccaaaaatatcaccggagcagccacgatattgcaccaaatcaacacgctactagtgcccaaaaaaaaaacggagtacgagttggcagtagctgtgtcaaccgggggaaattccgtgaggtcacgaacgccgccgatgttggacaggcgagcgagacggcgacggcacggtgaattcaagaggacagtacgggtacagtggcatatggtgtactagtctgtcttgaaaaagggtaaaccctcgtaactaggattgattttttttatttttttctaagacgaaggggtacgtggtgatacttgagagaggcgaaggcagcaaacctggagatcgaaaaccgtcgctttcgagcccttttctcgtgcggatctccttgccgcttttgaagcttccggccacattttcggaagctcccggcccagcttactgctgaaaaaaaaaatcatcgcgtccccgtctcatcagttcgttggtcacggatgaggcaaacgcggatgaggggaaaaaaatcgggatgattttgatgggactcaaatcaacctgagaccgggtaaaacacacacgctatacgagtgtggctgtgtgggtgacgagactcgccagtaaaatttgacaatttgacatcgccttcgccgtgttgaattgggcaatctccagacggacggagggaggcaggccggcacgcacgtcggggtggctccgtgtgttttgacctcgccaccactcggagcaggcaaggaggctgctaattcttgactaatcatagtcatcaatcaagaagacaaaaatgaatagaacaagtattagctgatacagtaagtctttggagggcgatgacgtctgcgcccgtttgcaaaattgttcaagcgaacttcaattccttaatcgatcgactgattatgtatgaaaattgcaagaatttgggaggctgttcgtttccttttcagagaggaagaggcaatgtatggatgcacggacagtttgtgaaacgaagaagcttgctgatcaattaattcagattccagtttccacttggaacgaagaaacaagcagagtgtagtacatgagagtacaaatgcgattggaatccgcgaaccaatgagcagtgcccttgatgaatcctgatgctatgaacaacgagaagaaagaagaaagaaagaaaaaaagaagaagaatcctatccatgtcgaactttctaatgaaagaggaactgtgaggcctgggcgacggcgtcgtcgagccaccggcgaggctcgtccatgaggtcggggctgagcctgaccatgaggacgcagaactccatctcgctgagggcgccgtcgccgtcgaagtcgccctcggcgagcatcccccggaggtcgtcgtcggacatcccgccgaggccgagcagcggcgcgttgcggcggaggctgtcgaaggtgatgagcccggaggccgggtccatgagcaggcggaacccgcttgcgagctcctgcatcagcccttcctcccccagcctctccgccatcaccggcaggtagtcctcgaacccctcctgcatcatctgctgctgctgtctctgctccgccgccatgagaatgagtgaggttgactgatcgatcgatttgttgtgttcttgtttgcttcttgcgatctttgagaggaggagaagaggagagggatgatttgatgtggtggggaggaggcgggaataaataggggaggaggaggtggtgggcttcagagaagttgcgagagaggacggtggatgtgggggggtctcacgtgtgggtgcgtggtggattgtttggattggattcctggacgcgcggggacaggttggacgcgcgcgcgtaggggggaggatgggatgagttgggcgtgggctggagggaggaaaaccgcggcttcctgcgcgcttcggcttggacgtcgcgtcgggtcgggtcgggttgggtcgggtcggcgcgagcgcgtggctgcggccgcgtgggtgtgctgtgggtgcgtgtggctgggcaggtttcgggtcgtagcagcgccgacgcggtgacgtggtcggggcggcgggtggatggtgcgtgtcacgtcacgcttcggggtggtggacagacggacggacggtgtcggaggaatcgtgggaccatgccgatacgagatcagggatcatatttcttcgcccacgtataaatcaccagacaaaatttttcatcatatcacattgagatatcacattgaatgtttgacacgtgtataacgtattaaaaataaaaaaataactaattatacagattgcgtgtaaattatgtgacgagtcttttaagcctaattgctccttgatctgataatgttgtgctacagtaaatatttgctaataataaattaattaagcttaataaattcgtctcgcagtttacaagcggaatctataatttgtgttattattagtctacgtttaatacttcaattgtgtgtccgtatatccgatataacacaccaaaactttacgcccctatatctaaacacagtcgagaaaaatgctataggacggaatcttgttcgaacagaatgatacctctgagctattgttatctgatacctgatagatatcgactaataccccgttcggatggaataatatctttgaggtatcgcctgatacctggtagtggtaggtatcggctgatacccaggtatcaggtgatacctctaagatattatccggatcaaacgggataccgtctagtagcattcccctatttctaaacataacactaacatttcatgcttacgacacacgcatactcacatctatgaacatatatgcacaccttatctttatgaatatttttgaaagattaagtcggcatatattgagattgacgaagtcactacagatatctcgctgttgatgagtacataacctatcactgaaagaagctatgaatgtgagcattgtgtcgtagtatttttgattgaatggctccgatcaaacatgatttctacgaaattcatcacgaactcaaaaactttgatttggtcaagactcaggagagtgatttgagtttatctcgttgtgaaattcaggggttcctgacgttggacctcctctgctgcgtcgactcgacttgcttaggtctgatttagggtcacgattgagaagtttcgtgtcccgttttttggtcgcccatgttgggcacgtttagccgtaacaggacgaagtgtcacccatcctttacccaaagtttccatggaagcttcggtcagaaaccccaaaaaaattttgacaccaaggaaggatccatactccacatcgctttctcgagtccaagtcgcgagtagagcagggccagaggctgttcctacttggggatctcgtacggttctcttcctttccacagattgcttttgcttaggacgccttttcttgggtttcttcctctttgtttgctaaggccctgttttcgggcggtgaaaagttttattgtgtcacatcgcatatttgaagtattaaacatagactaataacaaaaaaaattatagattccgtcagtaaactacgagacaaatttattaagcctaattaatttgccattagcaaatatttatagcaccacgttatcaaatcatggagtaattaggtttaaaagattcgtctcataatttacacgcaatctgtgtaattaatttttttatctatgtttaatactttatgtatgtatcaaacattcgataaacattggataagatacggtgaaactttttgcgtgggcagagtaggactagtattttactcgtaccagcagccgggcctatctcacttcgttgtctgcctttcacatctcgaattctcgactccaatctccatattttccatgtgcttttcctctctgactactaatatcactttatttctgctgatgatgctgtcactttcacactgaagctctcagctcaagggccaatgggccatgttggtgactacttagtgagcaactttctaaaggaaacatgaagatacaacaaactaca

SEQ ID NO: 66788 - DNA, 660 bp, Oryza sativa
  unsure (1)..(660): unsure at all n locations
cgtgtggaatgattgnctgtcgtctcncttccangccngcaggtcgactctagaggatccccagtttgtacagctttgttttactccaggttttttttttgtttctgttcttcttaattttctcttcctccttgctcgtgaagacgcaattcatgaatgaatccgtgtcagctctctgatagttttatgtcatgtcatggcatgccctgatttagtgctgtatactgctacttcttcttctgagactagttcctcatgcacgtacgtacatacgtgagcttttcagacgtttgatgattgaaattggttgcgctaacttattatgcccattctgtacaaatctatcttgcacgtccatcctggcatcatattgattaatttactgccaaagagtacgtaaactctcgagtaacaataatgcaatcagctagcgtgcacatactggtcgaataatcctcttccatccttgcatcatcttgattaatcccggaacgtaggaattttataggattttcacagaaaacaggtcgatttctccaaaattcccgtgaaattcctccaaatcgaactagccttaaactttggttgtctatgtgcctatacccctcacaatctcacagcggagcactatccatgatctgatcactaatatataaggtg

SEQ ID NO: 66789 - DNA, 13374 bp, Oryza sativa
  unsure (1)..(13374): unsure at all n locations
cctgtctataaagctggccagtgttggccaacaattacaattaaagcttgtgagaagtttgaagaaataccggaacctatatgttgtacagcaccggatagaagggagacttatatatccagaatctttaagattcttgccgttgtacattctgtccatatgcaagtctcttgctcttcgtggtggttacgcagatgtttctcttgatgaacgttgtgctgctggtttcagcatgatgatactgcctgcaaaaaagctgctcaattttatttatccttcattgtacagggttgatgaagtattgtcaatggtatgttatatttccttcatatacatcttgttaagttaaaacatcaatactctgtaaataaaatatgaaatgaaaaaaaaaataacttctagtgttagccttttttggatgggaataatcagcacaataacttattagtgttcaacaattagtttggaaggtctttactttgtggttttgagaggaaggttctgttttactttgaaactttagagctattaataattaataatgaaataaatgcatcagtcaccgagctgttttcgttggtacattagaaacacgcctttttcttctgtttagcttaagcactgtttgctaatgaaattgaattttccaggaaccagataggatcggtggatccttgaagcggttgccactaaccatgcagtgcttagacactggtggtctttaccttcttgatgatgggtttaccttcctagtatggttaggtaggatgctcccacctgaacttgtgaacaacattcttggagtcagcttggcaaacttccccgatctatcaaaggtacactttttactctctagtcaatggcaatgcttgctataaattcatcaagaagggcagagcatatttccattttattatgtcctaaaataaagtctcaagtatctctgctaggactgaacactttgttccgtaaattgaatctagttgttaatgtgggtaattccaaactagttttgagttacaactatgctaactgggatatcttgcaggttcaattgagagaatgtgataacgagtactccagaaatttcatgaaaatactagggaccctaagggagagggatccttcttaccaccagctctgccgcgtcgtacgtcagggtgaacagccaagagaaggctttttgcttctatctaacttggtcgaggatcagatgtctgggactagcagttacatggactggatactccaaatccaccgccaaacgcagagctagtcacgatgaatcaagggaatcgccgttccaaatttttggcttattgtaaactgctgcagattcagccgctgccagttcctaatctctcgaaacagttggaactaattcgcaagtcagatgtccagaatgtcttccccttagcagcagcacgctggcaagcaaaagttttattgttaatattcgtccctgtgattattttcctcgtgagtgaaaatacagatgttgtatgagaataattagggcaacagtgaccattggtaaggtatacaacttggtgttcttggaaatgtgctgtacgttttttttttccatttttgtttttattattgttcacatttctagtttgtgccgtgtcggtctcctggtatttttagttctccaaagtttgtcgtgtaaaactcatttttgactgatgatctagctgcatgtaatggggggagggctcccatttaactggtgttcttcggatgtctgttcgtgtcattcattttctgataccctgttttgattctggatgtggctactggttagtctcatcatggtttacgttgttacgaattgtagtcgcatttaaattcaaatgaaatttgctaagataaactcagtaaaaccaactactcgtgcaagagttactgacccatgaatgaagtgacggtgtctcgttgctttgtttagttccgcgagggcgaagctaatgatgttttgatattgagaaaacaaggtgaaaagcaaatattttgtacagggaggtttttttttttaaaaaaatattattgcttatgagctgaatacaccacttatatatgaaaaataatttgagtagggtttctccctaagaactttaggtgcaaaaagaccaaggaaaacccatgcacaaaattaaaaccatgcctcatgacatgtggttttgtgaaatttaatcttataattacggtcatgtggttttgtgaaatttaatcttataattaaaccgtaagttcttaactcaaaccgacagagctacacaaaaccagaactatgcggaaaacaatttaaacaaatggttctattaacaccttcttgtaaagaacattaaaaaaaggtattttctacagcatataaactagtgaaaagaaaaatggagaaataaaatatgtgaaatttcacataaaaaattaaatagtaatatgtactatgtagtactttaaaagaaaccaatgatagtaaccgtgagactcatatacttcatctttttttccttggtatcgtcaactcccaaatcacatgcgctttctcttgaaagtatcagttttccttatctccttttccgttgcaaaggcactgagtttatatttcgtagttgcaaaggaatagaaaattagtaaagtgagcgtagctcaactggttaggttctgtctcatagaagccgtccacatggatgcgcgcttattttcttttttaagaaaaaaaaagaggagagaggttttggactcgtagaaggaaaggcagccagcagcccagcgcagcaaagcgctgtggtaggccctttcccctcctcctccgaaaatgatggcggctcgccgtttttccgccgccacgccctcctctcccctcctcctccgccgccgcctcctttcctttcagccacagcccacggcggcggcggcggaggccgacgcgggcgcgggggagtgggtccgtcgcgcgggggcgctctcgcttctggggctcaccggcgccgtcgccgccagcgccgtcagcgacctctccgtcttcctctctgctccaggtcaaaaccctagaatcccttgcccaatctccattggagtattgtattgagcgcgtgattcgcctgttcgaactgacgattaggatggtgggggggattcggatcagctaacacctatcaacagcaatttgatttgaaacgcatgaccgatgaatctgtgcatccttcctggggagtatgagagctagcattcgcaacgtgtgatgatgatgttttgcttcgcgatttttttgcatcgagttagtgagagagagatggtttgggggctaactactggtggtgctcttgttgcagccaggcgatagagaaggcctcccagaaccagcaaatagtgaatgcgatcggcgcgcccatcgtgcggggtccctggtacagcgcttccatcgccgtgaatcacgcgaggcattccgtctcctgcactttccccgtgtcggcgcctcaaggaaatgggcttctcaagttcaaggctgttcgctcgggaggtagtatgtgatatattgtttttactacttggatgctggctggatagttgttaaattgacatgaattttcttttctgcactaaacttgaattaccaccacttgaacttttaatgcatactctgcatgaatgttcatttacggatggaatagaacatatttttttagtctgcatcatttatgaagtgcttcatatcatgttctcattgcatttggacgaaaagcaaatcatattagcagattcgtttatgatttgccttacctgatagcataatgatataggtataaaaactctctgactataggtacaaataatagctataggatatgatgaacaccacgtatgcatcaatagatctcataatgctaaggtctgaggtgaacttcataatagtcattatccaccatccaaatggaatattatgaatgattggccctgatctttcatggtaatatgaatccagaaacctcctcatttgttggcatagcttgcctcctttgatgcaccagtcaaaaacctagataacaaattcttatttccccctgcaaacactcagtgtgcaaaggtgaaaatagggattgtccagtgattatattcctacacctggtacaaaaccaaagatgaaccctagatgattcctcaagcacactcacaagtgctgccaatgccatggtggtttcctggtattttttttactcaaaatattcaatccaccctcttagacgcccattggcctatgacatttatagcctagcaccagcttccctagtttaagatcatatttgaagtcccttagaaacaaacaatatgagttctcctaaaaatcaacaggagtatgctattttgcacaagattggaggctgggttggccacactttttggatttggataaggttccagccacactcctaaaaatcgaagttgcttggacttgtgctcaaagtactagcgagatttgtttttatgggcttggttgcagtagattttatcgctgtgtttggattcattctgtttttgtataatctgttggattagatcagcttggaaggccaattactagagtactggacttgtggttggttcaatcctttgcttggtttttacacatttacactctgcctaaacggttaagtattactccttatgggctgataatacttgtcgttttggacaaggacacggttttcaaaatacaattttgaccactattttttattataatatatatagaaatatcaataaatatatgattttattgaagtacatttaagatcaatctatagatatggtcaccatatttctaagacaaatattttagatgttatttatagacaaatagccttgtccaaaacgacaagtattatcaacccggagggagtagtaaggtagttcctttattcacaaattttgactaccagtagagcttgggtagatgaaagatctatggtggcaagttgagagacacaccatgcaattattaggtgcagaatacaactgtgttatttcattgttgaacagtaaaacaactttgcagctacaaactagcctaccaaaaattatgaggttagagctattggatccttgcttaagtgtacaacgtagcaataaaaaaaaaagatggcttgtcaaatttcaagtagttggcacttcatgtttgaactttacccgaagcgctgcaaatatactcgcaccggtcagaactcagaaatacttgtccttctggatataccttggatccaatctttttaaaatattttgattgtaaatataaaaaccgtgcatgtagatttgtttgaaaagtattatcataatattatatatttgttttattttacaaatacattaaaatagaaattaatggtcaaagttgcattttgaagatagtgacaatgtccaaaaggataagtatttgtgactggacggagttatattttggtatttgaactaataagcaaactctaaaattctagttctcttaaaaaggttggttccactagggctaggtcagcattgctgtgatgcctacattggcctagtaatgctctttttctcactcaactcacagtaataaacttttttctgtgacaagaactatttagactaaacgttgaatgtagtttgtaaatttggtcctgtcggtgtttctgattgctcagtggatgattttcttggtatcgagacttaatgctcatgctaatgtgttgctactgatattgcattcctccgggagctgttagttcttaaatttatcacttcgagatatttcctccaatgaagtactgtctaactaaagaaatttttgttagacaactgatatcaatacttttgagtggctattaagtcttgatccatgttgtaggagcctaaatcttatcccgtcatgttcttattcttgcagatgagtcgtggttttcatttctgcagcccaatgactgggaaatactcctaatggatgctatccttgatgttcctactgacgatgggaaacaccaaacaattagggtaacaattccagacaacacagcacctcctccagcaattgattgcaaggcatgcaagtcccagccaacgctgacgccaccaccacctccatatccgtcacctccacagaagtgaattcgtctggagaaattcttttggtcccgaaatacctaccttggattagtcttgttcactctattcctcattgaccatgaaagaaataagtactgcagttggaccgagagaccacagattctttacttttgtttttgcaatgatacaacatagaataggttacctgattgttccccactcagcaatactttggaaggtggatccatcaatcactaaactagatttgctttaggacttgctagcgaggcagcgttttggcactcaagttttttagggtttatactacatgatactccatgagaatctaggttggttaattcagtgcttcttcctggttgtccaagccttctggttggcatgtggaaatacatcatactaaatactgatattatgtagcagtttgggtaggaatgtacgatttgaagttcaagaaatagcacctggggtcatttgttaaagctaaaaccaacgtcatcatacgtaaaaaggatacaaaatcaaaagactgaaaatattttagaagatcgttatcttgacgcctcttgtaggcattggagccatctttttcaacatattctagaactctgacaactgaagggaacattttagacaagcccatcaatgtttcataacgagagctccaacaagtgtcacctagcctctgaagagatatttcttgatagtcaccttcctgtaacaactcttcccttccaattgttttcctcacttaactcttcccttccaattgttttcctcacttctttttaatgatgctctcgaagtttttcttttctcttgtaggaactaccaacacattcaacaaaactgatatcatataaaaaaatcaccaacatcggatatctcacaaccaccaagttaagtttatgaccaaaacaatgaatataatatgctgaattattctcataattttagcttgccaaccattaaattcacctaacatattacttgctccatcataaccttagcctctaatttcttttagacttagaccaagatctgcaagtaagagataagaagccgtcatgtcctccacatgaacaataccaacaaattttcttttaacacctcacatttattaacataccgaagaaccaccaccatttgttctttgttggaaacatctaagacactcatcaaccaataagctgaacacatcattgccaaattcttccataatacttcccaataattcttttgcaaagcacttagtgatttctttgtgaattgttggagatagcatgtgattattaagtgaggcattttttaatgccttggcaacaacatcgttttgcttaatagtatactccaacaactacaaataatttcctttatttttggactgttttgattcattatgcccacggaaaggttgtctctgatgcaacaagtatcgacatatatcaattgatgcatttaaccggataagatgctcatttttttccgtttgggtttgtctgtgaaaggccacaggaattgactggtcttgtttcaatagatgctcacaattcttgagtgcctttatgtgaaaactattacagtcaccaaaatgagtcactaatatctctgtcttgttccaagagttgaagtcttatatgacaaatacatcatgcccatggtgattaccttttatgctaacatgagtcaccaatatcactgtcttgttccaagagttgaagccttctatgacaatgcttcatgcctatgatgattatcttttatgctatccctaaacaaatagcagcataaacagtaggctttgtcatccttttcgctatactgtagccaattagcatatttatcaaaccaacatggactgaatcgcctcttattcccaatcaacctatacggacactggaaataccatgtggatgatatggtccccatactaaataatttctccttaatgtgaccaagctgccatattgctcatgtagacttgcaactcctttgcggcaagtggcctaacgaagatggcggagaactcgaggcgctccccgatggaatccgccgacgccatagtgttcctcgtcggtggtgcgctcgctggagatctcgccggagcaaacacaagtgcgggagggggattccccaccagatgcgcaatgcgtgggagacggcgatcctcgacaattgtccacgcgcgtatcgactcggcttgggcccaaggtcggcaatggcgatacgggctctcgattcacagcccattcctgtagcaatggcctctctatccgaccgcgtcaactcgcgcaccttgactcctgtctacaacatctgtgggggatagatgtgagggagctagggcttcgtggaggttggaggagaggtgaaccattacacgaggagagggaggtagaagagtggcctaggcttgggattggcggtggtggcaggggatccaagtggaggagcacaattcacggtgattctcgccgcttcgcgaatgtggtatgaggttggtggcaaggcatggagtatcagggtggaggatagcgagggaggttctagcccaagcaggcgttctgcagcgacggcaagcatccttcggagccatctccacaaggcggccatgaccaagtggactggggtaactagcacaaggcctcgggaggaggagaaggtggaggtcaagctctgcccatggcgtccaagacaggggggatgcagtacaggccagtgcagagggcgtcgacagccttaggaggaggggaaggtggaggtcaagctccgcccatggcatccaagacagggggatgcagcacaggctggtgcagagggcgtcgatagagatgctgcccacccatgctgcagaaagcaagcaagcaaatccctaggtggaacaaccccaaatctaggccaatccccacgatggtatgcccctgaatactcaaaagactttttttgcaatagatgaaaaagctttggtcatgtggctagggattgcattgtctcagtttactgcatcaattgtgctaaagctactcataggaatgaggattgcatttttgataagcaacctagattggtagccaaattggttagatatgagccccaggtcttggttgtattctcatttagaacaccaaaccaatccctctcaaggaacaagctaatccaatggctcgtacacgtgctgcgccgatcgttcccgtgaacgccttgtccatgacattgaggctctgcacggcgcggcgacacgacagctgcacctgcgggtagctccacgagtggtgttgcagcaccttcaccaccaggtcctctacatagtcccacacctgcctgacaagatcgtgcgggacgtgtgcaatgctctcgatcttctggtttagtagattgtggagcaccgacctcagcatgacattggggaggttgatgcccttggtctcctcgagcacccgcatctcctctgccaagaatggctcatcgtcactcaccctcgtgcttttcaatgacgcgcgctgtgccgtggtggtggcggtcgcccgcgtacttgttgaaatctcccctgatgagcaccttctccagcatagatgatgtggaagaactccctcaccgcatctgccacggtacagagtttcggtggcatctggctgagctcgtcactgctatggctaagcttgtcgttgatctgcttgatgttatcgtttagtttatcttttcaagtttgtgctgcatttgtataaacatctgatgatgttttgtaagacattagatctataatacactatcatttgtgtaacatagctagtcttggataggggtttaatgcacaatttagttctgaattctggttatgaatatctgggtgtgacaattgtttcctggccaaggattaattcctccacctggagtgccttgagtaatgctttattcatggtggatttctcaagatccatgggtggattatgagaaagcaagattgttgtggaggttagggttcgttcttgggctctgggagtttgaagatgatggaagacaaagaggccaatgaatgagtaagtttattttttcgacatcatagcttctcgggtgtgctagagttgtcagcattgaatgagcatttgcgtagaggtcgagggttactgttagtgtcatagataaggtatacctcatatacatgtacttaccatgtctaggaatactgcatactgtcaatggagtagattcaacaactatgcttgtagagtatagggaatgttggtaccagggtatacacaagataggaataggaaaatgggagacccgagatttttacaggtttgggcccctggatgatgggtaatagccctactactattggacgaagccggtgttgcctttatatatcaatctctcgagtacaaagtatatagaggaaagcctaatctaggctgccagtatattggcgtaaagctcgagcatggtggtcggcggctagctgtagttggcttcctcgagtagtgactctacgagattgatggtggcttgtattggtttgtatctctcttggcttgttgggatgtgttggcttatccctcccttccttggggtcctgtatttataccctcaagtgtccccttatctaagtagaactaggaagacaaatatgtgtacgattcgagtagttctggttaggcccaaataggactatgtttctctttatttgagactcctctcttatctacttaagagttttgccatacgtatgaggtttgattccgtacaggatttggtatatggtggtccccgccgagctaagtacacatgtataggatatcccatatctaggacactgataacaatctgaaaattacacgcaagacgcgcgagtggtgatggatggaaggaaagctaggtagctagtggctacgctgatatccttttaaattttttttatagctatttgaataacatgtaaccaacgagggagggaatgtctcatggagagtattattatgcgtggcagctacacgcgaagtggagtactaggtggagtagtagttatcagacatggtcggtgcttgccgcgttaatctgtccatgatattggcgacgacttccctggattcccggagcagtttgatgcttttcttgagacagtcacgcttggcggcggcggcgggtgtgggcaccaacatccgctccactccgtccatgttattgcccatgacctgagcagcgagctcatcctcgagatccttctcagcgaggcgcttgatgctgtaaaggacgtgcagggccaagccgtcgatgacgcggagcacgacgctgttccagtacgcggcgagtcgcgccttgaggtcgaaggcctgcatggcgagctccacctgctccggcggcagctggtggaggtgcgacacgtcggtctctccgaaccccgggagggcgaccgccgggggcttggagaaagagcgaagctagcatcaaaacaaggggggtgcactaccattgagaatctagaaaatttcagtacaacgctatacattctagtgtttttaagtgagaaattaggaatttagggggttcatgtgcaccccccaaacactatataccttcgccactggcttggagcggtcctccagggcctcgcggagcctgctctggccatccatcatgctggtccaggtcttgatgtactcggggttcgccgtgtagttggccaccatctccatgtcgatgagctcgttcacgtaccgcgccgaccgctctcgcgccttgtccatgaagctctgcacggcggggcggcacgacggctgcacctgcgggtagctgcgcgagtggcgctgcagctccttgagcaccaggtcctccacgtagtcccacacctgcctgacgagatcgtgcgggacttgcgcgatgctcttcaccttccggttgagcagaacgtggagcgccgacctcggcatgaagttggggaggttgatgcccttggtctccttgagcacccgcatctcctccaccaggaacggctcgccgtcggtcgcggccgccgccgggagcctgcgcgcgaagccctcgagcatcttggcgaggcgcgccgtgccgtggtggtggcggtcgttggggtactcgtcgaactctcccctgacgagcaccttctccagcgacgcgcgcatctgattgacgatgtggaagaattccctcaccgcgtctgccacggtgcagagctccggcggcatctggccgagctcgtcgctgctgcggctgagcttgtcgttgatctgcttgacgatgtcggggagggaccgggcgatgattctcgcctggatctgcgtcagcctccgcgccagcgtcgggacgcccaccatggacttgtcgatcctggagagcagagggtgctccgcgaacagccgcgccttcgccttccgggccttcttgtaagtctcgtcgccgatgcggttccggacgcagacgtagcccaggccgatgcgcacgtcgtccacggtgaccttctcgagcaagccctcgggggccttgtcggacttggtgacgacggccagcgtgcggatgccggtgcggtccacctgctgcgacatgcngatggactcgcacgtcnggaagtccacggtggcgagagcacgtngaagattatgctttccctgggcggatgtacgccttgatgaatgcacgatctggtctagatggtttccgctggcctttacggcaccccggtgaagcccgcaagtcaacaggtgaagtcgncaccgccttctggcaacaacaggtgaatggccccttgaaaattccttgcccaaccgggaatttggggtgggggttttaatggcttgccaacctcgccttgaagaagcacccaccggccgcctttactcagacccaagcaagttctttttgtccggggtttgaaccaataaccagggcaccgtgtaaaatctctcccccccgaaagtttatccgccaaacaatcaaaccttggattgtcgttgaagggccccacccacacaaggtggggagttttccccccggtaaagtaaattccaaacggcccccggtacaaaaggcgggatttgttttataaaccccctggggcttctcagagccccctataagcccccccaattttccgtttgcccccgtggttttttcggttttggggggtgcaacactccatcggggaaacaataaaaaaaacccccccacccctttttttataaaaacataggccgggttttttttttttgggaggagggggcgcgtaaaatattgggggattaattt

SEQ ID NO: 66790 - DNA, 655 bp, Oryza sativa
ttcttccgtgttttgggttaatatgatgcatttttttgtgttgtggacatgcatgattgttctattgattcaccacacaatggtgtttgggccatctgttctgattgagacattgggtactttagggcatattactgggtaccttggtagtagcttaatgccccggtgaatattgattgctctcttaccttgtccattttacagggaatggtttggatggcattttcctgagttggtcaaaattgtcaatgacaactacatctatgctaagcttgctgattatataaaggacaaatctgagttggcggaaaaagatatttcgaagttagctgatctgattggagatgaagataaggcaaaagaagttgtcgaagcagcaaaggcttcaatgggtaatgagatatgattacatttaacttccgttgtaatataaatctagtagtttctttgtagtagtttttgtggtttattgatccttttgcttttcaggtcaggatctgtcagaagttgatttgatgaatgtgaagcagtttgctcaaagagtcatgaatctgtctgaatatcgtaaaaacctttatgagtatcttgttaccaagatgaatgatattgcaccgaatctaacatcattaattggtgaaggtgttggagcacgcct

SEQ ID NO: 66791 - DNA, 5648 bp, Oryza sativa
  unsure (1)..(5648): unsure at all n locations
ggtgtcagaagtccgccacgaggcacgtcggctaagcgtgaagnagaaggtggcgtagtcgagcgggaactcggcgagtcggactgccgggccgagtcgacggtggggcccgccctcgccgccgtggctggcgtggtgacgatggtgcagagcgccccgtgggtggcccccagcagtgtggtgtccaacgccggtatgaggtggccctgcgccatgagcgggacgaacacgaagtgcgccgccgcattgatgcagatagctcgtgttctcgctggcgatgtattgctattgcttgtgcagctagctgctgatccatccatatgtgtgtgtgcatgctttaaagagagacgtgacggccggtgatgtgttggatcgtttgtttccatatgccggcgcgcgccgccgctgttgccaccgacggagctggcggtgacgacgtcctcaatgtcctgcagccactgctcgccctcggccggcggtgtccgacgtccggtcgagcaccaacctcgcctcgccgcgccgccccttcatcgccagccatcgccacgacggcgtggatggtccgcatggcgtcgtggaagcgggaggtgcttcgaggccattgcggacgagctggaaggaggggatagagagagaagtgagataggagagctgacatgtgggcccaagggtatttttgatattttacgcgatttctctctcctcttcaaccggaaattattattttaatcagcgcggtgtccactggcaaattaccacgtttatggagtgttttccccccaaaagtgagtttggacttatcctagagataaaacacacacaagcagtgtcctgtaacaatgcctgattctaatctctaacagaggttagtatctctaaccgttataagttcggagcctagcaaagcaagaatacccagctcctcaatttgtttactgaaacactcttgctaagcgccctcccttcagattaagatcgaccgtccctcttctccatgtcaatagtgagcaccgcagtcggctctgctaccctacccaagtgccgcctacgcgccccccattctcgatagccaccaccactactacaatagcaaatttttgcgtgcggttgtttcgcccgtctggaatgattcgtctgggaaaatcacgaaaatcaaaatccaaaaaaaaaataaaattacaaaatcctaaccctaaccctaggtcgaacggcggcggcggcgctgctcccgcccgccacctcgtcgtcgttgtcggcagcggccccggtccgcccaccgccacctccccacgtttgtccgccgccgccgagctcgctgcttcatcttcgtcgtcggcagtggcccacgtccgcccgccgccgccgtgtgcacgacgctcccggccgccgcgtcgtcgtcggcagtggcccctgtccgcctaccgccgcctccccacgtctgcccatcgtgagcccgctgccacgcgcatgccgctcccacccaccgccgccgcgagcccgccgctcccgccagccgccgtcgggcccgccgttgagagccgccgggaggagaagaaggaggcgtcggccatgtggtgagaagaagaaggtgagagagagagagagagagagagaggaaaatgagaggaggagaggaaagtgagaagataagggggagagagagaggagagaagggggcccagggggagagaagaaagtcaaaattttttttaataggatgggagggaaggctatttttctgtgcgggtagattaggaggcccgcacgcgaaaatagggtaatttttgcgtgcgggcctgttaagtaacccgcacatgaaaattgattttcgtgtgcgggcaacgacccggcttcgctccccccatttttccgtgcagtccaacttatggactacatggaaacaaaatggggtggcgtccaggaaaatcaatcctgtagtagtgcaccgccacctcctcccccatgtgagcactgtgatctaccccccacctccttagcatcgcccaccctgatctagttatttcgacctccggggtgccaggtccggcctccccaaggcagcgagaagggacgacgacatgcctcctcattccccaaccacgtccgcccttttcacagcgatgaggagggatgctattgtggggtcacggtacccgggtacccacggttgggccattgggccgcataacatagagagggccgcgtaggtctgagtttatgcagtgcatgtgtggctagataaggcaaccgatcttatctcatgtaaatagatggtaggttcctatattataagtgatttgttacctaccataattggccgcctccaagtatatataaggaggaccgaaaaccctaattcaaggaagaggacgatacgttctacgtgctattcacacgttatgctgcggatacttagatacaaatctaatctcatacaactggacttaggggcgttggcgcgcgaccagccccactccccctagtctctatactactactatatactctactactatgatatatactactattcctatatacatatgtatatacatacatgtaactttgtatacgtacatacaaagtttatatatatgtatataaatataattttctatatgtatatattttataaaaaatatatacatgtatacaaactttgtatacatacgtatacaagctttgtatacgtgcatattaaaaacaaaaaaaccgagaaagaaaaaaacatgtatacaaagtttgtatacgacatatacaaactttgtatacgtcgtacaaacatataaaaacaccgaaaaaatgaacaggaaaaccaaaaaaaaccaacaggaaaaccgaaaaaaaaccaacagagaaccgaaaaaacgaaccggtgccatgtggcccttccccatcgcgccgttcagccctccccctcccccatcgcgccacgtgcccagtcgcgcgcggggggcgccaattagcaatttcgactggactagggcattacccctgagagcctgaatcagtataaactctgtgtaaccatatctccttaatttcgtgcaccctataaattatattgcggatccagagaatcgactgttgatacgccaggtagaggggcgctagatcaatcatcaggaggagatggcttcaatcaccgattgataccgtcgacgagatcgcgttgatggcataagcagcgcaggacgatgcagtgcacgcctgcgacgtgctatcctggccggggtggcgatcgcgcaagtcgtggacgcgtcacgagctggcgcgaccccaggctgttcatgtcggggcatgcaggaaggcgcggtgggcgacgcagctcgccgaccgcccttctcgtcccgtgcaacctcccgcatcatgattcatgcttgcttccccgcgcggccccggttgatgccgcaccttgccacgcatccgcttgaccgtcgtcggagctgcttcaatcacgcatatgcgtcgatggatctggcgtcgatgcacgagattgatcggcatgcatgcacatctggcaaacagagtgcatagttgatcgatacatgcatgcccattgcatctacaaaattagtttttttaaggctaatctgagattgttttgcttgtttgcatgtcccatgcgacctacgcactactggaaaaagcattttcgccgacgttggcaaaaaattttcgcaagcggacatacgcttttgagcaaatacctcgccggtgaaaactagaaccggggaggagttggccgtccgcctacgaagatcggttatcacaggtggaccacataaggggccgcccgcgataatcatcttcgcaggcgggatacttataagcgccgcctgcaatcttcgcaggcgggcagcttatgtgcgccgcctgcgaagattgtttttcgcaggcgctcattatgtgcgccgtctgcgaagaataattttcataggcacccgttatgtggtccgcctgcgaaaatgtcactatatagtcttttttctccccaagccctgttcattctatccggtgtttctttctcctaaaacaactaaaatatagagggggggggggggaggttttgaacttcaaatattggggaatttttctacggtggttagatctactcatttccactctatgtatacattttttaagcttttaaacctcaatttgtgatggatctatgcatgcaaaattgtgaaggaaaagctccatgtttttttatttactttattttgatatgtttgtgtaggcttttaacttcaaatctcagggggatttttctacgatggttagatctactcatttccactctagatatgtaattttttttatgcttttagaccttaatttgtgatgaatctatgcatgcaaaattgtgaaggaaaagctccatctcctaggtctagatctagacacatagagaagaaaattttttatgtatgttaatttggtcgattaaaaaaattatttgtgttatgatgatatgattttgttagatttttctatgatattaatttagtatgaaattaaataatctttgttcttatgaatagtgctatgtcatttttagtgaaccctagaaatttggtatgaatagtgtaaatatttgttggtcattttttgtagagatatggacaggcggcaatggatgtatcattcgccgaggtatttggctttatatagggaagaaatgtaaatttattagtattgtgaaggcacacgctgaacagaacaatatgacgaagataatttgtctatgtgctgattgtaagaatgaaagggcctgggaagatgttggtaaagtaaaggaacacttagtaactcgtggatatatggaaaaatacgaaatatggacacgtcatggcgaacaagaagtggccgggcctgaaaaagaagttccgacagaagttgaagacatggtgtacggcgttggttgtggtgaagacaaaattgatctagaggaaatgttacgtcatgcagaacctgaggtgctgattgggtcggctagaggtttaaataactttgaaactttacagaaagcagcgaaggaagttttgtacgaagagtcaaagggctgtgacagtgagttctcaacactacggccagttcttgaacttatgaggttaaaggtgagatatggattgtctgatagtagtttcgacagtctacttgaactttcgaagaacatgcttccgaggcgtaactcattaccatacaacacatatcaagcgaagaaactcatatgtcccctttcacttggtgtagaaaagattcatgcgtgcgttaatcactgcatactgtacagaaaagagtacgcttctttggatgaatgtccaacttgcggtgctagccggtacaaatcaaatagaaatactttcctagaagcgtctaacatattcaagggaactaagagaaaaatcccgcagcgtgtgatgtggtactttccagtcaaagaccgcattaagcggatatgctcaaatctaccagatgcagatctaatgcgctggcatcaagaagggcgcaagaaagatgggatgctccaacaaccgacagatgctcatcagtggataaactttgatgctaagcacggggatcctctaaaatcaacctgcnggcnntctnggaaggagaatgatcagtttcagtggcgcgcg

SEQ ID NO: 66792 - DNA, 5811 bp, Oryza sativa
gccattaatttttgagggaatttgatgctggtacgcagaaactcgcctgtttaggagcaaaagctttcaacttcgttgttggtaattcaagtccacataatctacaaagagtttccaggtccagctcctaaagaagttccaaaacaagaatcaacatccagctgatgattttagaactgttcactaaagctgcaactaaaatgcacaactgcagtaaaaatatatgtcgaagggtggtgtccgcgtacctcgatcattaggatttctgataaatgtgtcaaagggtggtgttgaagtttgtagccactatgattgaagtacattaatgctctaacacgagcctttggcagcaaagcaggcaaaaaaaattgatatgtcagaacgaaatatatccagcaatattaaagcttgtgaataaagaaatgtgctggtaacaaccactagcataacacaaacttgagataattctcattcatactgaaaggatcagaacacaattttaaaacgggtgaggaaaatttaactaaccattgcagcaattcgtttttttgcacaaacaattaaacacttcagcagtatgtgggcaactgggcacctactttacacttaacaactatgtttgtaaaagctagataacagataccatatggatataacaggctcaaatgtacatacagaaggcaaggatatcaccttatcattaaaagggtcaaaattgctgttcggcttacctcattgagaaaaggttctaacagacgcagctgaagatcggttccttcagctgctatggcgcagaagaaacgcttgaagtttcctaggtggtagaatctgcagaaagaagatcagaacatatatatatcaattaagtttaaaatgatgtgtctcaatagttagcacttctgagttgtcccaaatcatactgctgtgcacaaagaagactcaagaagcatgatggctcttagagcatgacaaaaatgaaggctctatgtatgttgatacaaataatatgcataaagttaccttaatatagatctagcaaataccatttcctttgattgtataattgaagcagatagatggccataccacaaagagagtgaatctacctggagataaacaggaaattaggctactattcactagctggagtaagaagaaagtattgggaacaagagaataacataaattagattatttagaaggcaataaaaattgggggcaaaccattttgggtatcttgcagcccaaatgtagaagcacgtagaaggaataatattcagtctctttactactctgtgaattgttcttgtgaattacatcatacatatcaaacagagaaagaaggcacttcattagctgctccatgtttaggtaacacagggaagaagcatcagaatcctgggaagacctagaaagcttctgatgggatagaatatgaaactttatctgcagaaggcaggggcatgcatcagataaagctgtgaaagaggaataatctaccctatatgcttgcacttgaagcaaatatgttcctccaccttaacaaaatgacatccggcagcataacatcaaaagataacagcatctaacgaacaaaaaggaccacttagtggctaacacagatgccaagtagaaaatgcctgaaagaactaattcatgcataatcggaaaagaaacatactttctcccaaaccaattagagagaaaaggcgagaacctcaacaacattttatgcatatcgagtattactctatctaacaagagtttggatgagtgaattttctggcctcaactacttaaaaaggatggaacataaccttacaaggaaaacaaagagaaagttgttgagtagtagttctgtgatagagtataaggatgctcaattctataatgttaaaagttagattccagacacaacaatctaaaccagacaaataagtaccctaaaattcagaggtctatacaataagataaaaacatggatgatatgagtgtaccacatcctcgtatatttgaattgcttgggcattcactatgttctgaatactgaggtcttgcctcacagaccttgtcctatcaaatataaaatcatgaactatctcaaactgatgctctgaggaatccaataaatgcaaaagataatccattgtttctcgcaggactgggagagggcgtatatctgatgcctgtacactcgtggaagagatagttctgcaaaactagcaggaaaccaagtgttagaaaaggaacggagatacacagaattctcaaatagctacctgattctcttaaaacacacgcggttcatgaaatctttcagaccacatgaaactgtagtgcaaatttgtaattataacagtgttttcaggtggcaaattggctattctatgtggttggtaaagattcattatcttacacaccttttatgatttttcagtggcatttttactcaagtttgcagtggcaagtaaatgaattccgacagtttcacctcaagtgtgcagaacatgatatctcattgtataactattattttcgttgatacaagctctttttacctaataacaatggcatgctaaataaataatgtaaaaaaaatcataatctgcttttgcacattgctttcttttatctgcaaacatgaccacatattcaagataaaaataagtattaaatgaattgataatcctgtcctttcatcatatcttcacccctgcaaaaatactagtacaaggtaagtactaagtagggttatatttcatccaataaactataaaaagaaatcaaacaaaataaatataaatctgacactatcgtacattcaatctcttgaaggctaggctacccgaatagcttccttacactctggcagtgattggacaagacaagcgtagatcagatttagtgctgcattgctgttattgcattattggtggcatatgtaactatatagctacatctaacataaagtgttgattgttccaacacatgcttaacggcaactgatcacccttttaagcaaaaatacatgcacagttgcatgcacaaaaaaaagcttccagctccatatcaaatccaatcaaaacagactaaaccaccacatggaatggaaccaagctatagcctgtccatttgcatggagagaacaatccaagcagatacgcaccaaaaatgaccagcagtgaagcatcaccacgacccaaccgcaagttcaaaaagaaaaaaaaaatcaggaatggcctccacatgagtacggagaaaaatggatggctcaccttcttcacggcgagggaaggggacgtgcgcgcggggtcgccgcccacccgctcgaacaccgccaggtccctcagccgctccctctgcgccctctccctcgctgcagcaggaaaaaaaacagtagcatccatgagctaaaacgcgccaaccaaatccatccaattaggggccaactgatcgcgcaatttcgtcgaacaggtggggggcaattcgccccgccaaacgggggtcaggtcaggtcagccagcgtcggcgtgagcgcacgggaggcttggacgaagcgcgttacctgggcacatgtcggggcagctgcccacgatcggcggggcgtcgccgccggtaccagccgcggtggcgctggccgccgccgggaaggaagaggtggaggaggaaggaggaggtggcggtgaggggccggcgccgcggctgagaccaaggccgcggccttctccccgacctcgccagcctcggccccatccgtggccacgagtggaactccggccgcggtggctcgccatgtcccggcgatccatggcggcccttggcctcgagctccgaggggtagtctggtaatttggtggttagttgaaccgtggagtggaacaatggagcttcaaacgaacatgcttttttagtggagagagagagggggggaggccaagatttttttttaaccttttaaaattttaattttaaagtaatgtcctgttttccaatttttttttcaaatttctaacttttccgtcacatcgaactttcctacacccacaaacttccaattattccgtcatatcgttctaatttttttaaacttccaattttagagtggaactaaacacagcctaaatcataacaaaacttatttttaaactgaatctttcgaccacgtcagcaagagtggtgtcatgaaataccgttgccatgtcatctagaacaatactactccctccgtcctctaatataagggattttgactttttgcttatactgtttgaccactcgtcgtattaaaaattttttggaattattatttattttttacttactttttgcttgcaccgtttgaacattcgtcgtattaaattttttttggaattattaattatttttttgacttactttattatctgaagtactttacgcacaacttttcgcttttttatattttcacaaaatttttgaataagacgagtgatcaaacagtgcaagcaaaatatcaaaatcccttatattatgggacggagagagtatcacactaccctggctagtgtgacggtgttattttgccacacgcactctggctgacgtgggcacgtggcaacgttctcttgccaagccattcatattgacatgacaaagcaaaattttcacatcaataaatcgattattgatggtgtgacaatattatttcgtcacgcacagacgaagtggcgtggcaacaaatattcaggtttagaaataagtaaagagatgatttatgtttagaattaaaagattaagaatcataaaaattcaaaaacctaaaggcaagacggtgtaccggtgtttgaggttcaaactgagatgtgggaactttttttttcaattacacaaaaaaatgtatattcacgttatatagtctacgcacttgtgaatgcatcatctataaaacacttgccgagacgggggcataaataaatacaagaaatataattggaagaatgagcagttctttttgaaagctctgcatttctgtcagggttacgggtaaagtataccctctactttttgatatacgtcacatatcgatatggtatacttgcgcgtatacggatgtttttggcatacgttaaggaaattcattatggagttcacagatggaaggaatcctactcggattgaactgggtcgtcattatatcgtatcgggtccgatgtctccgagtcctacttggagaccagttgacctgcggtataaaagggaccccccggagaggacctagggcatcgaatcttaccgccaacacatccaccacagcctacgaagccggagcctacaggagccaagtcgccgggtgatctagtcgaatcaactcgactacgatctcgtcggtatcgtcgagttccactattccctttgtaatctgtggtttccatcatataatcccatatcaactagattagggctattacctatcaaggggcctgaaccagtataatctttgttttctgcctactcgatgtcgtattacgtagatcctcgtaccagtgtaccctaataccctctatatccggtctacgggtatcccccgtcgacagtggcgcgccaggtaggggcacttggtgctcaaggttctactactatgacatccagcttcgtcgacaacggcgtcaacaccaacctcaaccaaggagttcctacttcaacaacactggtgtggactcaagtcggcgaaatcgtcttcccggtttacaccacagtgccgatctcagctggtccgtcaatggccggaaacgagaacgcagtggctataacccaggacgactacatgttgaa

SEQ ID NO: 66793 - DNA, 14782 bp, Oryza sativa
aaatctttccactctccagtgccaaccccgacaagaccgtcaagatcggggcattactaggccaaaaataggaactcgcgctcatcaccttcctccacgacaatgctgacgtgttcgtttggcagccgtccgacatgccgggggtacccagggaggtgattgagcacaaactcatggtgcgacccgacgccaagccagtaaagcaaaaactgcggagatttgcactagatcgaaaacaagccatacgagaagagctcgacaagcttctcaaagttggcttcatcagagaggtactccatccagagtggctagccaaccctgtcatggtgcggaacgccaacgagaaatggagaatgtgtgtcgatttcaccgacctcaacaaggcgtgtcccaaggatcacttccctcttcctcgaatagaccaactggtggactcaacagccggttgtgagttgttgagcttcctcgacgcttactccggctaccaccaaatcagtatggcgaaagaggacgaggagaagacagcattcatcacgccgttcggagtattctgctacgttaagatgccgttcggactaataaccgcaggaaacactttccagcgcacggtccagggctcacttagcgaccaactcggaaacaatgtcgaggcctacgtcgacgacattgttgtcaagaccaagtcaagcgactcattgattgatgatttgcgggaaacgtttgacagcctccgacgatatcgcctcatgctcaatccagagaagtgcacgttcagagtaccatcaggcaagctgctcggcttcctcggctctggcagaggaatagaagcaaatcccgagaagatcaaggcaatcgagaacatgaagtcgcctacaagactcaaggaagtacagaagctaaccggatgcatggcggcactaagcaggttcgtcgctaggatgggagagcgaggacaacctttcttcgctctgctgaaaaagcaagacaaatttgtatggacacagaaagccgaagaggcattcattgcactcaagcgctacctatcaaatccacctgtacttgttgccccctaacctattgaagaattatttctctatattgccgccacgccatatttcattagcactgtcattgttgtcgagagagagaaggtgcaacgaccagtctactatgtcagcgaagctctccacgacgcaaagacaagatatcaacagatccaaaaactgctctacgcggtaatcatgacattaagaaagctacgccactactttcaagcccacagggtcacagttgtatcctccttccctctcggtgaagtagtgagaaacaaagacgttgtcggccgcattacgaaatgggtagtcgagctaagccagtttgatgtccactttgtgccacgaacagtcatcaagtcccaggtacttgccgactttgtagccgattggactatgcctgataacaggtcagacaaccaaatagacaacgaaacgtggacaatggcgttcgacggcgcactcaatagccaaggagcagggggcaagattcatcttgacatcacctttaggagatcaattcaagcatgcaattcacctcaacttcagggcgactaataacacagccgagtacgaaggactactcgccgggataagagctgcagctgcactcggagtcaggcgactaatcatgaaaggagattccgaactagtcacgaaccaggtgcataaagattacaagtgctctaaccccgagttatctgtcacaccccgaagttttcctcccaagccaaaaattgaatttacaaatgaccccaagaaaatgcaggtgaaatcaggagaaaaccctaataaagtaatgcaaataataatcggattggacatgtggaatttttcttgagttctacatgtcaaaattcattaacaggatttttagtggaattttcagagctctagaaataattttaaccaattaaaattgagcaagcaatattgttaattccagggaaaatcctttttctttttctttttcttttttcctctctttttcctccttcttgtcaaatgggccgtcggcccatttcccttttccttcccccccctctctgttgggccggccgcaggccgaggcccagcccggtagccggctgcccgcctccctcctctcggggtcgccgacaggtggggcccacctgtcgggcccgtctccctcctcccgccgatcccggcgcgccgccgcgcccgaaaccgccgccgcgcccacgtctccgccttccccgggccacgtcgaccacgcccgcgcgtgcgccgcgtttcccgcgcccgttcccctctctctcccgctcgcgcccgcgcccgagatggccgggattcgaaaaccgaatcccgcctctctctcctccccactcccccacgtcggccggcgaatcccgcctcttccggccacgtccggccctctcttcccctatttaagcatcgccggcaccccctctcgctttttccccatttcgccgacccctcccgagctcccaatcgtccccgcgccttgcaaccacccgccgccgccgtttttgctacttcggccgccgctagccgccgctaggctcgccgccgtcttgcgccgtcgccgccgttagattcgcggggtcgagatctacctcggccgcctcttccccgttgaggttcgccgccggagacccgtccccgtcgtgcgccggtgagtgacgccatggccgcggccttcggccggcgctctcgctctctcgcgctctttcctctccctctaatccctctccttttgttcgttaggaggttccggagctcgtcccgccgtcgccatcgtcctccgtcgcccgccgtcgtcgaccgttgtcggtgaggccctcctcctcgttttctctctctcccgcaccgtttagccgccgcgtcgccgcctagctgcgtagccgccgctcctcctctagccgccgctctccgccgccggtcggtcgccgtcggccgtcgccttgcgccgctgccgcatgcgcaccgccgccgcgtgagcgctgcgccgccggcgccatggtcgccggttcggcttgcgccgtgcccgcgcgcccggccgcgagctcccaccgccgtccgatctacccttgggtagatcggggccgtcggttcggccgccacgtggagccgccgccccttccatctcccgtgccgctgacagtgggcccgcgagccgccgcccctttctctctctcccgggtcgctgaccggtgggtcccgcatgtcggcgccgcacccctccgtgctgacgtcagccctggttaatattgcgcaataaatgatttaaggtttttcttttatagtaataaacacagtgaatcttctaaaattcataactaattcatccgagctccgtttaatcccattcaagtctcagtaaatcaagaaaaatgtgtagaatccattaaaaatggttttgttctctgtttcagtagtcttatagcctgtttgcaatgtttgctttgtatgtcgctagattccggttctttcgacgctccggtgtacttcgagatagtcgccgaggttcctccagcagcagagcaaggcaagtcatgcttgtcacttgatcatattgatcctatattgcaaatgtcctaatgttttctttcaaatatcgcatttgttttgcaattatactatgggatggttaccttttgttacagccatgttattttgataccatgctcctttgttagcttgggttataacatgattagagttaggactagggtttgcttagccatgcttagttcaactagcacacaatggggagatctcatttaaaacctagactataggtttttatgataatgttggattagcggcaccgctttggtgttggttaattaaaatgaatcacatggtgggctgtgggtgcatggttttgctggtcgcacccatggcagttaaggaccggttcgcgggatgccctggaagaatttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgagcagtgggggtgaaacctgaggtgtggtgtgcttggttagagggggttatgtgaagggtcctgtcacggcctctttccggtatgtcgtggtggcatgtcggcgcacggaaacgtgtcgtggggctgtgtcctgtgggtacagttgtacacctctgatcagagtaaaactattcgaatagccgtgcccgcggttatgggcggtcaaccagattcaccgtgattagtctcaccctagtgtaatttgttgaacttggatagtttaggtggaaggttgggcctgtcgcaacgtgggttagcgttggacagcggatgtttaatactgcttaattattacaactgttttcgcattaaattcctgtttataaatgccagtatttatgcaaatgaaccactttagctcttctttgttaattccctgcatcatacccctattccggtatgacttgctgagtacagtgggtagtactcagtcttgctctacttttcccaaccccagaggacgggtatgtgtcagatgaaggtttccccgaggagtaggcttcgtccgtgccgtcgaggatgcctgtggagtggtgttcccgctgcagtttagtcaaggcttagctccagtttcttttgttttccgctgcatttctgtaagacttttatgatgtttgtaagacgtggatctgaatgtcaacattgtcgtttgtgtaccccggctggtcctggacggggagtttaatgcacattctgcttggaattctattcgggaatttctgggcgtgacattatccaagtatctcgcagaagtcagaaagctagaaaaaaggttcgatgggatcgaggtccgacatgtataccgcaaggacaacattgaaccagatgatatagcacggcgtgcgtccagacgagagccactcgaacctggcacctttctagacgtcctgacaaggccatcagtgaaagacgcaagcggtgaagatagcccggtctccctcaacaacagctcgggggctacagaggtagagcgcgtcgttgccgatatcgagaccacagacgactggcgcaccccactcatcaaattcataggcagcaaagagttgcccgaggacgacgcagaagctgagaaaatatcctgtaaagcaaaggtctactatatgatcggcaatgatctatacaagaaggcatcaaatggggtactcctaaaatgcgtctcgtccgacgacggcagacatctcctcctcgacatacatgaagggatctgtgggtcacatgccgcccggtcggacattagtcggaaaagcttttcgacaagggttcttctggccaaccgccctcaaagactcctgcgacatggttcagcggtgtgaagcctgtcaatttcacagtaaacacacaaggctaccagcgcaagcactcaagactatccctctcacttggccgttctcgtgctgggggctagatatactcgggccattcccacgaggacaggacggctacaggttcctattcgtggcgatcgacaaattcactaagtggattgaagcgacacccacgggggaaatcaaggccgacaacgccatcaaattcatcaaagggatattctgcagattcggattgccccaccgtatcataacggacaacggctcccagttcatcagtgccgttttctaggattactgcatcaggctgggagtcaagatctgcttcgcctcggtttctcaccctcagagcaatggacaagtcgagagggcaaacggcatagtactacaaggaatcaagacccgcgtctatgacaagctcatgtcacatgacaagaagtaggacgaagaacttccatcagtactatgggccgtgcgtaccacaccgacaacatccaacaaggagacacccttcttccttgtgtacggctcagaggccatgctccccaccgagctacgacatcaaagtacacgagtacagaaatattccgatgaggatcaggaggagcagcgaaatgacgatgtgaatctgtttgaggaacatcgcgaacgagttaccgttcgagcagccagctaccaacaggcccttcaccgttaccacgagaagcgcatccgagcacgcacgctttcgatcggcgactacgtcctccgacgtgttcaaagccaagcagggcgaaacaagctctcacccaaatgggaaggaccgtacacgatcacacaagttctgcggccaggcgcattcaaaattgcagatggcgattgtcgcgagttggcaaattcctggaacattcatcaattacgtaaattctatgtataagtcaatagtatccatacttgtaagacatcttacagcttcaataaagcctatttttcaggtccagaccaaaatcaaagtgttccttcccgatgatcccttacctagatgacacctagcgttgaaacctaccctcatgtccctttacgctgtcttaacaaggcctccgaggaacctaagggaacttcagctggggccgcccagagccgataagaccttgtcggatcctgtagagacaaaagaccatgtaagatctggtcgtgtaagagttctcgccatgcgtattaaccaagccgtgtaatcggaaataaactttccaacttcacggctgggggctaggatcagtgcttgttcaaccgaggcaggtcaaaggtccaagagccttatcttccgagaagaattctccgatgacaatgctgggggctagggagagtgtataactcaaacgactaatcgaagtcgcgaagtgagaagacactcatacacaatacatccagagtaagaaagcttagttggatagatttcttttctatttcacaagtacttcttacaattctataaaaatccaaaattatattacactcttcccctaggacatttgtcataggacacggagactaccaggaaggccaatgctagtccatagactggaagaccttttccgccagcggcgccatcgacttcgccaggccatctatctccgtaggagttctccgagaacgagaaaacccttcatggaggaactcgaggtgcagctgcggacgatgatctcatatacaggccaatacatgcccccggcatattggctcgatcgacgacactcctgcttcagggcctcgtcgatacgctggctgatgccctcaagctgggcgcaggccccattcagccacgggatgtatccagtcgccgatttctcgggatccccacggggtacccggagctctctacagacccttgacatggaggtgcagaaactcttcagatacgagttgaaccacacctcgcggccccggagtgtctccacggcctggtccttcttcacttccagcatagtcctctcgagttccgcgacctcaaacttcgtcctccaatactggatgcgacgatcctggtcagcaagcgcactctcgaggtctgctcagcatggaaacgactaagtcaaactgctcttctctcacgagaatacaacaaatcaagtcgatccagacggaagagtaaaggagatgaaaacaaagataaccaacctaagggagtcgtcgccatgctcgtttccacaggcgaattttgagctacatcgccctccggcacatgtggctcgaacgcaagtgccggaacgatcactggcaactcaggctgcccgcgctgctggacatcctcgacatcaacatctctacagacgacaacaaagtactcaagatcaaaatgctaaagaaagctaaggcgatgactgcatacacaaaggcggttggaaccaatgaaagttttacaaagcatgactaaggagtacaagagagtcaaaatcctactcttcaaaaagtgggagaacagactcccccagatcgccgacttcttccatcacatccttgcgcgcgtcgctagccgccccctgatccaagattttccgcagatcgagtttagggtgcgccagtctcacacacgcaaggacatggcacgccccggtatagatcccgttggacgtctcctctccaatcctagccgcgtgcttggaggggatctcctccatcgccgtcgccagctccgcaagagaagtcgtcggcgagaactcatcgggattcgccgggatggtagacttgataccgcactccccggcgagctggtgcagaccagtataggtgactcgcaacgagccacggatttccgacaagttgttctcgcgctccgacatgcggtgctcgagtccctgccgttgtcgcttattgccggccaccagctcccgcatcttctggaggtcctcgcgaacctccgccaaatcatgcgccagccggtcggcgcgctcattcgccgacgccgccgccgccgccctcgcctccgcgatctcgcggctaatgccgcgagcaccagcctcaaggaggcaccccatctcaacctggagctcctcccaggtgaggatggcagccggcagacctcgaccagtggcgagattgctagctgggccgctaggtgttgcctcgcggctcctgggcacgaccacgacatccgtcgaggccacgataggagacgcgctggaggtccctccagacccgtcttgcgccgccttcgcccacgccgccctgcgaaaagctgcaactgagacaggctgcaacagtttgacgaagtgacaaaacctcaaagtcatccacttgcttctcgccaagcgtcactagccgttgccgacgtggaggcgggggagacgcgtccgaggcctggagtataacggatatgatgtgaggtggaagttttctgactacgtgatgaaagaacaggagaacttaccgagggggtgggtgtcttccgacgatgtccgaccacagaagagaatttcctcccctttttcagaacgttgccgccactcgttgtggcagcagcagcaacagcgtcagacacctccttggcgactttcttcttcagcgacgccgccacctgatggtccacgagcggcccgatgatatcagtcagagggagagcctacgcttcatgaagtcataatgcgatcccggaagaaaaatgcaaaaggaccgctgagtacacttacattgatggcaacgtcgcgctcggctgcccctttctcgcaaagggggacttggacgttgctcgccgttgtcgggccagtgatcatcagttggccgacacggcgctccacggttgcgctgtccaagcctgtagatcgagaccagaatccgataagtcgggaagaacacgcacataagggagccaatttaactaaaaagaaaaataccccgaggagaaacccgggtcgcgtcctccggcccagaataatcaaaggctggatgggctcgagcctggagcggctagatccgcctaccaatgaagtcggcagcgacttcataccccgacaatccccgtactcggaggtcatcaatgatatcgatgaaagattggagggatggggtcaaggcgagtttggcggtccaagatgaaatcttgtctagttgctcctcaggaacaataaaaaccggatccgaatcttctatctgaagatagaaccacctcccccgccatttgctgcgagatgaggggcactggaagaggatgtatcgcgacttcaggccatcccgaagtcggaaaccgacacatccagacacctttttgggttccatccaactcaactcatagtaaaagcggaagaggtcaagaaacggctctaccccaatgtaggcctcacaaagatgcgaaaagatactcatgaaggcgatggaattggggttcaaatggagcaaggaaagactgtagaaattcaagaccaagagaagaaattcagaaggcggaggaagaaaaccacagagaataaagtcctcgatcacaaccatgcgacctaggacaggttggggttcagtacctcctacttctctctccgcggtcccgcgaccgggaagggcgccatcctcctgcaacttctttagcgacgtgctggtggaggtagacttgtcgagatccattgccgccggggatcgccggagaaaggaccgagatgagctagctagggttttttgcgggagcggagaagacgagggacgcttgggggctggagagttttttcacaacaggcggacttcaaattggatccccaaaactcccttaaatagacgcacttccgacggtgcgaattccaaggaaaggagagagatggccgtcggaaatttctgggtccgttacgcgcggcagtttttcggacttcaatttaaattcactcatgaccgttgagcttcacctggcgttgtcgatcactccttgtctctcagtcctcacaccgagaacgacgacaacttcgacatcagaagtcgcgatcggtttcacgagttcatataagcagaagtcgggggctactgtcagggttacgggtaaggtataccctttacccttcgatatacgtcacatattgatatggtatacttgcgcgtatacggacgttttcggcatacgttaaggaaattcattatggagttcacagatggaaggagtcctactcggatagaactgggtcgtcattgtatcgtatcgggtccgatgtctccgagtcttacttggagaccagttgacctgtggtacaaaagggaccccccggggaggaccttgggcatcgaatcttaccgccaacacatccaccacagcctacgaagccggagcctacaggagccaagtcgccgggtgatctagtcgaatcaactcgactacgatctcgtcggtatcgtcgagttccactattccctttgtaatctgtggtttccatcatataatcccatatcaactggattatggctattacctatcaaggggcctgaaccagtataatctttgttttctgcctactcgatgtcgtattacgtagatcctcgtaccagcgtaccccaataccctctatatccggtctactggtaacccccgtcgacaatttcaattataacaaaaatgttgcaagaattgagaacgttgattatctaaaaaaaattgagaacgttgatatttagagccggcttttggcatacctttatcctaaaagctatatatcttaattttgaatttaaaattacattttggttgccggccttatttccatttttacaagagaatgacttaaatttaaaactgatatataattgttataaaaaacatattttacaattttagatattaaaaataactataaaaacaaagatatttaaagaccccgatgaaattgacacttgtctttgctttaatttggactcattgtgacaaactgaattgaattgtttgagaagcgatactttttaaaagccaccaaataggacttggacaccctactccctactaagggtggacaaaaaaaaatcaagaccgaagaccgacaatgaaaaaaccgtatcacgattaaaaaaaacagataaattagtcactggtctcctgttcggtcttagctgtgagaagaccaatcaaattctcggttcttagctcttatttattggttacccggatggccgaataagaccgcagttggtccaatgcaagggaaacatatcatttgcagtactatcctttgactttgagtgactgacatatagacccatgctcattaggcccacgtgtcattgacccaagtcagaggttaataccgcagaggagattcaccccaatgcgagatctgccacagtgccactgcgcggtcagcttggtttagaccgaagatcaaactgcggttcggttaaccggaacatggttttttagataagttcggtttttcccatttgcgcgattgcccggaccgatttctcggtgaggaccgaaatggccgccctcgacagcttgacgaggcaaccacgtgacgggacatcccatccgggccgtccattcctcccaccgacggccgatctagcctcgtattccgtggctccgaatattttaaaattcccccgctccacatcgtccccgacgcaaaatcccacccccaccatgtccaaagcccacactgacacgtgggcccgaagcgcactctggccccacatgccagtcactgcgctggccccgggcaggccgtgggctacggggcgaggaggcatctttctcgcggcggaaagcgagggggacgacgcggctcaggaatcgaggcctgtggggcccacctcccccctgacgccactgccatgtgggcccgggaggacagcgtgggcgccaccgcagcactgagaaggggaggagagtggggctctcggcgactcgagtgggtataaaatatggtctctctggatccatcccctcctcttcttccaatattattttttcgccttttctgttcgtgtgttcgtggtggagttcatctcgccttcccctcttccggtcctcccaccgctcctcgccaccacaaaccgccgccgcctcctcctctcctatctggtatcgtaatcgaaccagcggaaaccgctattcgtgtgcgtgttttttttctattcaatttgtttgctcgggccgcgtaatcttgggagttatctgcaatcagttttcttttctttctttttctttttttttttcattttgaatggagtgaatcgtgtggaaaaggtggctgttgtagagtttttagtcttaccatgaactgattgatctacgggcgagtgggaatttagcctgttcttggattttagcctggttgcagcatctagtgtaattgatccagtttgatttcttttttttttttgggaataaatcagtgtgaggcagcctatgaaccgaacataagtatctagtattagtctgtgagacaaactatccctggctctataagagggaaacctgatgtgtctgaaagaagttgcgagttcaagaattcctatctgaaaaaagcaaagatcaggcaaagatcatcagtttggatcatgtataaatttcccatgttgcagtatgtcttaattaggaggattattcattaacaaatgtcatgcgaaaaatttatatcttcggaaacaatcgctttatcattcatgagcgaattattacttcgattaggcggatttgtgataattgatgaataattctaagtaatccttgacagttcagtgatttggactggtactggatggtaggtgcccatctgtgtgcctttttgacttgtctatatgccttggtaccattgtgaaacttcatgtattcagtcttgttggattttgtaagttgcattggaatgatatgcttatgtaacattactagtggagctgttgccctgatatgttagaaattgtgccattttttgcagtgcggaggaggtataccacacctttggattttggggaagcagtacgttgattggaagaaatgtcaggaggtaggcaatcatactggtgctaccaatgtagacagcgggtgaggccccgcggccaggatatggagtgtccctattgtgattccggttttgtgtctgaaatggatgatgttgatgctctcatgcgccactttgttgggatggatcctgatttccatcgtgatccaagattcggtatcatggaggcaatctctgctgtgatgaggcatggcatggcgggaacgaaccgggaagttgatgtgagaggaaggccaaacatattttctgacctggagatggagtttggctcagggccatggttgctcttccgtggccagcttcctggtcatctctcagaagacaatggttttgatgtattcatcaatggacgccgtggtgttggcatgcgcagagcaaacattgcagactactttgttggacctggactggatgatctgattgagcaattaactcagaatgatcgacgagggccgccacctgccactcaatcatcgattgatgctatgcctactgtgaagattacacagaggcatctcagtggagactcacattgccctgtctgcaaggacaagtttgagctgggatcagaagcaagggagatgccatgcaagcatttataccactctgattgcatagttccttggctggaacagcacaattcctgccctgtttgccgatatgagttgccaccacagagctctactggtgctagctgctcgcgcacaagatcaaccaaccaaagtcagagttcaagtagcaatgggagaaccaatggacgtcaaaggagaaggaatccgttctcgttcctatggcctttccgatcatcaagctctagctctcgttagattagcctggtaatctggttggagtcctcaagactgtttaatcgaagatgctcataaaatgggtgttatgcatggcatcttatcgtccaatctgtaatgtatggcttgttatgatcaccacggaatgcttttccttgcaagtatatccttccacagcttcatatcagatacttcttttactattctgtttacataaaaggttaacgatagtatgatacttgtttagatagctagagaaggttattttcttaatgttgtattacttaatgttctacagcagaatatacttctgtcaactgtcattaagacgtttttttagctgtaaatctcaagggatcaatggtagcaagcatgatgatataatatagaagcaagttgcctgaaatttcagttaaataagtactagttaatgctaggttgtgtccttgtgtcatccatgttggcatattctgcctgattactatttgcctgtgcgttt

SEQ ID NO: 66794 - DNA, 7651 bp, Oryza sativa
  unsure (1)..(7651): unsure at all n locations
tacttgagagaatacttcacagtgaaggccatcatcttcgtgatcattaacgattaccccgccatgttttcagtttcagggcaaattaaaggtaaaacaggatgtgtgatctgcttgaatggaacgtactataggtaccttccgggttccaacgagtttgtgtacatgcagcaccggcggttcctacgcacagatcacaagtaccgcaagatgaagtcagaattcgatggcattgaagagagtgatcctccacaaaaatatacatccggggagaaagtatgtgaaatgacagagaaaatagtttgcgaatttggaaaagggactaagaaaccttcaaagggtacaaagcgcaagaaacctgacaagaccaagaaaccagaagatagaaagaagccaggtgatcaactccctcccccattcaagaaacattcaattttctttaagtacctcccgtactggaaagatctagaggttcggcatgccatagatgtcatgcatctagaaaagaatgtgtttgacaacgtaattgaaacattgttggacataccatagaagactaaggatggtctgcaatcacgacttgacctagtcgagatgggaattagtgaagagttacaccctcaagaaagagagaagaacggcaaaatatatatttcaccagcctgtttcacaccgacacctgaggagaagaaatcattttgcttatcacttcgtgatgtgaaagtgcccataggtttctcatcaaacatcagtcgactagtctccatgaaagatttgacgttatctagttataattcacacgactgtgctgatgcgaaaaacatatactggcctgggagatctgcttagctccagtgcatgtccaaaggttgatgacatgcgagcgtgccagtcagtttgatcctgcaactgacaagatatgtaaaaaacagataaaaaaagccgattggctgacaagccgatggagtaattccagccgatagccgaaattagccgatgccgatttcagtcgatgtcgatagggtttttagcaatcggctatatgtccaatgtagataatgatataaaggcgatcggctgatgatgataaacaataataatatagcaatataatccagtagaaaccaatctgattcgaagggtaaataatacgctggaggtccgatgtcataaaatctacaagattagataaatcaatgaaacttttgttgtcatcggctaaatccaacttttatatatatatatatatatatatacatatatatatatatatatatatcatatgctatccttataagctgatgcaacatccagataacttatcggctagcaccccgataaaacactagcatgaacctatcggctaaacaagacttatgttatcaacaacaatctagtaggtcgaacctaaccgatgcagcacgagattgtatatgataatctaatactagatgagccgatagatctgtctaatgtgatagatataacaaatctatttagaacaacattatgattgtagagatatatcagctaagatagaagatcagacctaaccgagacagtcccaactaaaccgatgcgtctctaaacacaatgcaattagagatggaattgagatatcaggtaggcaaatatatcaaccaaaccagagcgatccaagagatcgaagcagccgatagattcaccagggccggcggaacgtaggacttaccccttcgccggagatcgaactgaaccgatgcagccccgtgtcaggtgccaaatttcaagtaaaaacctcaggaaagagggtggcgatgcgccgagagtattattgatcgagagataaattacaatgaccccgggtttacatatttatacccatgggtagatactagtccttgtaggacaagaaagaaactctcctaaagataaaaggaaaacataaagtcctaatcggacactaaacacactttcctaaagataaaaaggaaactaacagactattcctaattaatagataactgccatgctgcatcctcattgaactcggttactcttggataagctttctttaatagattaatttccttaaccgaatatagtaagaatccgactatggcgacttgataactcccatcgactgattccaggactctgaagccgatactgattttaggccgatgacatcctcgaggtttaccaaatttcactgttaacagactgtcatgtcttgctcaccgtgtttcttgccattgcaataagtgccataaaaccagaacatttgaaggttgctatcacaaggttgtgctgcttttttaatgcaatctcacagaaggtcattagtcatgatgagttagcaaatcttcgtacattcgcacatgagacacagtgccaacttgagatgtgtttccctccatcattttttgatatgatagagcacctcatcgttcacatagtgccccagatggatgcacttggcccattgtacctccatcaaatgtggtcatacgagcgttacatggcggttttgaagggctacgtctgaaatcatgcccatccggagggatcaatggttgagggttacagtacagaagaggttgtcgagtgctgtatcgattacctcaaagatggaaagacaattggaatacttgctgtcgacgtttgatgtctcgactacggtatttggacagtatggggatcgtcggtgctaggatatacgcgagactgaggtaaaagagacggagacgaggatttttatacaggttcgggcccctgagcggtcaggtaataaccctacatcctgttggccggagccggagttgcttttattcaccataatcgcaccagtacaatatgtggaatagcctatctaactgttgtcgacatggcggtctgaaggtctgactcgtaatcgacaacagggtagccttgctcctcgaatccgtgtccggcgagatcaaagatagcgctttcatctctcctgacggtatccggagacaccgtaggggaatagccatgcctatccctgaagtcgatatccggcggcgtgtcttggcgtatgttggcttgtatgctgtggcttcagttgttccgaatattgtggtggttgttgattgaggtggatctcgatcgtggtgaccatgttgatcgtgttgatcgtctcctggtcagtcatccccctcctcctagggggtcttgtatttatacccataggtgtccccttgttcaagtagaacttgggaaaccaatatggatacaatccgaatagtccttgtcgtttccgtgtagaactctggttgcctttccttattggaactcctcctatatccgaaggttgcttccgtataggacatggtatgtggtgagccctgtcgagatttagtcaactactattaggtatgtggtatccataaccctgacagtagcccccgacttcaatgcacatgaacggattcctattctcgaccactgaccatggagtaactattatcgagctcacgtgaccgttctcggtgagtttagagataacgttagacttcctttatcagcctcgtgcgggcaccgaaagggtttgtctgagtcaatctctgatgtcaaccaaggaagtatagagcagacgactaagtctcccatcttgctgtaatcgaaaatttggattgaagtcaagaaattttatctcggcgggtacaccatctcttcattccgtattccttgtcgagatccagcaaccgttctcgagcgatcgagaaggcgtagagtctgcgacggagccttgtcaacatttgtcgtactcgccttagtcgatcttggtgtagaactatagagacatgagttttcaacaaatgtcgaatagaattttcctgaaatcaatactcataaaagaatatcaaatagaaagagcccccgagcgaatgctcaaagggtgacatgttataatatgtatggtaaattaaaaatgaattaaatttaccgaccaatgttttgtgtatgagcgtcttctcttttaccgacttcgactagtcagtttgttgagttatgcactctccctagcctctagccttgtcgtcggagaatcgttctcgagggacaaggctcttggacctttgaactgcctcggttgaacaagtactgatcctagcccccagccgtgaagttggaaagttaatttccgattacgcggcttggttaatacgcacggggagaactcttacacgaccacggctgacatggtctttcgtctctaaagaatccgacaaggccttatcggctccgggcatccccagccgaagatcccttaggttcctcggaggccttgtcagcatggcgtaaagggacagtaggataggtgtcaacgctaggtgtcatctgggtgagggatctctgggtaaaacacttggcgatcttgtgtacctgataccaactttgttggagtagaggtagtaggagagtcgctgcaccactggtggaggaccaggcagtagtcgtgactcgaccacttgaagtggaaacagtgggtgaatcgctacaccgctggtcgagaaccagaggtagtctaaacttgaccactagaagtatgggtagtgggagaatcgctacaccgctgattgagaaccaggggtagtctaaactcgaccactagaagtaaaggtagtgggagaatcgctacaccgctggtcgagaaccagaggtagtctaaactcgaccactagaagtaaagatacgagagatcgctacgattgactggttgagaaccagtgagcaggtgtttctcgatcaatttgaagtcgtccgaagtcatggtgcgaggactgctactctgctgccgttcgaagatcaatcgtagtcgtacctcgaccatctgaggttgcggtgcgagagattgctacgtactggttcgaggaccagcaaacgtgtagagttatctcttgaacaccaatgaagtttgcggtgcgagagattgctacgtactggttcgaggaccagtgagcgagcagaattatctctcgaacaccgatggaagcgctagagttggtttgttgcaagtgtatctcatgtggccagcatgactcacgtacccaacttatagcatatacggatgtccgttcgcaatcatgtcaggtgatcaagccgacggcgttcacgaggaattattcgttaacaaccttctctcgagtagcccagcgatggccggtgctatgagataggtcgtcggtcttcgttggcaggttgggcgcgatggctctgcatttgtcgagatcgttctcgataatgcggcgtactcgaccacatcctactcgagtgctcaattgttcctttgtagatacatgccgggtgtattttgtcggtccagccgatgtcgtaggcggaggtctgggcagttgattctccgcggtgttgacgtcttgaagtttggtcgatctcgagagaacgagttgttgacgacgatggttccgatctcgtcgggagacgtactgtggtcgagttagatctatccatagtcgaagtcgtcgagtagcttgttgtcggagactccatctcttgaacccatctcgtggaaatcctagagcaccaaaatccccctacctagcgcgccactgtcgacgtttgatgtctcgactacggtatttggacagtatggggatcgtcggtgctaggatatacgcgagactgaggtaaaagagacggagacagggatttttatgtaggttcgggcccctgagcggtcaggtaataaccctacatcttgttggccggagccggagttgcttttattcaccataatcgcaccagtacaatatgtggaatagcctatctaactgttgtcgacatggcggtctgaaggtctgactcgtagtcgactacagggtagccttgctcctcaaagatagcgctttagtctctcctgacggtatccggagacaccgtaggggaatagccatgcctatccctgaagtcgatatctggcggcgtgtcttggcgtatgttggcttgtatgctgtggcttcagttgttccgaatattgtggtggttgttgattgaggtggatctcgatcgtggtgaccatgttgatcgtgttgatcgtctcctggtcagtcgtccccctcctcatagggggccttgtatttatacccataggtgtccccttgtccaagtagaactagggaaactaatatggatacaatccgaatagtccttgtcgtttccgtgtagaactctggtttcatttccttatcggaactcctcctatatccgaaggttgcttccgtataggacatggtatgtggtgagccctgccgagatttagtcaactactattaggtatgtggtatccataaccctgacacctgtacctcaacacgtgggtagattgactggcagggggacaataggaaagaagagatttgtcacccatgattacaaatcattttgagaagctcacttcagcattcttcatcagtttgctatcattgagccttacatcgatcaacatatcgaattactaagagctaacaataagggacgcacaaccgaatggataatgaaagaacacaagcgtgtcttcatagattggttgcgagacctagacttacctgatggagaaacaaccgagcaaataactatgaagcggttggcttgtggtccatcaactacagtcaattcttgggagggatatgacattaatagatacacatttagtacaagagcctgagatagtaagaccgtaactcaaaacaacggtgtttgtatgaaggcaattgattcagggggaaaaacaatcatactttgggtttattgaagaaatctgggaaatcgactatggactcacaatgcaattcctcatatttaagtgccagtgggtaaaatacccgaacagggtcagtattgataagtttggtattactattgttgaccttgcgaatgtgggtcataaggatgacccttgggtactcgccaatcgcgtggcacatgtgttctatgtgacagaccttgcaaatttgaagaaagaaatagttctatcaggaaaacaaaagatcttgggagtagacggggtcgaagatgtcgaagattacaaccagtacgatagtatgccactttatacgtaatttgtacaaaagattaagcttgtagaggcatcaactcagaagaccatgaagccttacatgcacaaggacggtgtggggaaaaatgttaaagagtaattgtttgttctgtaataatggtatgtagggggctatatgtactcatattgcacattattatgtttttactcacaatgcaattgttatgtgcacttatcatctttattataatatttatatggacttaccatttttattatattttataaaatcaattacatttttaaaatgttttttattaagtttttaatattttgtaacaatttttgggaaacttatcatctttattacaatttttatatggacttaccatctttattatattttagaaagtcaattacttttttaaaatgtttttatcaagcctttaatatttcgaaacaatttttgggaaacgtaccatctttatcacaattttaatatgggctcaccatctttattataatttataaagtcagttaggggatcctctaaagtcgtcgtgcgggcntgctcggaggggatnctcagtgaggtgaattcaaagggcg

SEQ ID NO: 66795 - DNA, 72338 bp, Oryza sativa
cccacgccaagattgaccgtcaacgccggaaaccaaaaaaccggagttcgggaaggttttaaaaagcgccgggggaaggaaataccgcccggagaggtagaaatcgcgcgcgaaaaattcggctccattgattgcgccggcgacgattacgggcttgattcgaacgaatccgagggagagagagaggggaaagagggggaaacgggggaggggaacgcggggattaattcccccctcttgattgcacgcggggcggacgggagcggcgggattcgcggcggcggcggcgctagggcacgggcgctggcggcgggcgcggcgagaggagggagatgacaggtgggtcccacctgtcagcgagagtggcgggcgggcccgcctgtcagcggcgcgcgcgcgcgcggggagccgatgggccgcggaggagaggagagagagggagggagagttgggccgagccggcccaagagaggaaggggggggaaagaagacttcttttagggtttttctttttataaaccttttcgactttgtttatttcttttcaattattatttgtgctctgaaaattccactaaaatttgagggctccttttagaccaaggagaatttaacaaaaattctccgggtcacatttgaatttttcttgtacgtattttaaggtttgccaatttcttttcgaattttaattaattctattattccttttagaagatgatttttattttgggatgaatttatcaggacgtgacaaacgcccagacccacaaggtacgacgcaaagaaagcatggtgccccatacacaagacggacagacattctttggaagattgccttgtttttaaaaagtcgttcgagaagcacatggcattggaaaaaggcaagcgagtacgcgtggtcgagaaagatgcggaggcgactgctccagaatcggattcagcatatccagactctgaccttcgtgtctcacacattttcggaagttctacaacgtaatcctcaaagcgagaatacaagaaagtggaacgagaagtctgttcgacatggcagggggctgcacccaagatgaagtggtctgaacagaagatagaattttcggaagaagaccatcccatgactgccgttatcccaggacgttatccgatcgtggtcgaacccactattcggaacatcaaggtcgcgcaggttctcatcgacggtggcagctcaatcaaccttctcttcgccagcaccttggacgtgatgggaatcccacgaagcgagttgacacccaccgatcaacccttccatggaatcactccccagtcctcgtccaaaccattgggcaaaattacgttgcatgtgactttcggccaagcaaacaacttccgaacggagcagatcacctttgatgtcgctgaattcgatacagcgtataacgccatcatcggttgaactgcacttgcgaagttcatggccgcatctcactatgcgtatcaagtgctcaagataccgggaccgaaaggaacaatcactattcaaaggaacgccaagctagcggtacaatgcgacaagcggagcctcgacatggtcgaacaaacgcccagcccaccagccacaactgagcctcccaagaaagtgagcaagacaaataagacgccgaaaccagacagcgcgatcatgatcgtttcgctctctagtgccaaccccaacaagaccgtcaagatcggggcatcactaagcgagaaataggaactcgcgctcatcatcttcctccgcgacgtgttcgcttggttgccgtccgacatgccgggggtccctagggagttgattgagcacaaactcatggtgcgacccgatgccaagccagtaaagtaaaaactgcggagatttgcaccagaccgaaaacaagccatatgagaagagctcgacaaacttctcaaagttggctttatcagagaagtatttcatccagagtggctagccaatccagtcatggtgcggaaggccaacgggaaatggaggatgtgcgtcgatttcaccgacctcaacaaggcgtgtcccaaggatcacttcctcttcctcgaatagaccaactggtggactcgacagccggctgtgagctgttgagtttcctcgacgcttactctggctgtcaccaaatcagcatggcgaaagaggacgaagagaagacagcattcatcatgccgttcgaggtattttgctatgttaagatgccattcggactgataaccgcaaggaatactttccagcgcacggtccagggcgcacttagtgaccagctcggcaacaatgtcgaggcatacgtcgacgacattgctgtcaaaaccaagacaagcaactcattgattgacgatctgcgggaaacatccgacaacctccgacgatatcgcctcattcttaatccagagaagtacacgttcggagtaccgtcgggcaagctgctcggtttcctcatctctggcagaggaatagaagcaaatcccgagaagatcaaggcaatcgagaatatgaagtcgcccacaagactcaaggaagtacaaaagctaaccagatgcatggcagcactaagcaggttcgtcgctaggatgggagaacgaggacaacccttcttcgctctgctgaagaagcaagacaaaattgtatggacacaggaagccgaagaggcattcgttgcactcaagcgctacctaacaaacccccctgtacttgttgctccccaacctaatgaagaattattcctctatattgccgccacgccatattccattagcaccgtcattgttgttgagagagagaaagtacaacgaccagtctactacgtcagcgaagctctccatgacgcaaagacaagatatccacagatccaaaagctactctacgcagtaataatgacatcaagaaagctacgccactactttcaagcccacagagtcacaattgtctcctccttccctctcggtgaagtcgtgagaaacaaagacgttgtcggccgcattgcgaaatgggtagtcgagctaagccagtttgatgtccactttgtaccacgaacagccatcaagtcccaggtactcgccgacttcgtagccgattggactatgcctaacaacaaatcagacaatcaaatcgacaacgaaacatggacaatggcgctcgatggtggactcaacagctaaggagcaggggcaagattcatcttgacatcctctccgaagatcaattcaagcacgcaatccacctcaacttcagggcgaccaataatacagccgagtacgaaggactactcgccgggataagagctgcagccacacttggggtcaaacgactgatcgtgaaaggggactccgaactagtcacgaaccaggtgcacaaagattataaatgctctaaccccgagctatccaagtacctcgcagaagtcaggaagctggagaaaaggttcgatcggatcgaggtccgacacgtctatcgcaaggacaacatcgagccagatgatctagcacgacgcgcgtctagacgagaaccacttgagcccggcacttttctagacgtcctgacaaagccatcagtaaaagaggtcagcggcgaagttaacccagacgcccccggcatcagctcggaggccacagaggcagaacgcgtcattgccgaaatcgaaaccacagacgactagcgcaccccactgatcaaattgatcaacagcgaagagttgcccgaggacgacacagaggccgagaaaataactcgtaaagcaaaaatctattgcatgatcagcaacgatctatacaagaaagcgccaaacggggtacttctcaaatgcgtctcgtccgacgaccgcagacacctcctccttgatatacatgaaggcatctgtgggtcacatgccgccagtcgcacattggtcgggaaagcttttcgacaagggtttttctggccaaccgccctcaaagatgcatgcgacatggtccagtggtgtgaagcctgtcaattccacagcaagcacacaaggctacctgcacaagcgctccagactatccctcttacttggccgttctcgtgctgggggctagatatactcgggccattcccacgaagacagggcggctaaaggttcctattcgtggcgattgacaaattcaccaaatggatcgaagtggtacccatgggggaaatcaaggccgacaacgccattaaattcatcagagggatattttgcagatacggattaccgcaccgcatcataaccgacaacggctcccaattcatcaacgccaatttccaggattactgtatcgggctgggagtcaagatatgcttcgcctcagtttctcatcctcaaagcaacggacaagtcgagagggcaaacggcatagtactacaagggatcaagacccgagtctacgacaggctcatgtcacatgacaagaaatgggtcgaagaactcccatcagtactatggaccgtacgcaccacaccgacgacgtctaacaaggagacacccttcttcctcgtgtacggctccgaggccatgctccccagcgagctacgacatcagagtacacgagcacaaaactattccgacgagtatcaggaggagcagtgaaacgacgatgtgaatctactcgaggaacatcgcgaatgagttgctgtccgagcagagggctaccaacaggccctctgccgttaccacgagaagcgcatccgagcatgcatactttcgatcggcgattacgtcctccaacgggttcaaagccaagcagggcgaaacaagctctcacccaaatcggaaggaccatacacgatcacacaagtcttgcggccaggcgcattcaaaattgcagacggtgacggtcgcgagttagcaaactcttggaacattgaccaactacgtaaattctatgtatgagtcaatagtatccatgcctgtaagacaccttacagcatcaataaagcctattttcaggcgcagattacaatcaaagtgttcctgcccgatgaccccttacccagatgacacctagcgttgaaacctatccttatgtccctttacgccgtcttgacaaggcctccgaagaacctaagagaacttcggctggggacgcccagagccgataaggccttgtcggatcctgtagagacgaaagaccatgtaagacctggtcgtgtaagagttctcgccgtgcgtattaaccaagccgcgtaatcggaaattaactttccaacttcacggctgggggctaggatcagtgcttgttcaaccgaggcaggtcataggtccaagagccttgtcccccgagaagaattcttcgacgaaaaggctggggctagggagagtgtacgactcaaacgactgaccaaagtcgtgaactgagaaaacactcttacacactatatccagagtaagaagaattcatcaggatagatttcttttctatttcgcaaaatacttcttacaactttacacaagtccaaaaccatattacattttttctaagatatctatcacagggtacaaagactaccaagaaggccaacgccagtccatagactggaaaaccttttccgccagcggcgccatcgacttcgccaggtggtctatctccgccggagtcctccgagaacgagcgaacccttcatggagaaactcgaggtgcaattgcggatgatgatctcatatgcaagccaacacatgccctccagcatatcggctcgatcgacggcattcctgcttcagggcttcgtcaatgcgcaggccgacgccttcgagctgagtacaggccgacgccgccactgtcctcgcctcggcaatatcgcgacttatcccgcgagcgccagcttcgaggaggtgccccatcccgacttggagctccccccagctgaggacatcggcaggcgggccgcgaacaggcccaagatcaccagataggccatggggcgtcgcctcccgacttcgtggggcaaccacgacgtcagtggaggcagctgtaggagacgcactggaggtctcaccagacccatcctgcgccgccttcgcccgcgcccacctacaaaagatcatcacatgcgattatcaagactagtcgccagatctccaaccaaaggaatgaactcaatcttcatctacttacttctcgcctagcgtaaccaacttctgtcgtcgtggaggtggcggagacacgtccgaggcctaagtaaaccaaggatgatttgaggaacgacttttctgattacaaggtcaatggctcaagaaacttaccgtgggggaggacgccttccagcgactgccgagtacggaggtgaacttccttcccctcctcggggggcggctcccgctagtcgcggcagcagcagcagcggccgcgttggatgcctcctgtgcgacaccctctttcagcgatgccaccgcctggtggtccacgagcggtccgatgacatcggtcagagggagaacctgcaccgcatgaagtcgttatctgatccaggagcaagaatagaggggtcgccgaatacactcacgttgattgcggcttcacgatcggccacctccttctcacaaagggggatggggatgtcacttgccgttgtggggccactgatcatcagttggccgacgcggcgctccaccgtttcgctgttcaagcctgcaagtcaaggaccggaattcggtaagccaggaggagcacacatataaggaggtcaaatcaaatgcaagaaaaataccccgaggagaaacccgggtcgtgtcctccggcccagaatagtcaaaggctggatgggctcgagcctggagcggctggattcgcctaccaacgaagtcggcagcgatttcatacccgacaaacttcgtgctcggaggtcgtcgatggcctcgacgaaggaccgaagggcaggggtcaaggtaggctttgtggtccaagatgaaatcttgtctggttgttcctcgggaacaacaaagacaggatccgaattctctatctaaagatagaaccacctcgcccgccatttgctacgagaagaagggcactggaagtggatatagcgcgacttcaggccatcccgaagtcagaatccgatgcatccagacacccggttggattccgtccaacgcaactcatagtaaaagcggaagagatcaagaaagggctctaccccaatgtaggcctcacaaagatgtgcaaaaatactgaggaaggcaatggaattagggttcaaatggagcaaagaaaggccatagaagttcaaaaccaagagaagaaattcagaaggcggagggagaaaactacaaagaatatagtcctcgatcgcaaccatgcgacccaggacaggctggggttcagtacctccaacttctctctccatgcctccacgaccgggaagggcgccatcttcctggagcttcttcagcgacgcgttggtggaggtggacttgccgagatccattgtcgactggagatcgccggagaaaggacggagagtaacgagctagggttttttgcgggagcggagaagacgagaggcatttggaggctggaaagtttctccacaataggcggacttcaaaatgaatccccaaaactcccttaaatagacgcacttccgatggtgcgaattccaaggaaatgagagagatggccgccggaaatttctgggtccgttacgcgcggcagtttttcagacttcagtttaaactcactcatgaccattgggcttcacacgatgttctcgactatgtcctgtctctacggttcccacaccaagaacggcatcagcctcgacatcagaagtcgcgattggttacacgagctcatttaagcagaagtcgggggctactgtcagggttacgggttaggtataccctttacccttcgatatacgttacatatcgatatggcatgcccgcgcatatatggacattctctgcatatactaaggaaatccttcacggagtttgcagaaaataagagtcctactcggacaagactgggtcgtcaatgtatcgtatagggtctgatgtctccgagttctacttggaaaccgcttgacctgcgatataaaagggaccccctgggaggacttaaggcatcgaatctcatagccaacacaacgaccacagcctacgaagtcgaagcctgcaggagccaaatcgccgggagatctagtcgaaccaactcgattacaatctcgccggtgtcatcgagttccatcgttccctttgtaacctatgattttccatcatataatcccatatcaactggattagggctattacctatcaaggggcctgaaccagtataatgctcgtctttttgtttgcttgatgtcgtattacgtagatccttgtaccaacgtaccccaatattctctatatccagtctacgggtatcacccgtcgataatgtacatatacaaagtttgtatatctttttatacgtgtatatatgttttatacagcaaaagtgtatgcgcatacatgtaaaaaattgatttacgtatatatacaaagtttacacacatattatattatatatatatatatatatacacacacaggtacaatgggcatcaaaataaccaggatattgttgtgaatttggctctggtcgcacgccccgtgtgggcaggcacggatcaatcaccctctactagggtatatggatgagatagtattgtatccggtttgttatggtagaataggattagtttccaaatctacctaacggcttgtttagtaactcgagggaaggggattgggagtttacacaagggaattgctgatgagattaagatgagaatttgatttttaatcccaatatcttgtttggtagatgtgatggaaattgatagagagtttagttggagattaggtcattaataaaaacagatggctgagatttgcttagacaaagtaaagaaggaattccctcccaattacctgcctctacccaggtattaaaaaggagagagttcctccctcaattccccattcctatcgcaccaaaattgtcatgtctcccaaccaaacaaaacacttaatagcctcatctctttaaactcccaatccctcctaaaaactccctccaaccaaacgggccgtaagatccaatccatgtattacaatatataccggtccctgatgcttaatacaatgtatcaatatttacagtatttctctctccctatactattcaacatagtatcagagcaggcgacctagagccgccgctgccccgggagagttccgatctcccgtgggtggacacctgttttttttcctatcttagtcgtcgtcttcgtgttctacttcttcatcgcgtggtggtcttcgcgtcgtcgcaaaaacagcaacagcaccagctacctccacgagtccacctcggtcaccgggggtcatctccttgctggctccatctcccacggtcgtcgtcgatctgatctgctcctccccgccggccgctaacttggtgttctgccgtcggcgcccacactggagctccttcccgccggcactgcagggcagccaccgccacgccgggtttccgcgaccgccactccaggggacccgttgatccacccaccaccgccgggagagcccctccacatccggtgcgccgctccggctgtcctcgccagtcgtcacggatctggcgcccaccaggctcgccactgcggccgctgcctctcggggtgttcgtcgtcatcccaggccgccggctggactcctactccctctgttttccacacgattggaaccgcctccgcaagcccgccgtacgcaccgaggtcgtcatcgaagcacgctccggttccagcacgccagggcacgcccggagcgaaagccgaggtcgtcgaccactgctccgctagccttgccatcgatctcctgctgcccatctctctctctctcttatctgtctacacgtgcgtggatggataggattttgagaacaggcaaaactggtatcttcccgattttgctgcttaccaaaattatgatctgttagcagtttcacatgtcctaaaacgcgatgtatctgttttccaattgttgtacgactaaaagctctttcaaaattcgcaaaatctaattagctaattagcttgtactagttgtgaagtcatgtaagggtggtttgtacgttggctgtgtttttgattctgcaacctagaccagaagctgcggctcggtacgtgactgtttcaacgagctgaggcctaagtcctgcaaagaggggagagcgggagattggacatcggctcggctctaatcatgagcttgattgcagtaggggattggacacgcgtcattagttcacgtggtgtcgcacgggcgggggtcgtgcggcactgccacagataattttttttccatgaaacagaggattggagttgacctatttgctggactgctactggtgttgctgctgctgttgtaccttttcttttttctcctgatcagagatcgggtttgcgttgctcatcacctcatcgacatttgcgcgtctctgacattagcatcgactctgcttcaattttatcatttcgcctcgcgcatctttggcttgatcacccgttcaagcacttggctacagttacttttgcaaccgatcatcatcgagcacgtgtctacgccatcaagctcgcgtcgtcccctcggaccggagtgcttctatccatggtccacctccactagttgttgcagtgctgagaggcgcccccctcaacatagcttcatcacaggtggactcttcgccactgcatcgacatggagctgcaactgtgttgttctctcggaccgcagctttgccactttcgtcgtctctatcgccacctacgcatcgacacccacgtcatccgcactgatcatcgtcagccacgcgggtcttcttcatctacttcgagcatcgccgccgcgtctccaagcctgtcactgttgccgctctaggtcgatggtccagctacctctacatagctaccaatgtcgccgtctaggccattggtcccgctacattgccttctacttcgtccagcattattcatcgccagcgtcgccgtatctttctcgactacacttcgctcttctccggcaattgcgtgctgctccggcaattctccctcttctctgttctcgtgccgcgactatctcgcaggccttctctgctagtctcctccgacattggcgtatgattcatggtggtcccctacctcgcccacgcggtattggcaacaccagcacgcgcgttcgtcccgagttgtcccggggtctggcaaaccctgtatgacgtctcgtccttcacgattcgactacatcggctcttcggcatcatctacctcaatgattgtcacgatcgtgtcaccgtcatcgtctccagcgcgtcctcacgcaccttggtccacgacgccctcccgtgcatccacgaccactctacggcgccccatgcgtgccctacggctcgactacctcgacatcatcggctcctcaattttggctacatcgaccacgtcaactttacgcacggcttcatctaccatggctccctcgcaccctttgctttggctacgtcaactactacacaaagggctatcatccgtattgagcattcttgctagtttcttctccagtccaagtgtccgcgctgctcacgtttggattgtgggggatgttagagtatatggataagatcgtattgtatccagtttgttatggtaggataggattagtttcgatctctatctatctgagtttacttaagatccaatccatgtattcctatatataccggccccaagactcaatacaatgtgtcaatatttacagcattcctctctccctatactacccaacaccctcattctatacatacatctttggtttctatagtaccctcaactagtctttgcaattagatccaacggctttaattcacatgcaaacattctcctacatatataaaagtgcacaatccgtgtgctctcctttgattggttgagattaaaaacataacaacagtaatatactatcaatgaattactcatgtaacggcgaaaaatacgagtgagccaaattcacaacaatatccaagttattttgaagcccatttctctatctctactattataaaaattgaagatgtttttgccggtatttggtatgccatccgtacatgagtcgatttttaagttcgttcgcatttgaaaatacatatctgtatttaagtaggtttttaagtttactcgcttttaaaaatacagaaggagtcgtataagaaatttctttaaaaaaaactcggatgctaacttgagacttctaaccgcagctcatgattttcttaaaaaaaatttatccaagcgaattcctacaataaatttcaccttaactaaactatataacaataataaaaattaaaatagcctttaagacgttgtgaattgctatgtagcagcctgctgaattttatggttgtgtcatccgaatttgaggtcgtcggatatcatcaagatcgagagcagtctcgtcggcgtcgacgtggccatgatgtggtcgacggcagcgaacggagactcgcaccgcacaaaaaaactacggcagcagctgacgagggtgcaatgtcttctggcgtgattgacgtggtacagtagaggcaaggcatggaggggtctccttggccgttgctttttatgtgactatggcacctatgttagtagatctggtgttgttttctattgcattcggctagatcaaagtttattttttctaatttgtcctatttgctgcgtggaatggagatgcaatctatcaagctatatacattcttgaggaatgtatgtgatctaaatctgtatgtaaatgaattcatcaaggattgtttttatcttttccacatgctaatttcttgacttaggctcagttagatctacatggtcatgcgatttcctatgctttgttagaaactaatagtatttaagcatatactttttttctccaaattcagtagatcttagttttgtttacactgaagttgactacttgtttttcattctatctgctatgtgaagaatactatattttctgagaaaagttttgggtataagtccttacattttcaattaattatatctatgttttatttagaatacaagagctataatttgtggcaagggctaagactcagtagaagatggagaagctaaatttcacatcacaatacatcaataaccggcagtcgattggcaatgtgagtataactattttgcaacctttttttgttagataaaaattagttttgtagattttcttagttttgtacgttttggttttgtaaattttgtagtttagttatctactaaacatgttttattagttttgttgttaatttcatagtttcattagctactaaacatgatttagtttggtacgttttggtttggttttcaacaaacattgtttaggaattttaaattttgtactttctcagtgtttgtcttatttgtctttatctttgttagtttttaaaattttgttcataatctcagtttcgtcaaaatttcagtttgcagtatttttgttcatggcaagaaacacttatgcggtactttttgtcacgaaaccctagcgatgcactcaggcacgagccacttgcccttaaggagatgcggttacaatttctattgtgaaagtttcttctcatgcccttgaggatatgcactcatgcacgggacatcttattacaccatcatggtcgatatatcatccgtgatgggatatgattgtgacccgttatgggtcatccgtgacatattacaactacgacccgagaaagataaccttgtatcgatgatgggtcatccctgatagtcatatcttaaaagggatttttttttgaaccattaaagatgagttatcccatacgagtcgcattagcccgacacggttggctcgtcaaggatgcccaatctgtactagtgacagatttcagatctggccttttttcacgttgctatgttgttgcctatgtttattgtcgttatggaggtataagagaacaagagagttagcatcatgagtgaaatgactaaaaaaaaccttttctgttgttaatgtgctctgatcggtgttttcgtcgcttgtgtgagtgaattatagttgtctctacgtgacataaaatgtttattatttgttacaagatttcttacttttaccaagggggtttaaactgtcggccacctgtaaaaactgtcggccatatacattcctgagtgtatacggtttgtcacctcccctcagccatatgtggtcggtaattgatcagattgccgacagtaccctcagcaacaatgtagccgtgggtttatgtacggcttttttttatcagagaccacgtatagttctttctcgccgacaacatttcccgagcatataccgtcggttattcattgagtgacagtataatataccatcggtcttattctcaccgagaggtttgttttctcgtcaaattgtgagaaccctcggctatttagtgaccgatggtctgcaagccttcggcaatggtatttgccataggtttttatagaccaccatccattcgtcaccctcacaaatagtattgtggagaggttatttaggttacttggaaaagtaatccaaccctcagtaattggagttttttcaaaaaaaaaataacatgcaaatttaaattttacccattttgaactaatcttgtaaatgtaacatactccatagtcacatcaacacaaaatccataaacagatccacaggaagttcaaccacagatatataatcaaattgttcaaaaatatttatcatccatcaccatagcaaaactacgtaattcatgacatgtcttgcatgaaagactttatttgaaagtttgaaacaagtctgtaacatttaaaataagatagattgagattaattctctaaactgcaagggtagtccatcttttacataagaaaaagtaagcttcatgaagttcatggtctccatgttcgcttttagataagccataaatcaatatcttcatagtcgctttcagacattccatactccccatcagcgtcatcactattgccctcttctttaggaatctcatttcctccctcttgataaaaatcattgccctcatctttaccaatctcatttcctccctcttgatcaaaagcactctgtggacaaggattgtatcttaaacattaggtactgcactttatgtagataatgttatgtactgcactagggctgagttctttcccccactttcccaactcacatatctctttttccacgcgtacgtttttcaaactgataaacggtgctttaaaaaaaattctatacgaaagttgctttaaaaaatcaaattaatccatttttgaaaaaaatactaatacttaattaatcacgcgctaatggaccgctccgttttccgtgtggaggagttgggttcccaacccaaaggagcgaacacagcctaaagcaaagttcgctatcacaaggatattttgaaataaacttatttccaacctggtcatgttgatattcagcctcttgatgatctggagcagacccaacatttgaagttgagggaccctacaattttgaagcaacatctatatattatgctacaagtatttagaaacacaagacaatgacatcataaaaatgaaacagaagccaagatgaacaaacctcttttagttgctctcatgtatactatcgatatcttgtcattattcaaatatagttagttactaaaacaggaacggaagactattacatattatggagagagtgaactaaccaactcaagagcatattgtttcataagggtattgtcacatcctgatttttgtttcaggatttataaattatttaataaattattattagaatttatattaaatgttctttaattttcaagtgaagttaaatgtgggaaataaaatttcctaaatataaagcatggatggatttaatttttattaaattctccatggttaattatactctctggaatattctcggatttttcggagctcaattcctaaatgatacaaaaaacagttcagtaattagttaatcaattaatgatctaattataattgttaaaagcttttcttgtttaaaaatccttaaattgttgtttaaaaggaattattagaaatgatcttaaaagcctaaaagagaagatctaattttaatttgctaaatctcaatataaaattggggtagataaaattttgttaaatacttctcttgaatctttagttcctagatttttctgggatttatttgagccaagaaagtatttttaataaatggaattgcatttcttgaataatttaaattgaaaaaggtttttaaaagtctcttttggctttgggccgaaagccggcccaaaacctctctatttctctctccctccccggcccagtcggcccagtccgccgcgtccctccctcctctctctcagccgctgacaggcgggacccacctgtcggggtcgtcgtcctcctcgagccgcccggccgaaccctagccaagccgcgccgccgccgctgcccttccaaattccgtcgcccctctctatttccggtcaaattgattgagggcaaatgatccttgagatctcctcttccttttctcttttggaaacatcggctaattttctttggaaaccggaggatttgagttggattcggattcatctctctcctctaaccctagactttccttctcgccgccggtcgccgtgggcctccgtcgccgcctcctagccactataaaagcacccccgagctctcctctatccgccgccacctttgccttagcccaccgtcgcgtctagcgccgcctccgcgtagccctagccgtcgccgtcgttgccgtcggttcagccgcgccgcgccgccgttgcagccgccgtcgtcggtcgccgtcgccaccatcgggatcacgaggtcgtcgccgtccccctccaccgcttcgccgccgctgtagcacgccggagcaccgccgtcaccgtcgacccgaagaccgccgccgcttcaacctcgccgccgtcgtcatccgtcgtcgtttgtcgtcgtccaagagctcggtgagttcgccgcgtcgccctctacccgttggtgtcctctgtttgcgtcgtcgcgccgtcgttcgccggcgagcatgcgccgcccaagccgtcgccggtgatgacgtcatcgctgacgtcatcgttgccgtctgccttataccgatcgtagaccgtttagatctcggccgatctttgtggatagggtagatctcggccgcctgatccgtagactgcagccgtgcacccggtccaccgtgaacccgacccgctgacgcaataatcctccttttccttttcaaaaataattcattattgcgtcataattcaattaaaatctatataaatgctttaatccgatttaatctttgaaaattcataactaattctttgtaacttagtttaatgtggttcaagttgcaaaagttttataaaataaagatctacatattaaaattatccataaatagaattaaatttatttaattctttttaaatgggctttaattagatttaatcttgtaaaattcataataaattcatatgaagtcagaatgaggccgttcaagtctcataattcatctaaaattatgatctacatgtttgtttactttatatgtactgtttatttggtttttattagtttttttcttcgttttgcgtgttagcttgtcgtttccgtcgttgcgaaggttcgtgagtgcgtcgggagtgttcagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactttattctttgataccttgggttattataacttgactagttgagctttatatattggttcagctagatattagatatgattgcttagccatgcttagaaacattagcacattattgggataacttatgactcattattacttaatgatggtttaaagatagttcacgatggtcaatcgtgattggttaattaattacttgccaactaaaacttgataatggttttgagagtcgtgctcatgacaattaaggaccggttcgcgagctactattgtgaaacattaaccgtgccaaccacaagccagcgtgggcaacggctttaccttttgtatagcatggttcattgcggagcaccagactgagaagtggcggagataagcccacgggggtcgctggggagtccatgccttgttttataagggggtgattatgatccaggaatggtgcactgtggtgagttgtgttgtgcagagggtattgtcacagcctctattcgggtactttccagtatcgcgacgcatggtagacaagatgttgaggctgtgtcttgtgggtacagtggtacacctctggccagagtaaaactattcgaatagccgtgcccgcggttatgggcgggttaagcaatgtttttcgtgattagtctcacacctctcacaataattatggatgttatacctagtaataatttgcttagctcctggtttggagttagttctgtacagccgggtatggttgttcaggatggttgggcctgtgcagcatgggtgtgttgttcagtgttgattaaaatttctgattaattactccactgttttacttctcttaaatgttttgctaaatgctgcttttgcaaacgagcctatattatgccatcctttggtatccttgtgcacttgcatatttgctgtgtggcttgttgagtatgtcatatgctcattcttgcaataatcaatcaacctcagttgaagaaaaaggatacagaaggagaagacgtttggcttataccccagttgagctgcctgtgggagtggagctgaagccatcgctagaccgttattccgctgctgttttcttttcttttgtaagtgtgtaacgttattattatgatggattgtatattaaattgtcagtttgtgtacctcggctgattcctggacgaggattttatgcacaaataagttcggaaattactagtgaatttccgggcgtgacaggtatcatagcccagtccactttttgcagccaatgcccacaaagttacaaaatcaagggcaaatagcagctatgtctaagtccaaacttaagctatcaaattatgattagaggttcaacattacagaggacttggttctcataattaagcagcagtctttaaaaagtgaattgacagagcttaggcaagcttcttctgctctctggttgcatagctgttcattttttccttgtttcatcctgtgtatgtgctgccaagcagcagcaagtccttgttgcctaccttttttatgttgctacattacaaataaattagtatatgcaacgattttatataggaacaagccctatgaattgctacaaattaacaagcaccaggtacagtttcgtagcaaccaagcctcgcgacccgccgcattggtatactgtatcacctccagctaacctgtttctccccccatttaaagatttcttcctaaattcaggtttactccagtgctcacaaagtagacgccaaccctcttgagtaattgaaaaatcctttggtttagcagaaatcaaagcttgcacagtaggccaatggttaccatgcatcctcatcaacatcctctattggtacattgccttttttatataacatattggtagctattttcttctgttcgaacagcacctgtggcacttccttcttgataatatacctttttaaatttcagattgcattgcatcatgcttacaaagaggaaaatattaataaaatatggcaacattttgaactaagatgtttgtgctgctgaatttttttttgcacaattttaatactattgaataatgttctcttcattttgaagtatatgcatgccatttcataaacttatccggtcaaagttataaactcttttaatgcaaacatacatgagcatagttttatcatgtgaaaaatactcccacaccattacatttataaagaaatgagataataattaatttataagattgggacacaaccaaaatggtgccatgaagcggtacatacagcggtggggggccgagaagaacgaaataaaaaaggaaaaaaatggctatgagaatgactcgcacggagaggatatatgagaaagtggagaaacatactgtctttgatgcgaagcacaagatgtcctatagatgaaaacattaaaaataaagatgacaactatgtgcttaatatggtagagagtagagagtccattaatttattgcgcccatgtgtccgtgatcatatctactttaatttgatctaaaataaagattaaagaaaacaagttactataaggacgtttgttttttagttatagcctatgcagtacagagtattttaccttttttttcatgcaaatatagttctctttgtcacatattattgccgaaggtaccattgtgaaccatcggtaaagttgtgtcctctcagtattttttccatgtagccgtgtcactctatcttggccttcggaaacatataaccattttcgagaggtatattaaaccactctgttactaatatatcccgtcggtcactaataattgtttccgagaattatattaaacccctcggttactaatataccccgtcggccactaataatcatttccgagagttatattaaacctctcggttactaatatactccatcgggccactaataatcatttccgagagtcattttaaacgtctcggttactaatatgccccgtcggcgacttataaccatttctgagtggtttcttatataactctcactcacttaaatatcccgtcagccacatgccaaatagtcaagtgttctcttaataacccttaataaccctcactaaaatttcaaatggtcggccacataaatctttctgaccgtttgtagaatttttttcttagacgcttggcaaatctttggattctagtagtggttggtagcttcatggtataagcagctgtcaatttgagcaataaattatggaatatcactggtacaaaacatttgtgcttgtttcttccaaaaaatcgcccgacttgtgacatgacgtgcgacatgccatcgtcatggatgcctttcttcctataaaaaacgaatctaggaccgaatgtaatatgttctagtactatgaatctggacataaggacatgccacatttgatagttggttttttgtgggacggaaggaataaattagattacgatttgttttcatgcttttttgacgtctaaggattcaaaaagttggaaactcatttatataggtggttgtgctaggacgaatgcttgtctctacggaaagttggcaatgggatcctatcgatgggccaagatccatggataggggcagttgtgccggggtcgagacgtcgcctcttctctatccttgtcatagaagtcgtcgtcggagaaaccggttcgtcgctccatgatgggttgattcctgactatatttatagttgatgtgtagggcaacctggttttgtacgtatgaaacaatacaatacatacaattaaatgaagacacgaggtttatacaggtaaaagtttaactcctgtttatatggattgatttgagatgttggagaatacggtggaaacttagtaggctaatctggcgacaatgggatctcgacgggagacgattatctgggggctcgaggtggatatattattagctctggcatctggcgatataaggttgtgtcttccattgatctgcgtttaaccccaaggccgctgcttatgtatacgtgaaaccatgtcatactcaatacggacttgggcaggttcaggagttcaaaaaattaattccctggatatatgagtatgtcgtctaccatcaatccccatatccacataataattaatgcatgtaccggaaaattttctttgtctgacaggtcggtatcccctatttatttccttgatatatatgttcaagtcttttactttgaatgcccaaacaagtctttgtagaaatttgtatataattttacaattagttgctttgctgttttgtagttttggtctacgtaccttttccattatcagataatatatctgatgtttttttctcttcctgccatttgttttagtatgatactatttgatattactatccccctctaatcacttcagttttccttggcttgttgcaaatttcaatctcttttctactagcaatcttccttccagacatctaactgaagctaaaggtactcaatttccaagtcattgtttgagtaaattctctgtgtacccctgaaaactcactcaatcccttttatacccctaaaattaatccgatcccttctatacccctgaaatttcaacttgatcctttccatacccctaccattatattttacttcatttcactagctactacatttggttgcaaatgtcttttttgcccttgatgttttaagttttaataataggtaaattggaaccatgccattgtacttttgcaaagtttgagatatgccatcggtatctcaatgacatgtaggacccacatgagtcaatggcatgtgggtcaggatgccatatctcaaattttgtaaaattataatggcatggttccaatttttccaataatataagcttgaaaaagattgaaaattttgtttgagtgcatagtatgtacatttttatgaaactaatgagactaaataaaacaaatgtactaaattaaaatatttatttgaaattttaataagacaatggatttttttatcgggagcattcataaaaaaaattattgtgagcattggtagtcctatctttatataaatgctcctcatcttttatgacttcttttaaataataaatacatattttttatttcattatctaaaaataaattttgtgataaataatgcatcacacaacaaactcataataataatagactcatgcgacaaacttttacatttttaataatgtaattcataaattctattttcatccaaagggtaaaatggtcattttcatagaaattagacggtcaactatggtcaactgaaggaaggagtatgaaaaggatcaaaatcaaattttaggggtatacaaggaactaagcaaaatttagaagcatagaagggattagctaaaatttctggatatataagagattttctcttataaaatgtctcaagtttctctttctcatacaacaaatttttgtacactataaatttatatgtttgcataccatagggcaaaaatagactttttcataagagtttaacaacgaactaacgcaaacggtgcagaagagatgcaaactaaaatttggaagtataaagggaatgagcatactgaagagcatagggattagacaaagttttaggcgtacacagggaattttctctttctcgaaagtgtatggagtaaccaactctatcatccaaaccttatttactttcctcaaatcggctttctatgaatatgaaacttcatttgttataacctactcctgctttatttgtctctctatctttaatttatgatatatccccatatatacaatgacgataaattctgccataacaatctttttgtaggctctaattttcacctgcacttatgcaagttgtcaatgatattcctctatggacagttatgtctccaagaacaaaactatgtaaaaaagaatcacctagcaccaccgtgcacacataagccagtaggaatttaggcatgtgcaatatataaatgctccacagtaatctgttatcctaactgacagctgcttataccaaactaccaacaaataataaatttttggtgtcacagaatgacaattacatgttccccaccagtgacaacacactgatcagacctgttaacaacggaaaaaggatgagtctgagttaatggcaagataatatcagacacgtacatcctttttatatctcaggatggagactcaattaacggctaattaaaacgacaaaagcattatccccgatggtttcacaactactgtagtatataaatattcataccgcatgtcaatcttcttactctagcattcctcgtcctgccctctaaaaacaaaagaaagaaagaagagaaaaatgagtaataagttacacaatagtagtagacattcatttctactggcttggcattcctccaacctcgcgattttacacgaagcaatcagaataatcccgagatatatcgtcgccattgtcgtggaaattctgcgaggcctcctcgtgatcctcctcctgggcttcgtcctccacctcgccggcggcgaccgccacccgccgccggggccgatcgcctgcgcgcgcggcggaacatccggcggctgcacggtcacgaacatctacggctccttccccgaccgcgccgcctgccgcgcggccggcgtcgcgtacccgcgcaccgaggaggagctcgtggcggccgtggcggcggcggcggcggcggggcggaaggcgaaggccgccaccaggtactccaacagcttcccgcggctggcgtgccccggcggcgtcgagggcgagggcggcgtcgccatcagcacgcggtggctgaaccgcacggtgcgcgtcgacgcggcgaggcggctgatgacggtggagggcggcatggtgctgcgtgacctgattagggaggccgccgcggcggggctcgcgctgccgcactcgccgtactggtcgggcgtcacggtcggcggcgcgctggcgacgggcgcgcacgggagctcgctgtgggggaaggggagcgccgtgcacgagtacgtggtcgggatgaggatcgtgacgccggcggcggcgagcgaggggttcgctgtggtgagggagctcgccgccgacgaccctgacctcgacgcggccaaggtctccctcggcgtcctcggcattatctctcaggtacacgtgttgccatgtactatatgcacgtgcttcagaaatgtccacgtcaacatgctcaggccaaactgcgtgcatgcatgcatggcagatgtggattttcattcctggatgggatatcccctcgttatttgcatgtcatataaatagttatttgcatgttatctaaatagttattaaaaagattaaaatatatatatatatattaatacgaaatatatcacttcacaaatatgcaagatcaaattcaacttctataagttacaacaaaaataacaaattaaactgaaaaaagttatcgcacattagtaactatatttgttatttttgctacaacttgtaaaaattgaatttaaacttacatgttagtgtgtgatatgtttcatattaatctatgttgccaatttttttatatattttttgatgactatttaagtgacatgtacgaaacaagagtatatcccctcaaagcatgaattcactttcccatgcatggcccctactctggtgttcttttgttttcagagagaagaaacattatgctttcgatatttttttttcttagctaggtgctgggaataattgtattttatgattttttttaaatgtcctaacgtattatatattttttaattacatggcaaacgtgcacacacaccactacgcacgcaataccacactcattccccatgaatgtgacgtccaacacatgctttaagaaaaccaatggtatattctatcacactaaaagtctttttcaaataccaactatatatgtgtaatattcatatatacaagtattaaatcctggtgggtggatatgatcgataacatcatcacaccactcgtgcttcctgggaagaagctataatttgggtgggcgctaatagtaaccatcattatatcacggtcatgcatgggagcacacttagagcaaggttaatagtatagccaaccaaatcatctatagctaatctaatagctcatttatacaatagttaaatataaaaatatactacaccattaatatccggtcccacctattatacacacataacgtcttggagtccgtgttgcagccggttacaaatctatagtccgttttcttctctcttttaccttttcttctcgatacgtggttatagttggcttgtagtttgctattgtacccgctcttagagcaagtataatagtgagctataagtctactataaacttatgtggagaaaagagataaccaaaaatcaagagtgttggctctcatgtaagagctaacttaacacaagctctaaaacaaatacagtaaatatatagatagagaggagtagaaaattacagccaaccttatagctaatctattataaatgttggatttaacataggctaacagtaggaagatagctctaccattatcttgctcttatggcaaagatgtctcaattaatttggggagcactctagcgatattcgccaatagtgtcctgatttcgatatgacaaatctacagcaggtagccgtgtgtggttgcgtaaagaataagacactatctccatgaaaaaaataaaataaaggcgtacaagtttttcgcacgtggtcttcaatatagaacactgattattaattcatttcacactatataccgccaacaactacgtatttaacatggtataaaaatattttcaaacataaagttgatatatactatatcataacagtaagtatatttatttaattcaaattattaattagttgacagccaaaagtagttttgtcgtgcacacacatgtccacgctttcctgcaggtaaccctggccttggagccacagttcaagcggtcggtaaaattcgtgaagcgcgacgacgcagacatcgctgagaaggtagcggtttggggccgcctccatgaattcggtgatatggtatggttgccggggcagcggcaggtgatctaccgtgaggacaaccgtgtcaatatttcgacgcctggagatggtctcaacgactacttcggcttccgggcgcaaccgacgctaagcatggtcggcgcaagggtcataggtgattgaattctttatcatatctcaaaattttctgagatgagtagccagggtagaaacctctttttttttttttcaaaattttccgtgcccctttcatttcatattataagttgctatgtggtcggtagagaaatttactaacatctataactccaataatgttattacatgtaacattaaaaatatttcgataatatatttgttttcggtagaaaatattgctccaattttctataaatttagtcaaatgtaaaaaaagtttgatcaaaaaaaataaaaacaagttataatatgaaacagagggagtaactattttttttatttattttttttagagaagggtattttttatccggtctgggctctacatccaaccgaatatatgcagcctttttaaaattagaaacttagcctatcaaacaagatatacgtaactcttaaaataatctataatttaaaattcgctcctatgaagtaactatttgaacattatattggcgcagatgagtgtctagaagagaatccaatgtacactgacactgcccgatgcctagcatcccgtgctgtcaccaagatgttcgacctcctggcgtacggcttcaccaacgacggcgccaccttcaccgggtacccggtggtgggctaccagcaccgcatccagtcctccggctcgtgcatgggcagcctggaggagaaggacgacggcctcctcctcaccaccacctgcccatgggaccgccgcacgcggggcgtcttcgcctacaacgtcgccttcaccgtcccgctctcccgcgcgccggcgttcgtggccgacgtgtccaggctccgcgacctcgacccggcggcgttctgccagatcgacgccaagatgggcgtgctcgtgcgctacgtcgcggcgtcgtcggcgtacctcggcaaggcggaggactcggtggacttcgacgtcacctactaccggagccgagcccgcggcgcgccgcgcgcgcacgctgacgtgttcgacgaggtggagcagatggcgctgcgcgggcacggcggcgtcccgcactgggggaagaaccggaacgccgcgttcgacggcgccatcgccaggtacccgaacgccggcgagttcttgagggtgaaggacaggttcgaccccgagggcgtcttctccagcgagtggagcgaccgggtgctcggcgtcggcggggcgagcccggccatcgtcggcgacggctgcgccatggaggggctctgcgtgtgctccgacgactcgcactgcgcgccggagctgggctacttctgccggccggggaaggtgttcaccgaggcgagggtctgctcgttgttgcgagacgctgccgatggctaccttcgcgatcgtcatggcaatgtcagggttaatgcaactagtacagggaagcattcactattgcacgaatgattttcctaaaaaaacaataggttggacacggattataactggtcgtgtctgtaaaaattgactcgcaccatatatgaaaatcttttatagatgtatcttaagaagctatatgtaaaaatagggcttttttccagaaaagcctcttaggcggccacagggaaatatatatttttgcaaatgggcctcttaaagttttacccaaatatctgagttaccttctcttttccgttttagcactctaattttttttcaattcatccttatctactctcttctactttctctcctactcctctctttctcatatccgtctctctctctctctcaaactgctctctcctctctctctctagcgggtacgtggcggtgggcaccctacgcatcaaaagcggtgaggggtgacggctgcaacggcagtcctccctgcttggatcccatgaatctgctagcggtggcaggaggaggagcacggcggctgcggcagcggccctccctcgcccagatccggtggtgggaggagcttggcggtggcggccggctgcagcggccgatgactggcaggtgttttgcgatttttcctcagatttttgtattcgcgtacagacgatgtaagtacccatataaaaaaatagcaatttttgtatacccttcggagtagatgaatcagagatccacacgtgaaagtcacttttgccgtcctagaaaaatcgtttttatccggtgattgtaatctttaggacttggcgatgtgcgacggctgtctttgaggcatggaattgtcgtgcgctgagttggcttatttatggaccatttatatattcgccttatggtcgatgtacggcattgtttttatttggctaccgaagcaaattaatcggtacaacatcgaaaaagacagtcaaacataacaatataagtgcgacaaggtaaagttgaaatgacaggaacattatttttttcttagtagcaaaatattttgaaatatgacagcagcgtgtaagatcgaacatctcaagatcacaattacataacactgagccatattatttgttaacgaggcacaactttaaaaatgtgaaaaagaacaagttcatacattctatatctataagcctacaagttcatacagatttttgctaactaaggatgaaaattcacaaatagactttaataattgttttcttctaatttgttggttttattaattgttctagttattattgttgcttgactattgactctctttgtgagagttttataataagttataaccatctttgaagcaaaggcctgatttatatttcattattgaaaaaaggctgaatcctagacatccagacactacggacacagcatcatcgctaagatattctaggaatagatatgccagttaacctctctattaatttaagccaaattctaccctgcacctaaatctatttttcatacagagtaaaagttaattcatttatttataccttgatttggtaacctcaaatagtgatcacaaattcattcagctatgcaactgttcagagaaaaaaaaacaataataaagtcattcggataatatgctggctgatgtgatccctgccatctatttcatcataaatggaaaagattggtatatataacatgtgtaaaaaccgctacaatgacactgagccatacacaacattagcaactgctatattctcaaccgtacaagcagttataatacttgaaatgaaataaattgatattaatgttgagatatcgaccgtaccacacaatattctgccagctcagtttccctttgatgctctcaacctactgacaattctgaacttttactccaagaaaacgtgtgtcatgtccatttttgctatttatggaggaccaaatatttatgacaaagttaattaaggtttatgttaacacaacttaccaaaccttgtggtttaagataaatatttacactggaggtatgggtcgccaaataaagggctattgtttttattgttataaaagcaaaaaatataataatacgctaaacatgttggttatttttcgaattatacctgcttggactaaaaagaagagtgactcaacttgctaatacttgattccgaattttgaaatttttaaaacactaaaaagagtccatgatatttttcgatcgcttgttttctttaatgcaaactcccaacatgttttcggtgatgataatccacgtcatcagtggatataatccctccgtttgcatattacaggacgtcgatcggtttgttctaagtgaaagttcttcatgctagaccaaatttgaaaaagaactagtaacatctgtatttataacggtccatattccacaaggcaatttccaaatttttggtccacctgcaatttttggtaaataatttactgttttgaattagcaattttgtttctttagaacatcaattttgttcaaaattacccgatatgtgttcaactattaagtgttccgtctcaaatgttgggcccatccatcctcctgaaatgtttgcaattttgaaatataaaactctggcatgaatgagaacggggttaagattaggcatatttactatcactgccacagacctcctcatcaccaacggttcaaagttgccatttgtaataggcaaattttattgtaggccattgagattttgtggttttacctcctacacatgacaacactacaagaaacctgttaatccatgacggattcttgttgacggattctaagactgtcactggtaggcgcgatctgtgatggttatcttattttcgtcatagatgtgcactagtggatattctcggccctctaactcgtgacggttttatttggaccgtcacagtttatgactataaattcgtcatactctagttggcccaaaacaataggccctctatcatatatttagtgcaaagaaaaataaaaaaatgtgattgcaaaatgaatcaaacccaaaagacaatttgtttttgaactaaattattttgttacttcgttacttgtatgcgtatggtacaactgaaaatattctgtatatatatagtgtgcgaacaaaaaaatatttggagcttgtaggtattgaacctagcaaacgtcataaggggcaaaaagcaaacgtcacagatttatataatgaatttctataaaaatatattaaaagttaaagcaatttaatcaagtgaattaatgaggaaactaaaattttcctttgaaaatcatggctagaaatatttttttaatattctaagtggtccaaattattctctaaaattttccgtgaattttcggagttcaataactagttttaataccacaaagttcatttaacttattaaaataaataaaaaacaaattaaaatccctctctatgtccttgggcctttttcagcccaagtgttactcactccctcccatagtccgtatcccctctctctccttgggccggcttccccttcccctccaccttcttcgggccaccggcccagcccatttgctcatctctcgctaagaagtctatttttcctccctcctctcaattaatttcaaaatattaaaacttcgaatcgatttttatggcactaaatcaactcgtataaaccagcaagaaaatcaactggattaatcgataaacaatttagttgacattatgtccttacaaccttcatttggaagtatagctgtctgcacttgcaaggaagtacggttatgaagaacgaaaatttagtttattttagactgaagattcaagagagaccagagttcatagagtcgaatggagaatgatcaagagcttggccgagttaatcataacgagtttgatcttgattaattagtctggtccaaaaaatgggcgaattgcgttgagagcaaatcaggaacaacgccagctatgcataaaggtaaaatatgacacgtaccaaagaacatgaacaagctgacctcgaacaaaagtacagaaggacgactattaagtggggatttttgcaccattcaaaatcagaaactcaaattcaactttagggcaacaaatttcagccaatttaccaattaattaaaaaaatatccaacttttaaattaggagtggcagtgtggcacctcgcaaatgaatacattttcaacttgattctttcgtagggatatttgtgtatgactgcacctgccagaattcaaactcagtatcctggttagtgtaaaggctgaaagttcgcgaaatgaaaatttttaggtgtcacatcggatgtttgaccggatatcggaaggggtttttagacacgaataaaaaaaataatttcataactcgcctggaaaccacgagacgaatcttttaagcgtaattaatccatcattagcacatgtaggttattgtagcacttatggctactcatgaactaattaggctcaaaagattcgtctcacaatttcccctctaactgtgctattagtttttcttttaatctatatttaatgctccatacatgtgtctaaagattcgatgtgatgtttttgaaaaaacttttgggatctaaatggggccttatactatttcctgtgtccaagaagttactcaatagaaatttttcagaactatagaatatgatatttgccaagcaaagaaaaatgacctctggtgttccaataaaacagaggttgcaaggcatcagtcacacatctatctataatctatctatctatttataactatactaattaggcactttctacgagctcccatgttaattagaaagatcttatcgttaattagatagatcattttatcaccaccgttagattgaatatattatattaaataaggcatacaattaaataaattatgggctcattagtttaatgtcaccaagttaatagtgttgttttataatctcacgtatttcactggtgcggctgatttgggcgccgatctcaggattcggccagaagaaaattaaaaaaaaaggaagtctaacatggatccgatctaatatatctactccgtctgttctgttcgctaatgatggaaaaaactgcgaccatggcgccaccacaccgtgatttttcacttttgtgggctgttttaaaagcctgtcaaatcttatgtccaagggcacacatcaataatctatcttagatctatcttggagagtattaaccaatcagccaggcaaataaaatatggggacacgaggccacaagtggaacgagattgatttttccgtcaatcaaagattgatttttgtctgagacgacacagatcagaattcatccaggctcgctcatatacaccaacatctatcatggcatataatttttttgaggggttgacaattgataagaaaggttcactcttagtacatatttaatttatcatctttttatcgtctcatctgtaatatatacaggtaggtagctttcttattgatgctgatctcatgttgtataaagtactgctgattttatcgacataacgatctgttcttttttcccttttttttagcatggatagttcaacgttatcaattatctaaaaaaaagttcaacgttatcaaccaatgtacctgcatctcccctgtgtgtgttttagctgaagcgttgcatgcgtgtagcataagctgtctacatgaagcagcttaacagaattcaatgacaaggtgattatggattcatggaagggtcaatgcattaagatgaacttacaagaaaaccaggtttgaacccatttttatccggttatattttaatctatttttatttgattaagtacatgcatttacgtttttaaaagaattttaatgagataaggaatttaccgctggctcgcgagcgtgagaaagagttgtgtgcgtctgtgcatttttctatgtgatgaaaaaaatatacagagattgatatgaacaatatattaatagcgcgtgcaaatacgtgcagaaagccatcagtaagaaattttatcgtcaaccaaattttaataatttgagacaccacgccaattaccaagcacaactcactattcatttgttaccgattacaaaaatatcaatcaaatagggaaaaaaatataactgagactctcttcatacttaataactcataatttctcaattaaattaaaaaaaccaaaaaaactatattgagaccttgttgtgaattaagagattagaatacaaataaaactgtaatatttataatattaataataatagcccgtgcaatgcacgggttggcggctagtaaaactaattttatataaacttagttcacctttggacaattccaaaatatattataacatgaaacagagtattatgagcactgcatcacagcacaacttaatcaaagaagcagcgagtattactcacgatgagtttgcagccttctccagcagttgccacagctcaacgacagcagccagaattaatggtcctccgggttataatagttgttgttttgaacaagagtatggtctctgaaaaaaataacttagacattattttgtattataatatgcacagaagtgttaacaaatatatgattttattaatgtactttataaaactaatctatgcatatagtcaccatatttttaaaactaatctttgcatgtagccatcatatatgaaaggcaaatattttagaaatgatttataatcaaagattctaaagtttaatctcacccttatctaaaacgacatgtattatcagtccggatagagtaattatcttattcctgagaaatatgggcaggctcgacgccacatcacagttcctaagatttggagttaagaggaatacactgtcatggccgctcaaaattggcttagacaccagccaccggtgaatctgcgggccgagtctgatcaaagtggtggctccccacgtgaaactgcacaaccacccctcgctgacattgttttcacctgtagagggcttttacagtgcttgagaggtatggaaggtaccttcctccatacttcaaatccaccattgatttataaaagggtaaattcggaatatggagaacaacgaaaacaaaggcagtttagtaattcttttagccagttcagtaattatcattcgttaactttctcttattgccgatttgatttcctcatggagtaattaagatggtaattggctgctttctcatcgctatgtgtcggcggcacttgggtacaatttcctacaaataaattgagagtagtattgtttttttcatcgcaaaagcattacttacaattggaccattcataaattctcttcgtataataatacataaagacaaaaggcatatacatgtcgattctcccctttcaaaatatttcaacaataaatactgtcaaagttgattacttggttctttgatcaaagttttgatcaagcttagttagatgagtatgtttatacttccaaataagtcttacgcaagattacaaagttcgatgtctttaattaatcgtactgctaattgttccctagttacctaatttcaagcacagttaccgagtttatctcagtagttcgttggaaacaacagttgctttctaatttgatcacaggtacaaaattacctatatgaccatctaactttttacttaatacctggcccatatttttagtaccttcatgtaactatcttttgttatatatcgttggattaccagctatcaacggctataatgtctcccaagcatcttagaaagcctctcacctgtagttcaaccatcggcccatttgggtgtccaaacagaatatctaaaactcccaaagtctctcattccaattaggcgtgatcatctccccaactgaagcaaacaatttcaccttgatctcctcacccattgtcaatcctgggatgttacaacataacatatggctcgttagtactctctcgtttgtatgaatttccttgagagaagttatattctatttatgctatggctactcatgcagcccataaatactgcaccaaccacaaacacactttgttttgttagcaatatagaaacaaaatgtatggttgtggtagggtatattcatgtgtcatatgacatgtgtaagaaaggatgagcagaaaaaataatataatgtatttaatgatcatgcaaattaaccaattgcaattttctcctgttcagcgaagcaaaatctcctgttcgaggtgaagcaattttcttcaatgtcctcactaattgtcagtactagaacttcaatgtcttgaactcggtcacacgtacttcaatgcacctttcaccaagctgttttttgagatattactgttacattgcagtagtatcttgaagtacgttacggcacggtgagttgatgacaacttgagaccacatgcagagtctgagaggacatggactgaccggacgacggctgaatctaaacatttttgaatttatctaaactttcgtatctgcatcattccaaaatgattcttccttcggcaatctatccatcaatcggatatgtgaggaaaacttgaggttcccgctgaagttacatccccaaacaaagagtcaaacctcgaccagcagaaattcctactgtctcctattcctacgagccacacatttggctgaggctatgaaaagacgaagaaatattaaatagtgctagaatttcacgataaaacatatcttgtgccttttttccatctttatctgcctcgaacagaaacatgtctctgcaatttatgaagatacctagaaggctagaagctagggaagtccacgaataaatagagcaccaccagtcacacccactttccatggccagagttaagtgcaatatcaatttcttatctgacaaggtacacaaattgaaaccaaatcttgcaaacaaaaactaacgacacaacaatttgggatgaatacattgttttttttattcataacaattaggcaaattttgttgtaggaccctgcgactttgtggttttagctctagaacacgttaaaagtcgatcattagggaaagacactgtcaaaatgtgattatttcctgatagacaccgcaagcattaaattctcggactttactcttcgagctcatatcacttttaggataggtggagaaaatagtattttcatgcctctatttctaatttctccgtgacctaagatcacgacaccgaggattgtttatttccataatataataggttcagccaaacatgactgatctgcaacactgaaataaggagaatgtaagtaaacaagtcctcactgacgtcgtctgtcttgaagctgttagctcgagcaggaaccccatgtgtccctcctcagggtcaggatcaccactaattggcgattgcttttcctcgaagaacaaggagaagaacatcatgaccgatctcatagaaccagccccaataacatatcaataatcgaactcgaaagaaacgccatagaaggtctaatactgaatataacaccaaggcacgttattatctgttaacgaggttcagccgaaacctacatccccaaggcactaattacggacactactctcttatacagcatattacagtgtatctaggtatccaccctcctagaactacttgctatagtagaatggctagaggatagttatacatgtctgcaagagctatctgtcaggctaaaggctactcatttagtagtactacagtagtgaatatagtgactgtaatgggactcttcaacctatctctaatgaccagtaaacttgtggtgctgcagtagtgaatatatgtgtttctcaatcgaaactcaaacaacttttgagaagaaagcgaacagttgaatttgttattctttgacattttcttgacaggagtgtatagcattttttggaacagtgagcattgaacacgtatgtataaccgatagcctcgcgcggcaggtgaaatcgaagatggcatcacacatcacgattcttccaaatccatggccataccgggtgtttggtagtggcacacggtatttttgggacgttaccgtgttcctgttcgtacacccgtaagctacctagtgttttgttaaactctcggtaacatttgggagcatacgggagctttccttgccctggtagtgttcgcagccagggaatcctgggactgcagagtgccaattcaatctatccaagactgcaatataattttctgccagtaataccaacaggattttgatctgtgttctgttgtatgtgacgatatgttgcaacagtatgttcgattctttgtttttgtcttcaaagttttcgaatgaattcaatctttttaatacacaaagagaggttccaattttctggctatgcaataaaccgctcaggaggagccagaattcagcgatgggagtacactatttactgtggctaattacctaattccccacttgtctccatcacttgaatcatcactgatgcatgcaggactggtaattcctggtttgccggccaatcaattttgcaagactggtatcgagtcctcaccgacggcggtgattgccgatgaccacacgcctgaatcctctaggattccggcgtttaccaataaagtacttgtttatctgggccaaattaacagaagattaaaaggtgttgtggtcacggccaatgccaagcaaatcaagcaagttgaacaaactgtgaaatgtgtagtattacctgtgcggcagcagaataagaaccaaatttcctgatgcctcctattccacacatcatatgcactgctaaaataatttctttttgatgtcatatgaaaacttgaatatcgtggagtgtgtagtgctctttccgtcgtaagatgagcctgcactatttacgcaatggaaaggtaaccacaaccataatggacaatggttgtgcaccaacagcccagcaaccttcctattaaatcacagtacatggtagtactatctttcagttactgcgtactctctcaattgcacattataaaacaatttttcatgtcatctctcgtcgagattcacacatgtaattcacatacatagatccatgcattaattaatctattaaaaaaccaaaatgtcttataatgtaatcatagatagtagctaaaaagtacacattacatatattcaagccaattctctcaataaaacgaccaagaattaatataattcgcagaaactcttgatggctttcttttcacattgtcgcacaatttacactattagccgttaacccttgcattacataatcaatcataaaaatgttacaaatgagattttgcaattattaaataatgaaagagatcttctatggtgcttggaaggcatgacagccattgattacatacaatctgacatataacaaaaggtacgtagagaaaggtactaaatatgtgggctaggtattaacttaatacattaagtaaaaggttatatcagtaattttggatgcataatcatctgatgccgttgtgagagccgatacagatacagatcgagagaacatacatgagcgatctgcagcttggatggctcaatgggaagataattatctgtcatggaggctgttgatcaggatgttcagtaaatttgattgaaggcaaggattgctccttgatcaactgtcgtacataatgaatggttacaacaaattgtggaaagaggacgggaaggtcactgcttcctgtgtctatggattaatcgaagataatagtatgatcttttcaataatcccattttagatgagaatcagtaaaggaaagaaggatatggaacaaattatagggacggacggaaaactcagtagagttctagaggtcacagctaataataattactatactacccatgtttacgtttttctattcctaaactaccctttaaggaatgaacggtagatagtttatacgagaggaggtacttggaatacctttcaagaaccgtgaaaggcctcataatgaaaatagtatacttgggatactgaactgaggacagtacggtatttattaatttcgatattcaggtactcatcaggtacaactcaatactactcctattaatttattgatgtaatgtttttgaacaaaatattgacatatttagaccacgctaaattatgcacccctaccaaaaaaattattatgaacatttgaaccggattaaaaaaaatcaaagagacataagatataccgtgttcttataatcagtgatggctttcgctagtgcaaactcatgttatatatttatgttccagatgtagatggagccgatgtttaggactgcgaaacttacctgcatccaaaagaataaatacttgtttgtcagtaaaataagttgacccattttctcgcattgatgtcgatcaacatgtcaatgaaatatgaagggttaactaaaggatcatgtgaattggtatattaatccatgatcagattgaatacaacaattagttcaatttatggtaaaatctggactaaaaaaggtatttttgagtgccaaaaaataccttacccttcatattgctagtacacgataatcataattgtacagcctgattaagtatattgtgacatgctatatatctgtatgtttacatatttctttttttctaagtgagaagtgcaaattccatatgcagcttacttttttttatgtaagtggttgttgctacactcaggttactagaaactttcatgatacaaatgctattaatggtttccttttacattctctatcttgaggaaaacaactgtacgaacgaaaattgccatatggaaataaaaccaacaagatgttgaagaatctgaaggaactttggtacgcgatgttgatcattctttaaccaaagcccttaataagaggacatgcaagcggctggacttctcgctataccctctccatttcttgttatatgtcactttaacttttttttctagttagatattttcaagtttgattaaatttataggaaaaatagcaatactttaaacacaaaacaaacatattatcaaaatataattaatatgaagataatttggtgttacagatgttgctagatttttctataatcttgatcaaactaaaaaaacaacctataaaatgaaacggattggagttagtatttgatatttctggttggactagcatggtatatctgccaacctaaaggtcactagcccaacagtagcactgtatgggcttgtgatatagacaatgagcacagcatcgaattactctgaatctgtctcgctctaaaatcaatacataatgaatcactgtcagtatgaatcatggaaagagtaccactgaaattcctagtgtctcccatcccaacgagctgcgatgtgttggccttgtttttggtttatagccaaataaattagcactgtcaaaaaaaatgacacctgtttggtttggaaccaatatatttggcatagaaacaaacatgcccaatttatatgctcaatctcacccattttcatttgtcaatcatggaatgttacaagaaaacttatgttatatatgcggtctcttctcatgagtttcccttaattagaataggtgtacgctatttatggatgctctggctatgtatctcatatatagagaatgcaccagccgcccataaattaaactacttgcagttacagtgccatatttaaaatatcaaagccatctctgcaaaatcataggaaccaatgaaacagctcattttccataatctttccctttcacattcataatatagagctatagtagcatgaaaaggctgtaacacattgtcaggatttgctccttcgttcatattataggttgttctagatttgtttcaagtcaaacttatctatgtttgaacgcgtttataaaaacattcagcatcctttcgatacaaaaccaaaatatattcagtgaaagacttaataaactattttgttttgtagatattgacaagttttctataaacttagttgccttaatacagtttaacttggccaaatccaaaatgtattataatatgaaacagcgagagtattatgagcaccgcatcacagcacaacgtaatcaaagcagcagcctagaatgaaagatcttactcatgatgagtttgcaaccttctcgagcagttgccacagctcaacgacagcagagccagaattaatggaccttcgggttgataatacttgtcgtttggacaagagcacggtcttaaaaagcaactttgaccattatttctctattataatatgtttgaaagtattaccaaatatatgattttattaaaatactttttaagactaatctatacttgtagtcatcatatttgaaatattttaaaaatgaatcataatcaaagattttaaattttgactccacccttatctaaaacaataagtattatcagcccggagggagcaattatcttattcctgaaaaatatggccaggctcgacaccacaacacagttcctaagttttggagttatgaggaatacactgccatggctgcttaaatttggcttagacaccagccaccggtgaatctgtaggtagagtatgatcaaactagtggctccccaggtgaaactgcatgaccacccctcgttgacattgttttcacctgtagaacaaccatcggcccatttgggtgtccaaatagaataactaaaactcccgaagtctctcattccaattaaggcgtgatcgtctccccaactgaaccaaacaatttctccttgatctcctcacccactgtcaatcctgggatgttgcaacagaacatgactctctttggtatgaatttccttgagagaagtatattttatttatgcaatggctactcatggagcccataaatagtgcaccaaccaccaacacattttgtttcttagcaatacagaaggaataaggttgttttttcgtacaaacaaaatgtatggttgtggtagggttcatgtgtcatatgccatgtgtaaaaaaggatgagcggaaaaaaatacccttattataattaacataatgtattaaatgatcatacaaattaaccagtagatttagatccaccaaataatatcaccagtggtaagatttgcacaacatatttttgatagttttctttgagcgaaagaatttttcttaatttaacatgaactagtcgaattttacacattgcacacataccaatgaggataattccccttccatcacatcttcaaatgttatgtcctagtgtttgatgagagcacttgatgcatccaaaacagcgtgcaagctcgaatggaaatgtcgattgggacatggatgcattcttcaatgtatcccctacttcgcaaaatgaaaaatagcaaaaagcagtgtaaactatcgtttatgggttcagttgagcagaggcttaactaggaaaaatccattagaattatttgctaggctatgttatggactgtatctcttgatgccgaggccgcaagtcctaaaatagatacattgggaaaatagtcacacaacatgtttatgttcggcatggttgtctgcattatgaagaatattttcataatattcgccatagttacgctcacaaaaatgcgtttaaacacatttattttccgtttaggtatcaaagtacctaatcctacccagaagtgccgtagagcttcgaaaaatggccatcttggccttttttctcgatgacatatccccgtacacgtgagctccgacaaaacaacacccaagcttttcctaacaacacgtatcaccttgctttcccttactgcgagaagtcctactatacccaaggtagttgttcgctcacttgctctaaaacactaagcacattctttcctttccgaaaagcggtccctacaaaaaataatatttgattttcaataatcatagtggaacatgtgagaatagtcagactcatatattgtttgttttgctacctttatttcataagcaaaagacctcttagctagccggggcaggcgtgtaacctgatgtgcccatctcatttattcactgtcgactattactctttttcatagtacagtattttaagtttcctcactccgattaattgtagaacaagaatgctcggacaaaagttcctcactgaggcgagggttgcctattagactagatgaccaatggaaagcggatccaactctctatctgcaaggctaaatcaataattcaagtcgcacactcccgtaatccgccttattttctttccatcccaaagcaggtcgagcccacttctgaaccacagccgatgggtcctccgatcctgagctggaatctacagagatttaatgagctcatcaaccaattcatatttcttgttcacagaacagatttatggtcaaagagaacaaccgcgtcagaatttagtctgttcataaatggcgacacatgcacattgcaaacaaatcagttgctcgcatgatgtgcaattgaacatttctaacggtcagaaaatttcaatctgtagtgtttagattgcagggagcatagactatcttgtttctgcacaaaagccccagcttttactgaaagcataaatgtgtactatagaccatctagtttctgtaacactaataaatcttgttgaaatggattaagctatgcgacgcacaatcctaacatcatggcgaacctcatgaattcggtaatcttacgagtgtaagccaagcttaaatgggtaaataaggctgagtacatgcaattggtatcccctctgtatcacatttcagcgcacaaatctcctgctcaggtgaagcaattttcttcaatgtcctcactcattgtcagtacaagaacttcaatgtcctcaactcggtcacacgtacttcactgcacctttcacccagcagttttacgagatattactgttacagtacagtactatcttgatgtacactacggcacggtgagttgatgataacctgagcccccaagcagagcctgagaggacatggactgaccagacgacggctgaatctaaaccattttgaatttagctcatgtttcatatctgcatcattccataacgattcttccttcggcaatctatccatcaaatggatatgtgaagaagacttaaggttcccgctgatgttagatccccaaatgaagaatcgaacatggaacagcagaaattcctaccgtctcctattcctacgtgccacacatttggctgaggctgtgaaaagacgaagaaatattagatagtactagaatttcatgataaaatatatatatcttgtgcctcttttccgtctttatctacctcgaacagaaacatgtatgtgcaatttatgtagatagctagaagctaggcaactcacgtataaatagagcaccaccagtcacccactttccatggccagagtttagtacattatcaattttttgtctaacagggtacacaaattgaaaccaaatcttggaaacaaacactaccgacacaacaatttgggatggccacattgtttttttattcataacagttaggtaaattttattgtaggacatcgtgactttgtgttttagctctagacaatgtcaaaagttgatatttggaaaaatacactcccaaaaggtggttatttgctgatggataccacaaatattaaaatattgttttctggttgtatacgagagaaaaagcgtgaaatgtcaaaaatgcccccgcgggcccacttatcgttttcttcccccacatctcagtccctctcacactttggccacagcaccatttccgcttgccgccggcgaccaccccggccctccctcttagcctcctctatggcagcgtggcttgacttccctcgtcgcgtttgggcggcagtgtggcctagctcccctcggcgcacacgtgtagtgatgcggtccgtcttccctcggcgcgcgctggcagcgacgcggccccgctccccggcgcggggctgaggcatcgagcggtgtcaaccctaagctgccttcaagtgaagaaggtggaaggggattatggcactggtgctaggggtagggagagcgaccaagagagagcggcgccggtctgacgtaggaggagggagtgtggcaccaactgacggctgagaagaggaaggagctggctgaggggattgaaaaagagagattcgaaggtgcaatttgttcacaatgcgttgaaaagtgggcctgctctcgccaagttagcactaaaacactaaataaataggtgcagtgttcgctaacaaataataaagtatcttcccctataagtgactttgtgcggtgttcctctgctagagaaagtaccgtgaaaagaggtatatatgacggtatatgagctggtataaaagcacaaaatgttattccaagtctagcctatgcaataataaacaataacattcatcattttagttgtcgttgaatagataataagatatataaagccaaaggaagaaagaaacattaagagtactgcccatgccaacttgccaacctatctggagatcttcatatttgaagccacagctttcgtacctgcagaatatgatgaattaaacaagcaacggaactggccgtcaaaacatttaccgacaccggaacttaattatatttttgatggatcagccgtacaactgtagaatggttttgtacagggacgacgccagcacaaagttgcaatacactgttcaaaatcgccaggacaatggttcaacaactcaaactccaattcttgtgatatgcatcacaaacatgccggatgagcccaatcacaatattgaagcttccgatgataacacacatcgtgttagctttcattaattgtatccgcacattgtcctcacaaacaatgatagactagcatgctcaacacgaacgtcttggatctttcgagtttttcgaccccatgtgttcacagtggcaaatttcaatgcaagctatcatgttctagctttgtgtaaccctactgccataagtaaagttcatcggccacttttcctactgcaaatgaaattcctaatgccccccatattacaacaagctcatgcagcgtgatgtacgctcaaagatgctatagggtgccaacccaagtacgcctttaagctcgtaaatttgtcattgatatcgaatgcatctcaaccaccagccaacgttttgttgtggtcgacctaacatggcatacatataccactttatttatatattcattttgatgttgttagtatggtagcactgcacaacgcgtgttggcacgtacctaaggacatctatagtttttggtttgaccagtccgatcaacaagccaaacaaaatttcagttctgtagatgcagaattaaaatctatttgtgggatccacgcaaaggaatcacccaatcaccagtccgttctccatgcatgcatgcatgacaaataatttcctattcattcgttggattacaatttagagttcgatagctgcagctggtagaataggtggtgaataacaagttctatttgattacatttggacttggagtcgtaatagctggtagctggtggagttaaagttggactctgtaatccgataactctctttaatagagaggggggcaacacaatgtaaccatagcgactacaatatagcatagacacgcagggagatgatagcggcgagaccatggactcgtagcggcttagagatatattggttggggaggaacgcccataatcagagccccggagatataggcttcggatgaacttcgttaacaaatatcgtgtgttactgtgtcttcatctgacgtgtcttgggtggtcaatggctgaagcaatttagaaggttagtcattgttccgctataacgactaaattttgtaacagcagcatggttcgattcttctggtaaaaaatcgattttgccttcaccaagtagatgctccagggattctctctacgacgtcaagtacaagtgttgtactgtttcatattggtcgagtgttgtagcaggaggcatacaacattctcctattcaaccgaaatactctcattcacttaccaaagaggcttttactcacagcaaatacttctcggcctaatgtgacaggaaaatactaaaagactgacgcacgcggtaagaagaccagtctagaaaggagtattttagactaccacaagagaaaaataccattcaactaggtagatgaagcctgaagttaaggtcgttgagagagtaatattccccaagaatatatagtggggagcattccaaccacccccaaagctagcacaaggtgtttcgagggaccacacacatgtgcaaccatacccctttggatttctaactttacatgggtattgtagtatcttcctgtgtatccttggggtaggattgtaatatcacatgttccttggaaggctatataagctggtctcaatataatcagacacgagatgagagatatcagaataccataagacacatgagactccatgtcgacaaatattggaccccatgtcgacaaacctgcaagcctcgtccatccgcacactactcggcccagcctgctgctcggcaggatgtgtaagcatggcgtctagagtggcgtggctaattcgcgtgcacgcgccagcaacgttgctggcgcgcgtgccaggtggcaggattgccccctccccgcctcgtgatttttttcgctttctcacgatttttttcgttcccttttacgattttttctgattatttttttaaatctccagtacacgtgttttcaaatattttgtgttgaaagtttttaaatcttaacttaaaaattttcaaatctggacttcaaagttttcgaatctcgagttgaaagttttcaaatctgagttgaaagattttaaatctcgagttgaaagtttttcaaatctcgagatggatgttttcaaatcgagttgaaagttttcaaaatttgtcttgcaaatttatattttgagttgaaaattaagttttcaaagtttgagttcaaaattttaaaaattgacttcaaagtttaaatcttaagtcgaaagttatcaaatataatttaaaagtttccaatctgttagtaaaaaaatttcgaaaaaaaagaaaatctttttcttaattactgtcattatcttaactaaatgggttagttacagtaacacccgcggaaagctccgttagcggcgcgcacacgccagctagctttcgcgcagcccgcatggcatggatgagtgccgctgaatgtacaagtcagggcagtaattaatggactgcccagtccagtgtggctttcccgtgtgtctcgtgaggtcatgagttcacgtcttcccgaggcaacatggctaattttacaaacagggaaactttattaggtgaaccaggaaaaaactgttttttgtaaataatttttacgatatgtagctgatgattagtccactgtggcatgaacatcggcttaatttgagccagggtgggcagctgctgttcatagtaggtccatagtttttttttctagttgttatcatagattctgaagatataatcaacacttaattattttaatgactattttttggacggcaaaatttgctacaggacatctaaaaaacgggtaattagctgggagacatcgcaagatcgcgtatttgctaaagggcaccacaaaaaaaggtaattagctgctggacacccgtgcgattattttattattttcggaggaatagtagagagaaacaatcattaaagacaagtttgccctttgctcaaatgaatccaacgtgggtcccacatgtaaatccctctctctttttgtagatggggtggcggagcggcgacacaccggagccgacgaagggtggcaggcggtggtgttgctgatcccatccgtttctccacccagacgcatcgcccaccctgactctccactccaacaccatccaaaccgaggagaggacccctgctgctctctcccatctcaaattcgccgctagctgtgaggaacacgaaggccgccattgcggacaagccatcgccatcgccaactctttcctattctatattcccctcaccatgctgagaatatttctttttgacgccactctatttcatccattgcaatgacaggaacgctgtcgtgtcatcgccgactctagagcgagcaccgagtgccaccgccgcatctctgtcattgcgccggccaccgtggacaaaccaagccaagccaccgcgccagcatattctcctcggcatcctcttcagaagcccccaagaatccccgagaaccgagcgtcgagcagggagaacggacgttttcttcccaagcaccgaccaccgtctccatctcagattccgtcgcctccgatgagccaagtttcaattcctcgcatgaatagcttcttagggacctctctaaccctttggggagatttaaccgtcgctgttttccagagatgaagcgccgccgccaagctactacacgtgctgctgctggatagggatttcaggtatggggtgaacaacgagtgccctgccaggctgccaccaccaccgtcgttgcttcccagcgccgcttggccgccgctgcaaccagccgaagccgtcgtcgttgccagaagaaggcaagaggaaaggaaggagtagagaatgatagagaaaactgaaaaaaaaatcatacttactcatgtgttcgaagggtagaatcgtacttacatatgtgtttctctctctaattccttcggatataataaaataatcccacgagtgtccagtagctaattaccagctttttacggtgccctatagcagatacgcgttcctgcgatgtctcctagctaattacgtgtttttttgaatgtcctatagcaaattttgccttttttgacaaccctgaatgatggttaaaaatggtctgtggctttctattcctgcagcgctgttaattttttattagaaacacagtacaaacacatgcgcacacgatgcgcgattgcactaattctgaaatgttagttttatttcataaacagctgtactactacttatttgacatatattgccaatatcacttcactataaaaatatttatacaccggaccatatgatttactgcctccgtgtctatatatttgatgccgttgacttttttaaacatgtttaactattcgtcttattcaaaaacttctgtgaaatatgtaaaactatatgtatacataaaagtatatttaacaatgaatcaaatgaaaagaaaagaattaataattacttaaactagccgtcaacccgtgcgttgcacgggctattgttattaatattaacacatatcaaaatatattaattatatgttgagtacattagttattaaatttaattgaaagttatatgtaaactttttgttgaagtatccgttgtaatttttcataacacaataattctaaaattcagaatgaataaatagaacaaagtagaatttgtatggagcagaaattaataaatatataagagtcatacttagagtggatttatggatgaaatattttttttcgtcataaaataattcaaaaatccagagttgacaaataaaagcaccctacatggcaatacaatttaaatttctcatgatttgatatttcgagacacataattcataaacatgtcaaattgtaataaaaatctctaaattctgaattttaacatttcctctaatttctaaattttaatatccattatttaataacatggaaatttaaatttagaattagctaatcgttgttcttttctaagctgagtttataatttgctgtcgcctagatagatgaagtatttaaattaaaaatgttattttttggcatttagtcgaaaatggaaatttagctcactataagaaagtactatatctctttcaaagctctgctgctccaggaatatcagatgaatataataaggactgtacacataatcttttcaatcaattataatgcatactggttataaaatccaattataaattttatgatttcataattatgaaaataatgaataatacattggagttgtacttggtttggagttcacataatttacaacttgctaagtatgcatttaaaacattgcaattaaattaacaaatttatatcccatgctacttttcatgtcatattttaatttacatgaatcataatagatcgaagatcatagtaatgcgatccacctaatcaacggtggtaagtaagatctttttgtctaatgtgcgagcatcctcgaagtgtccaattaatattggttttcatacaaattcttgattgatcaaagggcattggtaatacgatcgacctaataaactaccagatctttagatagttatcgttatagtaaacatgagagctctctcggaatgcctataaatatgaacattatttgtgaggggaatatttataccgacctcttttgttaataattatcatgtcggttacgatttatgccataacaaagtctgattatcctgaccttgactttggacgcttccttcgcatcatcaacagcttgaacaatgtcatatgctactgtagttttggtagaagaaaaggtaagctgcagactacatgcagtgcatacgaacgtacataccgacaggaaatatggaaaattaaatattatttgctagtttatatttagagaaaaaacatagataagggttctgtgatctgtcgactgacctggttaccggattattagcacggctcatcaataggttaagatcaacagctgtgtcattatttcagtcaaaatcagtaatcgataattagttcttaaacagattgcaacatgtatattcaacgaataccgtacagctcgctgggaaacgatgctcagtaattcattactcaaaagtccaaacaaatcaaaaatcaattaatttgactgtatacttagcaaggtttgattatttgtttaacatgcaagtttgactgtaccagcgtgaattggggagcggtgcagatgtgctcgatttttcgatcggcatctggacttctcaaatttattgggttggatgatgatgtttcagatgagtctgaatcaaaatcaataaaaaaccaatctgtcaaagattgaggtaaaatagtagctgagttagagaggttttgagattcaaaattgtcacaaatcgtgcggagtatctcgtggtcgctggagtcctctctcccacatctctgtcgttaattgctatcggagagatgagatcgatatgtatctccctagattactgccgatcagtgagtggtagagaaaaaatagatgggctgaaagagcccatgaagatagaaggcaaattatagcccaccacgttagatttgtacgtacggccatgatattaaaattaatttaatcaacggtgatttctccagttaacgtggaagcttgtagaaagtgcctaattagtagaggtatagatttttttgaataagacgaatgatcaaacatgtttaaaaaaattaacagcgtcaaatatttagggacggagggagtataatctagcaacaagattggactacaattaactccaaagcgtccaaggccaccatgtgaacacttctttttcgctggactggtggatggacgctggtcaatttttgttgagcataaaagagggcaaccaagcagttttacaccaacggggttattagggagcaccgcagcacagcacttgagcaacgttggaggcttggagcacccaaggaacagctactgcaacagctggaaacactgcaaacagcgaactacagatacatcttggttatcaactcctgaagaaaaggcaatgtgtaaagccacagcagaaattccaagtgcctcacattcctgacaagaatttctcatggttaactgatacgatttcctctcctctcctctcccattcttacactacttaaaaagccattctttgtgacaccactcttttattttctagcggttttattaaacacacgcttgtaaaaatatattgggggtattttggtcacgaatcactagtgaaaatcgacatcacttcataggcccgcttgtaaagatagggttacttttacaagcgggtggcttaaatgacagccagcaaaaatcttatttgtgctgacggctgattaagagcaccgcttgaaaaaaaatattatggtattaaaagagagactccgaggcgcatctcttttttttttgtcctgtcaccactcccccttttacctctcattcctccctctctctttctactccctccagtgggccacgaccacggcagccgccgagtgctctcagcgatggccaagacggcgacgaccacgcagtgtgcgggcagcagcaaggttggtgggtggtgcacaggcaatgccgaggctggtcagtggcagatccggtggtgggaggcacatgggcagtgggtccagcgataaagaggattgcgggcagcggatctggcggcgggaagggccgaggctggtgaacagcggatccgtctgtgggaggagagtggtgtgggcggtggcgaggttggtgggtagcagatctggctgcaggaggcgcatgggcagcagatcttgtgacgaagaggcttgtgggtggcgggaaggcttgaaggcgtggattcggcagcccagtggagcacggataatggccaagaggccaaaacagggttacgggcacggtggggtgtcctagagggggttcaggtccaccgccagccagccacggcctccctcgccgaatctatccttcctcatccctccctcgatgacggcaaattggctccattcctcaccgacagcaacttggtgatagcataggccaccaacgacgcgtgcgaggactgtaattggggatttggaacaatgatttgcgatttgggaatttgtgattttctgtcggctgttttggacctggatttttatttttcttctccaaaaagtattttttgtggcgggtctcttaacattgccgccaactaaaatcgattttcgttggtagacatcctagcttggccacaagtgaaaattgatttttgccggcagccgactgcccatcactatagggttgaaactggtacatatagtttcggtctatccggactatttttcggattcggataggttcggttggaattatccagaaattctcgggttcggaaatgaatttggatttttcttggaaacaaaaacgaatatagtaagggtactatccgtctgaatcagaaaatggtcggatttcgcatacatggattaaattttagacacaacacgtatatacacattactttttcatacaaagtcagatgaagtcaaactttatattaaaattgtagtgctcgatgagatctacaacattcttgttgactatgttattatttgagatcatttaagggtctaaataccatatatgtttttacaaagtctcagatatacaattcaaatgacatttgatggagatgtgttccatatcaaagttgtagagctaaatgggatcttccgctttgtagtttataatatttgtatttgaaaatatttaaagtataaaacaaactctacaagtttcgaagatgtgaaataaaataaataatatatccaatttatacagcaagaacttgataagtgatatgataagtaagctatacatgtagtaaaagattttgggattattcatatttacatgtcggtctcttggaggaacgtgcatgaaaatcgattttcacatatggttgtgggaccacctacaatatcgaggatataaatattggagacgttgatcaaaaaaaataagcgatatctcttccttgattaaggaaactcaatttgaggggatttttatataccaataaatattcgttgccgtagtcgttccgtatctatattcgataatattcgattcgattttatttctgtatccgggttttagattccaattttgatcccagaaaaatgaaaacaaatatgataaagctagtttccacctgtttccaatctattttcatccctgcccaccagcacaaatgtattattttcattggccttatgtcgctggaggactgccagcgaaaatctattttgtccttcagcgaaaattattttgtaagtactgacagtcgttttatagtgttttaaacggtccatactattgattcatatgaagtatcttattaatgctgatcttatatcaccaaccatcccattgttcctttccgtattgtaaacatcttcaaccaattaattagcataagtgaattattttttgtggtttaccctgaaaggggttaataagcctcagtcagtttacctaaaaaaattgctggataccatggatgagcctggtacaaatgatattaagaagaaattaatatgaccatgatctagagtcgagcacgggcagagtggtaacaacagcccatgattcatctgcgctatcatagttttattatcagccaatttacatcgatttgaagtcttttttataataaactacaacacttctacatggtcagattgaagtaattatcgacaagaatgagatttgctccggtctttaaaaaaaaaatacctcaaggttacggtacctcacggtaccaaattatttccgatcgattggaactaaaatacccatacccatcctggaacggagcaaatcttgacaagaatatttgaacggcatgatttgatttgatttatgttcgaggcattgcctcgatcgggagcacatacttggatgggtgacgtttctggtctttccccttgaaggactgcgtcctcatctcgctttgaagtgaagacattagccagagcagagaatggaagacaggtcaacatcactaacacctaacaaatcatgtcagttaaccttcaattgtaaacaatggctaacttgctgttagcgtcatggaacaattgatattcctgctgtctctcactccgatggacaacaataatgtcctctgcaaccgaagcaagttctcttccctgtcctcacccatttacattcaaacaggctgatttgctgtgcagctcaagttcaatttggcgtgctgacacgcgcgttacttatatacgcaatatgtacggaactcagttataaacagtaccatccacccatggagtgattctccaagggaattcatatcaagcaatgcacacatttcgggagatagctctttcatgtcagtattaagaaatcactcccataatctgtcctgataataatgacatttttcgactcccataacttcttgcaatatgttcaaagacatagtacatctcaacattttttttttttacgaaagagccaaaatctgttgatacaacttaaagagatgaacccaaactgcattcttacacatagacgtagactcaacaatcaatccaacaacaggaatagcacaaatcaaatctaaacaaaacaataatttcactacaacgcaaagaatctattatatactaaaagtccattaagcttcctcaaaacgctctcaagccgctacgtggcgctctaataaattagagaaaattctaaaaaatatgagaaaaaagtaaaacatctatcactcgattttcactgaaatcggtgggtccaatgttataaaccgttagattaggtttatctcaagactactcctctgttccgttctatatataggtacgtattgccggcctccatccttgtgttgatccgatccatatagttacggtactgcttgcatgcgttccgttaaaggagtgtacgtacataaactttcttttttttttccaggtacgtacgttactattctttctttttttttcaggcatataattgagataataataataataataataataataataataataattattagtgataataaattttgaataaaaatactttataaatatagaatatacagcatataaatctcttcaagtagacataaataaattagctctacaatgtttgaaaacaaagttccacaattatgttatattatgtacccattattttaggttattttgtaacaaaaacatttgtccatcgatattcacttaaatcggtcctaagttgccacgtggcaccactacaaacaaaactaagctaccacgtggcgctctcataaataataaaaaaatttaaaaaagcaaaatatcggaccttaaaatattcacttaaattagtgtgcctgataattttaggtaagtccgtacttatgaacgtacgaaaccgctcaccctgatcacgtccgtatttctcttctttcccttttataatttctgaggataattgaaataacattaattattagaataaaacaattataactttgcaaacgtagactgcatcgtcataaacgtctataatgtttgaagaaagtttactgtattatattctttacacatctatctatatattatatactgaaaatccattaaacatctgttatatactaaaagttcatttaactccctataaatgctctcaaactgtcacgtgacattttacaaatattcttaagatgccacgtgacgatctaataaattagaaaaaaaatcctaaaagttttgataaaaaagaaaaaaatataaccattgatattcctttaaataggtggacccactaattttaaccattagatctctaaaaagatacagtatccccaactccaccgtataggggcacacacgtaagtacgtagtccctcaaccctccaactctcctcggagatcccactctcctctcctattttcgagccaacatttcctattttctaactaacacataatatatatatagatgataataatcagatagttaaatgatcatgactctcaaagttacatgcacttttctcaatttatttgcattttatcatgctatttatagttaaatacataattcaaaatccatttacccatatttcctatataaaatttagataatgtagttctttctgactacaaatatttgagtctaaattccagattcaatcagcaccaaagagcttggaaccatgatgcataccctggggcctgaacttaatggaggcggagttgcaagatattattaggttgtattcattagatgggtttgggagctaatctctcttacacacataaaacaaagcggctcattacattagagtattattaattaaggattagttattttttataaaatggattaatatattttttaaagcaatttttctatagcaaacttttagaaaaaacaccgtttagttgtttggaaagtgtgcgcacgaaaaacgagggagctaagtttggaaaggagggggaagaatacaaccttagcgaggtggacaccgatggaaacaccaacatcgactttccatgacttccagaagctcatagcacgctagatgattatatcaaggacaaagaactgagatgaggtggctagatgattatatcaaggacaaagaactgagatgaggtgcagagggagatgttccgcatcttcgacaaggactagaaaacaacttcatatctatcgctgaggagttcataattaaattcagaaaaaaaacaatttgattaaaatgcacattcaaaaatttagaaaacccattaaaactatacaaaatgtataataaaataactattaaaagatgagtccctatacaacacgatacgagattaagtacaatttaaaatccttaaaaagaaaatctagaataaaacaataatttgatttgaaaacaaattcgaaattagattcactcaatcactaaattcaaaatataacaaatattttttaaagaacttatcactattgattcagatggataaagaattgcgtatatatgaatcaattagaggattgacagggtggtaaaaaaacatttattgcccatagaagtttatcgagatttctcaaaaaagagatacaatgaacacccagttaaatatagaaaacacattactttaatttcagtttattttattataactatttttagaataaactaacatgcatgcccgcgtgaatgcgcgggctgtcatcctagtttaccaaatatgttagatgggtccatcacgcattgttttacgggccggtgtgccgcatatcaatcaaaacatggaagacgcagcagtcagctatacaacgttacaatggctgtgttctctccgaatagatcatacgagtctatctgcttgagctgtaccattaccagctccatgcagggtagttgatgccttgaaccagtccttacaaaataacaatattaactgacagcccggcagctttcatctaaaatattttaaatttcgctaaagctgtctgtcagcatggttaaaaaagaactgtagtttttaccccgactccaaaaatcctattgctgaggaaaacaaaacgttcccacagtacagcgatagaacagaacagaggtaattcctagtgcttcccatttccaagatccacaactatttgagaccagctgtgcagttacagacggggcatttgtaattccaagaatttcacaataaaactaccatctggtctttctcctggatgaatatttctcgaaaaggaaccgatgcctgctatttatgcaaatagctcggtcataaaccacacaccaacctgccataaacttagaccttgctgaatatttcaaagagattaaacacacaaaaatttgggaggatcacgtttgattgttttatttatatatttattatagtttttgaaacaatacacgcaagatagtgcgacgtttcgtattagtagagcagaaaaaaaatacaagattatagctctgaaagacaatagctaggaaaaaagactacaccacgtgtctacaaccagagacgcgctacgaaagagacatgaacatgacatctcgaagaaaaagaatcttctaaataacgccttcaggaagggaacaacaccgagggtgccaccgctgccggtcctggaattcaggacgtggttttcacctagtggaatccatcacggcacatgagagatcactcaacaatgcccaagtggaaatcggcgcacataggaatcaacgtttctggcttatgcccgtaatcttcctgtactcctgtgtctaggtctcctacttgatatagaagccaccatcagctgcattccttcgattcgcagccaccataccggcgccttaccgctctccccgccgtccttctatcgccgtcaggcttaccaagctctgcatcacactggcctctgccgaccacgacttccttccatcgtctaccacatctgtcagcctctcgttggccatcccgtagcatggacacgtcgactccctactcgatccatgcaccgtcgtcatagctgactgctcactgcaatcgctgcctcagctaccaccaccctcccgtccacttctgccaccccgccgctatgactgccagaaccgtcctatttccgtcgatgctgctagcaccgtcgtcctatagccatcactcccaactcccgcagcaggtatcgacctcctaatgccgacggcgtcacccgccgtgtgccaaccgtcggacgtcgtccgcggggcacaaccgctcctgcgacgtctcgcgtcgcccgccacgacggagtcacctcctcccactgccgccgcgccaggtactcgaccccagccaaatccgggtgaggatgccagctctggctcaagggaactagatccagtcggagtggcaccagatccgccgccaccatgttggagctcgctggtgaattcccaagctccacgtcgcccccgcccttgtgctggagacagacggtcatcggtttttggccctaggttgccgcccagttttccaggaagcaagctccagcggtagcaaggcggggatgagggtgggggtggtggtggcgggcgtctagggtttctccccgagccacccgagcatgggcgacgtggagcaggtctatttttattatagttggaccatattgtttccaccaataataattaaaatgaactagaaagatagcccgcgcacatgcgcgggcacattatataatgcgactgaaattttattatgaatatttatgtgtggctgactatatattaaaatattttttcctatattctaaaccaaaattaagcttatttagtgtgctttgaatgttcgttattttcttacaattacacttgcaacatataaattctaaaataaaattacttgagatcatgcagtgttgaaattatcagaaaacattatgtcaaaataatggaggtggttactatgagaaaatttagggtattttgactccccagaaggatacctcacaacccaaaataaatctaacaatatcattttttgtttgattttattttaagttttatatattttcattctatctgtcctcataaaatgtttattttttctatttagaatgggttttaaatccagcaatatcttttcagttttcaatttatttcatgtcctatttttttttggagatttccattctatgaatcatccttaaaacgctttgatctttgcaatctagggtgaaaatataaatgcatttattgcatgggtaaaggcatatgttctaaattttaatggtcatagtattttttgtgaattatcactaaattgaagtgtcttataacaaatacacgtttctagattacacgtttctagattgttctacatcaggactcaggatttaaaatgttagcatgttttaccaaaaaaataaaaaaatggacattgtctttaattcctatatggaattgacttgatatatatctaaggccacctcaaggttgtatcattgctaagattcctaggtgcaatcgacatgcttatcagtatgatctttaaccgaccacacctttattttcaacttgttgtttataatgctagatgagtacagttatgattaaaaaattgtgtcacttaaatttttttctctaatttattagtgcctttgtagatcatatgtgtaatttggatgctatgatcatcattattaagaacatttatttatctccaaaaaagattgttttaaaagtatcaaggtcaatttgtataagtacatagcccaatatgtatgttaagaaaaattaattaagtcagtagaaagtcgttatatgtctaacgggatataagtaatagatggatccatctatgtttttttttgcccatatagataattaaatttgaattgttaaggagataaacaaaacaaagagaaagaatggtgcatgccatacatgggcaaggagagagggaggcttgtgatgtttttctaaatgattaatctaaccacctaaaatgatgcattggatgtttaagtcaaaaatcaatggtcggatgttttgttttcttgtcaaattttttaggattttatctgctctacgagagcgacgtaacatcttaaaagggtttataggtagacttttaacaccgcatgccgcaacggagtaggagggatgcaaggaggtttgtggtattttaaaaaaaatagatctaatgacccaaaataatgtgtcaatcgattgaaaataatgtttccatagatttaaatcacaaccaatggttggattattttttttcaaaaattctaagaactctctgatttaagaatatcatatagtatcttagaagcatttataagatgtttaatggatttgattgccgcataggggtggggagaggatagaggtttgtgtttttctatttaataatactaacaatccaaaataatgtatccgtcaattaagtagaaattgatagtcggacacttcgttttttttaagattttatagtattttgtctaattcaatagcaccacgtagcggtttaaaagtgtttctagaatatttaaagttactgagggagagttaatagacctagtaggtgaaggtctatttgtgcgtttttttctgtaaaaatgattttggttttaattaatttctcatgaagaaaaaaaaaccgtatagaggaaggaacgggagagggaagtacgtacgtacattacataggtacgttctttgtttgtaaaaaggggaggttccggatgtggtttttattaccaaatagatctaatgatataaaataatgggtccatcaatttaaatgtaaatcaatggtcggatttctcttatttattagaatgccacttggcgactcgagagtgtttataggataccacttgacaacttgagagcgtttataggaagtttaatggacttttagtatataatagatagattaccaacatatatttttctcaatatgactttgacatctccacgatgacacatattgtacaaagttgcaaggcacaacgctatgacaactcaagcttgaattttcttaaatgcatgagaagcgtccacgatgaacctaaatatgtacaactaatgtggtgattgaatctcatgaagataaagattaagtatattatgcaaatcgaggtagtaataacgtgtgattaattgagtttatattattacaaacttaaaaaatggattaatctgatattttagaacaattttcatatagaaatttttcgtacgaaagacaccgtgttcccagtaatagcaaaagtttatccaacttttgttggagattcgaaaagggcctaagttcccggcaatagcatatcacggttatcttcgttgtgtgagttgtgtcagcacattcttctcacaacacatggaccagcgtcttcattatgaatggctcagagcttgcaactcaagctttcgcgcgccccttgcacagttgcatattcacagtggcaaatctcaattcaagctatcatgttctgaaattcctaatgcccccattcgaacaagttcccagtgtcatctgcacatcagaagcaatttgtcattgggagctcctcagatatttcactccaagctagtcttacaagacaacatgtgactgatttcaactgcaccgctgcacacactgttcatacacaatgcttacttttctgaagggtaccaagccaagcagatattataagctatctagtaagtttatcatttttattgaacacatctcgaccaccagcgtgtgttttgctgttgatgacctaccatggcatacatataccagttaatttatatattcattttaatgttttttttaacattcattttaatgttggtgatacggtagcactgtactgcgtaatagcacctgatcaggttatcttactacggtgacaacaagtgttgtactttttaatattgaccaacgccggattagttcaaacacagaaacaatcaggaaagccagcagccacacatcttcaacatgacattccctgtggcatggcccactagtgcagatctggtcatctgtgttaggggaaccttcatttgtgtcggcgaacggtttggtcatggattattggtcaatgatatgaaaactcatatgtgttaggccgggagccaccaccgattgcggtcatctttgtcaggcccaaataaaagaccatcgctaatgactctcatctgtgacgggtggtagttatgatccatcacggataagagtcatccgtgacggtttgtaattacaaacattcatggatgagaatttactttttttgaattttaaatgcatcaaaaaaccttaaaaatattcaaaatattattatgatattccaagtttccaaccatgctcacacatcactagctagaaattcatgaactttcaagtgatatgtgtatgcatatgatacgtgcgattcaaacctaaaacctttgaacacatgcaaatcaatcttactatctcacatatagatcacaggacaatcggtcatcagatattattcttttaacttttcctctccaaatataaaacacaaatttgaaactccagatttttcatatgagaacgtaactacaaagttgcagatctcatcgatttctacaactttagtgtagggtatatctctatgcagggttgtttgagaaattcagaaatattttagaattagatcacatcacatataacacatattcgggtatttcaaatttttgattttttttctcatccgtgacggttcgtaactaccacccttcacggataacgttatccgtgaagggtggtaattaagacccgtcacggcttagtgctatcatctttgacgggtcatctcattacatccgtcacaagtgatttgttagctttgacggggtattgttgtgaccctttatagtttatctgtgacgtgttagaactacgacccgataaagatgaacttatatcggtaatgggtcattcccggtagttatattttaaaagggaaacttattgagccattagagatgagtcatccgagcgagtttgctacatctcagagcaagatgtgggagtctgggtgcagccggcttgccccgccagcccgctgtgcttgcccctgaaccccgggtggatcatgagctcacgtggcgacttggcaaactggttgcaagttcataaaaacatgggaatctaggagaactaggaaaaatattatgacatgtgtctgatcaggaatctactgtaacttcaacaccgacttcaagtaggtggcagcggttgttcatggttagggcctcggtttttttctgatgggtattgtatatatgtatggcgaagatataattaatcaatgtttaattattgactgtttcgggaacaatcctgtgtgatggttaagaatggtaattcctccgtttcatattataagactttctagcattgtccatattcatattgatgttaataaatctagccacatatatatgtctagattaattaacatacatatgaatgtgggcaatgctagaaagtcttataatatgaaacagatggagtatgtaggtttctttttcggtggcaacgttaattttgatagcactattctaaaattttagtcctctttgaatcgataagcaatgagaaaaaataaacatgaatagtgtaacagtgcccccctgccaacttgcgcaagttgaaagagggagattttatatttgaaagcacatgctaattaccaacatgatgaatcaaatcagcaacggaacttggctgtcactatgtttattattcaaatcggaacatgcatttcttcatggacaagccaaaaaaaaaaatcttactatcagcctgcaactaattaatcctcttcgtatagtcgaacaacttgggtcttaggtccagcggctcaaagctttcgcgtctttaaaccgcttgcattcatagcgccaaaaacgattcaaatcctgccattagaatttctaatgcccctcattccaacaagctgccagcatcatcatctgcgcagcacacccaattgctcactggtatcccccttcaatctttattcctagctactgttacaagaaaaaagatttgactgactccaaaagcactagctagccgctgcacacacgcgatggccgacgcacactggggtttgtttttttacttatacatagtaccaagcaagcagacacttaataactctcattgttcttgaacacatctcaaccaccagacagctgtttttgctacggagggcctaccatggtataacaattagcatagtagcaccatacatactgcgtgaagattgtgttacatatctcaatataaaaaacaagtgtaactaactaatgtgaaacatgagaacaacttctcacagccacagtgtaatcagagaaccggcccaaacaagctgtgtaggatcgaaacacaagaactaagccatcaagagagaggtaaatggttggtatagctaaaaacccaaactttcagcggaaataaaagttaccctcaaattcgatggatcgcggtctgaccgaaagtgtcgcgtcggtctgaccgtctggaagccgtcgttctgaccggaattgatcgctcggtccaaccacctaaagatcgcctctgcctcctgtcatcctcgtaggtctgaccgcaggtctgccactggtctgaccgccgcctagccgccggtctgaccatcggtgagttgccggttagaccgccgaacccgacgaaacacaaatcgaagaactctcaaagtagatgataactttattacttctctctatgtttacaaagtataacaacatcactccctataaaaatctcgactaaactagaaaccataactaaactatcaactcaatttctcttaaaagcgataccgcgaagcctcacgctccctctctatttatatatgaggtaggcagcctaaagccacgaaccaaactcatactagaagtcctaatccacctaggaaaccttcccgtacaagaaacaaactttacaaactccgatcataccaaatttggactccttccaaattcgaatccgcatcccatacgcacataatacctccatcgtataccatatggaatcttcaccaaccacgtgcactgaactctacccttagtatcccgcatgatatctgaccgtcacggacatcgtcttatctccaagctgactcccgatccatcaccggcagtactctcccgaggcatgaagtcacctacacatgaatcaaacaaataaactatattccgagaccaagctatctccaacttgactcattagtagcaaacaacagtattacatacacatagtatccatctagaagctataaatataaaacaatcatagatatccaaacaaacaacccgaaaccgaaactgacacagaatcggccggtcagacctcgggctgggccggtttgactgcgcgatacacgccggtctgaccggcagcacatgcccggtctgactggaccaaatcaacagcagtagttcctattcacctgcaaattccaatcatctctaaaaccacttcgtaaataaattccaaatatcaaaaccaataatcttatatgccaattgttcatcacagaataataatccaaaacacctttggttttacaacaagctgaggcatgaacatgtagctgagtacttagctggtttcaacaccggccacttgtccatggtggatgtgtcaatgagggcgactttatatgaatttcttaattcttcagtgatggtctcatgtaaaaataaataaatttctacataattgatttttggaatattttttgacgaaaagaaataagcataattagattgtgcaaaatttttatatttcgtttctatgagaatgtatttagctagtgattgatgaaattcttcatcctttgaataaaaatgtgaaaattagggaacatctaagtacaatcccagaagaagtctatgaaaccacccaaccagacctaaaactgcaatcacagaacgattggacttattttttttaactagttatgatgttttgactatgcatcattttcagacggtgtatgtatgaatagatttcaagttaaaaggggctaagagcataatgttttcttctaagagactaagaacccatttcaagaccactgtttccatcgttccagagttgatggtgccaacccaacaaccccataaaaatagagggtgaatggactcctatccaaggcctaggtttgctagtacattgataaacgtgaagacatatttctgtcatttgaaataagagaacctcgttgtgaaatcaaagtgtgttttgattattatttatgataaataattggtatttgagataactgcttttgttatttgaagattattggcgatgtgctttttggatcggtcagactggcaaatattgtgaatagtttctgacgatgaactgggattttgtctggtggttgcagtcagaatattttagaataccatgaaaatccgtatcatgaatatttctgaccactgattgtatatgcttcaagtatgtctgtacgagcaaatataaaagcagaaatgttgttgttactcatgtgattcagccttttagtcctcttggaatcaataaaagcaaatagaaaaataaagatgaatagtgtgacagtgcccctgccaacttgccaagctgacgagtgacggagggagattttgtatttgaaaccacaggctgaatacaaccatgatgaatcaaaacaagcaactgaacttggctgtcaatatgtttattcaaatcggaatgtgcatttcttcatagacgagctgtaaaaaataaggcatcttattttcagcctgcaaataatcttgctcgtatggtcggagaacttgggtcttaggtccagcggctcaaaggtttcacgtctttagaacccttgcattcatggcgccaagtctaagcgcaatgtatcaaggtctatctttgagtaaccaaactaaagcttcaggtgctgcaattagaattcctaatgcccctcattccaacaagatgccaacatcatcatctgcgcaacacaagcaattgctcactggtatctcccttcaatctttattcctagcaacttctacaagaaaaacatgtgactgactccaagagcactagctagctgctgcacacactgtccatgcacaatggggtttcttttttgactcgtacatagtaccaagcaagcagacacttaataactctctcattgttcttgaacacatctcaaccaccagacagctgttttgctacggagggcctaccatggtgtacatttttttagagaatagtatttttttatccggcctctacatacaaccagatatatacagtcctttaaaatttagcccctcaaataacccaatttgaaattcgctcctatggagatttgaactcacacacaagttgtgctctatatagtcattttgccgttggtataacaattagcacagtagcaccacactacatcatggcacctgagattatgttagatttctcaatatcaaaaacaagtgcaacatgagcacaacttctcacagccacagtgtaatcagagcacaggcccaaacaagctgaggcatgaacatgtagcagagtacctagctgctttcaacaccggccacttgtccatgatggttgtgtcaatgagggcgattttatatgaatttattaggtcttcagtgatggtctcatataaaaataaataaatttgtacatagtacattgtacgaatattttcatcgacgaaaagaaatataattagattatgcaatatttttatatttcgtttcaaagagcatgtatttagctagtgattgacgaaaattcttcatccttttgaaaataatgtgcaaactagggatagggaacacctaagtacaatccctgatgaagtctatgaaaccacccaagcaattcttctaacagactaagaatcggtttcaagactattttatcaatcgttacataagaagttgatggtgccaagataacaaccccataaaaatggatggtgtaatggactcatgtccaagtcctacgtttgctagtactttgattaacgtgatgacaccttttcgtcagttgaaacaagagatcgcatgtgtatgatcagttgaaacgtagagaaccttgttttttttttcttttagaggcatgcaagtagcatcaaatgtgttgaacgaattatggcaacagttcagaagttcatacggtttcccattcggatgagccacggtcatcttgcatctgctctacaaaatgctcaccattgtcaatactaaagttctacaagaaaacacatggttgtgagatttttttaataaaaagatgccattgcatggctagcgaaatccacacggctaaatctatctccatgatagtttattgctacaaatagggctcatgtcacttgtgaatgggtagtgtcaagattgcaatgagcacattgcataatgtttctatacatgcattaataaagagaaacccgtgacat

SEQ ID NO: 66796 - DNA, 3377 bp, Oryza sativa
tggtctggggggatgccctccttgtcctggatcttggccttgacattgtcaatggtgtcagacgactcgacctcaagggtgatggtcttgccagtcaaggtcttgacgaagatctgcatgcctcccctgagcctgagcacaaggtggagggtagactccttctggatgttgtagtcggccagggtgcggccatcctcaagctgcttgccagcgaagatgagacgctgctggtccggggggatgccctccttgtcctggatcttggccttgacattgtcaatggtgtcagacgactcgacctcaagggtgatggtcttgccagtcaaggtcttgacgaagatctgcatgcctcccctgagcctgagcacaaggtggagggtggactccttctggatgttgtagtcggccagggtgcggccatcctcaagctgcttgccagcaaagatgagacgctgctggtccggggggatgccctccttgtcctggatcttggccttgacattgtcaatggtgtccgaggactcaacctcgagggtgatggtcttgccggtgagggtcttcacaaagatctgcatctgcacacacaattaccgaagcatggtcagcaactatgaacatgaaattataacaataccaagcaagtacagcagaaatcagtcaatcaaattattccaatatgttagatacacgacctaaaccacaataacatcagtgtacctatcaacaccaacagtgacctaacaaaatagagagacgcaccgtgctcgagttcacaaaaataatctgcaggtctatgaactactagaattccatcggcaaactgattcaataactactagcactatcccgagagcacataaggcaggttaattaacataggctagaatttacaggtgcaacagttgataagataggcataagcaagtaaaatatcctgaaagctatgctatgtaatcactaatcaacaagacgcagcccttagattaaacatgaacagagtagaatctatgcaactagagggactgaatcaaaaacaacctaagcaaaatatacctgaagctgctacttggatcaacgagaaaaacagagactaaatcctactaattgaacagatcggaacaaatcacaaccctagcacagttctacttctagatccgaaccaatcaatacttggaccacgaacagcatcgctcataatcacagatccagcataccacgcgaaccccatctaaacctgttcaaatctaccacagatcgcaaaacggagactaaccacaacatctcacaatcacgaacaggccgggaaatcaaatcaaacgcgaggaacggagaggatcagaaaatcgcataccttgagaaggcgattcgacgcttcgcttcgaggggagatttttttttctctgcgattttggggttcgattgacggaggaagaggcgaggagggggtggggtatttataggtggggagggggggactcgtgagtgggcccaggggtgcggtgggtggggcccagtgagaatatagacaaataaagaaaggagagagggagaggcggtttggggagtccgtccccaccacgcaaacgcgagaaggaaagaaaggaacggaaagggggcgggtccagacggcgccgcggagatatcgaggaggtggaaagctgatgccgtttgctcacggcggggttggtggccgttaacacgcagcgaagcggcgttactgccgtgtacgttttgtgacctttcgaaagagagccccagcccaagaaaggctggccaggtttttttgtactgtgtacgattacgatggaagaaaacatactcgttgttttgtattggtacatactgggccgtagtaaaattagaatcagttgttaattggttattatatataccatcttaagctaccaaaattaataaagttgtgatggctatggtatattttggtagtgaattatattgatttggtatatattagaatcaatccaaccacaacacaaccaaaaatacctgaagctcaatattgatggtgcttttcgactatctagcaaatgtggtgaatggggctttataattgaagcagcccaggatgcactttgtgcagagactgatgtgatatatatatatatatatatatatatatatatatatatatatatatattaaatttgtttggtgctatataagaaacataatatcttcgtcccataggtgtcttcccagggaaaaaaatatctttcaaaaaatcaaatagccaaaagaaaatcatgatcaacaaaataatcatcaggtcgacattcctgatggcacgtagcatctgccctggcctcccacgcgcaggcgcagcgacgtcggcgtgccgacgtgataacggagacggagggagacgcgcatctgccaacggctacggcgccgtgccttgcggtccaaccacaccccacgtctctttctctctctcctgaattttctttccttttttccatcatcaaagctgcatgatttggccacacgctggtagtaccagcaagagccaaggaccattcttgctttaataaaaaaatcaaagaaaaatcgagaggctgaggctgagcctgagggagagaggctgtggttttcgcaaaggcggttttccttcttatccgctggtttttggttttccctcgtcgtcgtcttcctcgtttgagaatcacagtgactttgcaatagacaggcattgcagagaagagagagattgagagagattcctatctctcatcttcagatgactgtttgtttgtagagattctttgcagtatttgcagctgaactgcatcaaaatttttaatcagatggtttcttgtagtgttagtttttctcgttgtaagtaaaggatttctagttctgtactcatgtactggtactgaaagtctgaaacttggcgtgccgcgttcagttcagttcagtagtgtctaggcaaggtatcttcagataatcagatgaatagcatgaacaaaaaactagtaactgaacactacatgattttaatcaatggcatgaacgaaaatagagaaacaatacatgattttaatcagaatgtcaacctgacaacctggatttgctcaagggctccatcggttgatttaataaaccaaagtcaaagctaaaatttgaattttcaaacttaattttaaaatattttcaatgtagtttttttaaacattgtcttttacctcctccgtcccaaaaaaacctaatcccagctacaaacctggacataggttcatagctagggtttgtctttttcttgggacggagtaatagctcattaaaaacacatatacaaaagttttacctgtaaatcaatttgtattatactccctccgtcccataatataagggat

SEQ ID NO: 66797 - DNA, 31187 bp, Oryza sativa
ggcccggaggaaatcggcccatcgacccccgggggaggcaaaatagacttttgcggaggaatttgatttggaaggatttggattcggatttgaactcgacgatagatcggggattgagatcttgagatgacacggacactagacaacaagcaaagaaacaaatttcacaattagggtttttaagagataattttcccgctaggcgccacgacggaacgggcgctacatagtcccgctgtccgcatcttgtttcttcaaatgtcatgtttattcgtcgccgtgcgagggtggtttctatggcagttcagggacatccacctttacaagattactgcaacagaccatcttagccaattcgtcaggatatggtatacatggagcagcaaacccaacccaaccaatcaatcagctcacgttacatagttcaattttatggggtcttttgccatcccctgtaaatatttaggctctataaacctctttttttttcttttcttttttttggccgggttgattgaagaatagccaaccaattttattaagatttggaagagagacatagttcaaatacaaatttgtgatgtcgacagaaaacagttgaggcctggtgctaaaaccaaatcgtacgtgcacacactggaaacaaacactcttgctattttgcaccttgaatagccctgcatgcttcatgccataccttgatcttgtccgctcctcaaaaaccctcgcgttccttttctgtaaacctcttctccgtccatacataagcggcaatgcttttgccgattcttaaaggaaaaaatgtgaagggtggtttcttgtacaaaggtctgttcctttgataatttttgtggcttccgtgctctttcactgtagtttcacatctgctgaatttggtttctctctcacggttttactttctactgtttcttctttagggtgtgtttagttcgcgaaaaaaaaattttgggtgtcacattggatgtttgaccggatattagaatgggtttttggacacgaatgaaaaaactaatttcataactcgcctgaaaactgcgagacgaatttatgaagcctaattaatccgtcattagcacatgtgggttactatagcacttatagctaatcatggactaattaggctcaaaagattcgtctcgcgatttccatgcctgtgcaattagttttttaatctatattcaatgctctatgcatgtgtccaaagattcgatgtgatgtttttgggaaaaaaaaattgtgggaactaaacaaggccttatttcccagcttctgaccttcatgtcatgtcacgatatttcatttttcactgttaatgaacagattgcagagaagcaccctgtgcttacatgttaactgggtccttttggatgaaacagtggctactaaagaacttgaggagatgcaaggggtggcgctgcacgctaaattttgacacaaaagttgaaatggatctaaaaacccatatgtggattgttcatgaagtaatcagttagcttgagagcttgggttgttagaagcttactagattgtcagtggaggaagttcatgttgtgtggttaaagtgtacccatctggagaggttaactcactgttcgaacagtcgtgcctctagtcatgggctttacctcatagatttgtttgcatgtgctttgtgaaaagttgttgtggatgggggaatcattaccagaattagccaatgttgtaaatggataacctggtgttgacggtcgttaagtacaaactttaaccgtcaaatcttgcataaaagatatcaaatataatatcaaaacttagtggtaggtgtttactactaacattttccattaaatttggtaaatatatgtttataggtcatttatggatgaaaatacacccgccatgcgacaaaatgaaccttcaaccaatcgcaagcgagtacaaagattggagggttcacatgacaatcaaaaccgacctaaagttggaccaaaccaaccgacctaagttggtggtcagaggcggtgggaatggtttggccgaaccagacttcgcccccggcttaattccccccttgcacgtggtagcgtcctattggatggtgatgacggttataggtgaaccgacattggaacccaattctctaatctcaactcagtggtacggataggtggaatggagaaaaatagggaaacacagagggccaaggcccccactatttatatgtcttcaaattatattagtgcaaatatcattagggtcactcttcacataccatggtgcacatgtctatttctaagagtgatttattagttccaatcatatttagtcgtgtcatatgactccagtaaatatatagtggatccgtccctggaacgaagtgtccatttctttgtcaggctgatggacccacccagcttgcattggtccaccgtgaaacgagcccaagagtgcaaggcccattttgaagatggtctacatatcagggggtagtgctgggcagcagtagcacacaatcgcggcaaaaaccccaagctagcttcatagtgaaacaaaaaccaactaaaaccaactaagctcagaaagagagtaatggcgatgcagtactccagtgcgcctccccctcttcctcctcctccaacctctccgatcgtctatccctttctcctccgtagaccttcattccctcaccgctagcaataaccgagctgtgcgctccaccatctttgatcagctccccaccaccatcatgtgtcttcttgtcggttttgcactactggggttgggtgttgcggtggttttcctcgtatttactatctcgatctggatggggtacaagctcgctaagtactgttggaattcatagttaatcctgctattttgttttccctgactgtcaatactatagcgtgtctagcgtttttcgctttctgttttttcagttagtttgttcctattttcccgttttgtggagccgacgctccctgcgtggtgttcgattgtgcgcgtcgtggagttgtgcgtgtcgcgagtgggatgtgtgggatagcacacattgctaacgttcctcttttcccgctttgtggagccgacacctccctgcgtggtgtgcgatcgtgcgcgtcgtggagttgtgtgtgtcgcgagtgggatgtgtgggatagcacacattgctaaccaatcatggcgtacattgtgttttttcagttagtttgttcctcttttcccgttttgtggagccgacgcctccctgcgtgctttgcgattgtgcgtgtcctggagttgtgtgtcacgagtgggatgtgtgggatagcacacttgctaacattcctcttttcctgttttgtggagccgatgcctccctgcgtggtgtgcgatcgtgcgtgtcgtggagttgtgtgtgtcgcgagtgggatgtgtggggatgtgtgggatagcacacattgctaaccaatcatggcgtacattgtggaggaccatggcataaaacccggttgtgtctttctttatattttagagaagaaatacagaaaagttgccgcaacaattcgcagcacaaactcatgtgttcgtgttcttcagctccacctctcacgttgagtttgattctcaatcttttatagcgattttatgaagcctggtaacatttcgtatcagagccatgtccatgccgacgccgccaccgtgtccgcgtcagcaatcacgctcgcctcctcccccgccgtggttgccatcgtgaccaagagcttgtgtcattttggcgggtggtgaaggaggtgggcggcccggccaactacctcatgttgacgaagacgaactatgatgattgagcgctgatgatgaaggtcatgcttcaagcgcgcggactgtgggatgcagttgagcatggcgatgctaactttcaggaggatcgcacagtgctggaggcaatcctccgtgtcgttcctgccaagctgctcggcacactcgccatcaaagctactgcctaggaggcttgggacacagtgaagacgctgcatgtcggtgtcgaacgtgtgcgcaaggtgaaggcgcagactctcttgaaggagtacgaggcgattgagttcaaggatggcgagaccgtcgaagattttaaagttcaagcaaatggtcatgaaaagtttcaatatgtatttttgaactttgataatgatgtcatctatgcctaaaaaagagaaaagaaaaagaaatgttgttagggagtacgaaccattttttaatgtgtaaaggggtaaaatgagaaaaaaatagtttagtgggtcaaatgatcaatgaaacaatttgacggagtaaaatggattttctctgtatatttataaagtaaatctgcatattataaataaatatattgtatgtacattacaaatcaattactacctccatcccaaaatgtttgacgccgttgacttttttaaaaatgtttgaccgttcgtcttattcaaaaaatttaagtaattgttaattctttttctatcatttgatttattgttaaatatacttttatgtatatatatagttttacacatatcacaaaagtttttgaataaaacgaacggtcaaacatgtttaaaaaagtcaatggtgtcaaacatttagggaaggagggagaaatatacatgacatgaaaaaaatatatatactagatagcagtgatcaaaatcaatgttactccaattccataacttacaaaagcaacgaaataaacaacgctagtaaggagtagatggcagtagtgctcgatgtggcatccgagcttgttgtccttccgggaccaccatagaaaaactggtcgtcaacaatcgccgtgtaagagtagagcttcgggttggatgagaaacctataaaatgtctcgccgttgacaacgcttgcccctgctcgtcgatgagttgaatgttgctcatggatgctgccatgttgctgccatgacctgccatgtatccgctgcccaccggaggcagagcgggtgtcggctgaaacgttgcattattaatcgccatgccactgaaccataaggctatagccttgtaagccaggcctgagaagattgatttggggagacgaccaattagttcagggtcactattgaacccgtagtacaccaaccaatcccctgaagcactatcctgttaaccaaaagagatattaaaaaaaattaatacttcgagagattactttgacaattgtatttgccttcaattaattaagcagaccttgaatactttgagtgccatgtattgcctagccccatttggcctggagacactggggataaagtcgcctggttgtatagatgcaccgctctcaagttgaaaaccagggcattccatgtccacataggttgaacctgatattagagagctagcactcgatgcctttttttaagataaattgttagcaagagtgaggacaatacaaagttacaaacacctggacaataagaattaggaaaaagtatgaattacccccctgaactatcgcggtcgtctgaattatccccctaaatccgaaaatcagacatcgttcacccttaactttcaataccggacaaattacccccctcgacccaatccagagcggttttgcctacgtggcgtacgtgtggcaatccagtcagcattttcttattaaaaaaatgatggggtccacctgtcatcttccctcttcctcttctcctctctctctctctcatccacaagctgacaagcggggacgacggggatgggcggtggctggaggaggcgcagcacacggagcaggcgcgctggcgatggccgagatggagaagacaagtgccgcccggccatggaggcggccgaggaggcgcagcatggcatggcgcacggcggtgcggggaaggcagtggacggcgcggtcggcgtgcacggcggtgcggcccagctagagggtcacccctcaacagctggcgtgccaggtagggggcgcgttcgtgatttttgaggttctttcgagcgccggtgtggtgagtgtcgcgtcgccgctacgggggaaggcgcagcatcctcaggagtgtcgcgccaccccaggcaaggggcaagaccccccacatccccaccaggtaagcttggctaccaggtctttgtggcgagtcttcggaatgtccgagggcccccaaagctccagccctgcctcaccaagaagtacgacgatggcgccgacccctccgagtccctccagatctgcacggcgatcatagaggcggcggagggtggcgaccgggtcatgacgaacatcttccccatggccctcaggggccaagcgcagggttggcccatgaacctgttaccgcctcggttcactcctgggaggactcttgcagttttgagctccaggtgccgtcgaaacccgggaccccctgtgctggctcttctgtagcggctggctttggtcccgccggctggctacggtgcccggcccagctcaactgatcgtcctttcaagcttcaagtattttcaatttttcaattcattagcttaaaatcttatatttaattttcctccattctattctcatggccctgcgacactcgcgtgttgcgcatttgtttggcccctcggtggtaagagcccaacctctctcccatctacatgaatgattcttcgctaagtgtgggggctaagtcttctagccttatcctagccttaagttgagctccgggtgccgtcgaagcccgggaccccctgtgctggctcttccgtagcggctggctttggacccgccggctggctacggtgcccggcccggctcaactgtggacggggattgctggctctagaatttttcggctctcacactcgtgcgaaagtaatcgtccatgaagaaggaagagagattggaaggaggccaccgaaaggaaagagcgaacaaaatgtgtagcgttgaggcgcaggctcatgggagcttgaccttgtttgctaagtggtcgcaggcttccctaaagggttcggaacccatggtggggagccctcttcgagccaaaggtttgaaaggtcgcgacgtgtaaacaaggataaacaaaggtaacaaaggaggtgttacaatacccggaccaaagcagacctctataggaaagctcagcgttggccggggactctttttgagcttagcatttgtaatactttctttaagtatatatcttctttattcgcgcttatcagcaaaattatcatggcttatatttatctctcacccatctcttcctcgcggtcccatgattaccacgtgtcgcatgctcgtttgccccccttggtaacaaaaagtttgtattcacttcacccattcaaatgattctttgctaaaattgtgggggctacgattcctagctctatcctaaccctgcgtcgagctctagacgccgtcgacgcccggggccccctgtgctggctctcccgtagcagctggctttggccccgccggctggctatggcacctagcttggcttgatcgcgggtgaggattgctggctatggaaagttcagtcctcacactcacgcgaaaataatcgtttgaatagatgaagtagaacatgaacagaggttaacaaaaggcaggggcaagcgaggtgcgcagcatgaagtcgcgggcccgagagaatctaacaacgtttgctgaatatatacagaaaataagttcacaacctaaggtacgggacggtgagtcgccctcaagttggggcgaaaaagacgcatgggccctagtgccagcaaagaatggagaagagaccaggcccacatcgttagactaggagagtggcgtcaaccctggccaccgggggaaggttttggtcagggctaacgccgggggctactgtcagtgatatgggcccgggggtatcacatctagagggatgaggccaccctcaaacccacgtggctccctgcgaggggggatcaagcccggggtggagcggtggctacccccacccagctagagggaggaggccgccctcaaacccacgtggctctccccgaggggggtcgagcccagggtgttggggcggctgccccttcccagcttggggtcgggccgcccccaaacccacgtggctccccgcgaggggggatcaagcccggggtggagcggtggctaccccctcccagctagagggaggaggccgccctcaaacccacgtggctctccccgaggagggtcgagcccgggggttgcagcggctgcccttcccagcttggggtcgggctgcccccaaacccacgtggctccccccgaggagggttgagcccggggtggcgcggcggctaccccctcctagctagagggaggtggccgccctcaaactcacgtggctctccccgaggagggtcgagcccggggtgttgcggcggctgccccctcccagcttggggttgggccgcccccaaatccacgtggctccccccgaggggggtcgagcccggggtggcgcggcggctgccccctccaagctagagggaggaggccgccctcgcttggggtcgagctgccccgacccccttcacgtatcagctcacgtgtacagggttaggtgggcgcgcctaacgcctacctaactgcatttaaagcggtctatgcaaccgcgccatgccgcatttaatgcagcgtgctgcgcatctgaccggtctgtgaccggttgaatgaccgatgagacggcgactgtgtacccccgccctgtcagtgtgtcaggcggcgagcggcgtgctccgtcccgtcccatcccatcataatgatgaggggcttcacagcttcttatcccggtcagagctggtccaaccactctgaactgacccgggttcccgttttctggtgtgaacgagaacccaaaagtcctcatccattaaatggcgaatgacaagggcgccatgcatgatttgatgggccccgcgcagcaaccgacgtgcagatagcttctgggctaaggcaaaagacatgtaattaatatagagaatattttcccttctccctaggtagcactcgcagcacatgtggtatccccttagagtataaaaggaggaccatgcctagcggagaagggggatcggactgaggatccctgagccaaagcttgtctaaccctagcttgcataccagggattcagggactttctaagcacagaagaatcatacacacaggagtagggtattacgctttatagtggctcgaacctgtataaacctcttttgtctcatcgtcttggaggagcctccgagatcaagatcacacacagtttcgctcaccaaatccttgaatctcacccgctgcccccgaccgaactctcaaagggaggcctcacagcctcccgctagagagggtcacctctcgacaaacgtaaaatgagatattttgtatatataataatatgaatgaaatcattgcggtgaacataaccattcaaaagttggataagcaacttcaaattatttgtgcccatatgtaatagtccgtatgtgaaataatggtacgcataacattagcaatactccaaactgatcacttttttatttttcttaagctgcgtgcaattggtcatgaattagttcctaccatcttttctcctttttattttcacagaattaggcatttttactatcttttcgtacaatgctttttagcaccgtacatggttttatataattaggcgacctaactctcttcattatcatctcatgcgtgcgtgataagaccaaattttcttgttctgtttgtgtaggtcattgcgcttgttccttgatattttagatcttaattaactttgtgtataataaacatatataaaagttgattttgatatggactccagcattgcattacgatcgggctagaagtttttataagatggaagacgccttgcttttctttttctttcagtgagccaagtcagtcgacgtgattttttttcattagtgtcagaatcgctctctttttttttcattagattaagatttgatcttgtgattataaattttggtcccatcaatttaaagaaaaatcaatggtcaaatgttttttttcttttttttctttttagtttattagagtgatgcatggcggtttagaaacgtttataagagtatcaagttgcagcttaaaaaagtttgtacaatgttttaatagatttttaagtatataatagatatcattatctcatattccatcattcgctccataaaaaaaatattccatcattccatttcaatgtttgccaattgactttatttttcttttggttgaaacggtatgagtcctgtaaactgtaccctgatggcgccatctgaacgtgtcatggcttagtctgctacgttttgttccttgcaactgttctatacccttgagatggtgactgcctttagctaacaaaatgcccacttgtgcatacattctttcttttttccactctagtaattcatacgcacagttcatgctttgttctgtatcagcagttgattttcccgggagaacagcgtatcagcgtgtgagataagcattactccctctgtttcttagataataccgttaacttttaaacatatttttattatttattttattcatcatttttatataaatatataagatgtaaatcatacttaaaatattttgaatgatagaacacctcacaataaaataaattataattatatattttttaataataagatgaatagttaaatgtgtgataaaaaatcaatgatgttattattagaaacggatgtagtattattagtagatccgattgattacgtgtgaggccaagttaatcaatcaaaatcatccaccaactggtgcagcagggtccagtcatacaaagaaacacggccatatgtgggtcattatgttttgactgcatcagatcccgaattcgtgccacgtgatctgccgtcgtgtattcgtgtccactagaatatcagttcttcccggaaagatggctggtttatcgaatcatcgttgattactcgattggttaagaaagcgaagagctttgccccaatgctcagggaagcagggacaaactgagctgtgagaagtaggtaggctgcctttcagatttcagattcttttccacatcttcccctttctccccatcgctttcctgcatttgtacctgtcgctgctgattctagaaatccagaatttatttggatgaactgagaggtgtgaaagacagagacagaggagaggaggatggggttcttcttcttcgcgtcccgtgctgctgctcggttcttgggcgaggctaggatcatccaccccggcgtctccaccgctgcgcttcttgttgcagcagccaggtgcggccatggccatctcttttcactctgaaatcttctaaaattttgccctttttgtgggttatctttttgtccattttagcccccctttccccatcttttcggttttgtagttactttcctgtttgatctacaactctgacgctatagaacagtagactttgaggttttgttctttgacacttggataatcaatcatccatccactgtactgtataaaaaatagttcccctttaacgactttatccataagatcggtcccaagatttcagatttcagaacctatccgtctactactttttgtatatgcatttgctaattctgtgatttgtttattggcttggctctgcagtggtggaggccttgtggcgtatgctgattctgctggagagaatgcatcatcagagacatctcaggaggctcccaggaagaagaaggttgtggttcttgggactggctgggctgggacgtccttcctcaaagatcttgactgctccaagtatgaagtgaaagtcatatcgccccggaattactttgcatttacacctttgcttccgagtgtgacttgtgggactgtagaggcacgcagcatcgttgaaccgatacgaaagatgcttgagaaggtatgccttgtgttcatcaatagaaattccgatacgaaagatgcttgagaaggtatgccgtgtgttcatcaatagaaattcttgagccatgttaatttagccatctatgttactttggctgtagttgctggagtgcagaattgtggactgacacattgattgagtggttgtgccctattgttcttttgtagaaaaggaaagatgttgcattctatgaagctgagtgtttcaagattgatgcatcaaagaaagctgtccattgccggtctgccgttggaacaaattttgatggcaatggtgattttatggttgattatgattatttagttgttgctcttggggctacagtaaatacattcaacactcctggtgtgatggagaactgctactttctgaaggtaaaaatcctgaacgacattcagtagccttccatgttctgttatgtttcatattccaaccctagactctcttccaagaactgagcctatctcagttggtagaatgtgtaggtgtgcactcgcggttcccaggtctggatgttcttaggcttgaatttgttgcttatcatccttcacacacacacaaacaaacttgttcagtatatatatgtcatgtttgttgcgatgtcccaatgcaatagaatgattaatattttccctggagtagccactcggccacccaatatcattacatcctctgaaccatttgcttctgttacataatttagcccctactccttagtacaggataagtattcagtatgttgtaatgacattcatggaactacttactgtattctcgacttacagtttgcattgtaaaagtcaggaagtagaggatgctcaaaagatcaggaggaatgtgatagactgctttgaaaaagcttcacttcctaacattagtgaagaggagaaaggaagattcttcactttgtaattattggtggtgggcctactggggttgaatttgctgcagagatgcatgattttcttgttgaggatctggtgaagctatatcctgcaattcaagattttgtgaagataacaattattcagtccggtgaacatatattgaacatgtaaggcccttgctactttcaagaaaacgttttagccttctgaagaagaaaatttgttgtagttgtatctgttttctgctaaatattatgactagttttggggcattggaggttccttttttaggcaagcatttcaaacattatgaaaacaacagttccatatttttttaacattgataccatcaggtgtagcatcagcagatgaccttttcatccttcctgtgtgatcactatgtgttgtttcaggtttgaccaacggatagctacatttgctgaaatgaagttccagagagacggcattgaggtgaacacagggttcagagtggtaaaggtctctgatgatttaattacaatgaagagcaaatcccttggtgaggtatcagtaccatatggaatggctgtttggtctgctggcattggtactcgtcccgtcattatggacttcatgcaacagatcggtcaggttgttaaatttaaataaggtcgtttagtctgctggtattgaaagttgaaacttgtccagtttgcctgatcatgttttatttcaagcatttaattgaagtatccaaatgttctctcctttaacagactaatcggcgtgtcttggcaactaatgaatggttaagagttcatgagtgtgataatatatatgcaattggtgactgtgcttcaataactcaaaggaaaataatggtatgtccaaagcattccttatatattgtttgacagccaatagtgattgacttacaattccataccttgtattgatcatgttagccacatgtttgcattaggaagttagcaagtatacaatgccttgtgaatatatagattggttgcaagataatgtcaaaagtattgatttttttttctgtaggccatacatgcatttaggcactcaaaagtttatatttggcctaataacaagcaccatgaacatctgagttaccagcatttgggtttatattttatcaattcgctgacttacttttcctattctttcaggatgacatttcaacagtatttaaaatggctgataaagacaactccggcactctaacactcaaagagataaatgatgttcttgaagacatttgtataagatacccacaagtagaactgtatatgaaaagtatgcacatgcttgacattagggatttgataaaagatgccataggtgattctcacaaggagtcgatggtggttaacatagaggagttcaaaaaagctctgtctcatgtggattcccaagttaaaagtattccagcaacagctcaggttgccttcatttccatatgcaagtcatgtcccaatgatattttatcacagatttgttgtaatatgtgaagaagaaaccttgcacgtgtgaacattctgcatttcttgaaactttgccaggttgcagcacaacaaggacactatcttgctgaatgttttaacaagatggaccaatgcaaagaacatccagaaggtccgttgcgcatgacaggaacaggatcaggacgacacaatttccgcccattccggtacttagctttatcgttatacctgcatagtattgatttgggcctgtagtcagcttgttttcattagatatgctcttgacagaatttttttgcatgtatggtgtgcaaaactgcaaatgtatgctaattgagccaaatcttttttgtaacattagctcatttccctctacttatgcttgtttatctttccatgtccttgttttcaaggtacaagcatcttgggcaatttgcacccttgggtggagagcaagctgctgcagagctcccaggcgactgggtttccatgggccatagcactcagtggctctggtactctgtatatgcaaggtaagaacctgctgtcagcagcaaggccatcctctaccatctgtctgaactctactatctgtctgaactctgaagaaatcaaccatggcatctcattctactactgctctctacttcattcacagccttatctcttgcatcatgcctctgagcttactacaattcgtttagctgcaattctaccctgagagtttgtttctttcctccatgttttgtgtagcaaacaagtgagttggcgcacacggatgctggtggtatccgactggactcggaggttcatatttgggagggattcaagccgaatttagcactgccaaatgctgcatcatttcttgtagagataacattgctgaataattttgttgtctttggctgtgtttagttcgtgtgccaaaaaaaaatttttgaagtatacggacacatttgaagtattaaatgtagactaataacaaaacagattacagatttcgcttataaactgcgagacgaatctattaagcctaattaattcgtcattagcaaatgtttacttgagcaccacattgtcaaatcaagacgtaattagactcaaaagattcgtctcgcaatttacatgcaaactgtgcaattggtttttttcgtccatatttaatgctccatatatgtattcaaacatttgatgtgacggaaaagttgaaagttgaagaaaaaagtttgaatataaaccatgcctttgtaacatactactgttgaataataatgtggtgaactttctttgggcaaggaaagctgtttcctgtccctttcttgtcctgccaaccgaagctgacacttgataacactacagtatccttacatgcctgcactccagtgttatttgctcctactgccacatggctctctctaactgtgactgagagggtgagagtttctgcaatgatcggtcctctttagatcctccgagctattaaatagtcctctaaagttttgttatttagagtattaaacatagattactgataaaactcattccataatctctaaactattttgcgagacgaatctaataaggtatagtaatccatgatttgctacagtgatgctatagtaatcagccgctaatcatggattaatatatatcattagattcgtctcgtaaaatagcctagaggttatataattaattttatcagtaatctacatttaatacttctaaataggtaagattccggagaccaaacaaagccaagtcgcttcgatagtcactgactgggtcactgcagactgcatccgataggtgggtccctggcagctacggtgggcccacttgtcagccacaaccttaatactattgccttggataggtgagaagtgtgaaaatagtagcagttcagtagctgagtagcaccaactttgactgtcagtaatcagtaataacaaagctgaaagcaagtagcagtaataacagcgtgtctgcctcaaaggtagccatgaaaaccgtagtactacatcacatgtttggccgtaggccttgcctagccgtatgcatggtcctagtatacgtagtagtattgtggtacgcatgctgttgcagttgcagatggaatacgagtagagatgtggtactaatgcagaggatcaacagtaccacgcattagaatcactgtgcaccgtcggatcaagagtgaaaggaccagattgtgtgctacagtaaattcggaacagtaccaaatagtgcgctacagtgctttgaattctgtagctacagtaaatcgacactgttcatggcattagctaactgttcccctcacatgaacagtgctcttctgcattacggcagacgatccggatccgagatgtggtaccctctcctaatgctgcactgagcaaatggtccatccttgcctccctcatctgtcggctccatcacatgaacaccaccacccagtcaccactcaccaaccaggcaactctcttctcttcatatagctgaattcctattaattgcaataccataatatcatgttgaattgtttatgctatccattatgcaattctggtgtttataagcttagtgttgattatatagttcattttaaaaaaatatcacagtgcatcttatatgacttatattaaaaatagtaaattttacattggaccacattttgttattattgatgtttagctttcgaccatcttttaattaaggttttcacttaagactgaataattttatcttggtggtaccttagaccaccctcaatttttttttccatctacatccaacttgtcatatgtcaggaaaaaaaatctatatctttttttagataatagaatagaatatcccggcctttgctcaacgagctacagccaaaaaaaaatctatatctaactgtcaaagtttattggcgagtaggagccgacgtattcgaaatcgttcgtatgtttgagaagagagtagagtggtctaaagtgaaacaaagcaagattactcaatccaagatgaaaacattaataaaaggatggtctaaacaaaataatggtaataaaaggtgaaacaaattaagtaaaatttactaagaaccattacataaaaatctatgccaaaagaaaatttcggtcaaaattgacagtcttcttctcaaccatatccattgccatattggccgccctatgttgtcctgcatatttgttggtcctgctgccgatggaagatatcaggacagttaaagaactaagcaaaatctggataaaccccaatcacataattgctttttaagatcatagtaatagtcatccatcccaaagagcagatcgataaaactgatgaatatagttctatttcttgtgcaagatatgaaggtaataaaatatactccacagtgggtgcaggccagaattctcaagattctatctgaaccgatctgctatgctctctactctggagtctgaacagatcttaaccgttgttttcccattccaacgacaatggtcgtaataaccatataaaagtgttagtagtaccgaccatgtactatccttttacaacgttttcttccatgtttcattgcagttgccgtacagtaaaagtgcaattacacgttggaatgaatgcctgtctcctgactaatccatcccataataatatcccatcacatctcacaagcttaaactccaaggtttcttaagacaccttactagatacgcacacacgcaatcgagaacacattttgcatagatcgagtgcctttctctcgcagcatgtcctggcccagatcctgcactcacaatcaaagaaaaaaaaactaaaaaaaagtagagagaaacagagagaaaatgcaatagatgaactcattagcagcatagactgagcttagctgtttctgtactgtggctttaccttgaagtttcatacggagatacggctcatgttaggtgcccaacagcaagaggagcttctcttccaaatgccaggacatgtatgcatggatactaacaagaaaagagaagcgtaaagcttttgctgttattttagtcagggaaaaaggaaaggtacacttgatgatgtctcaacagttcatgatgagcactgcataatcatcaggctcaactgtagctcatggtctcatcccagggagatgattagtgtaatacaggcaacattctcattctcattctcattctcattctccaatccaaaaatattcttttgcactcacccaacccacccactgatataatccatcattccattcaactacacacctaatcgcagtaaattgttactccctccgtcccattttaagtacaaccatgagttttcgtattcaactttgatcgtccgtcttatttatttattttttatgattagtattattattattattattatatgataaatagtactttatatttgacttatatttttaaaaaaattaaacaaaacagacgatcaaagttgggtacgaaaaatcacttataatgggacggatggagtaattgggtttacataagaaaacaagctggatttgtatgcaaattgcagggaatacatgcctgcaagattccaatggaagaagaaagcatcaagtcaggaggggtaactagaggacagatcaaaggagatggtagtaacatgcacgcatcaccaaccagtctacactacacgcatctaccttcactcacagagtaacagtgccatacacacgggtgcagtagtacgtgtacaaaaacaaaacaaaacaaaaacatttgtcacatagttgcatcatcaactccatctttaatacttcccaactcaccagcattgttatcagctgcaactctgaactccaagaagatgcattgctgcattacataggtaggcagtttgtgtgtgcattgctgttgctgcagagatgggagaagctgcagaggaaggagcagtggatggaagctgccatggtgaagcagcagcagaagctctcgaggtgctcaggtccatggcaatggcgtcctcctcgctgacatgctccatcccacagttcccggcgaaatggcagtctatcaaggacaagctccggcagctctgctccggcctggattccctgtgcggcagcgtcggcttcggcgtcgacgtcggcggcgatgaggagaggcatggcgtgctggtgcagcttgtggcgtcggcttcggcgacggtgaggagcatccaagccatggcgtcgcagtgcggcgatggcacgtacaagggtgggaggctccggctgaggagtgatttggacaacctgagctccaagctggaggcgcacatgaagcagctcagggagatggcttcctccgggatgccgtcgccgtcgcaggccatcgtcgcggtgaggccaagcgccgacgccggcgccggcgagaagatgttctacatgcgggatctcttctccagggtcaggattggcggctctgtccagaggagccagtcgctggccaccatcggggagctcctggcggaggacgaggtgtgcgtcaagatcgtcgccgtcgacatcgacgacggcgtcgccttgctcaccggcttcctcgagtcgagcgacgcgcgcctccaggaggaggccgccggcgccgtcgccatggtggccagcttcgactcctacagagggatgctcgtcaaggcaggcgtcatcgcgccgctcgtccagctgctggacgacgcggccgccaccgccgccgtcgccgccggcggcggcgccaccgcggtcgccaaggagagggcggcgcaggcgctgcgcgagctgacggagaactcggacaacgtgtgggccgtgtgcgcgcacggcggcctcaccacgctgctccacgcctgcggcgacgccggcagcggcggcaagctggtggcctcgtcgttcgccgtgctgcgcaacctgagccgggtggaggaggtgaaggtgttcatggcggagcagggcgtggtcaccgagctggtgaagctgtcccagaagaaggaggaggcgcgcaagctcggcgccgtcgagctcctccacgccatggcgctcgacgacgccgacgtccgggaagaggccgtgagcatgggcgtgatccagtcgctgctccagctgatataccctgacctgccatactcctacaaggcaagggaggtcgcccttgcagccatctggttcttctgcttctcctccgtgaactccattgatgacctcatcagctcagatgttcttggctggcttctcttctacctcaacaatggcgattacgccgttcttgagtgcacactgaaaattctgcggcatttgtccgaggtttctgaggagtacaacaggatgatgggcagagcaggttatctcagtgcactgtcaagcttgcttggagcaaaatcatgtcgggttcgcgaaatggcagctcaagtgctctctagcttgctgttgcttcatccgaatcgcgtgattttcatccaagacggcgacaatttgaacaggttgctgcagttgcttgatccagctgagggaaaattggtggcaaaggacttgatcctttctgccatattgtccctggcagataccaacagtggaaggaagaagatcatatcatcagagcatttcagcagcctgaaggaattagctgatactggggactttgatgcaaagaaggttgttaagaagctaggaactaacagattccaaacaattttcagcaagatatggagtgtttaagttattttgacttcttttttttccttcagttcctttactgaatacacccttgatttagcattagtttatttgatttgttgtctatagtttttgcttgtcttgtaatatctatattcataattatgatttctctatgttgtacatttccacttctgtgaaattcaagtatcaatataatgccttcagacttctgtcatgatcaaaaccaagggactatatactagggtttacattatcgtcaataaccgcggttaccggccttaccgtgggggtacggtaatagaaaaaccacggtaacctcctcaaattcaaataatttttttaaaaaatgaatttttgataatttttgcacagttttgtacggtttttcacggttaccgtgcggtaaccgtgcttaccgccagggctgtggcgcggtaaccccggccccagcggtttgggaaaccctgctatatactgctactcttctgcagtttcgtttctgaatatagattagcaacaccgatttttactggccaacatttagcaaggcaggttcatcaaactgtttggcttctgatgaaagagcaatctcgattctcatctcatcagtctcaatttgcagggacacccaaagagtatcacttttattcctttgtgaagcaaggacaccaaaagtacttgaaaacagaaaatacttattttccataccatgtattctgagccgtcaactagacaactagacaactccagcaaatatcctgtactacattgtagataggccaaatacagcttcggcatctgaccatttgttaagactagcaggactgcaggaccaagtgtgtgttaacctgttaggaagtagccaaactaacagattaacccattcttattactttactggtaggagaaaaaaacagagagatagaacaggcaactgacaagtaaacacaggcacacagccatactgaaggtctgaagccaaacatgaggagtaacatttataacactgatatctctttcatactagcaaacaatgatcagcatttagtgagacaaagaacaggttgtcctatccaccaatttgcttgtttccttctcctatctttcgatacaggcgttcatcccgtgatacttttaagattagcacgtgaatctccagcaacgactgatccaggcttctgtttgtgggccaaaattcaccagattggcttgaattttgagtctgtaaatttactcacaatctgacaaccaatctgatttgtgatagactgatagtttacatgccccaagactgaaaatgcagtggtttggactcattgtcccatattagcatgcttatttatgcattttatcacccttatcatccctgggcagctaaattttgaacttactatactggagccaaacaaatttatgaggaaaaaatagaggtgtcagtttgtcactggatagttgtttcttgctgtcccaacacacaaggaagcagctaaagacaaaatgtagggaaatcagtaagccacttattgacttaaccacaccatgaatcctgtacttactcgaagtctcaaaccaaagagcacacttacaattccaaaacaagaaaccatagaatggactcatcactactactatctcttttcacacattgactagcataggaaggccttgacaaaagaaacaaaaaaaaaagaaagaaagaggaaccagaccatgagatatgaatgtaacagtagccggaccatttatgcaacacgcccctgcaaaaagaaaagcctcactcgaatgctagctcaagataagcaggcaccttgaacactcaagaagaagacggagctgagctgatggaaggaacggatcaaaccatggtggttcatctcaagcttctgcgaccgcctcgggtgcttcgacgtcgagcgcccgcccgtcctcggctgcagccgtgaagaacgagcgcttcccgaccaattcggcaacccgcttggcgcatccggaatcgcgagggctctcgtcaggaggcggcatggtcctgatctttgggagcatttcagcaaccttggatatcgtttgaggagagagtggatcattggaaggctcgatgaccttcgctctgatttcctcattctggttcgcatcccctgatgatcctgggagagactgcttgcgtcgcctctcctgtgctccactgcttccaagggaagcgccaggagtgaggctgtagcggctcgggatgaccctcatcttggagctccccgccatcctcttggcagtggcggcggcggcggcgctgccgctctgacttgacgacgcacctttgggcttgagctcatccaccaccttgttgcctccccttgtgtcagtagccttgccattggattgcctcctgggcctggggctcgggctcctcgccttcgctcgacttgctgctgttccttgcctcgagtccagtgtctgccttgtattgctcgacggccatggcttggcggggacggcgaattgcttggagggtcgggtttcttctcgaatggcgttgagcttggtggtgaacggcttggctcgcgccgccgctggtgccttgctgccgacgccgtggtggatctccaacggcccgaggctgacgcccctgcgacgctgcaccggaggctccttgattggcttcaggatccgcgccgtgccagcgcgttgctgttgctgatgctgcgccgccgcgggcaccctagggttcgccgcggcgatctccatgggcccgaggctgagccccctgccccgcgtcgccggaggcttcttggtgcgcagcggatgcttctcacgattgacgatggagatcacatccaggggcccgaggctgaggcccctcggccggggcctcaccttcgcgaccatctcccccatcggagcgtcgtcgcggttgggctccggctgcttggagacgcggagatggtggagccgggacgagaggcgcaggatctccgcctcgatgtggccgatctcggcctcgacgtcgtagccggcggcgacatcaacaacctcggggcggtgattctccttgtcgcccttgcggacggccgcgacggcggggctttgggggagccaagccgatctggaacacgaggagtcgtcgaaggcggcgttgttccagacgtggaccagcgggatgagcgggtcctcctccatcgcctccgccgacgaacccccttcgcctcctcctcctgcaacaacaacggcggtggccgcagagatcagagaccaggcgcaaatcaatcgacgaacaaacaaacaaacaaacaaacaaaatcgaaccgaatcgtcagcgagagcaaatcgacgagcacgcacctggatcgaatcgatcgattgatcaatcggtcggttgattcgagcggattccttcccctttgcgcgattagcgcggagcttggatcggattaggtggtgagaacttttgaaatttgtgggaaggggaggatgatgcgaggagggggcgagaggaagagggtttaagagccaggtcagattcgaccgttgggacttggggagcggagggggagcgcgccgcttatatatttacaagtggatttttctttcttagaaaaaaggaaaaggaaaatacatgagcagacactgcggatggagacatggtgtgtggtggggttaacaagaccgaaagacgttgtaggaagtgcgcatccaccaaactccgctccttgtcttctctccatcgaaccatcctgaaattcattttccttttgccagttttcgtctcatttttcgggggacatgtgtgcacactatactactcctttcaaaaaaaaaaaacagtatatgctttttgtgtgtactacgctagttactactacctccgcctcaaaataagtgcagccgtggatattcgtgcccaacgtttaaccgtccgtcttatttgaaaattttgtgaaaaatttgaaaatatttagttacacataaagtactatttatgttttatcatctaatagcaataaaaatactaatcataaaaaaattttaaataagacgaacagtcaaacgttgaacgtgaatagtgtaaaactacacttattttgggacggagggagtaccagtagagtatggtttctttatacttacgtttttaacgttgtttaatcgaggcatcgagtgttcctcccatacaaattagagccgtagattgcacgaatgcgcaaaccccacaaacagaaaacagagggaacaggaatgtattggagggcgtttgctttctgagttcagaaagttgccgccaaattacaaacttgtgtgagttttgaaatttgaaaggggaaagatcaaacttattcatttgttcttcgcacgtcacgtcatatagggcctgtttggcacaggctggagcttagacaaacagtttcagctccaccaaaattgggagtggagctgggtagagctctctcacaaaataaactagagttatggagttgggtttagtcagctccataactccactccagacccaactcctggagctaaatttaggagttggagctgtaccaaacaggcccatagtcgctaatgcaaaatggtacttttgcttgggctgatggacttgccaatttgccatcagcccatcagcagcccatgcgtggtggcggccttcggggcatgacatgaaagccccttgtcttcaactcaatgggccgcggaaacaagcccattgagaacatagtatgacggaactcgaggaaattagcaaaagcccataggcaattttataccccatctccttataccctttttattattgactttgcttcagtacgtcacgcatgtacacatagcatgtggtcaggcatacctggcccgtatctcacgagtcacaatcctaaatgaactttctcttcctttctcttctttatttgagaagatgagctaattttctctgtaataaacacctaaacaaaggaagaaacactaacacaaatcgcaatctgccaagcaacgtgatcgtgcagcttgtggagtaagcgaaccaaataattgagcagctttgccaagtaacagaaacaaataaacaagtatgccaagttgccaagccatagagcggtagagccccgtcacacaaacggtttggtacgatgcaacctagcttcccggggcacagaggagacacgagacaggccggatcgccgtcagttgggcccccagagcagcaggtgcatgatcttctccgtcttcatgatctccgtctccgccgcgtgccgcctccgcacctccgcctcccacgctctcgctctcgccctcgccctcgccctcgacatcgtcaccgcctccgcctccgcctccgtcgcctgccggccgcgcccgtccaccgaaggctgccgctgctgctgctcgcccttggcggcgtcgcgctcccgcagcagcgacgccgcgcggaacgcggactcccgcttgcactcccgcccgttgcacatcaccgccgcgccgatgcccaccaccacggcaccacctgatgctcgcgtgccgcgctcctcgtgtcgatttcgtgtgcaaagctactagtaatagccagcttagccagctaatttgcctttctggcatgttatatagggcgccacgaaatttttgtcgcccatgcgatgcggtgacgtgacgtgactggggctcggctcggccaacgggtggagcgcgtcgtgacaggtcggtcggtcgcggcctcgtggggttgcggcgtcaagcgtgcggtggggagcgcggcggcgtgcgcgcctcgactcgacaagtcgacagggcgggggggaaacggtggacgggagcgaccacggatttgggccgagccgttaggcacacgacgggggccgtcgtcgtacggcgcgaacccagagaaaacggccgttccaaaccggtgggtatgtgcggctcgcgcggcgcgggatgggggtgtgcaccgcacctggtgctctgttccctttctcctctccgcgtcggtgcaaccaacaactcgcgaatcggccagcgatatgttcggtttttattttcttcgctctgtgactctgtctctgtctcttccatttcttttcgtttctattttacgaggaggacatgttcgagttgtacgctgcggcgccggcgcaccatgctgcccactacgctctttttttctctcgttaagatagtacttattttatccctatttttattagcacgtttttaaactactaaacggtgcggtgcgttctgtacgaaaactttctatatacaagttttttttaaaaaaaatatcaaacgtatacatttgttaagtttgcaatagttaaaatttaattaattatatgctaatagttttcttattttacgtgcgtcaacttaatctttattttcatcactttttagagcaagtacaatgagagactataagcccgctataaacatatttcgaggagatgaaatagaagagaaaagaacagagggctacagatttgtagccaactgaaacacggactcccaaatacatgtgtgcatgacaagtgtgaaaagataaattgactattaagttaactatagataatttaaagccagcggttggctatactattaaacttgctcttaaacaccccagctgcgaacccacgcgcagcctctggatactcccgaggatcaccgccggcgcatattcgtggcgccgtttttattttagtgcgattgaaatggagtacaacaagtgtgtttagtacttgttgattgagttgattccgtcgcatttggcgcgtgcccatttgcttagtactaaagcccagtctgtacgtagaagactaaggcttaaggctctgttcttttggttgagttgggaacccatccctccggtacggaaaacgaaacagtccattagcacgtgattaattaattatttgctaattttttttcaaaaatggatcaatataatttttttaagcaactttcgtatataaactttttgcaaaaaatacaccgtttagcagtttgaaaagcgtgcgcgtgaaaaatgagacgggggagttgggaactccaggaaacgaacagagcctaaaggcaaacggaatccacacaaaagagagaatttcaactgttataaatagcagccgtgatgtggagagtacgctgattgttggatacagcgtgcagctcttacggcggcagccggcagagcgtgaagaatctagaggatgttgaacatggtaacataagacaagtatcttctgcaagcctttgtgatgtttcatgtgaactaccactcaacttcaacatatctttctttagtgaagagcaaaagaaccttattaatttttctttaacagagaggagcggtagtagagtactgatacatgacttcatgtgtttgtcacttaattaaaagttcccaaaccgtttgatttgtgttaaatcttataaaatccacaatctcattaggggttatatttcaccaacaaacgtgatttcaaaccatgtctgacaattacgcacgtgtgattacactttcaatagaaaagtacttcatccattccattttaagtgtagttgtacgtttctatgtctaatatttctgtccattttatttgaaaattttattaaaaaataaaaataaagtcatgtctaaactattattcatgttttataatctaataacaataaaaaaataattacaaaaaaaaattaaataagacagatggtcccacaactatgatatgggacggagagagcagtgatgtttataaaaacaatgagagaggggaaaagaaatgtttatcaatttacgagtgctcaaaagttaatcactaatttgactacacactttcagaaaagatcgtctgtgactttgttcagtgacaccagtcgatagaatattctaccggtgcaaccaaacccaactctcaagctaccctcaaccctggtttttgggaatcagtgtgtagtttactcgtcccaaaccagcaaccggagccccctgtttcgcactcatcgcgtccttcctcgctgccacccctccccacccgccggatcccccatatataaatgcccctcacctcgtctcctcgccattgccgcaactcacagctcagtgtcaaccaccacaaccacaagcaagcaagccatacacatcaagaaggcgtctgcgtgcgaggaaatcatccggtttttcaagctaaaagcgtgaagatgagctcgtcgtcgttgagcaagaaggcgtcgtcgttcgtggtgacggcgagcatgagcgcggtggaggcgctcaaggaccaggcggggctgtgccggtgggactacgcgctccggtcgctgtaccagcgcgccgccgccgccaagcaggtcaccggccgcgccgtcccggtgtcgctgtcgtcgcagaccggcggcgcggcggcgtcctcctctcccgccgccgcgtgcggcagggccgccaggtcgaagaggtcggaggaggagaagatgcagaaggcgtatcacctcgtctgctggggacctaattaaaatctgttcttcaaattcgtgatttcgtgtagtagttttttcgtttgcaatttgtccacccctcattttctggtgtgtaaatcgagccaatacctgcagggatttttgtattttgatccgttttcatgtactactacttccccatctgattctgatggagaattgctatgtgcaaactacggagtaaaaatcaacaagatgatgcgattgttgcacggaattaattacctcttctctgttgggtgttcatcatctgttgcaacagaaataaacaaaaaaaaagaatctttagttctaaccataactgagttgctgcattgttgttagtgcttggtagtagtggttgcatggcagagatgccaaacgcatgattgagtgaagcgctgatgatgatcagatcaccggccaaatgcgcatcaacatggaccggttaccgttgttcatcaacgctgcactcaatgatgcatttgattctctgtttccataccgacttgtcccctctgacatgatctgcatctcgttatataatagtgtgcgctctggaaaacactggatccaagcttgaacaagtggtactgcgtgtactactgtactacagctgctgcaactttcgtgtgttagatcgagcttgtactactgccaagtgattagcataggggtgtgtttagttcacgctaaaattagaagtttggttgaaattggaacgatatgatagaaaaattgaaagttatatgtgtagaaaagttttgatgtgatggaaaagttaaaagtttttttaaaaaagtttgaaactaaacacgatgtaggtagagcgtgtcttcacggccccaacgagtttcacgaatgtacaaggtgtcgaaccactgcccagctacaactagatttcacaaagatcaaacatcaagtttggtagtaccaagtatattgcccacaacaatattcaagattgtgtaaaagaaaaggcatacgtgcacactatttctttgtactgctcacccaactaatcatcctggtgtgtatctcaggagtaggagggcatttcaacctcgtcgtccatgcgagtcatgacacacaattgtccagttaaaaatgcttaactggtcatcaggatgcgtggcatgacacaccacaattgtccggttaaaaatgcttaacacacaaagatctacgccatgatttgcctgcttgggttggttgctgatgcactagtacgttgacctcatgttatgatgtcagcatcactagagggtgggctagctttgaactgggcttagtcatggcccatgggcttgtaaacatccaacgaaggtcataaaaacatgccgacgccgaacgtcactagtctctacaacatgcaactatgcaaggttggagagtaattcacggagcgaatatcgaataaccgccgaacaagcgcttaattttagcatttcgattaaaattcttggttgaattgcactatgaacaaaattacttctactacaagtctacaaatcaacaagttaaacgtaattaacctctacatgatcgatctcccaaattaaactaacctgtaggggcgatcagatcagaatcaaacagttcgtgaggcgccatttggtcagtattttttttttatccccgatcggcgtctcgccggagaaaccagagcacctcgtcgggcg

SEQ ID NO: 66798 - DNA, 5702 bp, Oryza sativa
gcgggcctcaaagggcaaaggtctatctcttcttttttgggaccgtcggtaattgccggttcttcaaggaggcgtcggtgcttttttaatggtgggcggagcacatgccccttggttcgaaggtggtcatcgggtgaacattttcgtagtctagtccgagtgacgtcgtcgaccgctcgtcggcttcgagcgaacatgtgcatgtgggtgtttatatatgtgtaaggggttggtattttttttttatcaaagggctctaaaccatccattttcataaaagaaatgtcgcagtttcagcagaagaaaatgaaagcagaaatctcgttctgcgtctagagtttataaaagcaacaacagtcattcaacagttgtctgtgaggggtttgtatatatggatggaatgggaatgaggggtcttatctgttgattgtgggtaatacgggtggtatgggtgcatgtaaataatatatgggtgagtgtgggtatatgttcaaattttttttgtacaccatgtggggaagatatgttcaatttttttttacaacatgtggggaagatatgttaaaaatttttttgtacaacatctgggggagaaatgttcaaatttcttgtgtataacatgtgggggagatgttcaaattttttttcctatcatatggggggagatatgttcaaattttttttactatggcaacatagtggtctatgtgaattttttttttactatggcaacgtagtggtctatgttcaattttttttgcacatatgacaagtaggtggtataatctatttttttatgataagtggcctcgataatttaaatttgctactttttatggcctcgatattaattatggagttcatttttatgtttgaagtacgaaacgatggccgatagtactaaaggaaatgaagatcaggctgtaggggaggtggagtcttgacaaccgccagttgagccgtcccttgctattgtggttgctccgcaaccaacggtgctgccgtccgatgggtccgacagcgacgtacccaacgaggacgatgagtactcgtcaccaagtgatcgttgtccaagcccgaaacggtggtaaaaggatgagggtgaacaaggtgataaggactacattccccgtgagaaaggggtaggtacaattaagatcgtaattgtgtgagtgataactagtagtgagtagtaattcgaaagtttcatacctactcgtagaaaacggggccacggagatcaaaacggcagccgaaaaagaaagacaaggcacaagaagacgcggtcccagctaagtccaccggctcgaagaagaaagataagacgcaacagccgaagacacaaccatatttcgaagatctgcacaccatatatcatcgggaaaagatggacgtcaactatatcggtgcttagtgcctgtgagtatgagtgtacattaattacacgacggaatctatataatacataaccatgtgattattactaacaaactttttttgtaggatgcaatacatggatgctaagaagctaaaagaacctatcggatttctagatccaactaggatatgtcaaacacagcataccgggcagctatcaccacagttagagcagctgaaggacaagactcccgaagagatagctgaatacaagaagggattgcacaagcagaaactgattaatgtcgcacagtacattgggcgagccttcttgcactttcaaaataagaaggtcgtcctggccgcttataattttaagtaagtccggtatacatttctcttatacatatgtgtcttattgtatccatgactaactgcactgttgttaatatgtagcgatcattacatcggtttaatcatctacccgaagcactgcaccgtgacagtcttggaccctctcgattactctcatgactcatacaaacaatttctaacaatcttacaatagtaagtgattctgacacttgcatgtctgctatgaatatattataattaaatctcctccttaatgtgaaacggtacaaaatccatacagtgcgtacaagtactacaagttcaagggtggagaacagattcgatcaagggagaagctgctagtacatacatattggccggtaatactccactcacttaatgtattccaattgtttcactaattgcaaaatttaactattttcttctatgatatgtcatgaagtgtcacaagcaacctagaggcactgtcctcagcgggtattacgcatgcgaattcctaagggttaatgggaggtacagggttaacccagaggatgtaagtctctagactatatggattagacaacttcacatatagatgatactaatatattgtgcttatttccatgcatgcagttgccaagggaggagcaacaaacaagctttgacaatacagccattaaaaatatccagcgcgatctctaccacttcatccaccgtgagtgctgtcatgtggaaggaaagttcttcgacaaagagggtgccctagctacaagtgacaaatacaaaaatcttcgggagtgcagcaatgctatgccataatgtaattagatagcgtatttgaagtgacaatgtaaaaaatattataatattttgacgatacttttcccttttgcaatatatgtagatttctcagtatcaaaagcttgttatttactaatattatttatgcaacaattaattaattaattgaaaaataatttatgagaaaattattattgtaacaaatttcaaatatttgtacctatcttcgcaggcggcatttttttatttttgcaggcggtcatgctatattttcgcaggcggaccatatagctgttggaaatttggtcataattcggcatattttaatccaaaataacaagataataaacatgatatttacaatgggatttgatccagtgataatggtgaatgtaatcaacatgagcatgcttaatgtagaataagcatcaacaatcacataataacacaatgttgacattgcgatgaacatcaacagtaaaacttctaattgaaataatgtaagaagggtataccccaagaatggtcctccgctggagtttgaggcagtattaccttcggtgatgttgacgggagccctctttttcttgtatccagtggtggcggtgtctccagtgttcgacatattggtgaaggtgaagtagatgttgacgaacagtgagtagtcgcgccttacgcttccaaaaacctgatcgcccgcccgttcgtgcaaacgttgcaacagcgcgtggttttggaggcctactcttccaatgcgtgtgcacacactcgtcgggatgggattaccgtagcagcaacagcgttggaaaatggatgaaagtgtgtctcactttctcttttgggagatcaaatccattctcattttatatgagaaattcaagatgaagagtaagagtcatggaaatcggaagagctatagagtaactaattctcatcaattagccattaaccattctccactatacaaccatcaaccaaccgtcaattatgagtaattgatgtaggttacaaatggaataggaagaggaatagagcaacttattgtgatcaactagccatgaaccatcctccactacacaaccatcaaccatccatgaagtaggagtaattgatataagttaccaattccctaatcaaatggattaattctcaaaactcttgatcccattgatatcccataagaggatgaatacacatgaattcctagcataatgagccttggaatttatatgatttaattgatttaattggatcaattacccaattaaatctaacaatccccaccaaatttcaaggctcatgagaatgctctctattccatagcagcttttatataccagtgttttggtgaagactgttaagttgaactttcacctagaaaaggagctacaccggaccacaactgaacaatggactatgccttgaattgtcagtcttgtgcagttaggtttcactcaattccataactgatactaggcaaccgttagtattccctcaggttggagcttataagtcatactccaggcctttcatgagtatctagagatcacccaaatctcatagactgtgactagtagtcgaactcatataggtgtactccttctaatatgttttgcaggtcaacatctctgcttaataaaagccgaggcataagccatcctaccacacagagtagaagagaagtacatcatgaaaatgagcccatttaagggtctcttctctcggttacacaatagtttgtttcgccatccaaattcacgggatctccgatcacaatggacaggtttccactattgtgcaactctaagtgggtttcaagcccatttccctcgatgcactgtctatcacattacgtggtagccccttggtaaactgatctgccagatttttagctgtctggacatagtccagtgctatcactccagagtttttctgctttctgacagatttcagtcttctcttgatatgcctagatgacttcatgttgtcctttgaactattcactttaataatcactgtttgattatcacagttcattaggatagctggcattggtttttcaaccatcggcaaatccatcaggagttcacgaagccactcggcctcaactgtcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttccagtacttttgggtacccggtatagtgaatagcatagctcatagtgccctttagatagcgcattactctttccagagtctgccaatgatcatctcccggatttgagacaaaccggctcagcttgcttacagcaaatgagatgtctggcctcgttgcattagccaagtacatcaatgaaccaatgatttgagagtatctcagttgatcccttgctattcttcggtttttccttaatagcacgctggggtcataaggagtaggagctggcttgcagtcactatatccaaagcaactcaaaatcttgtccacatagtgggattgcacaagtgtaatcccaccctcatctcctctcagtagcttaatgttaagaataacatcagcctctcaaaaatccttcatttcaaaactcttggacagaaagtccttgaccccctcaatcacattgaagctgggccccaagatcaatatgtgatcgccatataagcccaagataactccttttccctcaccttgcgataggacacacatttatcaactttgtttcccaccaaagccacgccgatgtgaagtgtgttgccacaacttctcaaaccacctgcttatgtgcctgctctaagggcataccacgtagtttacaaggtacacaccatttcctcctggactcttaaacaaacaccgcttggggggcacactaaactcccccctcacctcttccggttggaaaaccggttaacgcccatcgagggcggaaaacaatatagcttctcaaccagatatctccatttcggcaaacggccacgctgaaggtgcgaacaatactactcttttttggtaaccttggccaaacctcttgtctttaatgccaaaaggcaagtttctgtaacctttgc

SEQ ID NO: 66799 - DNA, 2906 bp, Oryza sativa
  unsure (1)..(2906): unsure at all n locations
gcgcgccttgaanatgagnttctgcttcgagcangtcngcaggnngactttagaggatccccagaaagtccttgacctcctcaatcacattgaagctggtcccaaagatcaatatgtcatcgacatataagcacaagatcactccttctcccctaccatagcgatagtacgcacatttatcagcttcgttcacaacaaagccagcagatgtaagtgtggggtcaaacttctcatgccattgcttaggtgcttgcttaaggccatacaaggatttcaacagtttacacaccattccctcctgaccttttagtacatacctgtctggttgatccatatagatctcctcctccagctctccgtttaggaaaactgtcttaacgtccatctgatggacgagaagaccatgagaggctgccagagcaagtagtactcgaatcgtggtcaagcgggcaactggtgagtaggtgtcgaaaaaatcctcgccttctttttgggtataacccttggccacaagccttgccttgtacttttcaattgtaccatcaggcctaagctttttcttgaaaacccatttgcatcctacaggcttgcacccatatggacgctcaacgacttcccaagtatcattagacataatcgagtcatctcactgcgtactgcctccttccagtagtcagcgtcaggagatgaatatgcctcttctatggttcttggagtgtcatccacgaggtatacaatgtagtcatctccaaaggattttgcaaccctttgtctcttactcttacgagtatctacaatgctatcctcctcaggatttccctcaagcgtttgctcattgtgttttatcggtgcaaagtgctcatggggtaaaacaggttctagactagacgtgctaggtgtatttttcatgggaaattcattctcaaaaaatatggcatctctggactcagtaattgtaccaacacgcatgtcgggtactccagagtttactattaagaacctatagcccacactgtggatagcataaccaaggaacacacagtctatggtctttggtccaagtttacgctttttggctataggtacatttaccttggccaagcagccccatgtgcgtaggtatgagagatttaatttcttcctttcccattcttcgaatggtgttacttccttatgcttcactggaattttattcaggacatgacaagcagtaaaaattgcctcaccccaccattcattggaaagtcccgcagtgtctaacatggcattcaccatcttagttagagtgcggttcattctttcggctaccccatttgattggggtgaatagggaggcgttctctcatgaataattccaaactcttcgcaaaaggacgtaaactcattggaaaaatactctccacccttatcagacctcaaccgtttgattttcctttcaagttggttttctacctcagctttatagatcttaaagtaatgcaatgcctcatcttttgttttcaataggtacacagcaatatctagtgcaatcatctatcagtgtcatgaaatatttctttccccctttagtcaacacgccattcatttcgcacagatcggaatgaactagttctagtggtgccaaatttctcgcctcaaatgccttgtgagacttgcgaggttatttcgattgaacacaagtatggcacttggaacctttgaccaaagtgaattttggaattaaactcatgttagccaaccgcgtcatacaaccgaaattcacatgacaaagtcgcgaatgccacacattggactcatcattatcgctaatatggttcacaacattattattattattacacatgtcatccaaagaaaaacggaacagacctctgctatcataaccttttccaataaaagttccatatttagatacgacacatttattggattcaaacacaagtctaaaaccatctctacacagtagagagccgctaactagattcttctttattaaagggacatgctacacgttcttcagctgcacggtctttcccgaaataaacttcagatcaaccgtaccaaaaacatgaatagccgcaagcgacctgtttcccatcaacaaggaggaacctctcccgacctgataagaagaaaacagggaaatatcagcacacacatgaatattagcaccagtatcaacccaccaatcaggtgaatgaaaaacagagagaactgtaggtaaaaaataaccgtaccccgatgttcctccgccctcgctaataaccatgttggcagacttcttgtccttgcgatcaggacaattcttcgcccaatgcccaggcttaccgcacacaaagcagtcccccttggcctttcccttgcctttcttcttaaaattggttgtagcctttgggttgacatcagcttgactttcttcttggtgattgtatgggatgcgtgagggttcttattttgcaccaaattggcgctagaacctccctcgaatttttgccccgttgttcttgatctggcctcntcttacacccaagagccatgagatcataacacttgactttggctctgtggttaaagaagagccaagtcgaccaagaggtggtatttgtcataatgcaaccggcacaacttgtccgcaaactacagtggtgtcttaagtctttgtaactttgaattaggagctgttcactacagacggcataaacaatttgagnattgaactggtcagaaatacagtggttgcgggtggaactccgactggctaaaggctcccaagtcttctctaggtgtggctgcccctcctctttggagggggcactgtaaggttccggaaagaaatcgaccttaattatccctctcgggaaaaggggttcttttgggccgaaaaataaaatttgcttttaccacag

SEQ ID NO: 66800 - DNA, 2671 bp, Oryza sativa
agaacaatgcatcgcgtcaacaacagtagtgcacgtcttttcatatctaataatagaactatcaaaagcatgtggttcaagtgttgcagcaaagccacttaccgaaaatgacctatcaggtttttggattgttggaaatttggtcataattcggcatattttaatccaaaataccaagataataaacatgatatttataatgggatttgatccagtgatagtggtgaatgtaatcaacatgagcatgcttaatgtagaataagcatcaacaatcacataataacacaatgttgacattgcaatgaatattaacagtaaaacttctaattgaaataatgtaagaaggttataccccaagaatggtcctccgttggagtttgaggcagtattgcctccgttgatgttgacgggagcctccttctccttgtatccagtgttgccgttgtctccagtgttcgacatattggtgaaggtgaagtagatgttgacgaacagtgagtagtcgcgccttacgctctccaaaaacctgatcgcccgcccgtccgtgcaaacgtcgcagcagcgcgtggtttcggaggcctactctcccaacgcgtgtgcacacactcgtcgggatgggattaccgtagcagcaacagcgttggaaaatggatgaaagtgtgtctcactttctcttttgggagatcaaatccattctcattttatatgagaaatggaagatgaagagtaagagtcatggaataggaagaggaatagagtaactaattctcatcaattagccatcaaccatcctccactaaacaaccatcaaccaaccatcaattatgagtaattgatgtaggttacaaatggaataggaagaggaatagagcaactaattgtcatcaactagccatgaaccatcctccactacacaaccatcaaccatccatcaattaggagtaattgatataagttaccaattccctaatcaaatggattaattctcaaaactcttcatcccattgatatcccataagaggatgaatacacatgaattcctaggcgttgtgctataggcggaccggccttccggctgggaagatgtgtttcccctgccggcgaaaatgcttttcctagtagtgatggcgtgtgtagtcgtggccatgcgcacacaggtgcgagggccacgcactcggacacgaccaggtagacagaagacatgcccgtcggtagccgcgcacatgggcacactgtcgccatcgcatcgatatttccaaattcggtcgttaacaatcattttgcacatgcgccggagatgttcgacgtcgccgagtggtctccactctggccgcctttgtgtcgtagcagcctagctccatcgcctccgtagtcagccatcttcgagttgccgagtggcaaccgtgttcccatgtcggccacatctgcttacactgccgattgcctgaacaatttcgcggtcggctgcctccacgccaccgcgtggtgaacatgtccccgggctagccggcaccaacgccaccatgaggcttcaccgtctatgacgccgcacatgcttgggggcttcggccttctcctcgttgacgcggcccgacactacaccctagacggactactcccagggcacgatgccgcacgctcggggtattcggccttcgcacggctgaagcaacccgatttcgcctggggcatgtctccgtatgcccggggcaagacaccgcacgcccgggggcttcagtcttctcctggctgacgcggcccgactacgccccagacagactactcccgaggtatgatgccgcacgcccgggggcttcgtctttcgagcgtggctgaagcggcccaattttgtctgggcacgtctccgtacgcccgaggcaagacaccgcatacctgggggcttcagcctttacatggttgacgtggcccgactacgcccggggcacgtactctcaaggcacgactccgcacgcctgggggcttcggcctttgcgtggctgacgcagcccgacttcgcccgggcacatctccgtaagacctgggcacgacgctgcacgcctgggagctttggccttcacgcggctaactcgacccgacttcgccaggagcgtgtgcccgtatgcctaggggcttcgcccttgtacggctcacacagacccggctactctctacccgactacgtcactgttccgtatgccctggggcttcactcttgtatggctcacgcagacccaactacgcctccacattagtcaatcacgtacccaccgactggccggctccggggcagctgaagggcttcaccgcctccccggttgttttcaactcatggaatactaagtaatctaattcactttttatatggtattttcatttgagtaatttattttacttctgacttactgtttagttggtcacccaaccaaacataaagtcaagggctgcacctattaggtgcttcaaactgcatgttcatttcctcctcttaatggttgcaaaagtacttgagtagcacaaactctgattcgtgaagctctatttcctcgcacggctcacacggtcaaggccatgcttaacaccgtatgcccgggggctacgccactcactgcacacttacacggtatggctacgccccataccgtgcggatccagagtcgcaaatcaacgcacg

SEQ ID NO: 66801 - DNA, 8864 bp, Oryza sativa
  unsure (1)..(8864): unsure at all n locations
gggcccccaccctctggagtggccccccccggcgcaaaaaattttataaaaaccccggggttttttaataagggccaatttcttttttcccggtttctctgagggtattttaacaaaaaaccctttttttttttaaagggcccggtataatttttattggccgggccccggcccttttttatttaagtgtgccctttcttaataaatacccccgtggttttttaaagggtgcactgggggggagggcactcaaaaggctcctttttggccccggcccccctttggggttgcccctcctgtgggtttcttataagcggcatttgttgtttaggcacaccctgagggcggcttatcggtttggttgcaacggttggtgggaatgctccacgttgtttctttattggctaccatccattgccaaaacacgccccttagttgtctattcggggtcatcccaagtccgggttttttaaactggttgcttagccaccgtcgggtccttcatcccatgttgcctggtccctctccaccggctgggggttgcgtctccagattgtttccttatcctgcgtcggggtactttgtcccttgtgcgggttggtcctttcccccccgcgagcaaaatacgtccccatgttggccaactttgtgatcactaactggcttcctcacctccatggtttggctggttccattggatgaggcaaatcctctagggtttgtcttactcaaccacacgctgttgggagttcatgttcttgactctccacttgcttgatgcttaactaagtatagagtcgggggctaatgtgggggacacggtacctaggtaccaactgttgggcctttgggccgcatagcatgtggtgggccgagtaggcctgagcctatgaggagcatgcgtggctagataaggcaaccgatcttatctcatgtaaatcgatggtaggttgccagattataggagatatgttacctctatatagggtgaaccaaaaaccctaattctggggagaggacgatacgtgctacgtgctattcacacgttgtaccgcgcatactcaaatacagatctaatctcatacaactagactaaggcattacctctaccatttttgttggcggctaccttaaactagccgccagcgaaaagctatattccctggcagttggcgatcgccagtgaattgaagatgctgcatcttcactggccattggtctctagcaatgccggtggccgcaaaaaaaaaaccatttttgtattagtgaatttatccaatgcattgtttctacttgttggatcagataataattttctttgtccatctctctcctttgattttatgttgtcgatactgccctcccctccaatgctcttttacttgcatgataatgtcagattcaagacaccattttctctctttaattgctgacatgaaaaatcctatgtggcaagattatttgtctctcttctctttaatatttctctctctactctttaattgcttgtcaagtgaccttgtcattttcgaattaaggctgaatattcctgtcagaacccatgcaacttttttttagacgggtcaccggggggcgaaatgcccacctaaatatattacttcaaacggtcttacacagggcaaagcttctgctacacaagcgcagtagtcctggaggataagagaaagtatacagggaaaaacaaggaagagaaacacaacagaaacacaaccaccccgaagggcacctgagccacactagcaggactacgagagagagagagagagagagagagagagagaaagagagagaggaggtgtttgatgtttttcaccaacaagatcacaaaaccacaatcctaatctgagctaaagctagctccctagcctgacaacatctactctacacgcaaccttcaagcaccgggagttgaattgtcagaaggccatctgccacgcacaagccgactcagtttccggagattagaggttgtgtatgtcaaagaccacctgcatcaagccatcaaaacccgatttcattgtgttgaaatattgatcaatgctcgccaacgccctttgggtaaaggatgccccagaagagggagagcaactaagggttgctgtaaaggccgcacacatcaaatcggcttcaatccggcattagcaaattgccaattaatacaacgcccccgacgccccaagggagaaggaagccccaatggtgggatggtcgctgaacattgtggacaaggacacccaagcaaagaagatgaaaatagaacaaggagcaaagcaaaagaggtaagttgggaggcagcaattgcaatggtggaggaaacatcatccacgatggttgaggagtcataggttcactgagaaagccaatggttctaaccaacttgcagccccaaactatcaatcattctagcatgccaaaatggaagaaatctgaggaggaaaggggaaactgcatactcgtggtttatggtggatcaaggtgaaggtggtcgaagcaaggcaagaaacaacaaccaaaatgactcaaaccaaggaaactaggaggaacactaacactggttagatgaaaagacaaggcaaggtggaccaaaggcgtcgaggataggtgtaggcaggacacgatggatgccaggggacaaacaggtagagggcacaacaatgacgaggagaagaagccacccgagggttatggcaggggatttccaaatatgatgccttcaagaagaaggacgacaacaagaaagaagacgccatcgtacgctgtggaaaccaaaaggggttttcaacccagagcagggggtaaagccagccaggacactagtcagatagctcacgcggcggcggcacggacgctagcggcttgaagacaccatcacacaccgcccccatgggcaggtcagggcgccgctgccaccgacctcccagccccaaccgagtagatctggccaaggagtaagtggatctagacaaatcggccaaggaggcgaatgaacaggtccagcttcaccggcggcaaagaggggttgcgcgtaagcagtcacgagggtcgaagatgtctccccttggacaaccctatgccgccggcagcgccaggctgctgacgacgtgcgagccaccgccccatcgccctcttcaccggatccgcctgccgttgcctttcctcctcgccggatcctcccactgcgcttttgagctctcgccggtggctttgaacttctccgcgactgcccgacgctgccagcagtggcaatcgtcaccgttgtcctcttagcaaccgctagctcctagatcccgcgcaggagagcgttaatgccctcgccgccgccattcatgctgccgtacgttttcggtgtctggctccggcggcggtgaagcgggagggagagaggtggggggtagaggtgcaagcggcggtcgctgcccgtgtcgcccaacagagcttttgagtggaagcaacggcggactgatggagccagtacccatgaaactttgcccttgtacatgcaatgacgcacttccagaaatcaaaagaaacatgggagacaaagaggatattcttttgagtcaggaggaattggatattagatggttttataggaatagattatcttcaattatgagagaggaggaaatcaaatggtatctgagggccaaatctaaggatattctagagggtgattctaatacaaagtattttcacttggttgcaaatggaaaacataggaaaactagaatttttgaactacaagatggtgaccaattaataaatggtgatgaaaatttgaaatcgcatattaccacttattataagggtctttttggtcctccagatgattctcctcttcagtttgatgagagtaaatttactgacattcctcaagtttctcttttggagaatgaggctctaacacaaggaatttactgaagaggagattaaggaggctattttccagatggaacataacaaagcaccaggtcttgatgggtttcctgctgaattttatcaagttttctaagatgttataaaatttgatttaataaacctttttaaggagtttcataatggtactttacatttattctcgcttaactttggtactattattcttttacctaagtgtgtagaggccataaaaatttaacaatataggcccatttgtctacttaatgttagttttaagatttttaccaaagttgccacaaatagagtaatgagtgtggcccaaaaggtaattagtcctacccaaactgcttttattcctgggagaaacattatggaaggtgtggttattttgcatgagaccttacatgaattacatcgtaaaaacatgagtgcataatttttaagattgattttgagaaagcttatgataaggttaaatggtttttttgtacaacagactttgagaatgaagggcttctctcttaaatggtgtgagtggatagcctcttttattcaagggggacatgttggtattaaagttaatgatcaaattggtgacaatttttaaacttataaaggccttagacaagaggatcctctatctccaattctctttaatatagtagctgatatgctagctttacttattaaaagggctaaagataatggctctattaatggggtaattcctcatttagtggatgatggtttgtctattttgcaatatgcagatgataccatcattttcttggagcatgatttacaacaagcaaaagaatctaaaattgatcttatctgtgtttgaaaaattatttggagtgaaaaattaattttcacaaaagtgagttgttttgttttggtcaggctaaggagtgctatgatcaatattctagtatctttggttgtaagttagggtcttttcctgttaaataccttgacattccaatgcattttaggaaactgggtaataaggattggaaagttattgaacaaagaattgagaaaaaacttagtagttggaaaggtaaacacatgtctgttggaggtagactggttttgatcaattctgtcctttcaagtttagctatgtttatgatatctttctttgagataccgaaaggggttcttcaaaagattgattattatagatcacgtttcttttggcaaggggatgatcataagaaaatgtataggctagctagatgggatattatttgtcaacccaaagatcaaggtggtttgggggttcataatttagagattcaaaataaatgtcagttgagtaagtggttatataagttaattaataagaatggtgtttggcaagatttattgaagagaaagtatctttataataagtctataacccaagttgataggaaacaaggtgactcccattttttgtcaggactcatgaaagtgaaaaacactttcttaagtatgggttcctggattgtgaataatggggaagaaacaagattttgggaagataaatggctaggtaatatggcctttagagataagtattcatctttatatgctattgtcagaaggaggaatgcttctattgctagtgttatggcctctattccgcttaatgttttctttaggagagctttagttggtcagaatctaacactttggcatgagttgtgtgcttctattgttcatttccagttaaataattcttctgattattttagatgaaattatcatcaaaatggtcagttttcggttaaatcaatgtacttagctttaattaataatggttacattgataggaataagtttatttggaagctttaagatgttgctaaagattaagttctttatgtggtacttgcttaagggagttgttttaaccaaggataacctagcaagacgaaattggaatggcagcttgagatgttgtttttatatgaaaaatgagactattcaacatttgtttatggattgtcattatgcaaaatttatttggagagcagttcagttttcttttggattataccttcctagtaccatatctcatatttttgatagatggcttcggggggttgacatgaaaaagagtaaactgatatttgttggtgcttctgccttatgttgtgcactgtggttgtgtaggaatgatagggtttttgataaatcatcatctatttcctatatgcaggtaatttttagggcaacatattggctccggttgtgggcacaactacaaaagtgtaatgaagatgaagaattcctgattgttgcatgtcgtaagtttgagacgacggttatgcaactttttgccaaccatggatggagattcaccaacaggttagaataatattatccttgtcatgtttggtttcctttatttttggttggtgtgtttgcgttatttttttcttttaagtgtactaccttgtaataattaactgtagctctcttgagcaaaagccggaatgtttcattctattatctttacagcgcagaaagaagaaagtcacgcgagttggtctttttaaagaacaaagtgacaacttttcttagggtgggaggaaatctacgtggaattgtactagaattgaccctagatggcttgcggggtcaattatcactgataggagtatttgattgggtcgcatgtgattttttttttgtattttgaaaattatatttttgctatgtcacatggcaagttattttcgacattacataaatatttacagtcaatagcttaccatgttaccttcagtgaatggctagattgtttgttttaacaattggttactgaacgatttttcagttaaattataaaagatttaaaaaaatggttgcatgcatggttaaccacttgagagagagagagagagagttcatgtcaacatcttcggatccactaattcatttggtcaaaggcaaactgatatttcctcgcgcaagaaaaaaatggtattatggtaaaatcaaacttggagggcctaccggtgagttttttcaactttgcacagacaacaaagaacgaccagtgcatcagtgcatctccacagctccagttcttcgctagctccacagcctccactcttttccctttttccttttcttttgattgacgttgtgctgcctaagttggcaccctttatcaagcccaaaaaaaagccttttacaaagacgagattctcattcagctttggcaaaagttgcgcagaaaaaagattaccattcggcttatataaagttaacaaattaaagtattggtatctgtcctttcttattccagccgaaaaaaagaattacttcataaaacctttggttttgaatatttcataaagttaacaaagttgtagaaaacaatactacatcagttccagaatataagtgaacacggttattaagaaaataggtagaattaaataggggaatgttgtgattggatgagaagtgaaggtaaatgggaaaattaaatggtggagggttgtgattgatcaagaagaaaatattggtggatacgtaattatattttgtgacaaattctaaatcgtaaaagtgttatattttgggacgaagagagaagttgttattggtcgaatagctattgaatttgaatatataagttccaataggttatagatggttttaaagctgtaattatatgcaaaagattgatgtcccaatctctgcaacgcagactaccccataaatataaatatagatggtgtgccaccatcactgctacaaattcggtcatccttgacaggccatctgtaattaggggtggacaaaaagtttggccttgtgagctcggctcaagcttggttcaggctcgcataggtcggctcggctcgaaagccaaacaagccaagcccaagactgcttcctagctcgtttccgaaacaagccaagcccgagctggctcacgagccgctcgtgagctcttttgactcaatagaataggtcatatacaaaaaaattgcacatttttgaactatttattggttgaaaatgataactttgattgtcatattatctatttatgtgttgtgatgatatattaaagaaaaatataactttattacgcattctatatggtattatgttgctcgatttctcttagacctgcttgagatttacttgatgccaggctcgcgagccagctcgagctggttcgagcccattatcaagccaagccaagctgcagttttagctcgttgcttgtagcgagccaagccaagccaagcttcccttgtaccaagctttcacgagccaagccaggctcggcttggctcggttccacttctatctgtgatggtttctcttaccggttggaggggggttattacatccccacggtaaggcgngtnccaaaacnctttctgtagtaaagaacgttgaaggcggaaggagcggcgcggtcattggaagcggtaacccccccgatggacgcggtgggcgtgccgagccgcccgacaacgacgtgaccacacgggagttgggaggcatctgcgtcaagcattctcctgctggatgccgacgcaatccgcaaaagacgacagatgaggactgactggactgcgactagcaagcggtaacaacaggcagtgcatgtgtgtactaacatcaagcgtgaagccaacaagcaaatggctgactgacagaacactgctgtaaataagcacgcatcgacttcttgacggacggtggggcggtcgcgaatggcccaagtacgactaccctccccacccattcgtacggacggagcgcggccgctgaggatggggacccgaggggctggagcccttctggccctcgagcgccccccgtcgaccgggctccaacttcccgtcctgtatacatgccaaggggagaaaaaaagagtcggatttaatcttgacttaattaagttgctgcacactatgtga

SEQ ID NO: 66802 - DNA, 13791 bp, Oryza sativa
  unsure (1)..(13791): unsure at all n locations
cggcgccatgaaactgcacctgccaatcccannngccngcangtngagtttaaaagaccccccggttacggtttgatcttggtttccgcacggctagttacgttttccgtgtgttttgtaactgaacaaaccaatgcttaaaaaaatgttaaaaaacataaatgtgtgtgaaaattgacgataatcaaaagaattcatatgatacttgcaaacctaacttttggatgcaaatacaaaaattcagcatgtcctttactatgttatggacttcgaagcaattcaacaattcatagcataataagtcaacaacgtcaattcaacaacctcacatttcaaatcataatgatgtccatatgtagcacccacccaccctatatatattttctccactattgggccttaatttgctggataaacagtgcaacttaaaggtccattgcattatttttttaccattttctaatgtactctcggttttaccatcaaatgttattttatattactctttttcatcaaatttctttaccatccgccactacaaatcaagaactacatccatgtttttttcgatttgttttggaaattttgaatttggttaaaattcatcaaaccctaccgccggtaaccattaccgtacccccacggtaagagtggttacggcagtaagggaagccctgcttatgacccatcaaagatatttatgacccgtcatcgtaatagctcgtaactacgacacatcacacatatctatgatctatgatgagtggcagttacgaaccctcacacatgagggaatatatttaaatcacaacctttttttataaaatttgataaaaaaatgtgtattaaaaaaatgtgtatgtagtcgaatagacagactttatgtaaaagttgtagagttaattttataattgataatatttttatttgagatcgtttagatgtctgaatatgcactaagtgatgggatctattttgaaaaataaattttaaatttttcagacagacttgaatggagataggccctatatcaaagttgtagacctcaatatttttatttgagattgtttacatgttcaaataagcgttacaaatgatgagatctattttggaatttttttttgaattttttaaatgatctcagatagagacatgacgtatatcaaagttatatagctcaatgagataaacaactttctaattgataaaattttcatttgtgatagtttatatgcctgaatatgcaatatggggctattttacaaccccatcattaggcatattggaggaaaaagcaaaacaacataattacaaatgaaaaataatttgtgcataaaacttttatatacgtgttcttgacgatataaaagcaaaggctcaaatgctgaaaactaaactacaatgaataaaatcctaaaatcaactccaaatttaaggttgaaaatttaaattttggctgataagtataagcataagcgaaaagatgagggggccaactcggaacacaaggttaatgatcctaatcaaggggaagcggcaaccagtgctggagcaagagcatcccatgaggaaggtgaatacgttagcttctcacaacatactcctccaacaaaccctgctctaacaccggccgagcatttgacctatgtacatggattgctggaccaaatccccaacaatgcaacgaccaatccagatgcaacagcttggttggaacatatgaagtctatgacagccaacctcgatactacatttaaaactgtgaacaatcaacaaagagagggatgacattcagcaaatcaccaatctcccgcaaggaaccaagacggtgcagaaggccaaaataatgaagtcagaaccacaatcaagatcaatctatgcctcgatgatggagaacacgcaattctcctccccccaataatgatgtaggctcccatcaattgcccattttatccaaaatggcttattagaaaattaaaattaatttataagtaaaacttctgtagatttattcgtagcgacttaaaagccaacattaacaaaaattacgttaaaagcatttcaaaatcaatttcaaaattaagtttaaaaatttaaattttggtttattctttgactgtttaggccaaacgatgaagctgatagacttatgtcaacacctcaatggatggagggaaaagcgcgagaaccaaaggagtaatgaggacaacggttgctgacatcatcgtaacaatcggggcctcatcctcacaatgatgacaacaaccgtggtcgtcgtgagaactgcagtcagcatagcaaaaatcctatatatctatacgattaatccacacttactgcagttaatactaatttgctgccctcttattcatccacgtcatcagttaattggcgtcgttggatcagctcagaccagctaataccaagcgttggattatatattgagcaacccctctctttaggtgtgatatggaggcccatttttgtctggtaggcccaactgattccgatgtggaataagttcacttcgtgactctcaaaagtgatcgaaatctaatctgtgaccctaaaccacaaaaccggatatctcgacccccaactcttaaaaccggtgcaatttgactccctcggcggttttggagggcggttttactaacgtggcacctatgtggcagtattgactcgatcttctgtccacgtggcgttgatgtggcgcttaggtatcattagaattaaaaaatatgtgtgggacctatttatcattcaaagcaaatttgtgaacccactgacatgtggggcccacatattatcctctctcctcttcatcctcctccctctctctctccctcctctttcttgttaggaatatctcctctcactctctaggtgttaatcacaaacacgtaaattctctttggtagacacacgcacacaagaatattacaagtagggaggaagaacagaggtggacacataaactacatcttgctttctcggcaaccatgccacatattttcattcatttatctagtacttatgtacacaaaagagctaccaactccactcatgcacgacctattctctaggcactaacttcagcatgcactgcatggatatgtaagcagctcacacgactaacaacccaactaactcccactaatacacgcacatgcagtaactaatcactagctcatctgcgtgcaatcatcaagtaatggctaactacgtgactgactcagtgaccacgtacatctgcacatacacataatgtgcagcaactaattaagtcaagattatatccgacatctcttctctccccttcgcatgtctgcagggacgggagctggagcgccggcggcggggggcgctcgagggccagcgaggctcccgcccctcgcgtccccctcctccgcggccgcgctccgtccgtgcgaatgggtggggagggtcgtcgtacctggaccatccgcggccgccccaccgtccggcgaggagacgatgcgtgcctatctgcagcattgctctgtcagtcagccctttgcttgttggcttgccgcttgatgttagtacacacatgcactgcctgttgctaccgcttgctagtcgcagtccagtcagtcctcatctgtcgtctcttgccgattgcctcggcaaccagcaggagaatgcttgacgcagatgcctcccaactcccgtgtggtcacgtcgttgtcggccggctcggcacgcccaccgcgtccatcgggggggctgccgcctcccccgcccgcgccgctcctcccgctttcaacgttcactactacagaaagcgtttttgcatacgggcggaatcgatcttcacatgcggttggccggcccgcatgtcgcagccgtatgcgaagatatattttcccatgcggttgacctaagaagatcgcatgcgaagatctattttcgcatgcgggcgtcttaagtagaccgcatgcgaaattcaatttccgaatagctaaaataatatttattctagcattttggtgagatgtgtctcgtaattaatattaaattattgagggatttattatcgtatttcggagtagtaagcatataagataagacaagtgccgcagtaacaaacatgtaatacataaccattaattcaatcgtaatttacatacgaatatataatagcaagtggcacagttttttcatcatgttattgcatatgtataagtagtgtacatgttattgcatatgttctttctcccactctctgagaggtttaaatttgtcgtccattgtgagttcactctggttgtcgtagaagagacctcttgcgttgcagacatcacgaaggatgaatcggcagaggtcagcggccacgttcaagatagtagtgtcgttgaatcgttgtgcaatatatgggatttcggggatctgcacacagaaaggaaaataaaatggtactcagtgagaagtgtgtgcgagatgggtttctttgtagagaagagttcgatgacctgctcggttactggttgttttgtaccttccatttactctgagcatctcgcacacgtaataaccacacaagttggttcctggtggttgtttgtagcactgcgatataattatggggaccgatctcagtagatatatttagtatatatgtactgttcgataattagttgtattggtataaatttgatagtaccggccagccagtcctgacggataacttcttctgggatggaatatgtactggtccacctcttttgcggtagtacttgtgtgctctgtttgaaggaaacaattgttttattagtagttagaagactggtgatcgacctaaacaatttatagtaatgaaatgtttatcacttacaaattcaaaatagtgaggaattccataaatgtctccttgtcatagtgtgcggggtccaatgatatgatcaattggtctttcggatatacaaggaataatatgtagtggtctctacatataagataggcttattggagacagaaaattccgaagaagataaattaattaaacaaaaagaagagagagcttacgtgaactggtaggggaccattaagacatctttgtcggcgtgcgccaacattgctattgccaagtatgttgctacttctagcttcttcctcttgtgcaatgtcttcacatattcttccttttcttccggggtcttgccaaccaattgctcgcagtcttctctcagctctacggtgtgttgtgttttgcatattcttgttggatcgacgtatccaacctttgctccagttctatcagcttcgtggaattgcatactgtacaatgaataaagaagaaatgagcggccgtttccccctcatccgaccgccctctctcactcccaaccctatataaacgctcccgtgcctccctccgccgtttccgccactcgtcgctctctctccccgccggaatcgagctcgcgccgtcgctctctctatcagccgtcgccgccgagctccggtccgccgccgtcgtcgccccggaccttctcccgtttcggcgtcgccttcttcgggttcgccgcaacctcgccgacctcgtccacctctccgtttcggtcgccgaccgccggaacgccgccgtccccgtcgacccgtgccgcgccgccgccttcatccgctccggtcgccgttcccgtcgtcgccgtcgacccggggtgagccgtggaccgccgattcgcttcccccttccctcccctctctcgggcgccgatccgccgcgccggtggtcgccgacggcgaccatcggggcgcgggtgcgccgccttcgggcgcgtcccgcggctgccatgtggggcccggccgtcagccgcccgcgccctcgggtgtggctgacgcatgggacccacggcgccggccggtgtgaaccgggtgcgcccggtccaccgtggccccactcccgtggacccggtccgcgcgccctctcccttcggctgacgcaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgtgctttgtttctgcttgttatatggagtttattagagtaaaagccttttcttttccgttggtcgtgtagacgctgcagcttcggaagatccgctcttcgtggaagttgaagccgacgtttggaaaagcgagcaaggcaagtcacatcatccttgaacatattgaatcccagtttataaaattatgttgctttaaattattgcattatcgctttatttaaattcccgcgttatcactgttttatctagccatgcctatttacctttgttatgaccttattattattgttattgttattattaccttgttcaccttagattaaacaaaaccccaactagtggacactctactcatggtaccactagtatgattttaggtagatgcttcgctgtttaattaggtaacattaggtgattttacaactctagactttgggatgttcatatcacctggacactatggaatggtttggttattgtggaattggcttcacaccgctccttctattcaaaatccccaaaatggttttaggctgggctcggggtgcatggttttgatagtagcacctcggacatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgcggcccggtagtcgagatgtcatggcacagggccggtgtcctgctgctaggggctcagtcctgcctgcctgtcctgggggttccggccgtaggtgggattgggtcggtactcttgtctatggctaggatgggttggaaactatgtcacgtcttccgtctgtataccgtggtggtatgtggcacgtggttacacgtgaggaagatgtgtattagtggttaagatgtacaccatctgatcagagtataatctattcgaatagccgcgccactcggtaatggcaagccgagcaatgtaccaaagttagtgttttaattcttaaaacctgcttaacaattaaaaggtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttactaaatagttttgagcaactaaatatctttaaatgctatttactgcaaccctaaccctttatagtataactcctttgtactcccttgcatttattctgcacttgtgggtgtatcttgttgagtacggtggttgtacttagtcttgctcaatttttcccaaacccagaagaggagcccctggaagatgaaggctttggtgtctagctcgtgcctgccgtcaagcgcctgtggtcatcgccctagtcttccgctgtttctcgtttgtctttgtgtgtgctgggcctttgctgcccatgtaataaattaactatttacgcttccgcttgttaaactctgaattgtatcaacttttggtgtaccttgcctcctgggacaaggattaatgcacgcacgtaaggaacacccgttgggttatttccggtcgtgacaagttggtatcagagcccccttgaccctaggacgagccttagatcccaagccttagcaatattttcaaaataaaaatcccttcttatttgtgaaaatcctctagtctctctctgtcctgctgcttcatttatcgccaaaatatgacctttaaaatgttgcttttctttttgtttttgtttgtagatggccggcagcgtcagccgtcgtggtctggacatgactggtttcgtcttggagctgcggggcatgtgcgttgtcctggggtatccgcatggagtggactaccagggcaggccgctcccggagcaggagggtgacgatgcagagccccatgctgcttgggaggttactgcagtgatcctcactggctctcccgagcggacttcgttggcagtcaccgcgggtggagattctttccccgccgcttgccagagcgccgctctcctcgccatcggcactcttcaccagggctacccggacgagttgcagcactcgccctaccgctaccaccctcgtcgcggaggagcccgcgacttcgccaccttccgggatgctagctcggaggatgacgctaccatcatgcacctggcgcgcatggtggaggcgtacgatgcggctcgtatcgacttccatcagatggtgcgtcgtgggatggtcgagaacaacatgaagatcctggagctgcgtcaggagaatctgcagctgaagaaggacctagacgcagtggaggcgcagctgcatcagctcaagatcacccagggagaggtctgtcgccccaagtgtcgccgcgtctgccgcagccagaagatcaccgcccgcaagagcacctccaggcccgagcttgttcgtcagtccctggcgtggacttgcttcgtggagacccctcgtgccgagcctgcgcccgtggttccccaggagggggaagcctccggcgttggtagcatggaggatgcgctgttgctcaccttccgtcctggcccgtcgcagcggtagacgagcagttagtaggcttgcgcgtgtgttctttctcgtttgtcttcttgttggagttgtgtggggcatggttatgccggtgtgtggtgtaactgtgtcggagcctgtctttattttatttgcttaagcaacttgaactttaatgaaccaatttaatagcagtaataaattcaagaattatggtagtcgtggatggttagctttaattgtcagctctctctgtttgctggttttgggtggggttttcagatggtgacgaccaggaaaagtgctgccaccggtgagggcaaccaatctgaaggcagcaaccacaaccaccagggcagcccacctccacttcatcttccgcttccaccaccaccaccagacaccaacgccattctcactcaaatcctcgcccagcaggccaacatgatgactgctttcctccaccacctccaaaatccgccacaacagaatgctccaccaccacccccacaacactctaaactcgccgagttcctccgcatccgtccacctaccttctctagctccaacaaccccgtggatgcgttggattggttgcatgccgtggggaaaaagctagacactgtgcagtgcagcgatgaggagaaagtcatcttcgccgcccaccagctgcaggggcccgcatctctatggtgggaccatttccaggctacgcagccagaggggcagcctattacttgggcccgcttcaccgctgctttccggagaacccatgtgcccgccggagtcgtggcccttaagaaaagggaattccgagagttgaagcaaggcaaccgctctgtgatggagtatttgcatgagttcaacaacctggcccggtacgccccgagatgtacgggaagatgaggaaaagcaggagaagttcttggcgggaatggatcctgagctgtccgtccgtctagtctccggggactatccggatttccaacgtctggtggacaagagcatccgcttggaagacaagcacaaggaactggagtcacacaagcgccgcttggcgaatttccgcaaccaacagggtgctaaccaaagggtccgctacaccaatccctatccagggggatcctcctcgcagcaggaacaacagcagcagcaaccacgctccgcgcctcgacctcaattcgtggtgcgcgtcccacagccgcagcagcagcagagtcaacaagggactcgtgcgccccgtcctcctatgccaactgtgcagcctggtcaaagccgcagggacgctcaaggtccgcagcgtctgtgcttcaactgcttcgagcgggggcactttgcggataaatgcccaaagctgaggcgtcagcaaggccaagcgcctccccgctccaacaacggtggtaaggatgtcattcggggtcgtgtgaaccacgtgacagccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcttaggaaccctctgctcatcaccacccctggaggggttatgacagcaaagtattatagtcctgccgtccctatagaaattcaggggattccttttccctcggatctgattctgctagacaccaagagcttggatgtgatccttgggatgaattggttggctcaattccaaggagtagtggattgcgcgagacgcactgtcactctgtacccagggccagaacaaccggttgttttctttgcacccccaacctctgtcagtagttcagaacttcatcagataggactgtcagaaatccccatcgtcagagagttcggagacgtgtttccggaagaactacccggtatgccgcccaagcgagagattgagttccggatagatcttgctccaggaaccactcctctatacaagcgaccctaccgtatggcagcaaatgaactggctgaagttaagaaacagttggaagagttgaaagaaaaggggtatatacgtccgagtacttccccctggggtgctcctgtgatttttgtggagaagaaagacaagacgaagaggatgtgcgttgactacagagctctcaatgaagtcaccataaaaaacaagtaccctcttccccggatcgatgatctgttcgatcagcttaaaggtgccactgtattctccaagattgatcttcgttccggatatcaccaattacgtattcgtgaagaagatattcctaagaccgcattcaccacgcgatacggactgtatgaattcacggtgatgtcattcggtttaaccaatgctcctgccttcttcatgaacttaatgaacaaagtgttcatggaatacttggataagtttgttgtggttttcattgatgacattctggtatactcacaatcagaggaagaccatcagcaccatctccgtctggtgttgggaaagttgcgggaacatcaattgtatgccaaacttagcaagtgtgagttctggttgtccgaagtcaaattcttagggcacgtgatatctgctaaaggagttgctgtggaccccaaaacagtgaccgccgtcactgattggaagcaacccaagacagtcactcaaattcgcagtttcttaggtttggcaggatactaccggaggtttatcgagaacttctccaaaatcgctcgacccatgacacagttgttgaagaaagaagagaaatttgtgtggagcccgcaatgcgagaaggcgttccaaactctcaaagaaaagctggtttcctcgccagtgttaatcttgccggatactcgcaaggacttcatggtgtattgtgacgcttcgcgccaaggattggggtgcgtgctcatgcaggacggtcatgtggtggcctatgcctcccgccagctacggcctcatgaaggcaactaccctacccatgatttggagttagccgcggtggttcatgctctaaaaatctggcggcattatctcattgggaatcgctgtgaaatatatactgatcataagagtttgaaatacatcttcactcagtcggacctgaatcttcggcaaaggagatggttagaactcatcaaggattacgatgtgggaattcactatcatcctggtaaggccaacgtggtcgctgacgctctaagtcgaaagagccattgcaacactcttaacgtccgtggctttccacccgaacttaaccaacagatggaagccctgaatctgagcgtagtgagtcgtggattcttggctgcgttggaagccaagcccaccttgctcgatcaaatccgcgaggctcagaagaacgacccggacatgcgtggactcctcaaaaatatgaaacagggtaaagctgcgggtttcacagaggatgaacatggaaccctatggaacggaaatcgggtatgcgttccggatgtcagagaacataaacagctgatacttcaggaagctcatgaaagtccttattccatccaccctggcagtacgaagatgtacttagacttgaaggagaaatactggtgggttagtatgaagcgggaaattgcagagttcgtggccctttgtgatgtgtgccagcgtgtcaaggcagagcaccaacgaccggccggacttctccaacctctccaagtaccagaatggaaatgggatgaaattgggatggatttcatcaccggacttccaaaaacccaaggtggatatgattctatatgggtagttgtggatcgattaaccaaggtagctcgatttattcctgtgaagaccacctatggagggaacaaactagccgagctctacttcgctaggatcgtgagtctccatggcgttcccaagaaaatcgtatctgataggggaagccaattcacctctcacttttggaagaagctccaagaagagctgggtaccagattaaatttcagcaccgcgtatcacccgcagacagatggacagaccgagcgtctaaatcagatcctagaagatatgcttcgcgcatgtgtcctagatttcgggaagacctgggataagagtctcccctatgccgagttctcctacaataacagctaccaagccagtatacaaatggcaccttatgaagcgttgtatgggcgcaaatgccggacaccgctattgtgggaccaagttggggaaagtcaagtgttcgggactgatatcctgagagaagctgaagcgaaggtcagaaccattcgggataatctaaaggtggcacagtcccggcagaaaagttatgcagataaccgtcgccgtaacctggaattcgcagtggacgattttgtgtaccttcgggtcacgccattgcgagtgtgcacaggtttcagacaaaagggaagctcgcacctcggttcgtgggtcctttccgtatcattgctcggcgcgaagaagtcgcttaccagttggagctgcccgcctccttgggcaacgggcacgatgtgttccatgtgtcacaactcaagaaatgtcttcgagtgccatccgagcaggccgactcagagcaaattgaagttcgcgaagacttgacctacgtggagaggccagtgaaaatcctggacaccatggagcgcaggaccaggaaccgggtaatccgtttttgcaaggtccaatggagcaaccacgccgaggaagaagctacttgggagcgtgaagacgagctgaaggcagcccatcccgatctcttcgccagttcttccgaatctcggggtcgagattccgtttaaggggggtaggtttgtcgcgtcccaaaacgaccctaaaatacatcctctaaataatgcttagaataattaaaatccgtgtgagagcctcccccaattaaaatgtgcaaagttaaaagtcaaataaggcttggaggatttttgtatatttcctaaaagcctaaaatgcgtaaaggggatcctctagagtctccttgcaggcttgcnagcatgaggttgttcattcaaantcaaccca

SEQ ID NO: 66803 - DNA, 7406 bp, Oryza sativa
caaccatgtagatcatgattttagatgaattatgagacttaaacggcctcattccgatttcgtatgagttaattacgaattttacaagatttaattccaattaaagcctattaaagaaaagactattccaaattaattaaacaatttacaaatgatttataactgagataaaagattaaatcaacctccggaaatagattggatcatatttgatagatgacatatgttaaaaagaaataatatgccactgaaaaaaaagaatgggtttatatggctgagactaatcttgaccgagtcgaccaagatcggatggcttggattgacctggcaagcgagcctcacgacataccgattgaactacgtgacacgggatcacccaaatgatcaaccgaaaccggcgaacggaaccggcgctatgaacggttctaaactaaaggacgactcaatacggacgaacgaacgaaacacggggaaacacctcgttcaaacaaacgagcgaacaactcaacaacggttgtggctaaaccggtgagctagacacgattcacggtaaagccccggtacggcaaacgataggccggtaggaacctagggatgcacctacggctttacaactcggctaccgggctacggctaaagcggtacacggctgcgacacgacacagcagcgacggcaaacggtggctacggtagcgggacggcaacgacttggcacgcacgagcagcagcagcacggctgtagcagggagcggcacagcgacggctaggcagctagcgcagcggcgacgctagggcagcagctagcggcacagcaatacgacaagcggtgcgcacggcagcggcacaagagcggttacggtggcacatatacagcagctgcgcaatggcaacgtacagcggctaaacagcgacgcggcggcaacaaggcgccggcggcagcggcggtgcatacggcagtcggcaagcgacgcggtagcggctgctctagggttagagcaatagcggcggcgacatgaccgagggattgaaacctaacccgagggaacacggatagaagtttcaccgaaccaaagcgattggagagggagagatgacgacggcgacccggcggcaacacacggagacgacgacaacgctagacaaacaacgaattagattagattggattaataccctaggaaaaaatctacaccggtgaacgacataggagcggcggttgccggcgaaccacggcacaataatgcaaacggtgggcaccgggaggaagaggagattgagaggattccattcccgcaactaatttggaaagaggagcaatggggtggccggatttgaaaggaggaggcggcggcaacaggacacgggcacagcagctcggctctggctggaggttgaagatgcactgtagcgaggggatgcaaaacagacttttggctgggcttctattgcacagcctgatagatggagggatgcaaactagaattcggggggataaggccggccgaatagaaggaagaacgggccgaggactaaaggtgaacttttcctatttcggcccgaaaaggaaaagcggattttaattatgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattattaattttaatcatacaaagagaagttcagcaattatttaaatattaaattaatcattaaatggtctgattataattttgttaagtactttgagtgtccaagtattttcaggatttttcttgaaattatttgagtattggaagtatttttaacaattcaaagatcatttcagtgattattttaattggaaaaagtttttaaatccttccctaagtcgttgggccgatttcggcccaactctttctctctccgcgcggccgaaccggcccaatcggcccagcagccgccccctcctctctctctgtcaaagtctgttttgcctccctccttcaatcgggccgaggaaatgaagcccagccggaaaagtctacttttcctccctctgctactgttcatcttccagctctggacagagcccgagctgccaccttacgccgccttccgcctccaaatccgctccaatccgaccccgtttcttccggatttttgaggggttttgatcctctcatcctcctctatcttttcccccaagaatcggagcaaatcgttgggtattttatccgaatcaaactcgttttcgagtttatctccaaaaccgagttttgattttcccggagcgatttcttgcgggaggagtccgatctcttcaatccaaggctataaataggaccccctagtcctcctctttcgtttgccccctctcccgtcctctcccgtgacccgtggagccgtcgccaccgtgcaagccgccgccgccgtcgcttcttcgtcgccggccgtcatccgtcgtcgttcggcacttcggtgagcaccatcgggttcgtctcgtcgtcctctacgtgtacatgccctccaaatccgcagccagccgctctatctccggcgaggtcgccatcttggttcggccatgggtgatgtcagcatgacgtcatcggtttttctttttctcgtttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgattttagtctttttgctttagtttccgacgttccggaggagagcgttttcgttgagcaaggttcggaagtgtttgcggaagcccaaggcaagtcacacagatcccaaataaccctttgaacatgttgaacccgtttaaagctattattttatttcaactatgcattatttttgaatgtcatcgggtggtgaacctttccccgttaattaatggccgaagatgatcttattttcctatgggttataatttgattagcatgaaccttatataatggattggttcagctaaatgctatatgtaagtttgcttagctatagaaacattagataactaaaggggttaattataaactatattatattattcttattaattatggttatatttaatggtagctcacgatggttaatcgtgtgatgttaattaattgataattaaaacctggttaaggtgggttgtgagcatatggttttgatggttgtgctcatggcaattaaggaccggttcgcgagctactgttgtgagacattaaccgtaccaaccacaagccagcgtgggcaacggctttattttgtatagcatgattcatatagtgcgccagactgtgaagtggcgagaagtccatgggggtcgctggggagtccatgccttgtttataagggggtgactatgatccaggaacggtgcactgttttgagttgtgttgtgcaaagggtattgtcacgatttccccctttgcaatgccgtggtggtatttcggggcatagcaacatgtgtggaatcgtgtcttgtgggtacagtggtacacctctggccagagtaaaactattcgaatagccgtgcccgcggttatgggcgggttgagcaatgtttttcgtgattagtctcacacctctcacagtaaatatggatgttaatacttggtaataatttgtttagctcctggtttggagttagatctgtacagccgggtatggttgttcaggatggttgggcctgtgcagcatgggtgtgctgttcagtgttgattaaaatttctgattaattacttcactgttttacttctcttaaatgttttgctaaatgctgcttttgcaaatgagcctatattatgccatcctttggaatccttgtgcacttgcatatttgctgtgtggcttgttgagtatgtcatatgctcattcttgcaataatcatcaaacctcagttgaagataaagggtccagaaggagaagacgtttggcttataccccagttgagctgcctgtgggagtggagctgaagccatcgctagaccgttaattccgctgttgttttcttttctttgtaagtatgtaacgttattattatgatggatttgtatattaatttgtcagtttgtgtacctcggctgattcctggacgaggatttatgcacaaattagttcggaaattattagtgaatttccgggcgtgacaaattacttttcccaattaaattaatcactgaaatgatctttccattattaaaaatactttcaatgctcaaataattcaaagaaacttcttgaacatacttggacactctaagtatttaacaaaattgaaaccagctcatgcaatgattaatttaatatgtgaataattactgaaatattctttatattattaaaattaggaattgagcttcgaaaaatccgagaaaattccagagagtataattaataatggagaatttaataaaaattaaatccaaccatgctttatatttaggaaattttatttcccacatttaacttcacttgtaaattaatgaacatttaatataaattctattaataatttattaaataatttataaatcctgaaacggaaattcaggctataacagtgtcccacgtcgccgccgcctcctgattccacgcgcctgccggctctgtgtcccaggtcgggctccgccaccgcgctccgccgaccgcccgcgcccgccccctcgtctcgcgccgccgcctcgtctctcgccgctgcccaccgccttgccccgcacgccgccgtccacctgtccgccgctccctcgtctcacgccgccgccatccaccgatgcctccgccgtctagcgcccgcccactcgtctcacaccgccgcctgcccaccgcccggccccgcgcgccgccgtcatccaccgggaggcccccgaggtcgacgtggtcgcggcacgcagccccccggcggctgccgcctcgcctcacctcgctgctgcccgcgctcgctgcctccgccgcgtctgaactctgaaggagaagagagagaaagagtgagggatagaagagagagagagagagaaaaaactgacatgtggggcccacctgttttttaataaataagttgctgactggactaccacgcgtacgccacgtagaccaaaaccaccgcggattgggtcgagggggtaattcgtccggtttgcatagttggggggtgaagaatatccagttttgtggtttaggagagtaattcggacgaccgcgatagttcgggtgtacaaatacaaaccttatatacacaaatacaaactttgtatacgtgtatacaaattttgtatatgcgtatgcaaactttgtatatgcgtatacaaactttttatacgtgtattttttaggttttatacgtacgtatactaactttgtatacaccttttcagttttctctttctgttttagtttttttccagtttctcttttttctccttatttttaagatgtgcgtatgcaaagtttgtatacgtgatttttttctagtattgtttttgtttttttaatacgacatatacaaactttgtatacgacgtatacaaacttttgtatatatcatatatatatatatatatatatatatatatatatatatatatatataaacttggtatacgcgtatgtatatatatttttatacatataaaaatatattttttttatagtagtaccagcagtatactaatagtaggtactagtagtaatagtagtagtagatactagtagtagtaatagtatagtagtactactagtagtaattagcagcagcagcaggtgcggaccgcgcgaccagtctggtcgcgcattagctgcccccgactgataagagtacggcgttcttgccacgcccgctcgcatgacagcccggccctgtttcgcaaccgtatgatctcgccggtgtaggttgacatcatgggccgaaaccgaatcaaccccaacggtacggtgaacgaacgaacattaattactttacgagacaatcgtgccggcgagcacgtaagccgcgccgatggcgccctagcttctctagctagttctttaccatatatggattcatgcatggacacggcaagtaattaagttcctgaacaattaaacttgaggtcatcgttgtattcgtgtccttcgtcgatcggcctatatatatatgcaggcgtggcggtgaccacgcgggtggccaccacgggagaagatatatacttctatatacccctgcagcggcatgatcaccgtggcgtacgtgcaggccagtcgccatggcccaaaccagacgagaacgtaaagcaacgtcgtcgatctgtgtgcacccagccggcggccatcaccgacgttcaactgtgttctttcccaattttcctaacacctcctctcgaacatagccttaggctcagagatgctcgccgcaccctgcacgtgccaacggtcataagaaatcctcgagttttaaactcccaaccctttcccacgtgtgcaatacctcatttgatatttgattaatttcgttattacgtaatggaaaaattacaaaaaccaccccataaatcacttgaagtttaacatttcaccccataaatcatcttgttgcaaatacccacccctacttaatttgttgcaaaaaccatcctaatgtgcacacgtacttaatcaaatcaatttgttatcggtgctgtatggttatcacaagctaaactagccaagtaaatattgtccaagcgtttgcattagacttatttttcatatttgattgaacttttttttttcatatagcaaaactcagtgcgacaatgtttaagctctattttgcaattttatttgtggaatctcaccgaaaaatatgaagaacactctagaagtatttaattttggtaaagaccatattaacggctcacactttatgaaatcatattgatttggttaaacatgtgtttattgggatggtttttgcaacaaaactgagtatgtgggtggatatttgcaataaaataacttatagggtggaatgtcaaacttcaagtgacttatggggtggcttttgcaattttcccttacataattaatgcaattaatttaaacaaaacaagccaagcaaaagaagtcgagatcaactacatatatatgcacgcatggttagggaacaataatctccaacagaagtactatatatatatgccggtgtcaccgtgtcacgcgtacgtgttccggtgttcgttcgatgag

SEQ ID NO: 66804 - DNA, 29364 bp, Oryza sativa
cggggcagcagcactttttcaagcggtagccaagccaccatcagcaatatacaagctaaagaagaacagtgagcacatcagccatagccaagcaatctgcaatcagaagggtttgatctgcaatcaaagagaaaactatgtgccaaaccggtagcaatacaaatgtgtacagtacacagtcagaacaagagcataatttagacaaatttgtttgtcagatcaaatttttaagcaaaacataagaaacagcacaaaagggtatagcagaagcaaaatttggacacaatgattagggatcacttattcattatagttcttccatgctgctctaccacagcaaaacgtttcagacaccatcaaaccagacttaaggatacacattacaggtaaatagtacacaatgaaacgggacacgaccaaggaccagaccagacaaccatagctccattggggaagacaaataggcagacttgtgaaccctagaacagcagcagctccatggctgaggacttactggccaccacggaggcggagcaccaggtggagtgtggactccttctggatgttgtaatccgcaagggtgcggccatcctcaagctgcttaccagcaaagatcagacgctgctggtccggggggatgccctccttgtcctggatcttcgccttcacgttgtcaatagtgtcggacgactcaacctcaagggtaatggtcttgccagtcagggtcttcacgaagatctgcatcccacccctgagcctgagcacaaggtgaagggtggactccttctggatgttgtagtcagccagggtgcggccatcctccagctgcttgccggcgaagatgagacgctgctggtccggggggatgccctccttgtcctggatcttggccttgacattgtcaatggtgtcagacgactcgacctcaagggtgatggtcttgccagtcaaggtcttgacgaagatctgcatgcctcccctgagcctgagcacaaggtggagggtggactccttctggatgttgtagtcggccagggtgcggccatcctcaagctgcttgccagcaaagatgagacgctgctggtccggggggatgccctccttgtcctggatcttggccttgacattgtcaatggtgtccgaggactcaacctcgagggtgatggtcttgccggtgagggtcttcacaaagatctgcatctgcacacacaattaccgaagcatggtcagcaactatgaacatgaaattataacaataccaagcaagtacagcagaaatcagtcaatcaaattattccaatatgttagatacacgacctaaaccacaataacatcagtgtacctatcaacaccaacagtgacctaacaaaatagagagacgcaccgtgctcgagttcacaaaaataatctgcaggtctatgaactactagaattccatcggcaaactgattcaataactactagcactatcccgagagcacataaggcaggttaattaacataggctagaatttacaggtgcaacagttgataagataggcataagcaagtaaaatatcctgaaagctatgctatgtaatcactaatcaacaagacgcagcccttagattaaacatgaacagagtagaatctatgcaactagagggactgaatcaaaaacaacctaagcaaaatatacctgaagctgctacttggatcaacgagaaaaacagagactaaatcctactaattgaacagatcggaacaaatcacaaccctagcacagttctacttctagatccgaaccaatcaatacttggaccacgaacagcatcgctcataatcacagatccagcataccacgcgaaccccatctaaacctgttcaaatctaccacagatcgcaaaacggagactaaccacaacatctcacaatcacgaacaggccgggaaatcaaatcaaacgcgaggaacggagaggatcagaaaatcgcataccttgagaaggcgattcgacgcttcgcttcgaggggagatttttttttctctgcgattttggggttcgattgacggaggaagaggcgaggagggggtggggtatttataggtggggagggggggactcgtgagtgggcccaggggtgcggtgggtggggcccagtgagaatatagacaaataaagaaaggagagagggagaggcggtttggggagtccgtccccaccacgcaaacgcgagaaggaaagaaaggaacggaaagggggcgggtccagacggcgccgcggagatatcgaggaggtggaaagctgatgccgtttgctcacggcggggttggtggccgttaacacgcagcgaagcggcgttactgccgtgtacgttttgtgacctttcgaaagagagccccagcccaagaaaggctggccaggtttttttgtactgtgtacgattacgatggaagaaaacatactcgttgttttgtattggtacatactgggccgtagtaaaattagaatcagttgttaattggttattatatataccatcttaagctaccaaaattaataaagttgtgatggctatggtatattttggtagtgaattatattgatttggtatatattagaatcaatccaaccacaacacaaccaaaaatacctgaagctcaatattgatggtgcttttcgactatctagcaaatgtggtgaatggggctttataattgaagcagcccaggatgcactttgtgcagagactgatgtgatatatatatatattaaatttgtttggtgctatataagaaacataatatcttcgtcccataggtgtcttcccagggaaaaaaatatctttcaaaaaatcaaatagccaaaagaaaatcatgatcaacaaaataatcatcaggtcgacattcctgatggcacgtagcatctgccctggcctcccacgcgcaggcgcagcgacgtcggcgtgccgacgtgataacggagacggagggagacgcgcatctgccaacggctacggcgccgtgccttgcggtccaaccacaccccacgtctctttctctctctcctgaattttctttccttttttccatcatcaaagctgcatgatttggccacacgctggtagtaccagcaagagccaaggaccattcttgctttaataaaaaaatcaaagaaaaatcgagaggctgaggctgagcctgagggagagaggctgtggttttcgcaaaggcggttttccttcttatccgctggtttttggttttccctcgtcgtcgtcttcctcgtttgagaatcacagtgactttgcaatagacaggcattgcagagaagagagagattgagagagattcctatctctcatcttcagatgactgtttgtttgtagagattctttgcagtatttgcagctgaactgcatcaaaatttttaatcagatggtttcttgtagtgttagtttttctcgttgtaagtaaaggatttctagttctgtactcatgtactggtactgaaagtctgaaacttggcgtgccgcgttcagttcagttcagtagtgtctaggcaaggtatcttcagataatcagatgaatagcatgaacaaaaaactagtaactgaacactacatgattttaatcaatggcatgaacgaaaatagagaaacaatacatgattttaatcagaatgtcaacctgacaacctggatttgctcaagggctccatcggttgatttaataaaccaaagtcaaagctaaaatttgaattttcaaacttaattttaaaatattttcaatgtagtttttttaaacattgtcttttacctcctccgtcccaaaaaaacctaatcccagctacaaacctggacataggttcatagctagggtttgtctttttcttgggacggagtaatagctcattaaaaacacatatacaaaagttttacctgtaaatcaatttgtattatactccctccgtcccataatataagggattttgagtttttgcttgtactatttgatcactcatcttattcaaaaaaattatgcaaatataaaaaatgaaaagttgtgcttaaagtactttggataataaaacaagtcacaaaaaaataaataataatttcaaaattttttgaataagacgagtgatcaaagagtgcaagcaaaaacacaaaatcccttatattatgggacggagggagtattatggtttattagggaatgtgggtaactgatgaggttgcaggttgctgtcgtttgtcatctaatcctgctaatgctactagattttgttagtaaaattgtgctacgtgcgtaaggtgaaaggagctgtttgctgagaattatttttttgtttcccaagctgatcaggacagcatgttttacggtggctcttaagtcagcaaccaattgcttaaatgacacttgcaggtaaacaaacacgcaattcatcattgacttgtaggatcaaccgacgactccgtcgtaatttaatagggccatacaattgaaaacgaccctgcaactaatgccaaaccactcgtgacgtgttttagttggaactaatctcttctttgtactgcaagttgaagctaattccaggactaatagtagttaatgtttggccaaatggcgattaaaactatgcttaacgatgagcaagataagaacaatatgtgcattggatgactaggcaggtggcagcattcgttaggctcggttgaattgaaccattagttgcggggtgcatacatattgaacaagactattatgagcctccaagctggaattatgtggatgtttctgctttcgatttcagaagtctttcttatgaattgaatgttctaggataatctagaagactagaacgagcgttccatgaaaattctagaattagttccttcctaacattgaattcagttcccgtacctatgcgtatccatcgagttcctccaatgtctttttttttcttaatctcattgcgcaaattatttgtattttgagaatatgttactctcataacttatttgggttcagagacaatggcaagagtctccagcgattggaatattactgtgagtattgaaatggcacaccgcacagatcgttcttcttttgacatatttttttggacaaaattcttttgatctttgccacaaatcattattgtcggaaacaatatcttgatctagtagacctattttgtttcaataccaagatctagtagtcatgatcagagagtatatatttagaagtctgtccattcagattctttgacacaatgtttatacatgacatgaaaaatttcttcgacaatattgcttcttgtagccagctcttttggttgtggaaataagtagagaactacagtctagagacacactctgagcttctttttttttttgaacgaattacacactctgagctttcagccgaaaactaacaatcccattcatatttgctcttattcacggccatttctcttgttcagacaaaaagcataatgaattcaaggatatatatatataacgcaatgaactctccagtcttactatactgcaacaagcttccctgtaacttcagtaaggtaatgacataatgtcctactaacaatgtcacaaagtcacaggtctttttgtttcatcagagttatgcgcttatcccacttcacttcttttgcctcctcttcagtcttcagatagcgagcaagtgactcagaggaaaaggaagaacaatgcttcagtaattttctgaatttggtttctcgaacacagctgcttgtctgattgtcgtgctacatctgaatacaggatgtcttgtgctattgctttggaagatagctattgaaatctagctcaacatctcttaattctttggaagtgtactgcttcctgaccctgtactctactattgtagatcattcagataagtgcgatatttacataaactcattctcaaatcatttacttttgcatagaaaaattgctcaaaaacaagagattggacaggcatcttgtttttgtttcagactctcagttgcgctggtccattggttagaaaattaatcctcttggtttgcctcctagcagctatgtcaggtgtgagggccatggcgacggcgagccggccgtctgcattggctccggcagccggtggacggggagaggaagcaccgaagcaggcacagcgagggaagagaggccgatcggatgaagacactttggaccgctgtatagatggccatatgggccgagccttcccgtgcaggcccaggtacggagcggcccatctagccgtgccgtgcttgggccggcatggcatggcccctttctttttcgtttttagcgaatctcgtccatattttctcctatttcccctcatttctcctaatttcgctatgtttttcctaacttttttctgcttttatcttttttcctagcctaatatttcaaattatagggttaaatatatggatgggctggcaacaacccatgcacctctagcggtttgcacataatgacccgtagccttctcgaccaaggccacgtggcccagtacgacacggcctattaaccatgccgccatcggggcacgcgtcgtgctcaggcggggtaatccgttttgccacctatagatagctggtttcttgaggttacccttggatcgttgtctcaaggtgagagggctgtagtaatggtaagcttgtcgtcactcgtcagcaacaatgttagacctcgacagataggaaactaaagtagccacggcgagggaggagagaggcagatgcagatgagggtggttctacgaatttgttggacaccgatgtagatggttgtgaagcaattaaaaatggatcaatttgtacattattattataatcgatataattagtagcgactgaaatatgattttttttctaaaaataattatgattaccgccaatggtagcgagacaaatcaaaactttcctgcaaaatcataaggtcactaggaatagtagcgccacaattttcgctaccgatttagtgcgataggagtgaacaagcagcatatgactattgaccatagtttgatttcaatatcaaaagtttttgtgtaaattgtgatataaagggttgttgctacataagaaagagcatgtaggagtataaagctataggacttcaaagaagtttgaagcttagtatctataaacttttctttttataatcttctagttctcttatttatttagctgtttcgaagcttttgtaaaatttggctattaatatccaactgtaaatataaagacgggatttctatcaattatgtaaaagaatcctaaaattttaggaaatgttagatccaaatatgtggtcccgagtttacaacatatttgcaaacgaaaaataatttgtgaataaaacttttatatacgtgttcttagcgatctaaaagcaaaggctgaaaaataaacttcgatgagaaaacttcaaaatcaactctaaatttaaagttaaaaatttaaattttggctgataagcttaagtataagtataggcgagaagatgagaccacttatttgtaaaactttaggatcgcttcatcgccttatcaacattaaatacggagtacaatagatccggacgttggattaatcatgcacggtccggattgagtcgcggaagagatctgcattttctgcgaaaaccctcgcactatttctaattttattattacccttgttgccttcctccccctcctatacctcccctcggcggcgaggcggcggagctccggcgagcctggagcacgtcggggtttcccctcccgcggcctcgccgtatcggatcgccggcgtatggcctacgtctacctaggtattccttccatgcatggcctccgtgctccggctagccgtcccgcccccacggtcgccgccgtgtccccgcgtgctgccggccacctccggggcgcggcggtgcggcgggctcaagctgtaatcagccgaagaggcctcgatatcccttatcccaccacctgcagatagtgatacagtgctccaagtgtgcgctaattctctgaagtctgaacatgcccttggcaaccgatttaacccagtgtcagcgatactctattagttggtaggagtactactaactatgtcatattagtcacaattcaccaattctattgtcttgaattgcagttttttttggttaatttacaatttatttcccctcttcagagttcagatactatgcgaggaattgagagacagccgagcttcaggtacattctgaatcctccaagcttaccacacttcggttttcttaccaatattcagttatacggtatcagaaagacagcgaagagaagttggtgaagagtatcatattctaatgcgagattactcatttactctgttgcttcagccttcattatagtgctcacctaagcagcatcttaatataccaaccactacgagtacacttgacaagttgtcaatcacagtgtggtgattaatgacaagtattttaactttctagtttctacatcagtaaagtggttgttactatgtatgtagatagctagatgtggtgtgactgtcatggaccatatctgcaagtatttggtccaggaatccatcataggtctaagtatgttgcccacatcctaaattgcaaacaatgccagtggttgggtatagtaggtgcaaggcatgatcgttcagattagatctcgtcttcaggaaaaaaaaagaaaacaaaagatgagatgtttgttttgcttttggatgccatcatcttcaacttggtagctatgtttgtttgtttgtagcctgcaagaaactgcatctttcaattgtttgcataaagttccacaaaaagagcatagctgttgactagcctacaagttaatatcctgtattaacaatgtgtatctttcagcacaaataaaaatggagcatcttccatatcccaacgaccctgatgtagcctgcaagagactgcatatctcttctgaaactttgaaaatataaaaatatattgcagaataagagctttgctgtgatgactaatcttctctagttggtggtcccatgtggtcagaggtgtctctaaggaagctaagaaagagctgaactctgtgattatcttagtggcctgggaaatttggaaacaccggaatgactgcatcttcaacaatgccacacctagtactgctgccgtattggatgctttggcaagggagagtttattattgtgtactgctggggcaagagctcttcatgaactcttggcccggtcgctctccacctaggagcttagctcctgcgggagttgttgcgcatcgcctcggcgatgtttttgtgtttttctcttcttttttcagagtgttcctttgtgaagcactctgctgtacataccttttcttctccttaatgaaatgaaacgcatggctcttgcgtttttgagaaaaaaaagtatctttcatcaatacaatatgttatatactgactattccatattcatgataaaacggaccattttgttttatgataacaggtgtcccttttggtcgatttgaaattatattaagggacgtagaccaaatcactatgcaaatgaggaacaatgatgttctgaaatctgttttggatatgcaacttctatatttgcaaggtacctgcagcttatgaagcctgaaatcctggcaaggtactaatgaagacaagcagttccatgaagtccttatataacaacagtgaagttctatattgttttatgttctattttcttagttagtatcttgtttagagaaaaggctttacaccctgcttttttagtaagcaacaagagtacaggcatggtgtcactggggacgattccagcttaactcttagtgtttgcaggtttcctatctgttacgcctttaatatctcaaagagtacagatttaataggcaaagcccagagaagtactagcacccaaaaaatttgttgctgatgttgaactgaaagtaagaaccagactaggtaagcaaaacctatgatccacagaaaaaagaattaagtctgctcacaactacacttaggtgtcaaacataggttgctacgggaccactgaatttaatttaagttgataaaaagataaagtatgatagcagcatggaaatatttttagttaagaaaaatgcttatatggttttcctatatctaagtgtacgcttcagataatatctttggtccaaatttaatgtggtccgttttgggacgaggtagtggtatttttcatctaactgttaatgattgccattcatttttctacaagctttatcttcaatattatgagtctataacattctctattccaatgtattctacccaaaataattaggcacggccaagtacatagaggttattaccttaatttttacagttcaaggtcaagaccatactttataaccaaacatttggttgtttgatgattaaaaggaaataggaccatcagaccccatgcattaatagaggacagatttgagcaaaactcagcttttaaggatctaatctacctcaagcaaggctgtattctcttttcatgccaagtgaaaactaggcaggtgcacttgctccggcacttcattttcttcttcagtccatactcatgcaagtagcttgcttggatgattttgagtaaatttaggatgttactggagggcacaaaggaattcaggtagatcaagctattgtgcatgtaaaatgtgtatcacatagatccaacatttcgttccattctatttggtggagactggcccagaatacttatggtaacttgtcaaagacagcagcatgtgagagtgactatgcaacaaatcttttgcattggtaatatgcaactatctggagcagatcatgcagaaattaagcgctagcaagaaaatgtttagggagaaatggcatatttaagctcacgataaagtaatccttgaacattaagatcaagaacagctaaaacatcacatgttatcaaatatacacctgtcttatgaaatggcccaaatgagatgacagcagacttttggaataggaaaagccagctaacttgttagttgtcacctttatttaagtagtcttgagcttactcttattctcacactctctcagcccattctgttccttctcatccctctttctggtgtgtagtgtgtccaataattaggaagcagggctggttgcttctgcgataggagaaaactgcaaaccagtgtaggggcaaaaatggctgcctgctgacaagttctagttcacagtcaataaagccattcaccttggaagtgactccctattctgatcagcagtcatacacaaattcatgcagtgtatgatcttggtctccatgcatgaactctgctaccccacattctgaagattaactgatgcttagatatgtgcatggcaaagtaatacactagttcgtgagtatttccttcaggacacttatgttctttctttgtttggagtactgaggcacctcaccaatggagataaagatgaaggggatattcaaaggtttgaagataatctctcaaatattcggtaagcgaagcagattgtttatctttgctgcatctacctctattttcagtttttgatgaattagctgaaccacaatagcaatgcacagtttctataccattggttatataccagtatgaccattgctccctttcggttatccagcactgcagaagcaacaagagatggaaatcgggtgccctacagacgtcaggcatgtgtctcacataggcgtgggcactagtgattcatgcccaagctgggtaaggatctcatatctcatagctggaaggtttctccaagtaatcttctttgcaatgatctatacattttcctattctctggttgtgattttttatggcaattttactagatgagtgaattcagaggattggaagagttgtcagcaggctccatgggctcctttgcacagtcaaggaagacatcctgggcatctcaaggcaagtatctccctcgatctcttccttctgtccacttatgcgctcctttttcagtgtttgctcttcatgaagttttcagtcgggacgggacgctaatgatgtctgaaacctttgctcatgcaagaaagcataactagtcatgtacttgtgtctagctagttgattcagaatctacatactccagtacaagcttgaaccttctgttctacagtagtggcataccataccattgctctgtctgctcttctccattaattctggttttggaaacttcagcctagtttggtgtcaaggtagacttgattgtcatatcagcacttgcacccttttttgccattgtctgtccccatcctggtggaatgcgatgttcagacttgcagcgtcgccccttgctgactaactctggaggagtgatatgtcggatctttcgtgggaaatcttgtgttgtcaggggaccaaacgtcggtgagtgaggtggcgtgcctctctacagttcgtccactgatgcagctccgatctcttgactgagttggatgactgaattcatgctttttttcttctcttgaaagagtttcatcatgattttagtgggttatgatgtaaaccctgcacaatctgcttttgcccaacccgtttagcaaacagaatttcagaagtcatgagaaaggttaagtcctcaggagttctctttgcgattctcgacagaattgaactgattttcataaaattcatgtagaattcccatatccccgagaaggcctaacagtctttctggtgaatcataccattctttaacaaatcatgtcaccctacctcctctcatttcattatgttttgtctttgaattgctgcagattttgacaaaccaccaagagccacgctcccaacagaagtctgcacagacaaatccggccaggaggccgcctcctgctgccatgacatcccgagaggccccaagaacccgaggaggaagaaggcagcaagagcatcatccgcgagctccttcttgtcgaggtcaaggtcctcctcgtttgtgacagcgtgcggtgatttcagcgagttgcgtggcggcctccgagtcgcctagtttgaatgacagttcatatagttttctggtgtgtgttttcttcgtgctgttcgatcaggaggagaataaaatcgcctgaaataatcgtatgagcgttgtgatggatgctaagcgtctagattagggacatgtgtaatgtgtccatgactgaacaaactatgcattgtactgctttttttgagttttggctatttctgaagtttgaaaagttgaccggacctgaaaatggtgaataaacaaaaatgttccacctagtctgaacaattattctctgaagacattgtcagattttgtggatgcgcaagtcttttgtctattcctgaaaaaaattgtcatatttggtggctccatgctccctgccttcttgaccaatcctgaaactttttacagcatctttgagcattctaggaggacgcaagagcccctaccaaatcaaattctcagaatttttttttttactgaatgttactactgctgtttgttcagagattcctctcacaatgttccaacacacctactatattcgatccaggaggcttctgaaatttttctatgacatgaatgattgtcctttctgaactacaagatgaactcaaattcttctctgaatctctctctgtgcatagataagattagctgctcgccgcctatgcagagaattcttttctgaatccttctactactgccgaccaacgcatggtgtcgtcgcctcaagcctcgccatgtgtgtgggttaacatctcgacttctcgagtcatccctcatctgaaaatgacgttggatacgtatccaaatcgaagcattaaactgtgaattttcatgagcacttgtcactctgtcagaccatcacctgtacaacacatattatgccaatgaaatacccaattagtaataatcaaagtgacaacctgtggcaagtgctaactccttgtaaagtgacacgtccattgcattcagacaaagcctctgactaggcttattattaccaagtctccaattcattaattctgaatttctgtatcaccactacaaatacccagcaacccagctttgtctgatcgatcagatcaggcacagcactgcagtgaaatcgatcactagtcgtggtggtatcaactatcaagtgtgcaagaaaaaatggcgggagcagtggcaactgtcagtgtggggctcgcgtggttgggtctcatggccgcagcggcgagcgcgacgcagttcagagtcggaggaggcagaggctggagcgtccccgacgccaacgccgagccgtacaactcgtgggccggcaggatgaggttccagatcggcgaccagctgcgtaagtcgccgcgccgccgccgagatgatcgccggcgaggatttcgccggccgtgcaagcgtggtgatgatctcacggtttctttcttttttttttttggttggtgcagtgttcgtgtacccgaaggagatggacgcggtggtggtggtggatcagggggcgtacgacgcgtgcaacacgtcgtcgtcggtggccggcggcggcggcggaaggtacgacgacggcaacacggtgttcacgttcgacaggtcggggcccttcttcttcatcagcggcaacgaggccaactgccgcgccggcgagaagctcgtcgtcgtcgtcatggcagaccgcggcggcgccacgcgcctccgccgtcgccgccggctgtgcctcctcccgtcgcgccggtgccgatgccgagcccggcgtcgtcgccaccgtcgcttgcgccagccgccgccaccccgagcttggcgccgtctccggtagctacgacgccgagcccatcgccgtcggtttcacctatggcgccggcgcctgctccgacgacgtcaacaccgagctcgccaccggcgccagcggccatggcaccgtcgccgtcaactacccctggaggcgtggcccagccgccgccgccgccggggaccgatggggcgaacgcgacgacgccggcggcgcccgcagccaacgaccggagtggcgccgccgccgctgctccggtggtggccggcgtcgtcgtcacgtcgctgggagcatacatcggctacgccatgctagctatctgaagctttctgcttctgcagtgacgtgttcttttatttgtgcagtgtaaagttaaatgaaatcgagtggtatattgttacagataccgtagagactagagaggattatctctggatttgtttttgcattggtggaataatgatagtgaaataaaaatgtggttgagtacttgagtcattgagtctgcatgtttgcgttggaagcattgaagagttttttttctttcaaatgaaaaattgtgggatgatacaaaggaacttagcagaggaaaatggtgtaagtctaaaaaaaactcacgtatgagacatgactcgaacgtaggctagcttagtggtaagaacgctaccagggtttagaccagcctttgttcgaggcatgtctcgtgcgtgggttctctcaccattttccctctctatcaataacagctgctaagttctttttttatcatcccacatttttaaagcatagaagagtttagctaccaacgtaatgaaatgtaaataggttagaattcttgcaactagccaactattgctttgaagtattattttactaactttttggattgttgaagaattataataaaatgctattgcttctttgactatttgcttgattggttattgatccttactttataagttgtcctcatatattcttggtaagttatgaagagtttagctaccaatgtaatgaaatgtaaataggttagaattcttgcaactagccaactattgctttgaagtattattttactaactttttggattgttgaagaattataataaaatgctattgcttctttgactatttgcttgattggttattgatccttactttataagttgtcctcatatattcttggtaagttataagaaagcaaagttttgtacatacctccactcttaataaaatttggtcaatctttctttggctaatccggcaaaaagaaaagaaaagaaaaaagaaacaaaaagaaagcaaagttcctgtcgttgaattataagaactgtagttcgcttggagctgaagtgtgatctatcactaaaatgtcgatatgaaaataataaaatgaaaaggattaaattcggggccctcattacaccttgtatttctccttcgtgttttctaataatgaagatttgttttttaaactcatatatataaattctaaagggataagtctatttgacccccctgaactattgcgttcgtctaaaatacaccccttcacttcaaaatcagatatctatcccccttaactttcaaaaccattcaaattacccccctgtcttcaattgaagtggttttaaacagatctttaatccagcacatcattttgtttcactaagatgtgtgagatatcatggtatagattgaaactgagaggagtggtggctggtatatcggactcaaaaggagtggtgccttttatttttcgtttttaagggggaatcggatctatagttgaacttttttttcgtataagagagggaatcggatagaagtcggactttttttttaatttttttcgctttttttttctttcgcccggtttttttgaccagacaattattgttggggaatcagacaaattcatttttcccctgatttttcttttaccgcatcagatttggtttttcttttcttttttcgcacgttttcttctgcccgttttttttggatcggactattttggttttttggcccggtcttttttcgccccttttttctagataggacagatttgcagatttggtttttcttttttttcgcacgttctctttcgccctgttttttttgaaagaaccacggtaggggaagcctccaccgttaagattttatattaataaaggggaaaaaattacaataaatttaaccactgtaacaatgtatttctctcagaatttttgactctatgaactaaaagggagagatcattcctaaagagaactctccaagagggaacaatgttttcaaaaattaaactattcctctgcttccaaatgttccaagcagcataaagcaccttctcaacaaaatgggtagagttatatgaatttctggccgtgaccaacatttcaccaaagcttaaagaaagattccaaaccacactaaattacgcccaacattgagtgctaaaaggacactggaaaaataagtggagagttgtttcccttgatcctgttgaacaaagtacacagagcaaggaagcattttgaggggagcaacgccctattttttttggatcggataattttggtttttttttcgctggtttttttcgccttttttttctggatcggacatatttggttttttttcgtactttttttcgcccggtttttttattggataaatttagtttttttcgtccgttttttttacggacgatggaatttaagtagtagagataaagataaaagaggctactgtataacaacttctccgtgcttatcacctcgtccagtccagatagaaacctcaacaaactggccctagctattcgctcccgcagcattcgaactctttaaatcggaagagcccctcacccctcagctttcacccgcgccgccttttccaccaccaaacccttcgagtccccgtcgcagttgcggcattccgacgaacacctcgcgcgcgcgcgcgtcgccgcctccatctcctgcgtcgccgcggcgtctcacaccaacacctcgctcgctcgcgtcgcgtcgcgtcgcttgatctcgcaccgggggggagatgggcaggggcagagggaaacagcggaaggaggccgaggcggcgcgcgaggaggaggagcggcggtgcctcctcgaggcgagccccctgcgcaaggaggccgtggaggcgatgcggctggatcgcgagggccgccacgacgaggcgatcgcgcgcgcggacgagctcgcggccaagcacccggagtccgccgtcgtgctccacctcgccgccggcctccaccagaacgcctccacccgctccgcccgcgacggctccgacggccaggcttcggtgatgcacctcgtctacgcgcgcgacctctacgcgcaggccaagcgtctcgcccccaactgcgtccagatcgccaccggcttcgccatggcgaaggtcgccagcgccaaggactacgagccggatcgcgagatcatgcgtgccctagccatctcctcccccaccgacccggcggagaacaacgtcgcgttcgacctcgaccgcaccctgagcaccaccatggacaggttggcgaaagcgagggaggccgcgctcttccactctcaccatatcatgtcccacatgtccgccaagatcattcccgccgtcgtcgtcgacatgctcgacatctccaagcgcgagggcgcggccacggcgaagaagcaagcgaagaaggcgctcgtcgagcgattcggctactcggcgcgcgcgcacttgacccacgcaaagatcagcttggatttcgcgcgcggcctcgacccaaacattgacaagaagccgtttctgaatagcatcctcgacgcattgaacaatttggttgaagagttcagcaattcgcttgagattgccatgttccgcgcgaagctctggtttgtcatggggaagtattgttctgtggaagtggagtgtgaccgggcaatccgtatggaggagcctactgatcccagggaggaggacgtgcctcctggatctatccccggagagaagcctgaggataggaaatcttatatccgcacagagctcaaacgtttgcttcagaagcttgtcttggtgtgtagagattactggtgctcactggcaagcgagaagcaggacagctttcgattggtgggactcaagtatttgcacctacactttgttactttctatcaagatgaccatgaagctgcaaagaccatatctgatgcactcaactttgtcaagaaaaacaagtcatggaggttctggatttgtccctattgtgttggcaagaagatcccagacattgattcgctcttgcaacacatgcgcagcaagcatcccgaagggggtttctggacgaacctgcggcaagtttttgatccagaatcgatctctgatacatatcagggtgatcatttctcggacaatgcaacaatctgtcaagattcagaggagaattatgtcttacatttcaaaaggatggatgatattttcaagtacttgtttcttcgagcagctgataatattgaagaaaagccattttctcaaatacgagaggaaaaatgcagaaatggagtttttatccttgagaagattaagctaaagctgaataatgtccccacagatatttcaagctctgaggtttgagaatcttctgttttgcatggccttgtttcaacattgttttgttaaattcactcatactgacagccatctttgttatgttgcagttcaatgaggcttgtgctgaaatccgagacctgtggcgttattttcttgaaatctctcttatggattatcgtgtagccatctcaccgctcgcaatgtgtttcatatcggtatgttaagtctagagattcttgtttatgtatagttatacatctgatctccctttactgagtactgagtctatactataatcttaacaggaccagttactaacatgcatgactgaagataaagaggctgccagtaatagtattgatgttgctgctattaatgcagtatttccttttgttgatgtctgtcctgatattgatgcaatatttcctaacgttgatgatgcccctgacggcaatgatgctgatacatcaacatcaggttattcagaatttcggatcctctttcaatgcaacctgtcttgctttgatacatatcttgttatgttcatgcatctctcaaattatatattggcagaaaccttatagctaccccccaaaaagcaacccacatgacttttattcaaataaagaaacccaatagttacttcagtttaatttcataatgtgagaaatgcagtatctacgtttgtgcgaatgtcacattttaactctttctaataatctgcaacgaatcatcacattaaaatttttattaagaaaaccattccagttgtttggtagtattaacattacatagttgctttgttttcaggacaactttaacattccctatccaaaaggtaattatcagatggtctaatcatccctgaaaacggttaaacctctttcaattactagttgtacctctgatttatttgtcaatgtgaacatagtaatttatttggcgcctgctgtctgggtgaattctgctcctaccaaacgtcagcggcactacaccaatgaatgatgacacaaaagagggaccgtcgcctatcctcgatacccttttctgccctgtaccggagagcgtggaagtgtagaacacctgtttcttcgatgctctaaagtcagagcgctatggtcctttcttggctttgatgtgtctcttgcctacctccctgccttggagcatctctgaacgacaatccttcctgcactccctgccagccctccttcgatcccttgaacgattttggtgtgcatcccttggaacatttggaaatgtcgcaacaacaaggtcttaaacaatgtcgacgaacaaaccagtcaaaccgcctggtgctgcgtggatgatgtgctgcactggactggagctgcaaaacgatggtccatcaagccttggttgaatagggccgtaggttcttagctttttccagttcctaattccgtttcctcctcctgtccccctgtaactctttttcaatcacattgtaatattgcttacgaatatattaatataaaggttcaggctggcgtaagcccaccgtcgtttctgtcaaaaatataaatttcacaattatcagttgtatctgtgatttctttgttaatgtgaacatagtaatctctttgtaattacatgatctatccatggttttttttgccgggtcagccaaagattggctgaccaatttcttaagattggggagaaaaacaaaggaatattacagcgacattacaaacagcgtgaacaagcgaaagagaaagagacaatacaacaacgattactcgccgaattgggagaagatcccagctaccctccacaccgcgatttcttcttttatattctcggctacttgctccgtggtcatcgacacatgctgaaaaattctagcatttcgttccttccaaataagccagcaaattaacatgaaggcactgtcgaagtccactttgtagctcgtccgaaaacggcgtcgcgttgcaagccaccagtcagcaagtctgctgtcaccgtctgccgggattgcaaagtttgcattgcaccatcttctgatctttcgccatacctccgccgtaaaaggacaggttacaaacaagtggtggcaatcctcgtcttctctctgacacagcgagcagagggggtcgtgcggccaatttcgcttcgcaagattgtcggcggtgagacatcgatccttcaacgcaagccacatgaagaaacgcacacgcgagggggccctggatctccacagtagctcgccataggggcagtcctcagcagctatgaagaaaacatcataagccgacgccgccgagaatttcccgtcgcccgtcagcttccatctgatctcgtcaggcgatgggagcagggagaaatcgtggacctcatcccataactgaaaaaattcgcccattgcttcattggatagtgcaccctgcagaccacggacccatttgttgttgcacaaggtttagcaactgaaagtctagcacgccccacataagaaaacagcgttggccatcgccaagcaaagcagccgtgcccagtccagtttgctgtccaaaaatcagtgttttcgccatttccgacaatgtacttcgccactgatcttttgccgggtcggcgaaggagccgaccaaatttcattaagattgaaagggggaataagtacatattttacacgacattatactgtcggtccagaggttaagacccctggaaacaggagtggggaggggaagcaaagaaagaaaaactgcggtaatgctagggctactcctcacaactttcaaataccaccgcagttctccaaactgctacttcctctttgatgtctgccactagatgctctgctgttttgctcttttgatcaaagactctagcattgtgttctttccatattaaccagcttaccagcaggaacagggtgtcaaaagcacgcctgtagcgcgtctgaaaactgcaccgcgctagctgccaccattctggcagagatagattttgacgtcctgggggtggaaaactcacgttgagctaagacctcagcaaagaccagactctaatggtgaaggaacatttggagaggagatgatcacagtcttctagctctgtcaaacacaggggcaagcaggatcatgtggccatccgcgcttagcaaggttgtccgctgtgaggcagcgacttttcaccatcaaccacataaagaatctcacccgagctggtgccctagccttccaaatcatctccccataagggcagcgtactgccgtaaggaagaaaaactcataggccgatgcaacggagaattgcccattggttgagaacttccaaaggatagaatcctccaccccttgctgcagctgaaccagctgcagttcatcccatagggctagataatcgagcaacgcccttcctgacaaggagccctgcagtctcctaacccaagtattattggataacccctgacttattgttagattagctctgcccacaaaagaaaataggatgggccatctgctagcgatgctcccgtcgccaggaagccaatttcccctccaaaagttcgtgtcacatccatcgcctagcatatggactgcagttgagctgatgatgtcttgaagatctctgtccgtcccccaaccagccattgtccatggcctatctttgtgctccagtcttttgaaatcccatttcatccttaatgctttcccaaaaagatcgatgtctttaattccaaggccgccatttgaaattggccggcacagatccctccaagcaacaagacagtgccctccattaatctcttcctgccccttccacaagaatacgcgacggcgcctttccatttctttgatcgcccacctaggcagctgtagaacagagaggaaatggaccggaatggccatcaacactgatttgatcaggcatagtctaccgtcaggtgagagtaatttgggtttccaacctgcaaccttcttagccatcttgtcaagagtgggttgaacctccgctttggtaggcttcctgatcgagagaggtagcccgaggtaagtaattgggaaatcttccaatctgcaggctagagtgttctgcgccaatgtcttctgagactcagcacatcttatgggggtaacggcactcttggagaaattgatgtgaagcccagtagcagtcccaaacagattcagcagagcttttaccgcttccacctcatgaaccagcggcttaagaaagataatagcgtcgtcagcatagatcgatatgtttggagctcggttcctcaagtttactttgtcgatgaggccaatggtggtagtttgctagagcattgagtgcattgtgtccattaccaaaacaaagaggagaggagagagagggtctccttgccgtaaacctttctgcggcttgaaggattcacccagggcgccattcagatcaaccctagtttcagctgtcaagaaaagggcagccacccagcttctccatttcggcccaaaccccctaaaacgcagcatattcagcagaaagctccaagacactgaatcaaaggccttcgagatgtcaagtgtgaaaagaagcatcgccttgtgatttcgatggaattgtgtggccaaccccttcacaaaaatgaaattctcatggatggaacggcctctgataaaggcagactgggagtgagccaccagctcatccatgcgaggggcaagcctgagggccaaaatctttgttgcgagcttagcaaagctgtgaataagacttattggtctgaaatccttcaaaagtgtcggtgcatctttcttcgggagaagggtaatgatggccgtattcaagagttcaagattttgtgagttgcctgtgcaaaatttatgaagagcttctaggacttctttttttattacatcccagcatctctgatagaagaggccagtgaagccgtcaggaccaggggatttctcattctgcatggccttgattgtagcccagacctcttcctccgtgaaggcatcatccagctcagataagtttgccctagccaaatgaatttcttggaaaaggatttgttttaaatcaccctgtgaggcccccatcacatattcgaaatgggtcttcgccatctgttccatatcctcctgcgtggtggcaatgacgccatcatgctccagccagagtatcttcaatttcctttggtgtgatttcattttcatgaagaagtaagcagtgctggcgtctccctctcgaaggtttctgaccctggcacgctgccgaatcctaattctttcaagtgatgcaagagccaaacagcgccctttgagcgcagctcgcagctgccgctccaagtcagatagaattctaatttcctgtgccacatcaaaacggagaatgatttcattcgcaatctgaagttgtagcctgaaattactcattttcttctgaccccacttagacaagatcttactcaaccgcgccatcttgacatacagaatgcaaaaggggtcggtgctatccacactgcgctcccaagattctttcaccacttccatgaatccatctaattttgtccaaaacgtctcaaaccgaaacctcctagagataggtttgaactcaccacatgtcagcaaaagagggcaatggtcagagtttgaggagctcaaagcctgcagatgcgcctcaggaaagagatcttcccaggaggttgtcacaagaattctgtccagcttcaccaaagttggtctggcttgttcgctgctccaggtatagcgtctgccaaacatgtacatttccttcaattctaaatcattaatcttgcttcggaaggcattcaacagtcgtctattaatcctcgagttgttcttgtcttctgctgcagcgataaggttgaaattgcccgcaattaaccactcccccaaacaaatctcccggatcactgacaattcttccagaaacaaaagcttttcttcatcaccttgtggcccataaactgaagttaaggaccatgatctgttagcagccaaccagcacaaattaacagtaacagaccaagtgccaatatgaaccacatcccctcggaacagagcactcttccaggcaattattactccccctctagtctcctcagcgggcaaaaacacgaacccatcaaaatccagaccacaaagttcataaattagcgactggttgacagcggacaacttggactcctgaaaacaaacgacagaggaactagaggagattacagactctttcaccaacgcacgcttagcagggttattaagaccccttacattccacactaggaaactaaaacctaacatagggaactggacacacttcagattagctgaaaagggaaacaaagcaatcaggccggagacgcgacctccacccccggaagaacttcaggcagaggttgaaggggtgcggccatgtcgatttgcaacagttctgcaatggcctggacatgatgcggaggcagcggttcatcaaagagcttctcgaattcctgaaccgcttcctggtttgcctcttcttcctcctcaataattcccaacttcttcatagtcaccttctgggctttggagatcgtgtgccgccgtgtcccattcccctgcagagccaaccgcgggcttcgccatggcgtgaatccttctaggatagttgcacggcgtcgagtcctagtgactgggacagaggccggcggcccccctaggatggatggaggcggtgtggtggagatcgacgaaatgaaggccgagattctggcttgaacctccggtggtgcctcgttctcatcagtcgcacgctcttcgcgtgcccgacgaccgacagctgccagagcgccctggtcaacggccaccgcttgggctggacacctgcggcggctgtaaactaacggaaactccgtcaggccaacgggcctggtcagtcgcgctggagtggccaggagcccatcttcagttgccgggagcacgatagctgacagcccatctccgtctgcaggcccatctccatccgtaggcccatcctcagctgcaagcccatcttcagttaccagcacctcttgaactgtccaggccggctcccttgatggcccgtcgtcggtcgcaatcgcgccaatgctagccgagtcgccccgcgacttcccgcccagcggatcaagcactgtatccgacgtcaccgccattaagggcaactccaccgacgaaatttcgaactcttcgaaagacagccttctcaccaacggcaacacggcatgctccagcattaaacacgctggcgcggtggcaggacgctgaagactcgcttcccctagggaagcacatccgtgaaccgagtccaccgcgtccggaaggcccgtcgtgggtgtacccagcgctgtctccgcggacaccaccggctccaatggcggtaccaccgccggcacagcagcaaccctatggctgcctttaagccagggaacgatgtgaatctcatgttcagaatcgcctatcctgctcaaggattacaggccgattagtttggtgcacagtttctctaagttggctgcaaagattatggcacaacgactggcgccgaagctagaagcactaatcccttgctcgcaaactgccttcattaagggccgctgcattcacgagaattttgtttttgtcaagggcctggtgcaacaattccaccggcagaagaaggcaacgatgatgttgaagcttgacatttccaaagcgtttgacactgtctcttggggttttctgctgtcaatgatggagtttaggggatttggcccgaattggcgaagatggatctcggctgccctcctaactgaagaaacaagcattttgattaacggggtgctgtcagatccaattaaaccggctcgaggactgagacaaggcgaccctctatcgccgttgctttttatcttagtcatggatgctctgcaagctttggtttctcgggcaaagctggctggtttgctttcgcctctaaatgcaagaagagatttgctctcggtgtatgccgatgacgcggtgctgttcttcaagccaacaaccactgaagccaacactatcaagagattgctgactctttttggtgaggcaacgggactcaaaaccaacttctgcaagagcgctattacaccgattcagtgcagcaatgaacaacgagttctggttgaatccatcctctcttgccgagttgaagacttccccatcgtctacctaggcctcccgctgggaacaaggaaaccaacgaaagcagagctccaaccgatctatccatggtgattgtgtgttcttatcatccagtaactcctgccaatctgctgaggaaatgccaagtattgatgttcccaacaaagaaaacaaggacaaagacatgtttatcttgcatgtgatcatacaggtagtacaaagttgcatgcagtatgttttgtcatgtgctaacttctgagttctgattaactatgaacatgcgcagtcactgtggaatttgaggtgcttcagagatgagattttaagggcaccacctgcaacaatcctacatatcaaagaaaacttctgcatcgctgacctattctatggaatcttctttgcttgggagaataatgacacaacggagtggatgttttactgacctctctgaaggttaatctctgtaaaattgcaaatgataacatgtttcagaaggtatgtgggtttctttgcattgtcattgttccacacttccatatgcactggaatgaacaaacttagatatacgagtgcaatgttctttagttggcaagctctgttaatcaattcgttgctgtttttcctgattaacatgtaaagtgccgaactaatcggtcggaggctaccatgatctttattctgcttcagaactttatccttcatgtatatttttctgccttcacaaggttaaacctggtgaatcaatttcagttgcaggctggaaaagaattgcttctgaggttgtggcaacgattcttcaagcactgcatatgtcagaaactcctctgcattttgatttcaacagtgagattgaggaacgtgaagtaagtcctgtcagctgcggagattgcatatgccgaacacacgatctgttcgggattaagttccatgtgcaaatgagctgcaggtgtgggaagtgttttggtgagaaagaacatactacgattttctgtagacttgatgccagttcacctcaaacaacaaaggtgtgtcacatcagatttcctgtgtagctaaaattttatattatatgcaagagtagcaaatagttattgataactttttgcagatcgaatcctttgcagagcttccggttctctatgatgaacagttgtgctttggggacaattgcaagcattgtggaagtccgaagaacgttgatgtttctccttcaaacacaccacatatctttacaataggtaaaggtccttgtctacaatagtaaactgcaatttaatatttgctctctttttcctgcctaaacagaattacagaacatgatattggttgttcctaaaaaaacatgttattggagatatacatgacaaccacttgttgtaactcaaacatatcctgaaactttaaggttgacttctattaagtttgatacggtttgttattatgctggttaggaaggaggctttttgctatgttcttttatccttttggtttcctaaagttaacatcaaaatgtttgtttggtgttccctttttgccattatgctgcaggtttatactggtttggtgattgtgaaaaccaggttcagctatctgaagttctagttggcattgcacatcccattgatatcaaacttctctgcaagggtgttcactcctcggcaaaatattctctggcctcaatggtatgtgcaaagaaaacctttgactttttcatgaattaaattgttgatataa

SEQ ID NO: 66805 - DNA, 2437 bp, Oryza sativa
catctcaaattgggctgagaaatgggcccacgtaaaacttaattgtaggtcggcccatactacctcaattctggcccatatagaggcacgtcaaccacgaccccgtttcggaccagcaatttgtctccactagaagaagtctagaacagcaaaatccctcgacgacgacgaggccgaggtggcgccggcggcggagcagtcgagcagatagtgcaaacagtctcgcgcccgccacgccacgccacgcccggccatggctcgcggtcgcctcgagcgctcttgaaaatgagaaggagcgaaaggtttgactcgccgatatactggtatgattggtcttgagctccaagtgttcgatgaaaggacgcacaaaggaagccatgtgtccgttactgtcaagtatattcttggaactctgtagtctgtacctattatcaggtttttgagaaacatttccaggaaaatacttcagttgcaactatccattgaatacattctgagtcatatgaaccccgctttaatccaacaggatactgagattcttagttttaagagcagggagaaggtgtggggaaaatacgaataaatagcagttgcagggtctttatattttgttgattttctttttgtgctaatgggagcaaaaccagttaaaattcgtgcgtcctcaactatttcttacaccaatcttcatatcttcctcatactcacacaggtgaacaagaagagattgggagccaggcacctagcttaacaattgaattcacagcacaagctgagagcaaggatccgggggttgttggttcagcacagctgcacaagtggacattagaaatcagcaaaaaagatagtaagattctgttcgttgatcacaccaaattggtatgtttaattgtgtatgctcacaaaagagaagagactcaacagcgttaattattacatgatgagaaatacattgcccagttcacataagatgtctcgggaaggctatgctacccatcataacgggcgagctcgagcgccttctcgagattggtcacgaataccgaaatgggtggccgctcctcccaccgcagccgcacgcaatgcactgccgtctgcgccaccagttccaccgcctccagctgcctcggcgttggctccgctgccggccgcctgtccagcatcttccacacttcccccgcctcgatcagtggcagcgcgatggacaccaagctgcgatcagacctctcgtcccacttataccactcatgccattcttctgttgtcttctcctcttcttgtcgttcactctcctccttgtcatcttgtgtgttctccccctcctcttccgcacattcttctcgcttctcgtcttcctcaaattcttctgtcttctccctctccttccattcttccctattcctctccaccgattcttcgtcaaataaatatgatttcttcccggtcaatactaccatcatcacaacgccaaaactgtacacatcggtcatcaaattcagagtgcgttccatatggtactccggggccaggtatccatgcgtgccaatgacagtgtcagtctctgccttttcctcggtgagcgcaaacccgagcccgaagtccttcaagcgcggcgtccagttgccatcgagaaggatgttggatggcttgatgtcacggtggatgatcggctgctgaccgcagaactgcaggtactcgatggcccgcgacacacctagcagtatctcctctccatgcgtgtcttccaggatgccaccactggcgacgacgacgacgacgttgggccgtgcaggtggtgatccagcgagccgttctccatgtactcaaagacgagcagatgctctttctcctccttttccttccgggacggccgcaggaggtggcgcttctgcttctcctcgaccaacacatagtagctatatagtggaacgatgtgcttgtagcggatggcagagaggattgcgatctctgccttgaacggctccataccctgaggtgagttcagaccacgatgcttaatggcgaccacccgcccatcgggaagacatcccatgtacaccgagccgaagccaccttcaccgatctttctatcaggggcaaagttgttgcttgcctttgcgagctccttaaaattaagaggaattttatggtccagcaggagaggaggtaccaaaatcatgtacgtccattggaacccatccgacggctaacgaacgtcggtaccgccaggtaccgtaatgccgatgggcggtacctcccctccatccgcgttgtgctgattaagtggaagggcaaatctggaatttcgcatcgtacatctgtttctggaattttttttatttataattttttttattaaaagttttacaaaaataattttccaatttgaaaattgacggaaatagtcgcctaccgccctctgggagggcgattttta

SEQ ID NO: 66806 - DNA, 9321 bp, Oryza sativa
gtatacggaaaatcgcgtgcgcgagggcgttgcaggcccaatcgcggcggcgcgcaaaggcgcgtgtggaaaacagactcgggcacgggcctgattgttgcctgcggcaaggagcgcgtgaaaaggtgcgggcccaattaattcatgcacgtctcggataagagggacactctaacataagaaaaaattaaggaaatgatttgatagaaacataaaactaaaatcgattcaaatacggatgacgtatcataattctagcggaaacaactttaatttctataatactccattccaaattgatctacatatagtttttttgaggttattcctaaatgatctacatatttgtgttcatttattagagtctattcgttatttgtgcattggagtaaatggacattgatgcatgcatccatgcacacaagtatttataacccacatgcaatatcttgatttgctattggctaggaaatattggtgcatgcattgagtttgttgctagagtaaatatagtatgagagagttattagcttttcttggtctttgtgtacctatgaaatatgtagatcaatttggaatggagggagtagtagagataagcatacaaagttttcgccacaacacgtagtgtttcatctagttttcatacagtatcagctaccccattgttaacgaccaaatttggtaagatcgacatcgaggaggaagattagatcgaagtggaatccaagacgaagattatttcagaaacagagcaagaatcggctagagtccaaatcggttatgttcagatcgactgagttcgagttagataaggatagccgatgcagccgattctgacaatatgactcggtatacgtcatcgagttaagttggtgtgctttacggtgattgctacgtaaggatagagtcctaaggaggcgattgtatctattaattaggatattttatgtaatttccttagagatatgtttgggcaaaagtctgccgtaaagacttatgatatcttagagtttgttagagataatagtcgtgtccggtatggacatatcttgtaattctcgagtataaatagatcccgagccctatgtaataattaacacacacgttcaatacaattcggcgcatcgccacctttttttgctttagttttatttcaacgagttcttgcttttgggttgagctgcatcggtttcgatcttcaacaagaggtaaaacttgttatggcggcttgcgttctcgggattagtgcttccatctttatgacactctaatcttgtttatgtaatctgttgagttatcatatattttatataatctctaacaatatcgttatctaacctacaatcgaccagcatctgtcggtagattgcagctgatcaggttagatattgacgtttatttagattatataggatatctaccactctataaaacttccagtggcttgattgtctagatgttgttcttcttttcatacttaatgttgtatcagttgagtttgatctattaagtcgtgcttagaatatcaatttctagcctgccttctggttgccgattagggtagtatcggggtttcagccgatcttacctgatttaactacttttattccatgtgcatgattgacatgttaagtctgccctttacattaagatcttattatatttgagtatattaagcttttgtttgatatattttacttgttttaatatcttaatatagagtggtatcggagtattagccaatacatgctagatctatctgatcggctatgctatgaacatatatagttctattattaacatatatttcgatctaagtgatttatactttctcggcatggcgtccgatctatcccaatcacttgatttaagtatatgtcaatatagggagtatatattgttaatatctacagccgatcgagtagatttagtttttccttatttattcatgattgccgatcgatgcatatatgacatcggctcaaaggtaaatgatatgtcatcggcatctagccgatcggctatcgtttataggattaactgcggtttctttgtctttatttcttgttgattgcaggatcaaatcaactggcacgctcatacacccgaaggcgagttttggacctgcactggagttaagcaaatctcccaggccgccgtgttcgatttccacatcaacacccatgcgcttctatcaagagaagtaaatgctaataagtactgcctccattccaaaataaaaataactttgttttttaataaactgcttgtgtccagatgtggtataacttttttttaccgaatctaggtattttcagctaatcatatgcttaagaaaggaatctctaaataatttaaactttgatcactgaaataactaacaaggaatgtttttccataatctaattaatatttgctaaataacctgtgggaccaataggccttgccagcgcaagtcttcgtccaccctaggtcttcgtccaccctaggtcttcgtctgccctaggtctacgtctattctcgatttagtaagccaggtcttaattggggccactgccagcgacagtcgtaagtccaccctaggtcttcgtcttcttgtcggcaaactgtgcatgtgtacagaaaacgtacggagcttctagataggctgtaagttaaaatgtatacatggaaatttacgactgtgggagggtaaactcctcaagtggaggacagccgaggctccgccgggagtagcggatgagattcgagagcttagtgaatgaagctatgtaatgtagagggggtcgggccccttgggaacgatgagacaaaatgagtttatacgagcggcggacagcctccatggtggcaaggtgtggcctcccctcctcaggtcccgattggtggcgggcagcctaccctcttgctgggctcggtgggtggcagacggcctcaacaacagtgcggcggatgaccttccaatgtcgctacaccagtagctcaaatccatgcgtcctcgtcatcggtttcgttctcttatttccagtgatttttagttcttgatgctaatctgtgcatgtttgatgtctgtgtgttgttagatgaatggatgatggcgtggttgttgatgatgaatgagttcttggatgtggtgctcgggatgcttaagggatgttatcgcttgggatgtgttctctgtgttgatgctttggggatgttgacgtgggtgttggtacgttgatggctgatcgagccgatgcattgatcgagcagtcaagcctttttatgtttgttgcatatgcttcatagaagtcggttgttagatgcttcgtatatgtatatactaggtgattccccgcgttttgctgcgggaattactaagtaattctcaatttgttttacatttaagttaggagtaaaaaaataaaacatcaggatttattagtcaaatgatacccgtgttttaatgtgaaacatatcgataagtatatattaaatattgtaaaagtgatagatagatttatgaaaatattgtgcaaatgatatgaggggtgatgattggatatacttgtattttgatttatagaattaaataaattatagatcatgttgtatgcttgcatgagattaaacatgtaattattgctagtaggtgatgatgtggtatggttgcatgttgagttttaggcttagtgggcattaaccttatagaaagcatatatatgtatgtgtgtgtgtgtataaaagagaatgaagaaaaacataactagttacctagttagaagagaggagaacaatcctataaaaactgactgaaattaatttaaaaatataatagcaaatttgtaccaaaaattgatcaacaaaagctataatcccccctcccctccaaaaaaacactccaaacacttttacgacgtatttattttttatcaaaaggacaggagctataaactaacaaattaaggagaatagaacaaagtctaacatggatcaaagaaagaacattgaggagaaagaaggctaaacttatgtgatactttttaaattacttcattattcatacaatatgcatatgccatttcataaaattttaactctaaaattgacccatatgttagaaactaaataaacaaaaagataaattcaactggaaatattcacacgatagactttttttataaagcaccagagtatataaaaaagagtattgttgacaactaaaatttggctagatatggaaaataacctgagccttctgcatagtgcaagtccgaccaaaggtatacggccgatccgactagcaaccccaagaccgagtccaattaagtctattcttgtgtttacttacttggacccgatgttttttgattcctatttgatctctaaacccaataggatgtggaggaaacttatagatgcaagaccaacacttttataagggttatggctgatttaattctaacccctgaatcctacacttgacaatcaatcgaatcgttgtttttcctttatttttcaaccatattttctactttacattctatagctgcatatagtacctaattcatccatctttgtcaatttatggtgtaaatcatccgtcctcgctacgagagtgcgatacccagcccttgtaggtttgtcctctaaattgatctaaatcgttctaaaggctggtttaatctctcattggctccgctagtcgattttcatattttctaaacccatcctaatcgagagcttttctatatcgaggtggttgatgactttgttaacatctcaaatatttaggtgagaccgtgttaattgcaatagtctccaacacaaattgacgacactgttgatcgagattttcagccatccaatatggccaaaatgaatctagaatgttttttgattcctaattgatctctaaacctaataggacgtggagaaaacttgtggacgcaagaccaacccttttataagggttatggctgatttaattctaacccccaaatcctacacttgacaatcaatccaatcgttgtttttcttttatttttcaaccatgttttctactttacattctatagctgcatagcacctaattcatccatctttgtcaatttacggtgtaaatcatccattctcgctacgagagtgcgatacccggcccttgtaggtttgtcctctaaattgatctaaatcattctaaaggctggtttgatctctcattggctccgctagtcgattttcatattttctaaacccatcctaatcgagagtttttctatatcaaggtggttgatgactttgttagcatcacaaatatttaggtgagaccgtgttaattgcaatagtctccaacacaaattgacaacactgttgatcaagattttcagccatccaatatggccaaaatgaatctacaagctgaggaacgagcttagctcggttggaacattcgctgtggtgtgaacggtcggtcgctagttggactcatggggcttcacctcgatgggtttttcccgtcttttcttcggggttgtccttagggtagtctcgactagaaaatagggtacacatgcgtacgcgttcagtagcggtcctgagtgtctctactattataaaaattgaagatgtttttgtcggtacttttggtacgtcatccgtgtatgagtcggttttcatgttcgttcgcttttggaaacataaatccgtatttgagtcagtttttaagttcgttcgcttttagaaatatagaaggaatcgtataagaaatcttttcaaaaaactcgcatgctaacttgagatgatcagactgctgtttgcagcacatgattttctagcaaaatatatatccaagcgaatttaacacagtgaatttcaccttaactaaaccatatctctatctctatctctactattataaaaaataaatatgtttttgccggtattttggtccgtcatctgtgtttgagtcagtttttaagtatgttcgcttttagaaatacagatctgtatttgagtaagattttaagtccgtttgcttttggaaataaaaaaaagtcgtataagaaatcttttttaaaaaaacttgcatgctaatttgagataaatgtcagactcctaactgcttctcatgattttctaaaataaaatatccaagcgaatttccatggtgaatttcaccctagctaaaccgtataacaattacaagattaaaataatatttacccgttgcaatgcacgagtattttttgtagccttaaaaaaatgaatctacaagctgttaccgctgcatatattaatcagatcggcaagatcgtttggttcttgccgctgatctatccgaccgctttcgcggaagccggtctaacctacaccataataccagtccgaccgggatgaccgacaggcagcaggcaatatcaatctgttagtgtatgcgtgtgttcttaccgaggacaataggaaatcagcaaagttaatttttgatcaaattggctacatacaaacatcaagtgtaccaaagaaatgtttctgggctgaggttaatacggctgaaattaatcaagggaggttttctccgactatgacaagtgaagacgagaaggacatgctcaccatggatgactaaatattgaccgaggaggagcgacaagagcttcaaaacaagtggcaaagattgagaaggcaatgctcacaagctttatcaagaccaatcaaagcatctctaaaagagacttccgacctgctacctcgaatcgtcgtctccaaaagtgacgggttgcgactatggtgcattaccgaggcacgaacggatacagaacaagatttaaggagaaactcatctctttcttacttattcagtcctcctactcttctctttctctctattctttctctttcatctctccttctatcaatggtaatccagcgaggtaggaaggactcgagtcccccgcacccacgctggatccgccctgcgaggcaccaactatatgcatgaagcacgtattatacatataggttggaccatcaggtggaggtcagttagaggctggctgggttgacatgtggggccgattggcccatccttaggtcagtcgggcactcttgtgctctgttagtgattacgtttagatgattgtgactttagatggtttggattaactcttgatgtggatcggatagttggtttgagcaaatagtcagggccagccaggcaagaaatggaccatccgagctgcgcaatgtggtcggcctaggtggggggtaaagaaggccgacccatcaccctcttgggggaaatcaaaacggaacgggaacagctcgattgacagaactcaagccaaactgtaccaccttcctcggcccaaggactgtgagtcctctgggccgtagcgaacggcccaagatatcccaaaggggtttggagttttcttctccgaaacccctgttcctctcataccgcctcgccagagcgcctccgtcggtagcacaaacgccactgcaggagcgcaggtgacgccgcaacatctctacatattgatcctcgaggcctccctgcgtcacggtcgccatctgcaaccatcctcttcgcgcacacacgccgcgcggcggtcgcggacgtacgagacgacggaggagcaacacatacagagcgtcggcgtgggctcgtggcgaccgcgcatggccagacatgcagcgcagtggccggagacagttgaggagatgcaaattttgtataaggccctgtttagatcacactctcaaaaaattttcaccctgtaatattgaacgtttaaacatctgcatgcatgaagtattaaatataagctaaaaaaataactaattgcacggattgcgactaatttgcgaggtgaattaatcttttaagcctaattgctatttgatttgacaatatggtgctacagtaaacatttgctaatgacgaattaattaggtttaataaatttgtctcacggtttactgatggattctataattagttttttattagtgtctgaacactccatatgacaccctatataatacccgatgtgacacgccaaaactttacgcccctggatctaaacaccccctaagccttaacattgcgatgagtagggttccccttaccgttttcggcgtagttatcggtccaccgcggtaaggtggataccacggtaactgcgaggtaaccgcgagacattttttttttagaactagggccagaaagcccccatttctcttactagaaatgaaaatatccttactaagtcagaaaggcaaaaccaaagaagaaaaaaaaagctaaaaagcttatccagatgcctcacgggctggatggctagacacgattacatcattctgacatcaaagggataaaacagatcacaaaaaaaaagagaacatcttcatccttctatcctcctgatcccaggtctccatccatgtcttgagcaaaagatatcacttgccatctgtcttatgagtctagctcccaactgttattcagtttgcttccaacttctgcaaagatgcctaggaatccacccaggaacaagccataaagaccaaatcagtaggatctcttggaattttattctcaaagcatgttttattcttggacttccaaattgtccaaatgattgcagctaagccaatcacaatcaagtgtttcatgtttttatcatatctatcaagccagtgtcaaaaagatcatgatgattcaaagttggaattatatccagagcccaacacatgatattccagagtaatttagccaaaggacaatcaaaaacaagtgttgtatatcctcttttttgtcacaaaatggacatttttcatcccccttccttcaaccttttttgtacagatttttccttagtgggaattttgtttttaacaaacaaccaaataaaaattctaattttcagaggaatcttaaatttccagattctcttttaaggaaaagacacctgatgcattttaagggctttataaaacgatttcacagaaaagataccatcccttgtcaaattccaacaaattttgtcttcagagtcatcctataagatcagactttccaaactatttttgattctcacccaatctctcattttatctccatccagatcccttctgaatttgatacattgcaagcctttcattttcacctttgcaattgtcacatgtttggtcaaagttatgttatacagatttgggaactgaatgttaaggggttttccacctatccagctatcttcccaaaacaaagttcttttcccatttcccacttttttgaacaaaatttaaaaaaaatcatcctttacttccatcaac

SEQ ID NO: 66807 - DNA, 10462 bp, Oryza sativa
tctctctttctatatgggaacgcttgttataaaaatagtaaagtccatcaccggtccctaaacttgtaccgctgtgtcatcccggtccctaaactcgcaaatcgatcattcaggtccttaaacttgttcgactgtatcatcccggtccctaaacttgcagatcactcgtttaggtcctccaacttgttcagttgtgtcaccccggtccctaaacaggacggtctaaaaactttataccaaaaaataattcataactttttcatgtgaactctaataaagacaaactttatatcaaaattgtagccctcgacgcgacctacaactttgtagttgaaaattttttgaattaaaactgtttagggtcccaaaatattgttgcatgtttatagattttgtaattttaattttaaaattacattttgggacaaaaaatgacgttaaaataaaaaaaacgtccaactacaaagttatagatcgcgtcgagggctacaagtttgatataaagtttatcttcattagagttcacatgaaaaagttatgaattatttttaaatataaagtctttagaccgtcctatttgacccagatgatattcaaatccaagtttagggactggggtgacacaactgaacaaattggaggacctatacgagtgatctacaagtttagggaccgggatgacatagtcgaacaagtttgaggacctgaacggtcgatttgcgagtttagggaccgggatgacacaacgatacaagtttagagaccggtgatgtactttactcttataaaaatataactacgaaggcaaaagattcgattacaattaattgaatggatagaattgtttgacaaatcaaactttaaacttttctaaaagaattacaatcaaatttaataaaatttaaattaggaaaattgcataaaaaaatcatttggttttcctatttctcctctacctggaaaccaaaaggatatttttttaaagaacttcaaccaaattggaagacatgtgtccatggagagagaaggtcaaataccattaaaattttcatcaaatttaattaaaattcattttaaaatttaaagttggggtaatatatttatctccttgatttgtttttaatctaaaattgttcttgcacttatgcttttcaaattagctttttatgtacgaggaagaggtagtatggtcattggaaaaaatctaacggccagctaatagaatagacataaagtagatcaaaacacataagagagatgacaaactcaggggtatgaaaaagatatgagcatagggcaaagatttagaggcacaaaaaaaaattcccaaaaatattacagtatgccaaacaacattagtacggagttcttatgtcaatctattcattattatatactgtattacattattaattaaagagaagaccaaagcaaaaaaaaaaccacattaacataaaaaaataaatagagatagattatacgtacgtgggatcatgttataacgttctgatcaatgtgattgtatctaaactacaactgcatgcaaacttacgcgggttcgttacaataaaagaactcacctgaaagatactgccgtcttcaataatgtatccgtcaacgatctctttgcagcgcgctgttcctccaattgcaccacattttctctgatgaaccaatcccaagagtacatatatatgattttgtagattgaaattaatttgagaatagatcgaccgatacttcatgcaaccataccaaattaaaagcaattcaatcagcaatgtgtagtgtaacataccgcttggttcatcgaaaagatcggcctgatcgttccattgccagatgcagaggaaataagcacgaagcagcagctcatcaggagaacgccgacgaaaaggattgtggccatctcgacaatgaacaattaatagttggtcgtcgtatgattcgagtctttagatctgcatataatatatatatatatatatatatatatatatatatatatatatatatatatgtttttctatatggaaggtatgttttaagaaagaatatatgtttcctttgatgctgatcgaagctcacatatatgaattatattttgaaatatgcattatttttcgtagttttacacatatatacatgtttctaacgttgttgtgaaaatatacttttcccgctgaacgggaacgcgccaccgcaccggcggcgcagcttgaagacgcgggaccgtgtcagtctagcggtgccgcgatacagttgtgcggaaccgacgcagttccgcggattggttgcgcgggattagtggcatgcatgcattagcagtaagttagattacgtgcgtagtgtagcatcctgtgagccggcattccattggctggctcgtgcaaagcatatgcacgtaagcatgcatgtattggaggagcatgcgccatcccgcatcaccaatctgcggggacgcgacggtcccgcaggacacagccgcggcaccgcctcgccaccacgttcccgctctcccagaccacggcaccgacgcggtgccgcagggaccgcagtggtgccgctcgttcaacatgcgtgaacaacccggctggcggttacgtagcactcccgcattcccatcgtgctgtacgggtatatttgtgctaattcttcttatgcatatatataaatgcaaatcattccaaaggaaggtatattatcaatttttttccacatatatagcatttttatacggaaaaaatagcacgcaaactggccttacttccttattaatcgtctaatattgctggagtaactatatatacaaagctaaaaaaattaattgttgttttctgtgtgtatatacgtagactatgatatggaaaattataaacttccggcagttgttactcccttcctatcccttttggcggctctaacaggcctttagatcaagtttaatagtagagtcaggccatgtttagttcccaaaataaaaattttcacgctatcagataaaatgttaatttggacacatgtattgaatattaaatgtaggaaaaaaaccaattacaccgattgcgtgtaaattgtgagacgaatcttttaagtctaattgcgccatgatctgacaatgtgatgctacagtaaacatttgctaatgatgaattaattagccttaataaatttgtctcgttgttttctggcggaatctataatttgttttgttattagactatgtttaatacttcaaatgtgtgtccgtatatccgatgtgataaccaaacccaaaaaaattccccaactaataaggtctcaactgtgagcttatgttaacatgtaccagtagaagagttacatggttattaactactagtataattttcttctcttctctctatctctcacttccttcggttccattattcttaatgttgtggacaaagttaatgtcaaacttcgtaactttgattatcaataactataaaaatatttaatttaaagtaattaaaacaacacatatagatttatctttcaaagtacaataagaaaagtaaacatgcatttgtttattatatatattataatagaaaaataaagtcaaagttatattttggagaccgtgtcattatccaaaacgtcaaaaagctatggtaccggaggaagtatgcatttaggttgtgtttagatccaaagtctgaatccaaactttagtcattttccatcagagcaacatgtcatacacacacaacttttcagtcacatcatctccaatttcaaccaaaatttaaactttgtgctgatctaaacacagccttaatgtgttcttgaagtactccttcctcccatactccctccggtactgtatatacctcatgttgatgcatgttgaggaagcgagcatgggagtacttcacatgaggtgagtacttcctatactttatattgaatgtattcttgacgttttggataatggcacgtcacatgagcttggatcagatgaaattagcgagtacttcatgttgaggagtatgcgttatatcttggtactgtggtacgaatatgtgaggaatataaaatgaactttaggtgcaacctgtcaaattaaaccttgcacgcagaaaggccacgatccggcacggaagctagtgggccgggctgcaaattccatcttattttatgtgggcctaaacgggcccatctactagccgcacgggagaagaaaccctagaaacgcttacctcctctataaatccctgcgagagccgccaagccgtcgacgcatagcgcccatctcctctccgcccgtcgcctgtttcctccgtaatctcttcccgttttgatctcgttttcgtctgattgctctcgaatttggtttgatttctattgtattttcgtttcgctggtagacaaatagatgttggagcggtgatgagcaattttttgtggactagagtttctgatactacttttgtagtatttgaagaccaaacccttggctgtctgagctcctcattctatccatcgctacgaccattctgaattagatttagattgttttatatttctgtttgcggcagctgatttgagatcttggtagcggtgatgagcaatttttatttggactagagtttctgatactgctactttgtggtagttgaagaccaaacctttggctgtctagttccagatctcacaaaacatactgttgcttttagattattaggctgttgtttatccttcgattaggttttagatctcttgattagatgcgtccattaccaattccggaggattattcagttcttcacggtataatggctcggacgccagatgatattcttctgatgtgtggtcatatcctgattgttggcgttcttggtgccagtctaatcctggaaacgccacatatatttacatagtatttttttcgtttatgtgaattttgtcttttggggatctaaatgatgcgaaactctgaaaggaaagcgtccaatctgcggattgtggcgttccatgacatttctttcatattgaataggaagatctgatagattcctcaattgatatgattttgtttaaggttatttgctttgtgatttttgttaaattctttgtgcttttttttcagatgtggatgatgaaatcacaagtgaaaatacagttatccctgtctgattccttcataagggtgctgagaatactttaatctgacacagttttgatgaacctatatctccttttaaattctatggctgttcgtgcagattaatcttttgtgagttgaatgcgaattgttggattggatctgatgcctttgatgacatgatggtttcagaactggcacacatcgttgttgccagagctatgttgatattgctcatgaactaggacggtctgaggcctttccaatccgatactatagaaaaataagagttcaaaagttttttttctgagtatgttttattgcttgcttgctttgatattgtttctgagtatattttgccgtcccaactgtgcatggtcagaagtgaagaatcggcagggatttcatattggagcattctgcaatcagagcaaatggaccacggagaatggaatgtgtttgtcaataagtaaaattgtactaaagtaaattgtggcaaatctgtatgttgatttgtactatgtactggtatcttgctctaaaacattgttaagttttaccagcatctttgcccaaattgaattcgtcaattcttctctggcgtcttagacggaatttggactataaacaacaatttgctctgctggttaaatttcgtacttcgtagcctaagaaggatgcttagttcgtgggcctgcttaacgatataggtggtgttattaagagttccacgcattatcacaaatttgaaaaatagattaatcttatatttataacaactaactttaatatagaaggtttctacacgaaactttacggtttgccacttttatcctaaaaaatatgttcaatactcctccgatccaaatatataagcacgaagtaatattatgaatactgtactgtattggttccactaagacagaagcgaaggaatttcttttaaattgcaaatgtcataccggtattattcattgaactaaaaatgtggatttgtacatgttccaattaaaatcatgtgcagggcccagtatgaaaatggaccgatgggaggctgggagcccacctggctagtcgccaaatacagcccaatgattttttttttcgaagaataatcatactcgcgagatggatcatcagttaattagcgtacgatgagagtttgacacgcaaatgacaaatccgtattgcatcatggagggacaacttcaaataaacagtaaactttatttatttcacggacaaaaaaaatacatgtacgctacttaatagcgctaaatatctactagtatgacttaatcacatcctaataccctaaaccttgtgtatatcttaaaactcctgagactaaagaagactacggctgaagcagacgacaggctacggtgacacacctgccagaaacaaatagacaaaatcagaagatgttagatgagaaaaagaatcataaattttaacagattaaatttcagagggtttcaaatacgaatttacctgaatatttacgacgatgggggactaccaggcgctggagcagcagcagatgggctctgaggcatcaatggaggcaccgagggcgctgtcaaatcaaacaaaacaccagattagattaattaatctcttcatcaaacaagcaatgcatgaaaaaataaacatgtttcatgatggtttatactaatctcttcaatcaaagaaacaatgcataaaaacaaaacatgtttttacgatggattatgttatcttcaaacaaacaatgcattagaaataataaacatgctttacgatagggtttaattagggtgtaatttgattagcaagaacttactgttgcacatggagaacgtctgaagtgggaccgtggcgccgcaggtgttggggagcgtcatcatcttcatcatgtcgacggggagcgggaggaacttgctcaggtcgccattgatgccgtggcacaggcagatgggcgccgtgctcaccagcgacttgaacccctcgcagcaggtgcccggcggcgtctgcgcgctgctgttcgtcaggtagtccgcgcacgacatcatcgacaacagcggcgtcaagcactcctttggctgcggcggcgatggcggcgccggtgccgccggcgaggcgggtgatgcttgagacggtggcgagaccggcgagctggggaacgggaacgggaacgccgggaagccggacccagacgacggcggagcgccgcccggcgaggcgggcgcagggaacggcagcgggagcgggaacgggaaccggaagccagagccagccgaaggcggagcggcgccgccgccgccagaagagccgccgatggggatcagcgggaacgggagcgtgaggaacgggaagagcgggaacggcaagccgggtaatcccggcaatgtcggcgctcctcctccggtggcagctttggactccccggctgcggcaatggcaggctcggacgccgcttcatggttgaacccttggaccctcgcttctgcggccggtgccagcgccgccgccgccacgacggcgaaggcgaagaagagggcggcgagcttggacgacggcgccattctgtctcgtcggcgagagatcggtggtgggtggtgagattggtgttgcggctttggctgattgttgtgcagagcaacgtgggatcgctcgcaatttatagcgttagaatgtagagatttggagtttgaatgttcgtgtaataagattggactctggattaatttcttgtacgtaaaagcagattttagtttgaacgttcatgtaacgagattgaactctcgactgattttcgtacgtgattaagagatatctaatgaacttattacgggtgcaaagtgtatgatgttttctcatctgtgctttcgtttaacgttaaggatgcaatagagaacatcatgatacagcctgcaatcctgacgatctcaaactacatgggtgaaatttttcaaattttcagatataagttgacagaatttgtaagtttgcagttgttttcatacacacaggaggagaggagaacgccattgttacggcacatggagtctgaagctaatacttcgtcctgatacttatctgaattctggattacgctggctgaacaatttttgcgagtccaaccagtgtgaagctgtctcttttgttttgattgcctcgaagagataatataagctcgtagtagtaataattcttaatttctggtgatattgaggacatataactcttttttttcagataaaccgcagagtattcctttgttttacctcaaaaaagaaaagtatgtcgttgtccagagttaaaacttcaatttgtaattatcagaactatactgaagatacgggactctgcagtcctgaacaaataaatgccgtctcgtcatttggatatatcatatatgcatagttacggcaattgcgtgatgaagtctggagctgatacttctgtttgtaataaaccagagatttaaaccaaacacaagaattttgatgagtccaatcagtgtgaagttctatctctgggttcgcttgtcttccagatcacacagcttctagctattctgaatttagattgatattgaaaacacagaattcttcatatttttagataaaccggagtactatttcttttatgggaacagagagttttttttctatgttttcctccagcattggtcttccagaatgtttgggttaatgagaagcctaccaaagcaaagcgtttgtcgatcatttattttatagattctggagagtcccgtttatctgtttgaatcttttcttccggacatcacagatcttcaaaagttcagaatagatttggcttcgaattttaggatttcactacagcttgcaagctgcaagcaacaggggcatcaatctggcaagcaacaacagggcatcaacacgcatagcggttcaatagattacgtaactcgacacaggcagcacacagtaaaacatatactagcataaaaacctgagataatatagcatcagcactggcaatctggcacaagtcaaacagcctcaaaatcatagtacatctcaagagataagagataacaacgcattacaggagcaacagctgccaagtgccaagtcggcggctaggaagagaggacaaagcattactggagcaacagttgccaagtcggcgcagcagcaactttttcagccgtagccaagccaccatcagcaatatacaagctaaagaagaacagtgagcacatcagccatagccaagcaatctgcaatcagaagggtttgatctgcaatcaaagagaaaactatgtgccaaaccggtagcaatacaaatgtgtacagtacacagtcagaacaagagcataatttagacaaatttgtttgtcagatcaaatttttaagcaaaacataagaaacagcacaaaagggtatagcagaagcaaaatttggacacaatgattagggatcacttattcattatagttcttccatgctgctctaccacagcaaaacgtttcagacaccatcaaaccagacttaaggatacacattacaggtaaatagtacacaatgaaacgggacacgaccaaggaccagaccagacaaccatagctccattggggaagacaaataggcagacttgtgaaccctagaacagcagcagctccatggctgaggacttactggccaccacggaggcggagcaccaggtggagtgtggactccttctggatgttgtaatccgcaagggtgcggccatcctcaagctgcttaccagcaaagatcagacgctgctggtccggggggatgccctccttgtcctggatcttcgccttcacgttgtcaatagtgtcggacgactcaacctcaagggtaatggtcttgccagtcagggtcttcacgaagatctgcatcccacccctgagcctgagaaccaggtgaagggtggactccttctggatgttgtagtcagccaaggtgcggccatcctccagctgcttgccggcgaagatgaggcgctgctggtccggggggataccctccttgtcctggatcttggccttcacgttgtcgatcgtgtccgaggactcgacctcaagcgtgatggtcttgccggtcagggtcttgacgaagatctgcataccacccctgagcctgagcacaaggtggagggtggactccttctggatgttgtagtcggcaagggtgcggccgtcctccagctgcttgccagcgaagatgagacgctgctggtccggggggatgccctccttgtcctggatcttggccttcacattgtcgatcgtgtccgaggactcgacctcaagtgtgatggtcttgccag

SEQ ID NO: 66808 - DNA, 2608 bp, Oryza sativa
  unsure (1)..(2608): unsure at all n locations
tgattccctccctctttccccccacttttccctctctctctccatcggattcgttcgggatcttttcccctaaacctcgccggcgcatcaatggcggccggatcttccgcggccgtttccccctcatccgaccgccctctctcactcccaaccctatataaacgctccccgggcctccctccgccgtttgcgccactcgtcgctctctctccccgccggaatcgagctcgcgccgtcgctctctctctccgccgtcgccgacgagctccggtccgccgccgtcgtcgccccggaccttctcccgtttcggcgtcgccttcttcgggttcgccgcaacctcgccgacctcgtccacctctccgtttcggtcgccgaccgccggaacgccgccgtccccgtcgacccgggccgcgccgncgtctttctccggtccggtcgccgttcccgtcgtcgccgtcgacccggggtgagccgtggaccgccgaattcgcttccccttccctcccctctctcgggcgccgctccgccgcgccggtggtcgccggcggcgaccatcggggcgcgggtgcgccgccttcgggcgcgtgccgcggctgccatgtggggcccggccgtcagccgcccgcgccctcgggtgtggctgacgcatgggacccacagcgccggccggtgtgagccgggtgcgcccggtccaccgtggccccactcccgtggacccggtccgcgcgccctcttcccttgggtgacgcaataaatccattttaaattaaaatttaaatgaagaaattcgcaaatattcatttaaagagcatataaccttcaaatggccataacttggccatttgaactcggaattggaccgttcaagtctctaatttttccttaagaagtcaagaacccatttttgggctttgtttctacttgttatatggagtttattagagtaaaagccttttcttttccgttggtcgtgtagacgctgcagcttcggaagatccgctcttcgtggaagttgaagctgacgtttgggaaagcgagcaaggcaagtcacatcatccttgaacatattgaatcccagtttataaaattatgttgctttaaattattgcattatcgctttatttaaattcccgcgttatcactgttttatctagccatgcctatttacctttggtatgaccttattattattggtattggtattattaccttgttcaccctagattaaacaaaaccccaactagtggacactctactcatggtaccactagtatgattttaggtagatgcttcgctgtttaattaggtaacattaggtgattttacaactctagactttgggatgttcatatcacctggacactatggaatggtgtcacgcccggaatttctatccaaaattccaaacgcttacatgtgtgtgaaccctcgtccaggaatcagccgaggcacacaataacaaattgataatagagtacaaataatactctaattaataagcgaataaaatgtcattacagaggtagatagttcttctcaatcaataaagttctaagcagcggaaattaaataaacggcgcagacggctccactccacaggtagcttgaccaaggctacacctaatcctccacaccatcagcctcattgtagaactcttcttctgatgaatgattgcaaggtgagtatatgacatactcaacaagccacgcagcaaatatgcaagtgcacaggataacaaaggatggcataatatggttgtatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttatactctggccagaggtgtaccactgtacccacaagacacaaccccacatcatgtcaccatgtgcctcaataccaccacggtatctcggaaaggagttgtgacaatacccctcgcataacacaatccactgcagcccaccttactggatcatantcacccncntatnnaacagggcatggnactcccagccgacccncgtgggcttnatctnncgcacttctcaagctggtgcccncgcatgaaccatgctatacaaaagattaagccgttgnccatgctggctgnggntggaccgataattgttcacaccggaactcgtggaccgggtcttattggnatgagccggaccataaaaacatgttgccccaaaccaccattataagttttaggtggcacttanntaataactaatacgcatggccttgggaaccttcaatagacctctggaaaataggggggctttggtttccatagggcctagtgttaagcgggctatcattggtttatatctttgcccacttataaaggccacttgaaattgtacccccgtgta

SEQ ID NO: 66809 - DNA, 8817 bp, Oryza sativa
gcccgaggaagacgacgactgacgggtgggccccacctgtcagcgacagcgcgctcgcgcggccggctccgaactgggctgtcttgggctgagaagaaaagaagggattttggtccgtctttcggcccaaagccaaaagagactttttaaaacctttttcaatttaaattatttcttaaatgcaattccatttattaaaaatactttcttagctcaaataaatcccagaaaaatctaggaattatagaattaagcaaagtatatatattttgaattttcagggtgtgacaaatggtttggttattgtggaattggcttcacaccgctccttctattcaaaatccccaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctggttataaacaaaagtacacggatggagatggaagaagtcgggggtcgatggacatctctaggacaaatgaaggctacacgagctgtggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaacctgcttaacaactaaaaggtggaatggttggcctgggttggcttgggacgagctgggacccagggtcgggttgccagttcggtctgaatcatcgtaggccttgggttaaggcaggttcgtgtgggttcacggccttgataaataatattgtatagttctagaatcgtgtttactaaatagttttgagcaactaaatatctttaaatgctatttactgcaaccctaaccctttatagtataactcctttgtactcccttgcatttattctgcacttgtgggtgtgtcttgttgagtacggtggttgtactcagtcttgctcaatttttcccaaacccagaagaggagcccctgaaagatgaaggctttggtgtctagctcgtgcctgccgtcaagcgcctgtggtcgtcgccctagtcttccgctgtttctcatttgtctttgtgtgtgctgggccttcgctgcccatgtaataaattaactatttacgcttccgcttgttaaactctgaattgtatcaacttttggtgtaccttgcctcctgggacaaggattaatgcacgcacgtaaggaacgcccgttgggttatttccggtcgtgacaaggcgacggtggtgcaggagcggcagcagtcattgcctgtgatgaggatggggttgaagatcctgctgcaggaaaggccgcgctcaggattatgtctctgcggtgccacaagataaactgattcactgcatcaccgagaagttcaatcccctcaagtgtaggtatgtctagttccaaggaaacgtggttgctatggaccttggcgacctgtatccttgcgtaatcctcagggattgccgtgttgtggaattgacgtccgggtattgcaaaacccattgcaacctccttagtctttccagcgcgaccgattggtacgatgagactgcacggaggtggtccagttatactatccacagggaaggtagttgtctgcactgagcctacactgctgggtacattagttgtttgctgtgcggattgtgtgggttgttggctatcaaggaataaccttggaaaggctgtcgggttttcagctgccaacgagtagaagtgttccttcacttgcgcatagatcttgtccgataggtgttctttgtatttggctctcttcttataacttggtgcgtcttgtggaaacccgacctttcaacttgtctttgaagacaaaccccttacacgttcagagtgttcagccgtccccaacgccgcagtaagctgatctcgctccctccgtgggacgaactgtcctgatctttctttctcgactatctgctgcaaattagtagtcacttcttctatgtctggagtctcgaatagtatgtctccctcatccgagacttgacctgtgctacgcgcccaaacccagttcttgctacgttcaaccatggggtctaccagcaggggcttaccggccgcggcaaatctttgctcgatctcccgccattgatcgacgtgaccagcgtatgacatttttttcctcaaagccaatgcttcagctgttgtatgatccgcaacaaacgtgtcccagtcagcctgcgatatatgtccataatccgtaaacggtgggagattcttctgaacataatcccgatttagatcggactttcactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgtgtcctgactagagtgccacatgcgttgctgaacttggaccgcactatcggtggctcgacgggcttcccatcctgatcgagagcaatcacgttgtaagtttccttgggtaatttattcttgcttctctcaccacatctttttttcccactcccgcctgcacttgtagatgtctccgtacgttcaggtgcagacgtagcggtgtccatctcaacttcttgctctgtcctgttcctctcggctttacgtttcgagcggcgtcggactaccatctgcaaagaataggtaactctatacaccattaggttcatgtcacatcatagttagggaataatacatggctaacgattttcaacacttacggcctgttcgataggtatgtagtccggatcatcatcgcggggggcgacttgtgttatttccattggaaacgggtcacttggtgtgcgccacgtttcttcactagaagcgtctggctgcttattgctaccggaattttgaggagcgttaccttcttgaggcgctattggtgcattcgatggaaccttttcgttcgacatgttccaacttgacgtaaaagaatttgacataagtcccaattttacgtaagtaccaatttaacgcaatttcacataagtctcaatttgacataagtcccaatttaacataagtcccaattatacataaatctcaattaaacataagtcctaattatacataaatctcaatttaacataggtcacaatttaacttattttcacataagtcccaataacttaatttcacataagtcccaatttaacataattctcaatttaacataagtcccaatttaaacataagtcacaatttaacataggtcccaatttagcatcagtcacaattaaacagaaatctccatttgacataggtgccaatttaacaaaagtcccaattatacataaatcccaatataacataagtctcaatttaaacataagtcacaatttaacataggtgccaatttaacaaaagtcccaaatatacataaatctcaatttaacataagtttcaatttaaacataagtcccaatttaacataggtgccaatttaacaaaagtcccaattatacataaatcccaatttaacataagtcccaatttaaacataaatctccatttaacaatccacaattaaaccttctcaaaattaaacaatccacaattgcacatatcacaatccacgatgcacaattaaacaatccacaatccacaattgcacatttcacatttctttttttaaaagtaaatgttaccgagcgacggcaacggcgagggggtagaagtcctggcagcggcgtcggcgacggtgaggggcggggcgacttcggggaggagccggcggtagcggggacgacttggcggcggggacgacctggcggcggcgacggcaacggcgaggggggagaggtccgtgcggcggcgacggcgacggcgaggggggagaggtcctggcggcggcgacggcaacggcgaggggggagaggtccgtgcggtggtgacggcgacggcgaggggggagaggtccgtgctgcggcgacggcaacaacggcgaggggggagaggtccgtgcggcggcgacggcgacctggcggcggcgacggcgacggcgaggggggagaggtcctggcggcggcggcggcgacggcgtggggcggggcgactttggggaggagccggcggtggcggggacgacggcaacggcgacttgggaaattttggcagcctggcggctagggtttcgctggagccgggacttagaaaattttggctccccgcgctccctatatataggcgcagatcatcgcatgcaggcggcttaagggaccgcatggaaaaaatatctttccatgcggtcgacataagccggccgcatgcgaaaaagatctttccatgcgggctgttaagccagccgcatgcgaaaaagatatttccgtgcgggccataaagccggccgcatgggaaaaagatatttccatccggctggcttaagtcgtccgcatggaaagatctttttaccaaaaaaactcatattttttttctctaagtaaactgtccatatatatttttttcccaatatttcgccacaattatccattccaaatgtttttggcactaagaaaactcatgaaaattgctcaaaactcgtaatcaaatgttacatgctaatgattacaacataagggggacctaaattcatgcacgtacatttggaacacaatgagaactaaaggttacgaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacttgagccacacgctctgctaaaacccatggatcatccttgtggcctgttttactgtgatcgactatcgttagcccgtagtcatcaacggaaacccctattgtgtctttaacccattcacaacggagcacagggatctggatgtttaggccatagtccagttcccttatttcttgaatggtcccataatacgacctcttttctccactcgtgtcaatcgcttcgacacggatcctactgttttgtgcagtgcttttcatgtccttcgtagtcgtactcaaggtaaatccattgatgtcgtaaccttgccatgaattgacaatacttgaaggcccacatgccagtctttgtaaagtaagttcctccacagaatcaccaactggcaggtttagatctttcaaccacggaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattattgaagaactgcttcctaccaacagtaccccttccagacaatctaccttcatgtcgatgaacaggaatgccaatggcattagcatcctttatgtagtccatacaacactcgactgcctcttcagttgtgtattcctctatcaatgatccttccggatgagcgcgattgcgtacatagcctttgaggatcgacatgtaacgctcataggcccacatctgatgtaagtataatggaccaagttcaataatctgagggacgatgtgaacgatcaaatgctccatcatatctaaaaatgatggtgggaaatacatctcaagctgtcatacagtctcgatggcaaatgtctgaagcggacctaattccaaaggatcaaataccttctgcgaaattcgattgaaaaagtagcacaactttgttataaccacctttgtgtggactggtttgactgcccttatagcaattggtaggaacaccgttagcaacctatgacagtcatgcgcattgtatcccgaaatggtcaaatccttcattgatactagctttctgatgttcgatgtgaaaccagtaggcactctaaccccttgtaaacatttactgaaggcttttttctcttcaagtgtcaacgagtaacaagcaggaggaatctcgtcttaccatttggcagcactactgggtgaaggtcatgccgtatggacaaatatacaaggttgttacgtgacttcaatccatccttcgttttactcgggatgtccagcaatgtgccaacggtgctatcaaacacgttcttctcgaggtgcataacatcaattgcatgtcgaatctctaggtccttccttgaatctaaatatttgaagaaaattgagtgcttcttgaaaggcgacgcagtaccgttgtcaccatcagctttcttcctctttactgtcttcttctttccctttccatatacaacattaatcttctttgttatctcatacacgtatgtaccacctcttgctactggggcagtgtcattctccactgtattatcgaacaatctagccatcttacggtacctatgtctttgtggtaggaaccgtcgatgtcgcatgtacactgtcttcaaagacgacgtcaggtatctgtatgaagttttctccagacatatcagacatccagtcttccctttaatctgcccagataatgaaaagtttgcaggtaggtcattgatggtaacgaatatgatcgcacgtagattgaagtgctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatattcatgttggaagattatacattgtgagaaggactggccatgtgctgtgcgagctgcttatgtcaccaaacgggttcattccatcagtgctcaatgcaaaccttacattcctaggatccttagcaaattctgggtgttttgcatcaaatgtcttccactggcgagcgtcggcgggatgtcgaatcataccatctattttctggctctcttgatgccatctcatcaactcagcatcagtcgggtttgagtacagacgcttcaggcggtccttaattggtaggtaccacatcaccattgaaggaatcttcccgcgcttacccttatcagaatctggatcggtacactctgaatctacgggcccattccccattttataccgacttgtgccacacgttgggcaacattccaattccgcatattctttacggtataatatgcagtgattcttacaagcatgaatcttttctacaccaagagataaaggacatatgagtttcttcgcttgatacgtgttcgatggtacaaagttaggcttaggaagcaacacacgcaacaaactcatcagatcattaaaacttgtgtccgaccatccatgtttagccttcaatcttagaagttcaagcactgaacgcaagactgtgaaatccttatcacatcccttcgtttcatcgtaaagaagatccttcgatgccttctctaatgcctgccaattctccaatcctcgtgacctgcccgctagcacctctggtttaacatggcgtagcatatcctctaaatcaaaactaccatcgaaatcatcactatcggtggaaacatcgacaaccattctttcacgcgacatgtcttcgattataaaattctctgcctcattcatctcgaaacataactcttcatcgtcatctttcggattggcgaattccctgtgataggttcaaaccttgtagttggcggtgaatccgtactccattatgtgacccaatatttcaccaggatctaccaacaatttctgattcttgcaatgacggcacggacaaaagatctttgtcatattctccctcaaagcatgcgccttagccctgatcaataaatttagatgccttccttataaaatatcggcttgcgtcttcacatttcatacatccatgacgactgatccatctattatattaaggcaaaaagtttcaaataaaaaattgaccgaagttttcatacaaaggtttaatgcattgtttccaaaaaaaatccaccatcctgtacctggttgtccattgatacatgcaaaattgcccataaacttatttttgagcttgatttgcaaaataatagacaaaacttgtaaaatttaaaaaactccctttccccacgaatttacaaaaggggcaaataggaggatgaaggttctacctttggttgggtcaacaaaatttcggttgaacctcccctaatgggcttgttaggaaaaaaactttttttaaaggcaaactggcctgggagacatttggccaaattgattggcccttaacaccctggtaaaaacctttcaagggttttagaacccctttgaaaaacccctgcaaaggcctttttcagggcccttaagggcctgcctattttgccctaaagagccttgtttggttataaccct

SEQ ID NO: 66810 - DNA, 9028 bp, Oryza sativa
  unsure (1)..(9028): unsure at all n locations
tatcttctgccgctaccatcaatgccacaaaaatactctccagganctgaatataaagaaaaaggaattagtttgcgcaaattgattacggccaaacaagtgttaagaagtaacccagcactaccgcagcaagttcagtattgtgaaaaatcatataacagaaggctgtcctttacaaatcaccactatttgtatacacaacagtcagtgaaataaactgtcaccttctatataatacatatgatgcaccaactaatttttctgtcataatactacaatcgctggcattgaaaaattgcctctttgcagagtagcagtctgtccattatagtccgtttagcttgctcctctgtctcggagattacaaacacgataaatggcctacagctccaccatagaatatattaagtaatttataagcaaccatgatcttataaatccaattgtctggcagcaataacttgcttcagattgaacaggacatttaagcttaaggatttagtctctctctttttgtttacagccgcttatgaattttacgagtgagttattatgataacaaattccatattagaataggagctatatgcaatgcctaaagaagaagagtcacgtaactacaacatgtattttatgcctaaagaagccaagcatttctttactatgttttcctgtcatggcacttgtgacttttcatctctagtaacaacctaactagcatcttagtccaaaacggatacatatgggatgggggtaaattgatatatttcttcagtgccatactattccagttaataaataggatatgctggtacatactcattccaaatgcgataattctcaaaatactagagaaatttgatccagcagcaataagcttacttggattgttaactacactgtatgaaaacagcaaaggtataaataacttgaatatcctaattaaagaaataaattttaaaaagcagcttctggaagagccttttatggaattatatgggccggatctcgcaactccaaatataactacatatgcgaaatcaaaccaagcttcttaagacatccaaaatcttagatgctttccattcttgctgtacgcatttactttcgatattgtcaacttacatatatatgtcatgggtgttaccatcgaagtgttatattttggataagaggtcatataaagcactatccatacacaagatgccactgactataagaaaactaaattgctcctttcaatccagtggaacttccttctgctgatgagagactttggataagagttcataaaaaagactagccagtttcaaggtcaggaagagaaaggaaaatgctgggtttctaacaaacacagaaacattccttataaattttccgctttgatttcgatatgaaattgtttgtattcaatgcattgatttgaagagtttggtcttccattacagcaccccttaggaaagaggggtacatgcatcagatttttgaaagagcgctactgctaccctaatgaatacttccatacattctaaagttcaactgtaacataaaaagtttcacacccaacttttttcccattttagaaaagcaccacaacattatgatatgattcaatcatcaactaattccctatcaaaatatttttattaatgggacaaattatcttacttttgcagtattgataaaatgtaatttgaactattgaagaatactttggtttgaaacagcacagccaaacacatagttagttgaacataactacaaattcatcttttattgtaggatacatatgttgctagagctagagaaatggtcagcagaatagacaaatatctgtgtgccgatgtactctctatcggaaattcaaatattcagtacacattgaattattgagcttaaagaccaaaaaataattaccatcattgagcagcgtgcaaagattgcagcgccatttccttccagcatccgcgaatgttgcgtaagggtttatatatgttctacatcttcggcaacggatgacaccagctgacccaaagttgataaccggaacctcctgagtgatgagaaacatgaatgtcagaacaattctttgacaaagagggtaaaagataaataaagtgcctaaaagtcattaccccatcaggtgattctgcgagaggatgtaccacagccccaagaggcagatgccaccttgagaccaacgactgggatgctggaattgcatgggttgtcagccggaagtacctcgggtggcagttcaatggatatgcctccaaaaccttagttggttcctcgtcaccatccaatggccttggcagccctttgacgtcgacaccaggatcaagcgatcctggtgcagaactaaccgagagcgactggaagtcctccactaagctctggagggtgccccctgtaggaggcccaccagtcgcatatgccgcctgattgccaaaacccgccataggagggggcggcatggtctgcactggctgctgaaatgttggtcgtgacatcgggaactgttggtttgcaggaggcggaccaccgtaaaaaccttgcatgggcgggggctgtgattgtactggcggtggtggcctcacatacgccgagggtggagccataccactcgctgtaggtgactgcacgagcgaaggcggagggcgaaaaggcggctgtgcggatgcaaaagggccctgagacggcggcacgctggcggcaaaggggccctgagacggcggtggcgcggtgccgaatgggccctgagacggcggcggcgcggtgccgaatgggccctgagacggcggcggcgcggtgccaaaggggccctgagacggtggctgcggcgctgcggcgaagggaccctgagaggacggtgcactggtgaaggggccctgcgggggtggtgccgcggcggcgaaggggccctgctggggcggtccagcgccgaaggggcgctggggaggcgggggacccctgtacccagccattgccgcaggtggcgcggccgcgaacggcgccgcgggggacgcagcagcctgcgggggcggcacgaacggcgcgcgcggggcggaagcagcgccgaacgacgagggcggcggggcggcggtggcggcgccgggcacgaaggcggagacgggcctcccgggcaccccctgcggcggcctgtcgttccccatcggcggctgcatcgtcgggcacctgcagcgcggcgaattgaggaagggatcaggctttttttttctgtactcccttgatccgcgatctgatcccgcttcctcgggcggatctgaacacacgcagggtagtaggagaggggggcgaggtggggggggcttaccgggatcggaccgcggcggcgctccggcgagatgggggcggaggcggaggcgcgcggcgaggagggaggcgagggagatggagatggagatggggttagaagtagaagaagcctagaagaagaagaagaagaagggggatggatgatgacgtgggtgggtcgtgctcgtagggaggaagcgaatagtagggctactcttctgctgctgtcacgcgttgcacggattcgccttttgattccaaatcttacgattcatctatctcttacttttcctcatgaaaattcgatcttctcttatggttgagagttgatttttaagttttatcaaattgttatgtcataaagtattcttatctggtttcatcaggaaatatgttaaagtatgtaaattgcttgttttggtacagtaacttgactagtttataactttatatgaacatggaccaaaacaatccatgcgagcgaaattgatctaacgtggggcaacttggtgacacctttgcgagttagcagttgctttgttttgaaaaataaattgcatagcagttgttttgttttgaaaaacaaaatccacactctatagttcaagcaacctacaagacattgctatacgatcccggtaggggtgatgtcccgatcttcacggcgtaggatcaagaaccgataactagcctcaaagagaccaaaataactggctgcaagcagccaagataacagtgcaacctaacgatcgtgcttgaagccaaccaccgtctctattacggcaacctgaatagagggttcgcccaaccacactctaagttactaaccaacacaacttggaatcaatcgaggaaaaaattctcaaaaggaccagaagcaccaattggagggcgtcgatcgccgcttctgtaatctcacaaggaaatcacaaaagcaaagggatagagatctctctctgaatttgctagcacacagctaaacaaaggggttcatattctcattgtcaaaaagtcctctaaatgataaaacataggggatatttatactaggaacaatcctcctagataggaatgaaaggtcttgggagtttacaggagtccaggacataggctagctcaaaggtcacttatacaataagtgaattcccgagaggactcacgcgtctgtttggcttctgagcagttctcaatgatttgtccataactccttattgggaagttgaaattatgagccgtttgttagaggtgaaactagacttaattatctttccaaccatatatattaagcacggagaaagttgactggttgggtcgcacgagccttggaagttgagcctttgcagcgtaaagccgtaaaccatcttcttgttggcgtacatagctactggttgagcatgggcggattcctcctcgacgtaacccttgttgtcctcaacgtaacctatccttcttggcgtagtgataatgttctcgggcgtaaaccttagcaatacaaatgtagagcatttaggtagtataaaattctcactaaaatttggattaagttgagcaaagagcgagttcacctcttgttgtattttcctagcacggttgcgcgtaattggacatgatatgcttgatcgttcttgctgagacgtaatccatcacttggtttatgtcatcttcattttcttcatgtgatgtatgacgtaaaccatcacccttgtttacgtcaagtatagctgggatgtgctcatcatcatgtgacggaggctggggcatatcacattgcatcataattattattgttgaatgctacattctgcaaaactaaaagcaagttaatgtgctcatgtatgcacaactacaaacaattgccagcatgcatatgtttcattatggtactacacattatatcattttttgcatgtgtgttgttttgtactaggttcgcacgagctatgcaagttattgtacttgaatgagcactttacaagttgttgtacctatttgcacccacatcacaagttcatgtatcgggagagcgatttactcttttttattttagggaatatgttgaactatatttaatatctaatgatattgtttctgataaacttacattgaacggtaacggatacggtttagtacttgttcttatacgttgtttattttcgtgtattgttaactcaaaatcggctctttccttttgttttcttttgaagtctcgatttttcatccaagtgtttcattatagtataaggttttaattgttatttgtacactttggttatgagtgatttaaggatgagatatcttcttggactctaaattcaaattgagctacacggaagatacattttatgaaggatgtatatcaatatgaaagagcattggaataacgattacctatactcggtttgaattagttgtgcggctgtagctattggcggctcagaaaataggcactggcgcatgtttaatcgtgtattaagtactatagaattttgtggaaaaccatatttgatgaaagtcatgcatatggcttggaggagaactcccgtatctttagagatccacccctacaatatgggaagtattatgtcttctaaaagaacgttggactaaaaattatccctattgcacaatcgtgcatcccacccttagacctccgtctccatcaccaacgctgctccacctctacctctagcctaccacactgtagcctggtgtccgccacctccacctttagcccgacacacagtgcaccacctttgcctccttgcatcctcacacacaccaaaccgcgccgcccacaaatatgtttcatgttgccaagaagtgaagaggaaggactaaaggtgggttgttcgtcaagcctagaacttctatttggttatttgctagttgctattgcttgatgcactgtcatagtttgtgacttgtcatgtgaagttgagaactaagttggaacttggaattgttatgttgcaagtgcatggtgcttctgatttattgttgctacttgaactaagacaaaacctacgtttgtgttccctcattcatcatttgtcttcctaacggtatgaatgtaccctttttttcaccccatcagtgagagagaagagaaacaactttttttttgaagaaaacgatggtaggagttctaccaaaatttatagaagaagagaattgaccctgtttataaggaaaaccgggcccgaaaaccatacaactgcacagttttgctatagggaaaccgacaaaacctcacacagaagacaaagtgaaaagcctgtggcaaaacaactatgaaccatagaagtgaccgaggaaggagcaagacctttaaggcgaagcctccaaggagggaaccaacgacagaagccgctgctaacgcccgtccaaaaaaggactaggttttcacccaaaggaaaagagagtcaaacaagacgacacctccaaggaggatacggcacccgtaggtgtcgatgtcaccgaacctggaaaaccaggtagggctttcgcccgagactcccaagaaaggtgcaggacctccaacagctagagcgagagtgctaagtgttatcgttgcccagctcaacagctaaacccgatacagcagctccaactccgcctaagcactaaagctctagcacaacagagggccaagaagccctctccatactcgtcactacgaccggttcactaagacacagggcacttgaagcacaagcgaggccaaagagcccgaacaacaaacaagctggaccaacttcatggacgaacacaactcctcaaccacctaaagactccacgaccatggtctggaagcagaccggccaacagaagggaggagcatcaaggaaggtgaggaggtttgcctcgccggaagaggaactgaaagatgaagccaggttaacagagacatcggagtcttccatgttccgacgagatcgaggcggaggcatctccacccagaatcgttgggcttcgcgggagcacctcttgcaactgcgacgatcgcttccaactttgccaccaacacagagaagagttggggcgagcagagcaacagaccatctagacaacttgcagggaggtggcaacagaggtgggggtgtggaggagggggcggatgccactgagaaggcaccggagttgccgacgcgccccaccgacgacagccccaccggaccgccgagagggggacgcgcgccgccacgcatgcgccagccttctgcccgcacatgtcagccaccgccacccacacgcgccggcctcgccgccgacacgccccagccggagtagcagacgcctccgccgccggtcctacgccatgccaacacacctgagattgtcatgcactaacacaattgcccgaactctcgtagatgatggtaggggctgtaggatcgaaatacaagaaccaaacctaccagaaagggacgaatggtaggaacaccgaaaacataaacttttagcggaaataaaaatttaccctctaacctgatgaagtcctcggcgtagccggtctgactgcatgctcgcctccggtcaaaccgtcgggatccaaaaaacatgtattgacgaaactctagctagtgcgctagcttgccgcggcgagcgtccatggggatggggatggaggtgagtttgaggacgggaaacaccacagtggtggcttctgctactgctttgactgcatgctcagccaagaatgtcgcgaacccccgtgattgtgcccaacgtgcccttgtagttgtcgtcattacctcgccttgccatgctaccaatgtcgccgacgtcaagttcggcggaggcgaggtagggcacggagatggctaaggttgccggatccgatggtggagaggttgggaatgaaaatgtatgaggccaactgcggtggtgaggtcgctgatttgttccaaccagcctgatcatggttgctgctcgaagtgagaggagaggggagaggaaaagagaagaactgtcggtcacctcctcacacatttgatgctgcctaagtaagtagagatggggaggagccactggagcgagcgaagccaccggtagaaaaagaggagggaggagggagggagaaggaaaagtgggaaggagagggaggagactagggatcggacgtctgatccttggcaaaactccgaacgatgtttcactggatataaaaaagttgtttcagatgtttcactactcagtaaaatttgtttcaataaataaatgttttacatgtttcattgcttggtaaagattaaagaattgtttcaaccaaatataacatcagaaaaggctaattgcaacatcagaccctgtatgtgcaacatcaaagaagacataggccgataaaacagagtgaaacactctaagacaaccaaatgcaacaaaagaaataactccaccaatgtaggccaatggcgtcttgctccgccttatgtgcaacctcctcacagtggcgttgccactttcggcgagcttggagctctctctggcgacaacgcttaccactcaaccttgcacgaagcctccttgcggcgccacatccacaaagcctcctccttgtgtgcctccactgctgccggagagctcggagccctctctagcaacagtgccttctgctccactccatacaaagcctcctcatggggccgcagccgctaccaaggagctcgaggccctctccgacgccgctgctacccaagactcctagccg

SEQ ID NO: 66811 - DNA, 36569 bp, Oryza sativa
  unsure (1)..(36569): unsure at all n locations
ccagaagttattcacccggccgtgggccacaaaagaaaagggcgtaaacagggtccctttgagncccaatcacaaaaaattctccacatgggcgcagggtttttccctcttatggcacctctaaaggggggagcacttgggagttggattttttgggacaacggtacccataacgttgaaaagcctccttgggcgacatatcaaaagcctcctctggtggcctccgtcgccgggaagttggagccttctaacaaagtgcttttgtctcactccaaacaaagcttctaaggggccacaagcgcacaaagaagctaaggcttctcggacgcgttggtaccaaaactcataccggcagctcctcctggtggctccacactgnagagttaggctccgncaagcgcggaactttcctaaagaggacgttttcacttccttgcacacntcttcctggaagcggtggcancaatgagtttgggcttccacgagattgattcctctaaacaagcgcgattcataaaatcagataaagggattagggtagaggaagatgaaatgggaagaaaggcatcggtgcacaagctccgcccggatggttgatatgaagcattttcgaaaggaaagaggagggaaggggaaggaaaagagggaaagaggccaaataccaaaagaatatatttttttaatgcactgaaggattaattagtggcttatattaaatagttataaaattataatatcatctttataaatcgatgaattgcaatggcatattttattttcaatgacaatatatttacatggtacttaattagggtaatattaatccgggactattgtatgtggtgccacatttttcaataataaaaaaaattcaaatcttatatcgtaaattccatatattaatactataatttgaaatcttagaacattaatatacatttttcatgctcatgaattaggaaagaaattaattatatattcgattaaaaaacatattagttgaatgaaagtataaaaaagaaagtataaaaaagttaggaaaggtatcccatatccctgcgtaatttgtgcctaagaagaaaagattgaggaaatcccccgtccgctcgccgtggactccgactcctcgcgagttcgccgccatcgccgatccccatccatcccgcgagtagagcagagcagcgccgcagtcgttcgtcgccctgctgctgctccccgccgctggtgaggatccatccgatccgtcacacgcgtcctttttttttccatgtattttttttctcgaatctgcttgcggattaaccctagcttctgttctagaaattatttgccttaaaatcttaatactaatagcactttgtttgctcccaaaaggattggggggttcaactgaaccctccatgttcccatgttagatccgcccctggattcagtacttatagcactgcatttctgattggatgtgtgtgtcttcatgaagggcttgaggaaatcccaggattgcgctcgctggcgtcgcgtggcagctccaacaagttgaactgtattgcaggtttcaggtaacttgttcatcttttttaacattatattaagatatgaatgatgtcccttgtgcaaacatactcattgatgcatcttatttttctcaactctatgtttggtttaacattgtttatttgggatcccaaattgtttagatagttcagctgaatgacatgtgtattaccaaccatcaacagattggaaagctatgctatcatatatagcaaataactcatcggcaactaggaaacatgttaaaagttaaaacattgggaatttatgcatgtatgctgggagccactaagcataggtcttggacttaagaaggaataagatacattaagatatcttgtctctctcgtataagttcatcatttatgcttagttacttttaaccctctgaccgcagcacactcactgttttttttttgtgccgtcagcacactcactgttgattggatgtgtgaaatcaacttaatagctgttgattcaatatatgcaaagtaatggtcttaattgaaatctgaacccatgcattttattagaaatttgaggctgcgttgattgaaggtgaaaagctgcttcttatgtataaaactgttgaagtttgttagcctctacatttgtctgcttgcatcgtatgggcattttcttatagcaaactgtatgcatcatataattatagtcccaatgctgaatgcagatgcggcaattgttagatatgtgcactcaatgctagttttaacttgctgttacttttcagtgatccttgaacaagcttattgaagatgccaaatgcagagagcagtttgttcaagatgccaactgcagatgcaaatattgctgccctgcacaaggaatgggacgatgcattgtgcccaatttgcatggatcatccccacaatgctgttcttctgctgtgcagttcccatgacaaaggatgcagatcctatatatgcgatacaagctatagacattcgaattgcctagacaggttcaagaaaatgaaagtagaccacaatgacggttcgtcacagcaaagttcatcgttgcctagggacataagtagccaaaatgtaccccagagatctcattttgatcccactggagaaatccaaacaggcatatctgaatcccatgaaattttcaatcatcgagatgctatccaaagctctgctggcctatctggacagcagggagaaaatagctataatcaagatctagatttgactttggaagctcagcaaagagagagcagtagcactgtggagtcaagtgaactgacacgcttgaaccaattggcatgcccattatgtaggggcactgtcaaaggctggaagatcatcaaagaggccagagaatatttggatgagaagtcgagatcttgctcgcgggaaacatgtgcattttctggcaactacagggagctccgtagacatgcccggagagtccatcccacaacaaggcctgctgatgtggatccatcaagacgccgtgcatggcaccgcctggagcaccagcgtgaatatggtgacatactaagtgcaatcaggtcggctatgcccggagcagttgtgtttggtgattatgttgttgaagggggtgacatgttttcacctgaccaggaaggaggcatgccaaatgaaccaagtggatctttgttgacaacattctttctgttccatatgatcagtagtagtccgatgagatcaggagatgagataagaggctcatcgaggggcctgagaaggcagaggcgccgttatttatggggagagaacttactaggtctccaatatgaagacgaggacgaggacgatgaggaggaaaacctagatgaagatgttcaaagaccaaggagtcgccggagatttgtaagatcaaggtcggaggagcgatcctaatgcaccacctgggtaataaaccttcgttgctcgttgtgaaattcgatcaccatgaatcgttgatgattccttgcatgatcctaaaaaaatgtcagtggactagtggagttgcaggtggtctgctgctttgaatggcaacatattgtgttcatccctgcagtagaagacccgaggcaaatgggttaattggattatctaggtgcattccatccgtgttgtgttcacaaagccttctgtaatatgatgtaaagaatagctgaaattggcatgcttagggcttgacacttgctcaaccaaaaatgctcttaagctctgttggtgttgtggagatgcatcataagcagggctgcctcgtgagcagtttggccatttgttgtatagagtatctgcaaatacattgaaccgaatttgttcgtgttgctgctgttctactttgaaatctttgttcaatgggaattttagaatcaaatttcgtccaaatggttgtgcgcgtttgacaaaccgactgaaatgctcctcatcaaatgcacatgtggtgtatttacttcatttgattgagcaagaatgaatcaactcactgataagagcatccctatcttttactgttgtgaagctgatataccctgacgctgcaacctttagaagaatagtttccatatttatacaacactaatccttctcttctttgtattatatttgcttataaaatacaaggtctttttagaagaaagagcacgagtcgtcagatgtgtgaggatctatgacagacttctatacacacacgatgagttattttttgcaaaatagcctatcacgcgttaaatttttcgaggaaaaaacaagaaaaacagtgcacgaatgggtgttatcaccggaggattgttgccaatgtttgctgatgattatctgattatcaatttagatattctgccttaactgtagcgctaccaagcattgaacacgcagtgacaaacaaccagctgattaatcgttattggcaacaaaagaaaggaagaaaccatcaaccacttacaagtaatcaagtagtacaacttaataatacagataaactagtccatgtaagtttgcaaccagttaaatactttagggaacatatgcactatacaaacacccaattaatcttgcctttccttgctggaccaaaaatggttttgcaagtgccaagactacaacttcttcactgaccaatcaagcttcttatttcaattgcacggcataacgatctggattaatataaaattgtattctccatgcttgcctctaaattttcctacaaatgaaaataaacatcatcagaaatatgtcaatataatgatgcacagctctccaaaaaaaaggtcaatataataacagcagctacacactatcggtgttcatgtttgcattactgagccaagccctgcaccttgtgtcataactggggattccccagaaaaatagaaaaaaaaatcaagcatgccattttttagtctgctttctatatttttaattattttcaagagtggttattgaaactcggtgataaccgtgaacttgtgccgtaaccgagtgccagacttatcctcttaggtttttgccttctttttgtatcatctgtaatttgtttggttttctgaatactgagctatcacaaactcatgtattccgatgactgcgtagaaaacagctcgaatttggacatatagaccaaaacagacacactcgggaaccaggaaaatttccatcagaagcagctacacaataagattgactgtcctctttacatgccgcgattattaaaagatattacttaggctcagtttatggttgctatgctatgccatgctaattgtgcttggtttttaagttgctgtagagatgtacatttatagtcattgtagtcgtcttacaaatcaatgtaaagttagagaaaatatgttaagcaactgtcatgtctcccacaattgcttctgctacttaaattaaaagaaaaaacagtctaccaaatgccaaaactactagaagcagtcacactaaataaaattatcataatccacctcaatgtcaaacggaaccttagttgatatcacacagctttaaataaaaatgcacataccattgatttgaagtcatcagagtgtctagctcctgttccaaaaaacaatagtctagcttcatgtgtcgactctgcatttattccctttttggcacatcgtgcactttccttttcttcataaaaattaaaatcgtccagaagtgacgtttcctggtcataatccttgaaaattttcaacattttcagaccctggagtaggccaatctacataacgtgaaaaaggatatcagatcaaaaaggtttagaaactaagaaattacaaaattaagtcatatgaaaacatattaaagagagcacggataaatgatgtgagatatagcattcattatcagatagcaccgcctttgttcacaggaggaatctcagtacacctgctaccatggaatttattacagaataaacttatcttgaagtgatgtgctatgtaccaaaataggggaaaccatccattttctaaatgaaacaaccatacgtgatggaatttttcagcacgaaaaaacaaagaagtggatgcatggtacctcctgagtgtccctgctgaaagtaacaattctgttgtcattattttcaagagttatatgtttgaagagcctattcggaatgtcctttataatgtgccaggttacagggaaaaagccattccatctatctagtttccaaaagtccatggtcttcttgaaatcaacagggcctaatatctcagccaatcctacaaactggccactggaattaacctgaaatagggaacacaaagaagcaactatcttgaaattttgccaggggatgaagggatgcatgatataaaatagccatagtaccatccagcgcaaaaggtgtgtaattcaaactttcagcagcacaaagtatatgtggtggattaagtctctctcttctggagaaattcatcacaaaatttaatggcagatgtatctgcaatgtaatttcaagtaaaattgccttttaaggagatcacacgatacagatgaaataatcaacccgtcgaatatactaataaagatagcaaatatttagaaagacagaaaagtcaaaaacgtgctagtaaacagcagttcaatctcataatagaaacttgccgttatgtcaactattttgctcaaacatccattattggagatgggttttaagcgtaccagcacgtgctcttgtttcttgtatgaaatgtattttttttttccacgtgtaggttgtagagtgatagattacactatctatgtaactatgctgtcataattgtttcataaccatttggattacatgcaagaaaatgaggacacatgcccttaagggcttaaaatactaaaccatgaaaataaagggccatataacaagaatagaatttgatcactaaccgaaaagaataggaagacagggcactttttgcccttttccttaattaaaatctgagcttcacgaaaagctgcatccagcttattgttcccatgtggtgtacttgcccaaacattgtatttgatacctttatgaatatcatcttcactatatgactttatcataaagaacttggcttgttcatactcaactataaagtctggtctgttaaactgatccctacggaccaaaggacttctgatatcttcctgtatcttggatcttgttgcattttccaatttgtttgcacggggaccacgaacttgctccaatgtatcatcagaatgtttgcatacattatcgttcttaatagtcctatgatgatcagatcttgtgacagtatgtttgcctgtgcccatcttgaacctctgattagtagcaatactactgacaaaactgtctcttgagtaacgattgccatgagaagcacctcgcccgtagtttagctgtggatgtgcctcagcatcatggcaccattgacgatgatgcaaaggtatcctatcttggtagcactgatagtcagagttagacagcgatggaatctcatcaccgtaattttgtctacttgagcgtgcgttacaatggcgagaaagtgatggaatctcatcaccataactttgtctacttgagaacgagttacaatggcgagaagaaagcgatggaatctcatcaccataactttgtctactcgcgtagttacaattgcgagatagtgacggaatctcatcaccataactttgtctacttgaaagcgaggggattctagcaccatagttctgactagacagagaagggatctcatcaccatactgcatccctcttggcagtgaaggtccccaattgtcaaaactccattgacttgaagaggaagtagtctcatccatggaattggcctgtctaggtatgtcaactatctgttttgatgataaaactaaaattagtaaacacccatatacagtctttaatcgtttaatagacatgccaaatacagaaactgtatatatagacaaaatttattgtgtagtcaaagggatccacaaccatacctcactgtggtgttcaatagattgaccattgctggttcgaaaggcagtagattgattggatcttctggaccagcgttcttctgaatgataatctaaggtaaaatcagctttaccttctgctgcatacaaccttcttatgtcaggactagcagaaggatatgaagcaatgtgatctggccttcgctcaaaggttttgcttctgacgctcatgttcccaactacatctcctgacccgtctggagtacttgacactgattctacttcagaagaacttctccaagaacaggttgatgaagaaaagcaagactgctgcctacgatacccacttcccgatgacatttcttccttagaatctgtatttgacccatgggaaatagcatggttggattctgaaggcggctcttgacaatcctgagaaagggaagagttgtttgtatgttgttaaacaaaattgctatgtttggatctagggcatgctatccacagatttaatggttgaattaactcatacttgtcttagcacataattactgaacaacgattttgttcgctgtgctatcttagtcaagtacacatgatcctatttctgatggagtgatggtacaaccagaaatctaactacagatttatttataaaccaatcgcgccattagtacaacatctcttgggtcctattagtttctttacttaactgctccaaagtatttatagtttagaaagatatataacacttcaggtaatctggtcaccgatagcagattaattgaagagattgtgttgtataaaaagaggatgagtaatcaaagaacaaaccgatgccaggtttgatacatcctcatttgcgagagacataatttgggtaccatctttgcatttcatactgttacctgcagaatgagaaagaaattgtccacagagtagaagtagaacacaaattgactgtctgagctattcagaaattattactatcaaaaagttttggaaactaattacgatggcacatacatggctgatatgaagaagtcgaatcttccccaccaactgcatcatcattcctatcgttgtttcttgtgaagccggaagaatcaccttctgtgtgcgataacgctgacatgggcggatcggaaggttccttcatctgccaagtaaaaacatgttaataaacagcggcgaaagcaggaatttgtgcgcggttaaataaaaaaaccttaaaactgagcaatccaatccattattaaggttgtaaatatgggacaagtgacatgaagacaaaattcgtttgattttagatgttccccatgagcagacaaaccaaagttcactgggtagtagtattaattaagccgaataccctaatacgtttagtgtgattttgcaatgtaactactgcttctacagatgaaggggctcgattattcccagccaagaacctgctatggcgacagtgctatctcaaatcttggactgaacgatggatttgggcaaaatacgtgcacaagaattgaaccggggccatacctacctggagcctcaacggtgggttgctgaggagacgctccgagacggcggcgatgcggaggcggcgatgcggcggcggcgacggggagtcgcctggtgtgaggaggggtctgggctagttttcttctctttttttgggggggttttatttattgagtatttgtctttttttttacgcattacggattacattaaacggcatgttttctatactgtttaacggtataatctctttggcccagttgtaaacaggaaatagctgcagcaactttattgttaaaaaaaatctccccgacggttaaattgtttttttaaaaagaaactttatatatatatatatatatacacaaatttataatatttaatacgtagttaatgtactaatgatatttctacaaatagatatatgcttaaatgaactcagtcttagtggtactgcgtagagaacatttatctactattataaaaattgaagatatttttgtcggtggtttggtacgtcatctgtgtatgagtcgatttttaagttcgttagttttttggaaatacatatccatattatctctactattataaaaattgaaaaaaaatttgccggtattttggtacgtcattcgtatttgagtcggtttttaagtttgttcgcttttgaagatacagattcatgtatgagttaaattttaagttcgtttgtttttggaaataaaaaaaaagtcgtataagaaattaaaaaaatatccaagcgaattctcacagtaaatttcatcctagctaaacgtataacaataataagattaaaataaaattcacccattacaacgtacgggtattttttctagtttttttttaaaaaaacaactaatgaaatttataattttaattattttttatatgtgctcttaaagtaaccatcgtaacacagttttagccttttagggctgacaaatgttgatttatatttatttataccactcaacaaagagtttatatttgctcatcaactgcctttctttggttgtgtgagttttttttctgaatgcatgagtttggcttccactttaggaggagcctatgttaccgagatacggggatacaaatacgtagtatgatgatacaaacataagccattttttaaaaaataaggatacggtgatatgtttatatatatagacacacacatgtaaattaaaaatacatacagaaaattaattaacctctccaaagaaatagcaatacaatactagtattggtactgccaattccatatattaattttgttcagttcctctaactatctcttactataataatctcttataataaatcaagttggtgaagtaattaagcttgccgactgccaattattcaagaaaaaaaatactactactagactagtgaactgatccatcatggttacaatatcaattctaagtgtaggctacacaaatagagccagcaactagaagatttcaccaagtggaaacaagagtagaataacagatttcaccaaacacaagtgaaaatgtagttcatagtactacacaaatagcacatgtccagactctagaccagaccaagggtacagatctaacatggaaggcctaaagatgggatttactcacaagggaatgaagggaaaacagctcggtggtgatgggctgacgacgatagggttcaatctttctttttggatatttgtatcggggttgccgatagagttgccgatagaacgaaatttagttccgaaaattttgataaaattcagttaaatttgaacaaatattgccaaaattcatgaaatattaaaaaaaaatcaaccgaaataatattgtacctagggagggggtggttcccgataggaccaaaatttcgaaaatttcattccggaattttgaaccctgcctgatgatgttttttttttctgcttgccggcccgcagaggcactgctatggcggatgggagaccacctagacccaaaaccctgcctgcggcggagaaggtgcctggtccagtggaggtgaaagcattgcaccacgcctgctgacagatgtaacacatcctaaacgattatagtattaggatgtgttacatcccgtattggttggtttattttttatgggacgaaggaagtatcagataagtatttataatcgtttgatttatttgcaaatcaagaaaaaaatggatacgtacgggatatgtatcagagtgtatccttatatgtatatgtattcgtcggtgtatcagatactgatacgtgacatgtgtgtcatatcggggtaacgtagggtgtggagccccgatttaattaaacactactaaaattcttttggagaggttcaattattcaatattttataacttataaaatgcacaattacatccctaaacttgctaaatatatcatcgttggggcataggcgcatagcgcgcgcacactgacgtgacatacatatataatatggacaaacttctaatccaaatttgcagtactccctccgtccataatataagggattttggagggatgcctaagtgtcatatccctccaaaatctcttatattatggaacggagtattaggattctcattcaaccatttatattttaggatggagagagtggtgattaagtggagcccacctatcattttctatttttcttttgttttctctctctactatttccttcctccctcaagtaaatcgttgatggtgttctgcaatggttttggcaccttggcactgcaagtctgcgacagtatgactagggacatttaactttttatcgcttttaagatgtggcaattaattatttgtcattcgctgtctatgacatatgagccctcatgtgtttatgacatgtgggtccagtgataattcctatatcaccacttgtaagagtggcaaataattaattattcccacgagtggcaaataattaattattccctatgactaatgggtgttcgagttatatactagatccgctcgccttgtccatcaccaccgatgatgtgccatctctgacttcacaccatgaggaggaagagaaaggatgagtgagagttgagaagaaaaataaaatgaaaaaagagaaataaaaagaaatagaaaaaagtgggtaggaaagatacattgtttatggatgtaaatatacatttgacaagtttatggaaccattacccagtataaaacctcttacaagtttaataaccaatttggtttcgagaaacatagtacaaacgcaggtgctcacaacgcgcgtacccttgtctctatgaacgtccttgtattttgctcatgatttaattagttgagagttatagaaaatcaaagatttgtacaacatctacaagaaaaaaatatatttagacatagtctgacaaaaaacaaatcttattatacaattactatgcggagtagtaccatttcagaaaaaaaaagaaaaaaagaaaaggaagaaatgctagcacaaatctcgatgcacgacgaacgatgtaagatgcgtagcctttcctcctccctgtctttcatttcaaagtagacaaggcgaggaaaaaaaaattcctccttttccccgtcttcccatcgctcgccggcgaccgccatgaactccggcgagcctcctgcctcgtcctccctcggcaatgccggagaggaggaggaggaggacgacttctactgggacgccgaggcggaggccgagctgcaggccatcgaggccgcttacgccgccgccaagcgccgccgcctccccgactggccaagccccaacccggtcaccgcatccgcatccgcatccgcatccgggggttgttcccccgcgccgccatgggctccctctcctcccgctttccgaggtgctcttcttggctttcccccctttctttgacatgatatgacgtttaatttaaagaatccctttttattcctggagctggatcgatttcatgtctctcgcatcagttcttttagggtcatagggattaatgtttcttggtagtacaacatatgcatcgttggggggtaaatttctcaattttgctgaaatgaaatgccagctccgtgtaacatttccttctcctgaggaaatagtcagaaatattgaagaatttgttttctaggttcttttgacaggaatcagggatttactggcattgccgtggttaatttctgaggtcaatgtagtttatgtatatcatccttcattttgattgaaatgggtattctgcaggtaatgtgaaggcaaggtaccaaccagtaatgttcaatggcagcatagtgtactgcaggaccccttcaaaagtgaagaaagccacaagggacattttatgcaaaattgaaaccatgaaggcctctggccaggtttctcttggattcgatctcgagtggaggccctttccgagaagaggtttgctgtttttcctaaatcctaaccaaatctttaattgcattttcagcatgttcagattgagcaaatgtgggtttctggaatcaagtcttcttttttgaaaaaaaagaaagcctcaaactcttgcaagtaatgatattgacggaacataactgatggggtatggattttgcaggagatccaccatgtaaagttgctgtaatgcagttatgcatggagagaactcgttgttatgtcatgcacatcattcactccggagtgccacctgtactaaagtctcttttggaggatagttcgtccgttaaagtaaacacagcttccctctttccctgcagataaatccccatttttcccacgcacgggttaacatgttttcatcatgcaaaccattgtttccatgtcagtgcaggttggaatatgtatagataatgacgcaaggaaaatgttcaatgactatgatgtccatgtacagccattgatggatctgtcaaatcttgctaatgccaagttaggtttccctcctaaaagatggagtcttgcttcattaactgaaatggtcacatgtagagaggtaatatttatggtatcaagcattgttctctttgcccagttctggtagcattgaataaaaatgtgttctttctgttcagttatttatgtttgtggtctatgcattacagcaagttcggttgcacaactagttaaatgatacaagttcacctaatatttggtaggatctcttaaatgtatttcaaatacaagcatttttcttttgaaggttcttgataagttgatatacctttgattagtttatatctattagtggctcaccactagtccaatacatgttctccatccctgccctcacacagcaagacgttaaataaaacaatgcaaagcccggtgttagtgatgcggtaatcagttacatagaaacacaaccatgtcggctatcaaacttgttttgacacattatcatatcatacagaaataaaaaaagagttttggcaactggcacctgcagaaaggcgtagctattgtgtgtatgtatttgagtgtattattgtatcatgcacaaataaaaatggatggtatggttgtatgcctgtggtcttctaaaacattttcacacccaaacctagggctccttaaaatgaatgggtaaacctagtgttttgtgttaaaagcgcctgaaaaatttgggttttctaaaatttaaattttgatgctttaatcgctgcatcttctcgtctatagttgccgaagccaagcaacataagaatgggaaactgggaggcatatgttctctcaaagcaacaacttcagtatgctgctacagatgcctacatatcttggcacttgtatgaggtatatgagtgtactacttacttataaattatttttttctatccctacagtcttgacagccaattctactcttgattaggtactgcagagtctcccagacaataatgttgaggttgaaaaggagacaattacagcagcatagatgcaaatgcataaactgaaaagtgggttgttaatctatttgattgctccctaatgttctgcatcttcacttctcaaccaggttggcatcatgaattcacaaatattttactttacttggagaattctgaatttctagtgatggcttatttttcacgcctgcaattattccttaaatgtcttttcctacttattttatcaaaaggcttgttcattgttatatgatggagattttacataccttttatatatatatatatatatatatatatatatatatatatatatatatatatatatatatatatatatatatatatagacggtggatggccatggagcccgggcaccatggtgcccctaacaaatttactatatatatatatatatatatatatatatatatatatatataatgcattagtcctactgtttcgctgaaaaaaggattttacatgacataccttccaatgatctatgtggtatttagttatatcatctgaattttaaaatcttgagggaatcagaactgctgtttccccttggtttcatagagaagcaaagaaactgctggttctaatttggaccgcagaaaatttccaacatagaagtaatgattttagtgacaactgacgagctatatcaaatgttcagaacagaaacttatagtcattccgtttcttttccttttacattatagaataggccctgttcttttctccaactaaagttggattaaatcttggatactcgtggcacgcttttcgaactacttaacggtgcgtttcgtgtgaaaactttctatatgaaagttgctctaaaatatcatattaatctattttcaagtttggaataattaaaacttaattaatcacacgttattacaacctcgttttgcgtgaaacacttaatcttcatcttcatcttcagaacattcaaacaccaccctagtttctcattgcttttggaactgagtttatgcttgccatgccagagttcgctagttgtgtagcagacaaaatctcatgaatgtcgtaaaaaaggtcaaaattttggaatagcaccttattttcggaagtctcttattccttttttttttaaaaaaaacatcgttttattgttagttgggtctatagtaagttcatcccagtgcacaagtaagtctcatatcatgaggtactatatgttggcaatcctttgttatggtatgtagaactgagatggacattaatgtgtaaattgtacggatttactccatgcaggcatgaactataagttgattcatccttgttagttactacctgcatattcatttgatctcagattcccagttgatgaatgcagtatgcattttattctgtaattatctgaagaagtacaaatgtataacaacagttgagatgccatttccaactttactagggaggtcagacgaaaataggctggtgaaattgttataaccttgtctagaaatgtgaatattgtatcgctatgtatgcagggttgagtagggatatcttcatcagaagtcagaaccaaagcagtatggaaccttcttgaacatgcgtcaaaaggcagtgcgtaggaacatacctaccattgttgtaaattgtgctaagatgcgattgctgaacttttcagctgctgttatctggaaaaattaactgtgtactttttagaccgaattggaattacgttttattttattttttgtgaggaagaatttgatttattttgtcaccttggatgaaaattaagatttttgtgacacactttttaaactgctaaacggtgcgtttcgtaccaaaccctaaaccctaaaccctttcataccaaaactttctatacgaaggttgctctaaaatatcatattaatttatttttcaagtttgtaataattaaaacttaattaatcatacgttaatatcagcttgttttgcgtaaaaaacttaatcttcgtcttcaggagaaaagatcgccttaccttagtgtgtcaagtattgcctttctggctggcattgttttctattatctctgtccaaaatataacttgtattagattagacacatcctagtactgtttgttcagatttgtaataatagggtgtgattaattcggttatattttaagatggaggaagtagtgtttattgatcagcccattgggctatattcttctttaatccaggaatacgttggtcttctgacccacttgtaatttgtcctgggcttcaagccattgtaagcccactagttctctcatctgtttgcctgtctggggttgtcatgtaagatgggttagccaaatggcccagacgaagaggtgaaatggtgaattgacatattgtgaactaatgccttctttggaatgggtgaattttgcggggttttgaataaaataaactaacgccttgtttagttccaaagtttttcttcaaactcttaatttttctatcacatcaaaacttttctacacacaaacttctaatttttccgtcatatcgttctaatttcaaccaaacttttaaatttttgtgtgaactaaacacagcctaaaccctgtgaaaaccctgcaattttttgcgttccatataaggtgcccaaactgatgctccaagattgagcatgacaataaggaaaggaagggcttattcactttattgtcaaagtaaatcttaccatttgttagtaaagctaaagattgacaatgcccaattttagcaaggttaaagatgtgaaggtgctatttggtttgataccttatcaagttttgatgtagttttgtgagtggaaggttctaaaattataaatttttggtagaattggtaaaggctgcaatggttatcttgtttaattagaccctactaaaatttgacaactgataaggttgcaatgataaaatcttattaatttgttaccctactagaatttgggcatttggcaatgccaaaatatgatggtttattttggcaatgaagtgataacccggaaatgcacttctatattgctaataatgagaaaaatactcatcattttacagtaacagtgagattaggcacctaaactccccttaatcaaactctgagatggcccattcaaccatgcaagaacagtaattttgacggcacatacatatcaccggcatatactaaactaaactcttagatctctttgaaccgtcctaaacgattaaaccgtcaacatctgagctcattgttcttggggctacgtgacacgtatcgattcttattcttaatatatcattagaagcatgccgttgcaaattaatattagttacaattagaacttgacccaaatcaaacatttgagagaataacagatatgcttaatttggtctcatgctactgacagtgttcatgggtcggctgcgcatgcatcattttcttgcatagttttagtgaacaaattaaaacagacacactttggtcggaattttaccagtcaaagatgcacccatatggatactgctagatatccttggattaatttctgatctagtttcaaacacaaatcagtgtgctaagaaagcatcagaaaagaaaaataccatcagagaatcacttgggttaaagattctcctagccgtctaagccacatggaaatgcagtagtaacaataataaaatcacaaaatggaatctttctctccatctcaaccgtccacttgttgccggcgcacgtgtcaggcatccatgcatccatctgggtcacctgcattagtactgaactactaatcatgatcagttcttcacatggatttctgttggtcaaagcaagccacaaacatctcccccatgaaaaaaaatgagagatagaaaaaagaaaaaaaaacaaagagaagccaacatggcattgtgatcttctgctcaagatttggacagaggaatcatttttcttttgaacatgctgtgcccatgccttgtaaaaagagcaggagagaaaaaaaaaagatatgttttgtgtgttgttgcaatcgggacagggagaattcttagtattggagcactacctctgccgcactagttgtttcttgcacacttagagtactagtactccatccctctctgaaaaatgtattgacaatttcagtactagtggagccaacaacagtgacaattaatttgaaacttgcaaaaataactaacttttaaaaaaatggtgcatggtatatctaactgagattgacatcagtattttaccaaaattttcagacaatagaagtattgtctttacttgctggacttgtttttatgcttttggattgctcaccaagttttgcaactttcttcattaagaggtttacacagctatgtttttgaaccattttggccgtctttatgctatatttgtttcagatgcttcaaaaatttttgaagaccaatgacatataggatgacatttatttgtttaatttatctagctttttggtgaaaactttcatatatattcaaaccacatgcaagaaaaaacataaccttttctagatactaaaatatatgttcagaacaccaaaagttaaaatgaactaacttattttgttgtgagtaaatttgatgcaacaagttcttgcaacaaagaaagattttgagtggtgtttctaacaaacaaaattaattactgcagagtttctagaggcagaatctattgtatagtgtatattaggttcagtatgtggtctgaatcatagtataagttagtggtgttaactggtttggtctggctagtcattcttactgccaacaaatcttgtcagccagctagctagtactcagattgggatttatgatcctgactctgttaagaaagcttgagacaaatgcttctgtgaaatgactcccaatcatgatttgcctctatggctctgtctttttgagaccatgcatgcattcttgtcatggtatattcttccactactactggaggacacaaatcttgcttgtgaggtctgttcagcatgattatgtacattagagggcaatgtgactttgctccaacatctcacagtgatcactcatatatgtggtacctgataggttcttggctttgagcacacaaactatatatgctgtcatctctatctgtatgctaaggtctccatggtacaatgatattgcatgccccacttcttccatatatgctatggtcatagcctgtcatttatttgagtgtgtgatgtttagtgtgtcatcatcaatcccatccatagcatccattttgttcttgataagttcatcaatcttggtgtaagcatatatcccaatccaacgtgtcgttttctcgtgcatctaactaaattatgattagctgatacaaagattaatttgagatgatattaaataagatatatctctgaagaaatgcaaatcaggtatagtggagaaggcaccactgctggttccctctttcaagcccaccagattggaaatcaatgcttgggattaacttctgaagaaatcaccattttgctgcacctagtaaagtgacatttttctaggtccttaaagagaaattacctctcaatttacattacattagaaagatattgggaggtaccagaaattaatctaaaaagtgtggtaccacctcaagaccagagtaaaaatatagtaaaataatttactttgccgcttaatctcagcacatgaaaactgtaactagttgtggcatgtacatctgctattccattctacgaaataaaaagcctgttgggggcaggccttctaattctctaaaaaggattagttgaaattccctaattgtttccacaagaaaacatactttccttttgagagccagtaaaaacatagccacaaaaaatggttgtgaacaataagaagcaaaatgtttttaatgcacttgctatagttaaacgatcctcctataattcttcgaccccaaggatcgcgataatgtactgaagttctttgtaacgttataaagtttccttaactctttctgtagcttcataatgttcactccaagcgatttgaggttatagcatagttgtggttgaatctaaaggatctaggataatcaaatatccttggaagcaaatcctatggtaagcatggcagtagaatccaaatctgcaaatgttgtggcaggaatagggtcgatcaaatcgttcataggtacataaactgcttgatttgcttttgactctgaataacggtgaaatgatctttacattagtagtatagaacgcatgacgaaaaaaaagaacagataaagttcatagagcttgcacaagcactgaaagattctcatttttacagagatgtaatatgcatacaaatacctactatttttccttctcagatgcaaatactttctagctacgcttttatttgcactaccaggtttttaacgtaaactgtacgtgtatgcatgtgttaaatcttccatgaaccaggtcgaatttgatgtttgaacaaaatcttttgttggatttatgtcacgcctagaaccgttaatttatttgccctaggtttagagacttcgaacatgaatgcgatgcaaattgagctcattttttctgcacagagatctagtatagatctatgttctttgccattaagttatctcatatttgtttgtcaagctcacattgagttaatttgtatcttgcagagattttgtacatttccccattagggaaagagggaatgaacccaagcacatgagaatcctaccaagtgcattgaccaacttagaaaacactctactaaaatcaaagaccacaggttcattacgaataccagatgatttgggcttatccacaataaaaaaacacaaattaattagctactatacttaatgtgactatataatatgaatggctatgcttatcctgcatgtgatgcacctaggagtagttgttatttgctagaacaagatgaaaaatatatgcatttttgtttccatatccagacttgcaatctctcaaaacggcgcagtgtctttcacttaattgtcacacaccagagagtacatatcgatttgtgaatccaaacaaattaataaaatgtaagaaaagaagtacatgcaattgtttcaaagctcatggggtcatgaggctaccacatgacaaacctccatatataatctgactgagattctcaggcactcaggccttcatatggcctgaaaataaactaagtataattagtctagtgtcagcgccgaactaagctaattttgtgtcaggcttagtggttaaaataatccaagaaccgcagaacaatagtggttaactcataattaaggggaaaattgcctgtaaaataatgagggcatatttaatagctatcacatggtagttaaaccgttacaaccgaccaaaaaaacagttggtatgaggtcaagctccttggggaaagagacaattttccagcagtcaagctaagctaggctagtagtctcatctcacatccatcaaatgaactacttaattaaggacttaattatatgattaaaatggaagagaagagaaaacaagcagccgctcgtttgggattgatggatagatatataggcaacttacaagcatgatcagtacaccatggatatgaaaggcctggtcactagtatatttgggggaggctctacttacatgtttgagattggggtttgtgacctgcgtgaatgtgctccaaataaaatgattcttgggaatccgtgacgccatgtgatcgatatagatgttggtgttaagttgtgctcaaacggctaacgactcaaatttttatcctcattttgattaagggagtaccctttggtacttaattttatattagaatttagaaaaatagaaatgtaattgtattgtgtgagtgaagctgtaacatcaaatcagttgaatttatatgactaagaaaaaccctttgtctttggcaaacttgttcctatatttttttttattacatggaagatgccagcacacacactttgctcctctacgtgtacttcatactaacacatctataagagtgcattctctaacacatacttaaagagacataaaccaacaataatccctacataaaccaagattaatccctacattttgaaactttttcatttttaattttaaaaataaaccctttttaaatatgaaacttttggtcatgctagttagatcagcatgaccaaattaaacaacgttatcactccaaaccctcatggcgtggcagtgttgtttctttggcatggctaaatggtttatatttgaaaataagtttttaggaaggctcatttttaaaattaaaattaaaatgttaaaaataataaaaagtcaatgggtggagtcataccttaaatgcttcccctctcgtggatattgttgttcccggctatttgcattttcccaatcatctttagtagtaaaagatactaggaaattttaatgaactaaactaaatctcttgtgaaaatcttgaattcaaaggagccctaaaatatccatcaatcttgcccctttgttgcaacctcgtaacgtatgcccacatatcctaacctaaatggaaaaattgtgcacatacatgtccccctccataagcctttgtactcatggttccatatttttggaaacaaaagaaactcagcggtcactgatagaccaagcttcatgaatttcataccccaagcaaatgagtatattttacaaaacctaaggttttggggcatatgtaacacaaaagccttaggttttgcaatttgtttcatgaaatcccaaattttgttgtaaaatgtttcacaaaaccccaattacaagcttatatcattaatttgactaatatatttatctaaaataattgttaatatattttttactacaaataaatgttatttgcttttcagcaaccgttgatcattgtgattgatcatttatgtgcatatttaaccaattattatgccattatcagttacgattatgttaatttttgtgaagtgcaaaattcagaaaaagaaatgaattagatgagagatatgtgtattttgagtaaaagattgatatttaaacaattatggttaaatttgaagattttatacattaagaaaaatgtcgccaaaagagtgtccaacccaagggctgaaattttgaccagaaatattgaagcttgaagcgaggtcaatgaataatgtgtcgttcttcaaattttaaatattttttcatttaaactataaattttcaatttaaaaattaaaaattgaaaattttcaagttggaatgttaagttttgaaatttattatccatattattaaaactagaataatgaagggttaattagatctatgccattgcaaatatgttgatttacaaaaataccattactattcactatatcggctatgtgccgttggaatttgagaaaattggagctatgccactctatcacgatgtctgtcaaaatttccgttagccccaactgcatgtgagacctagccgtcagttccttcttcttcaccttcctttcctctcttctctttcctctacctctctccactctctccccgacgctcatcatcctccaccaccgggagagctcagggtttgccgccatcgtcgaccttctccttagcgggagggctcgggagccaccgctgtcgccgtcgtcaacctcctcggcgggaaggctcaggagccactgtcgtcactgctttcgtcttccactccatccgcggcgggagggctcgggagccaccgccgtcttcgaccccattcgcggtgggagggctcggccaccactgccgtccttgaccccatctgcggcagcggtgacttcgagtttgcggaagctgcatggaagccgacagtggcgccctgtctggcatagcggggccatcagtggggcggttggggcaacggcggcgcgcggttggcgtggtggcgaggtccgatggatgtaggtgttgccactactaatactagtggtggtggttggcatcggtgtcggggacggagaagctacggtggttgacggatataacaaggcgatgacagaaacgtgacgacaatgatattgtttcaattttataaaatttcagtgacacgtagtagataccacgaattgtagtgatatttttctgaatcggtatatttgttgtgatatgccccctaccccaaataataaatattgcatttggcgtgctgtatgaaatgagatcaattttacaaatatttcctcagccaaatatgattttgcagtgtacgttgaacatatatttttggggggaaaatagacgagttctaatctaatgactaccattttgtcaactgcagaaaacagagagatatagactaattagaaactaggtgaatctaactacgtacaggatatatatcagaaattgatgatattagccgaacaacatacccttgaaattagtcaagaataataataattgcctcctagaatctgaactaccgaaaaaacattccaatgatcagacactagagcactactagctcctttgctaccaactaaaaatctcataaaggtgaatgtttgtagtatataaatctttaagttaggatccgatgggacttgaatagatcatatgtatacgagctagctataatatatgcatggcgtatgacccaattgtgacctatttcaaaccaagttgttggatgcatgatagccattggatatcttggttatgatcactacaaagttctctgccatgttctcatatgcatgatatgcaattagctgtgttgactcaattatttgtacatgctaattattggccgtatatacgttagaagatcacatggcggcgtcaaatgctcaatgcaagagctatcatatatatatgtttgagtgtttagccaactgagtagttgaattggttcttttgtttttggagaaaaaataaattgagggaaaggactagttgattctggaagagatagaagcttagctatactcttgtccatgcatgactcagatgataagcatatggctgcaagtgatggcttcatgcatagatgtacacatggatttggaattaaatactgacactttcccattaccaatgctttccaggcaaaaaaaaactaatcttctagtgaaacttgttaattaagactcgcccactgaaataagggaacccgccatatagggcaattcccaagtgatacttattcatgaacaggaaagcaccattaatagtaactctaccatcagaattcaaattctagtttgcataaacattgttgtggtgtgtatttctagttggtgtagaggctggaagtaataatttcatgatgtaaaaaattgacttcgatatcaatggtttgcccaatacctaattaaatcatgaaattaggtatttaacaccctattttctaatttatacccataaataatgatggttattacaatgtggcataataacatctatattgtttagcatgcttgatgacaagttggttatattagggagatggtatggataaggtctctcatttttcccaaggtcaaagcatggagagactgccttaagcatcacagaaagccatctcactatcagcaggttccttctatgtgattagtcatctccttgcattttgagtagctttatggagaagcatatgtatgccagtctgtggtgatgtggacatacatgcttcatgttgttcttgctgatccacaactccgttctatgtccatgtaatcgcggataaactaatctgtttcacaccaggcataatacaatatcgttctctctttgatttctctctcgaaacacatcacatacacagacactcaaagtatcacttgcacacaaacttacgatgcacactctatacacaccaactaacaattttcacaaaaaaattctaaaaaagatgtatatacactttaaatagtattacatatatatgtaaaatcttagtttcaaattcattatatttcagatataaaaaaagaaaaagtttgacaattttaagagtatatataggggtgaaaatgggacaggtatttcccgattgcccgcttgacctaaggctcgcaggaggaatatgggagaaaaaaaaagatacctgttattattcgagttcgaatccgaattcgttggaaaaatatgggttaggatacgagaagacatgtatccgttcgtatgtcccctattataaaatatgtataaaaatttattatgaatccacctaaaacatgataaaagattggttaatcactattttacgtgctcataggtaatattgcactcttttttcttgatgtatctttttaaatactttaattaccttatatatatatatatatatatatgtgtgtgtgtgtgtgtgtgtgtgtgtgtgtgtgtgtgtgtgttatccggcactacctatacccgactccgaatttaaaagaaaatatgggttaggatatgaaaatgtcataatccgtacccgtccgttttcacccctaagtatatagttgtcagaattttgtgtttttacagctcaaatataatgaatttgattatgagactttgcatatgggcgtagtactattgttagtaagtgtaatatttttatataatttttaataaaacttagttggtgtgcatggaatgtacaccgtaagcttttgtgcataggatgcattccctatatacaatgctagttttatggccatcataggagttgttcattacaactacaatatcattagcaaaagctattatgaattcttgaaaatatgtacacattttttcatcataaacgatccaatgcatcagagagatatttgaaacacaacaacgactttcttcccaatatggtgatggggacatccttgtacacatatagttagcattactctattttgtgaatgaccctactctaattatgtgtagagtatatatattcaataatcaaactttttctcccctatgccccacggaatattgagcaaggcttaaacaaatccctctacataaagtttctgggattagcttctcataaacaaacatagaatgcatatcacgaagtccctaaagaaatgatcatttgtagtgattgcatgcaaagcaccctccttttcgagcttggctatgaaaaggctccaaattagtgcgttgttaatgcaaaagggctctttcatcggtgattacacttttgagctaatcccatagccatgctagggcaagcacgtagcaagtgccatctatgccatgaaggaacatagaagctcatccatctctacttggacggtgacgagcatatatagtttgaaaaaaaaaaacagttgctatatatgcatatattaagagcagtatctttcatccttacatcacacatattctctttgcaaatcctatatgattattgtgaaatatatagatagttgagccaaactccatgacacgtggcttaggtttttctatgcattttaaaaactaaatgcatatttaatcctatgaacttcactttgcacttagctgtgcatagttcaccttaaattaatttgtgcaataatattttgcacttatgaataatcaaattagggaaaatgttacaaaattaatgatggtcaatatttctaatttacaatttaggcgctgttgttataaattaaggaatacaatagaagatattttttttcagaaaacttatttttgaagggtggagcaaataattcatttcaattatctaatgaacaagctaaagggaacagtgtatttcttatttattttgatgctatggaatttcatggtctccaaggtgaactttaattttttcatacattttataacattatattaatatatactaaaatattgcataatggtgcttaattaaaaattagtaacctagctacttctaatatagtttcatgtagccaatttagataattttaggctgagtttgattctgttgctaggaggagctacttactcatttatcgtgacacatttttttgcgaaaactttctatactcaattaatcgtacgctaatcactcatcttgttttgcgtgccgcaatcaacgtagcctatcctctgattcaaatggaaccttaatcatattaattgaaggctttaaattatgaaagtttggagtagggatattaggagatcagataaaaatgacaaatatggaggttcatggttcatctgatcgatatatagaaattaacaatatatagattggttgctaaggtactgtccaatcaaatatagtttctcgtgtgcatttccagtccaacaacaaaatgagacacattgttgatgctgatctactgtgaatttaatttcttcaataatttacaaaggattccggctggtttgtaccccaagtataacccaccttggaaccatacatggacctagttacctatcttggaatcaacacaaaatgatttttgtaatgatgttcccaagtatagaaactttcatgcatggagtgtaagaaatttctatccgtataggtcggcgattctggacaatcatgcgagtggccgcttcccaagataattaattaagagcgatagccttttagcgcgtgccctatactcgttaacgccactaaaaccctagctaagctaggggtttgatattagtttataattaaccctccagcacaaagctttaagggctagctcaaaaggctaggtgatcaagagagaacacaacttccgagggcggtaaccgaccacggtgatgagctagctacgttgtacattgtgcaccatggcagtacacaagctttcttcttgtttaagcagtggatttcctagggcatggcagaggcagatggaggaacaccagctatagcctattgtgagagctcacttttccatggctgggattaatttcttggagatcacaagctcattatttgtaagagtgcccaaactaattaatgttaatttttgcatcaacttggccaattgcgtcatgggtgaggtgtcttggaagggttataaaaatgtccatgccattggcaagctaagctcctacgtgttccttattctagggtttgccaaattaaagggtagccttgtgcatggggtcggtggctccctaaaagagataaaacaaattaactgtgaatgatatccttttggggttatcaaaaggagtgtggatttagggaaacaaggcctcttgcacatgctaccctcttatgcatgcacaatggcattcaattgttgcaaatgcattggctaatttgttgtatccatgcaaatggattcatatgcatggcccatgcatgcatatacacttgatgtaattaatctatttatatgtacatctacccccttctcctttccctaaaagtacaagctacatatgattaacaaatgcaattaatcaaccaaatagaggctaagagatgttaacctcgattcagtcaatcgatcacttgtgtatttaggccgaaaggcgtacgttgcatttggttatatataagctcatgatcatgtatggggacctatctatctctctctctttctcaatggaaattaagcatatatggtcatgcaagttcatgcatgaatgtaccacacataattaacctagagtgacaggtgtcgaaagatcttcggcacaccaacctaatgattgcactgatgattttgtattcatatatttgagaaaattgcgcctcaagtcttcaatttaatctttgacaaataaccatatatttaattgtcatgtgagaagccaaaaatcatgctatatatataaacaaaatggccctttcattaagctgagatgtcaacaacaagggcaagtgttgtatatgtcgatgtatatatagtatatgcatgcatataaacttgtgcaatcaattaattttttttaagttgaagataaatatattctcagggttcaagtatcaacacatcgatcaagcaagtttttgcgttgttcttggacgcgtttttagttttttttttgttgagaagtttattaattgtacacatatatatagttttgccccctaattaagctagatgtcatgcactacttactatctactctacgcggaagaatctctgaaagaaagctgtgtttatttcctctttgatatgtgtaggataatcaagaagaatattaggtgcaaaagaggcctgtgaactgcactgttgtcatccaggatgaaaacaaaacagaaaagatccaatacataatgttatatatgttaggtatataaggtatgggtgcactagcactactcctgaaacaaacaaattgagcactagataattaattaaactaattggaaacttagtttttaactaatatttgaagaaagtcaagctagcccagttgcttaattagaatttgcagataatgagatgacatggcaggggtatgggaggagatgcaagtgactgagttggtatcacctttttagggctagctagctagatgtggccaattcagcaggaagctgcttggagctcttcaaaatttggacgcttgaaagctcctttttgtgtaaaaaaatatgtctgcgtcataccttttctttgtcttgcttatttaattttcttcttgataaatataggtcggcagatgtaatatttttgcaccaacgaaggagacacatcggatatgaagctgctcagcagctgctggttatatttagacgagtataactgttggactaatatgcatggatttacaggtaaaagagaagatcgtgcggtatccaaatcagaattaacaatggaaattattttccagtaaatttcacaacactacagctactttgatcaatctatcacaaaactacggatttaatgtcagttttatcacctttgtaacatcaatattgtatggacataaactctaaaatgtgtaattctctgataatttcatcattaaatctgtgatacgatatatatattaaatatgtagttctgtgatgataaattttgtactaaatctgtagttttgtgatacacatatttaaatctgtagttttgcaatagtttgattaaagtatatgtagttttatgaaatttaatttactctattttttactaactggttttgatatatctaggaaattctagtgaaatttattggccggaaatgcactctaccatcaagctaagaggcatccatgcatgcatgaagtgaaacatgtaatgttcttacttgttattttggataccgacattatctcaagaagacgcgaatattagggaaagtcctaatatcaaataattaaaaggagtgaggctttaaacccaggtcgtctagcccatcaccttgtagagctagccggaatactctgggcgtttctccaccgacattatctccagtgcagatttaaagctattagaatataactacacgatgttatttttcatgaaaatcgtctactagtatgtttttacatactaaatcttaatattttttttgcatatttttattttagttatgcataagatttcgagatttggctgcatacgtcatagatgacgtctgtttgtaaacacagagatcaacgtaactcttttgtattatcttacccccatccaattctaaatggtgcatgcatgcctagatacgcatgcgaatataacttttcgatctcgatcatttggaaacgtacaaggctatagcgcgttgtaaacgatgccatatatatttgaataccaaccaactttcactccatatatctacagttagaccctcagatgcccatgacaaacacaagagttgtacagcaaagcttttgagctgtgcatgcctttctcctagtttattggagatcctcagaacgagatcatgatttgcacaaaagaagttcacaaagttgggagaggaggaggagaatttttgggtagttggtaagctcaaaggtggcatggtgaggtggagacctcagcttgcatattgaggatcaagatgactagcaacaacacacactagttggatagggaatcacaaaaaaaggcatcatcagctagcttgatcacagtttaatctgtgtctgcatcgatcactagatgtacagtgcaaatgctggcaatgcactgtaaaggaaaagggacccatctgcaggttgctgcatgcatgcatgcaatgctgactagctatcattttacacttggaatttggtgattggtctccttggaacttgcactggatggtggtggctgaacctttaacagcatggcaccagttggtaccccttttgtttccctgatcgattgttttcatgttacacacggtttcatcagagtagtgtatatcacaagggtgatctctagctgcatgatgctccagcttggcagtgacatatatttgacacaacttttttgaccatggaaagtgtttgtgtgcaaattaattatcaacaatcaatctgtggttgttgtgctgtgctgtgttgttatgtatattctaactaaattatatgcaaaatagtttccaatttttgaaaatgatatggataaaaagtgtatttttatattatgtctaggaaaactaattgctatttgatatccactgttgtgccaacttaggcttgagttctgaacagtttctcagttaggccagctagctacttcatcgtttatcatgagcacattatatttcttaaactgctaaaccatgcgtattgtgcataaaatttttatatagaagtttcttaaaaaaatcaaataattacattattcaaattcataattgtttgtatctaattaatcatatgataatgaccttcgttgttttgagtgctgctggaaatctccagcaaacctcgcgaacaaacgcatcgttagccgtccatgcaaatgcatatacaaaatatttagttaaaaatattaaatcatttaggagcctgatcatactttgagataatgagaaaactttgcctgatgcatgcttattttgtcttagtttgtataacttcttagattgtaaacctcttcccggttgggaaaaagaagagtaaaactaacataaaattcagtatattaatagaaacaaagtttgaaccctcccattcaccagccaatattattactgtgaacctttctcatataaacaaaattgtctatatatttatccattacttaattttcaagttcttcttatggtttgcatttcagcagcgctgctggacggtcgatctcctccagaagcatggcattgatagtcactcggcctgccccttttgcgctcaggagcttgagatgacgaattacatcctcctcgactacgtgttcgctcggcaggtctggctccgtatgctgtcacctcctagctgggctgcctctctcctccccatggcagctggcttcaggaatggtggccatcttctagggcctgtttacctgagtatctccgtgctggcttcgactccttggtcctcctgatctcttggcaactgtagaaggaacgaaactccagggttttcgactctgcactctcttcggtctcagtggttctagagtccatcctttggaatggccatctatggtctttagctagcgttgctactttggggatttcatgggagtgtagtttggcttcgccccctttccgctgattggagttacgtttagccatcgtagtagtttcttcccttttccttggttttgttttttctcccttcccttggcataagccggtctttccgattgcgttgtgtaaaaaaaactcttttattctaatatattgacgtgcaatacttttacgcgtccgcgaaaaaaatccgttacttaatttcatttctcattcttaatttgcattttaccactcattttcatttgtgataagaactaagcaaacttatgtgtaagactttcattttcaaaagttttttttaaataaagtaatcttaaagacttaaatagatatttaattttataaaaattataccgtttagtagcttaaaaaatatatggtaatccacatatattctgtaagagtaaaaatagtagtgcacagaggtgtatgcacctccaaatgtccatataacctgttgccaactccctgaaactcactttcatatcatgattagagcaggtacaatagcaggctattaatcagctataaacatattttaatgagataaatgatgagagagaaaagcagcgggctacagatctgtagccagctgcagcacggacttcaagacgcaatgtgtgtatgtcaggtgagaccatatattaatattatagtaagtaactattgtatgaattggctattagattggttataaatgaattggagccaatagtgggctatactattaaacttgctcttatgaaactactcattcttaagtagtaattacttgcattgagaagacattttcagctccattaatttatcattttagcacaatttctcagcagggaatatcatcgataaatagagtacaacggtaacaacaaccatgcatttattgctcggaatatacgcaggtgacattgtgacagggggtgaataacaaattaaccaacgccatgagcattcatgcttagttagttacccttattgaccaaacctccaattaacaaggtagtttaacacacatcatgctcgcttaactgcagcaaagagttggaatctcaatatatacaaaaatgtgtagcttcaaacccatgagggctggggaatctaaccccctaaccccaaacagtgggctgctggtgtacgtgcctagggcatcaccgcatgtgtttatgcctcatcactaattagaatcttaatttctctctcatcaagccaacgagaaaaaaaaattacttaattaattaaggccacaaaatcagttcgaaaattctctcgtgatttcgccgagcccagaaccagaaccaaaaccagagctcgagctagattagttaactaacatgcctgattcaaaaaagggagttagattctatatatcttctaatatcattgattaccctttttttttcctacgctaagtatgcttatgatgattctctctcttccatcatcacacacactctctcaatcgctttctctctcttcttccttgctctctcatacaacctctatttaagcaccccttgctcacctcctatccaccaacacaaatcacttgcaaaaccaacacaaacacaacacaagcaacacaca

SEQ ID NO: 66812 - DNA, 10996 bp, Oryza sativa
  unsure (1)..(10996): unsure at all n locations
gaggaatcttaaatttccagattctcttttaaggaaaagacacctgatgcattttaagggctttataaaacgatttcacagaaaagataccatcccttgtcaaattccaacaaattttgtcttcagagtcatcctataagatcagactttccaaactatttttgattctcacccaatctctcattttatctccatccagatcccttctgaatttgatacattgcaagcctttcattttcacctttgcaattgtcacatgtttggtcaaagttatgttatacagatttgggaactgaatgttaaggggttttccacctatccagctatcttcccaaaacaaagttcttttcccatttcccacttttttgaacaaaatttaaaaaaaatcatcctttacttccatcaacccatgccagaaatgagaattaccctgtttaaaagttaccccagacaaggtgaagcatctaggcccccggtgttaattttggtaattaatgacaagtgctaattgtggactaaccattcttttgagctatattttaagttagattgacatcatgtgtgtgcatggatgattattgatggattaaaattgacggcgcaaagcaaaaggaagagaagacgataaactagtgttttcattttgaattgatcgaggcgtggggcgatcaaaattgtgctagtttatttttagcttcgccatactattaagaggggtaatgacctatcaaagggatgattttaattgccaaattaggtcatttgcatttagacttgtgctcacatttcacaacatgcacttgctatatatttgtcactgctctggactgccagggccggtctgaccgccggacagattccggtctgaccggccggtgtcaccagtctgaccgccatgtcatggccggtctgaccgccgtatcaatgccggtctgaccggaaggtgttggccggtctgaccggccggccatatggccgggatggcatgctctaggatggccgatcccgagccgccggagccgtattcggtcagaccgagctgaggacggtctgaccgagccgaggccggtctaaccgggcaccccatgtcggtctaaccggccgaggcagtggggcccaatgacagccctacaacggctagaaaactagccgttgtagagtagcacggtctgatcgggcacatacctccggtcaaaccgacagagcactgagttgggggatttcgcccccaacagctagttttggtgggtgggagtataaatactcccccaccagcagcaaggggactctcttggcacccaattcaattgcatacaccccttgtacctctctcacacacctttgagcttagtgttcatccattgtagtgattgaggttgttctagccaagagtcaagtgcattgcttccatttgtagagctagtgtggcacttgattaatcatctccacgccgggtcattgcttgttactcttggaggttgccgcctcctagacggcttgtggaggagttgcccggtgacctctccgagaagattgtggaggaggccaggcgtcgaattgtgagtggtttggagttcaccaccttcggagtaaaggaagaactaccccgagtgatcgaggcttgggtagtcctctccgtgggccggctcccgccttgcccaccccttgacgaagggggcgtgcggtggcttcgtggttgggcggtggagttggactcgcctcaacggggagtaggaaaccggcaagtttccgaacctcggtgaaaaatctcttgtctccttgtctcatttgattaccgcatttacatttgtgcaatttacatttctagagacatacttgagatcatatcaccctaggtttgctaaacattaacataggagtgtgatttactttcctagagatataattgagccactatcaccctaggtttgcaaaatataacttagttgcttagttagagttgaccctcaccaagcctagccacttaggttagtgttgattaggtgtcatttagttttaaatcgcttattcaccacccccctctagtcgacatctcgatcctacacaaggttttatttttcaaatattttcccctaagaatctcctgccaccaaccttctttgttttccaaattccatatccatttccccaacaaggccttattcataatgtctaggtccagaacacctagaccccccgatctcttggtgagcagatgatgggccattgcactaaatgatattttctgatgccttggtcttcttgccaaagaaacctcctaaagaaatccattttttctttcacccctttgggtaacttgaaaaaggagatcatatacatgggaacactgcttaaactagaattgatcaagattaatctccccttattgactgaagtttcccttgccagcatcccagtttgctttccattttgttttcagcatttctccaatctttctttgtaatgcgtttctgatctattgggatccccaaatatttcatgggcaaagcacccacactgcaagtaaatatctgactgaaaacctctgccttatcagcagtctcaccaatgcagaacacctcacttttattgaagttgattttgagaccagataattgctcaaacaaacataagatgtattttagatttttttgcatgtcttattatcaaatagaagaaatatggtatcatcagcgtattgtaaaatgaccatcttgttgttatcattatcccccagtactcctatcagcagattatcctcagctctttacactagtaaagttagtacttcagctgccaaattgaataaaagaggagatagaggatctccctgcctcaaacctttatgtgttttaaagtaaggccccactctatgtgttttaaagtaaggccccacttgatcatttacctagacatcaactttactacccattatcactttctttacccaatctgaaaatgtaccgcgcatggtaactatgataaccacgtgataaacgcatggctgacgacgagattatatccacgtgagaggatgatggttcagatctaatcgatcacaaacaatgaaacaaatattgaatcagcgaatcagagtggtcaggaaaatgtaacggaaatatcgattcacgctcactcactcaagtaggtgagcagtgagctgagtcagcggtcgatggatcttcgaggacgcggttgttagtttggtcaatgagtttgaggctgtgtttagatccaaactttacatctaaacttttaactttttttatcacattaatttatcatacacatataactttttagtcacatcgtatcaatttcaacttaaacttttaactttgaaagaaactaaacacagtctaagcttcactgtgtaatgccagtccactacgcgtcaaagtgtagtgggctttcagccttgaagggctaatttcaatgggcccgggattccgtctatacaaggcctcgtctggttttgccacgtaagcgaatcacgagttttttttatttataattttttttattaaaagttttacaaaaataattttccattttgaaaattgacggaaatagtcgcctaccgccctctgggagggcgatttttagagggcggcgtaaatgacgtggcagccggccgttcgctctcgggcgacggncgtcaacgaaattagcaggcggnccccttgccgccctccgctagggcgattttgtactgtgcggggggccgcctgcaaatgggcggcgagggggcatggaattttgcaggcggcccccttgccgccctgggggagggcgattttgtactgtgctctatattttttttttatataaatagcaatagttatgaaatctttttatattgaaaactatacaagattaaaatctcaaagactggtaaaatacaattttattattttttagggcatatttggattgttaccgtacaaatattttgttagtgccaaaatataagcaagttttggtagtactaccaaatatttagtaaggtaaaattgcatttgatcatatttggtttgctgccaaaatgtaaaattgtagtgaagaatgttatacataatctcaaatctaaattacgtattaccaatgaataggcttccattttcgtgtgtggtgagctagtgggaaagaagatatgaagaggttgccttcagattgtcaattatatagcgtcgttttcactgcaatatatgtgaaatcaatgagatacattattcattagatgtgacaagacgatcacgcgtaggcgtgattcactttatgtcaacaggcagcgtcgaaagttgatagtgataactcgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttgcaagtttgtaaggcagaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccgagctgagaggagcctagtacgtcctggtggtctgcaccgtgcaagtcgtcgtcgtagaactggctagtaggaccagtcctaccggcgtgagacgaagaggccccagtaccgaagatcccggctgcatatcctgctggacaaggaccatcagattcgtacaagtatttagcagtagtaataaaaagtaaagtaccgtgtgggcgagggaacgacgctccgtgagaggaagagctggcgaacgcgcccgaagaggtggcgaacggccctgcggagctagcggaagcgccggtcgtgcctgcgaacgcgctcgaaggcagacgaggtcctgcgatgaggaaacgtgcagttaaaacatggtgacactttcgtgcaaaagctgaaacaaaaatgaactaatatcttggctgaactgtaccgtgcgaaaccggtgctgtaggtcgcactgctccgaagctaggggcgctcgaaggcaaacgaggtcctgctccgacggtaggcgcgcgaggccgtgggtgtaccggaccagctggaggtacgacgtccacggcgctgcgacaggagaagacgcgcatgaccgcacgcatcttgtcctgcatccggtcgaaggtcgccctctgctcaacgtcagtcaagtgcaaacctctgttcaacctcacctggacagcggtgatatcggcactgatatcccgtgcggcatcagcctatgcaagatggaaataaaaaattcagtagttgtcctattttatgcaagataaatgaaataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgatgtaattatcataaaaatttcgaaatgaacaatccgaactcacgagtggtcggaaggggggacggtcgtctgcacgttgcccggaaacacctgcctaagtccgaactgtctcatcacacgctgcgggcagtgaggctcaacgaaaatgtcgaacaccatcggcaggatggtcagccagtaatcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctgcacgtgagcgtaacgacgctgcaataaacatgatcggaattagaaatgttatgtgaaggaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcttcagggtgcagaaggtccgcctacagttaagaatgaaatgttagtacaaaacactcatccggtcgcaaataatcatgtatgataataacatcttatttacttacagtgaactggagcaaccaagccttgctaggcccgactgtagagtacggaggaagggtgctggtcggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtcttaggtctccagcggtctacaagagcggcaaggagtgaccggtctgcatcccaccgcttcgcagggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcgcacggttcaacagcgccggtgtgtcgtacgccatacctgcatcaaatagattgatcagaaacatataaataattagttcaacataagtaataaatgttcataagcgaattactaacacatattaaacaatagtacaaacaaacaaaagtgtcaccatacggaatatttctgattacaacaataactgcagttacacgatatgagtacttagtccgaacactcatcacgataacattatgatacaacaccgaatagttcacaatactactagtacaacaatagtcggaggtactcattacaacaacattgaattgaaattacacgatagaagtatttagtccgaacactcattacatcacaacagcattttatttcctaaatcgaaagcattgttacaccatcgaatcgcctgctgcgcgacgacgccttggccttgcgcgcctgcttgttgttccttcaccaggtggtcgcctaccatcacttgcctgtccagatggactggcatctgcgccgcttggaacttctgcatttttcgggcattgcttgtaagtatggccgcgcagatcacacttgctgcagcgtaaagtcctcccacctgcttctgactcatccatatcatttctgatgcgtctagtttggcgtcgaccctttttcacccttaacttagatggatcaggaatataaaaaacttgggcactcagcgttgtgtaagatcctgagatcccgaacccatatatttcctcactccatgtatgaaagattgcttctttcctgaaaaaatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacacacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgactgaaatttctgatggacgaccctgacctccttctcattgttggtgggtcatcatgtaatgcaccaagaggtatgggaggctcgtcaccttcaacttgtggtctgcgagattgctcgtctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcatatgtgccatacctcatctaaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgtaatgaaactgcccaatgcttcaccgcctccttcatctcatccttatgagcataccttgcaccctcaattacctcgttctccttatactcccagggtacatgatcaccctctgatatgacaagtccagagaagttctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttccatcgatggtccaacaacatcccctgcattgctaggaccctccacatcttcggttcgcattgaaacatttgtatctttctcttgtaccgacacaaatataacgaggggccatgaccgttcaaaagccatttgcacataccgtctccaagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacattaactgcgttaacctcgcatttctgtactacgccttaagttacattctctacaatattgtcctctaaatttctaaaagtacgttacattctccagatcaaactaaactacatcttacaattaacactactgtctatgtctcaattcatactattatattctatgctctggatctacacatatgtgctaaaatatatggaactaaaactaaaacgcaacatatatactcaatcataacatattagtacaaatgcaaaagatgtatgggagcatacctgtgatgaagtgagcgaaccagcagggcttcgccgctccgcttctgctgccctcccctctctctctttcgttttttctggatttttagtgaatataatgaaatttaacagaggaggggctgggctttataggggggggcccaaaaatcgccctcccccagggcggcaagggggccgcctgcaaaattccatgccccctcgccgcccatttgcaggcggccccccgcacagtacaaaatcgccctagcggagggcggcaagggggccgcctgcaaatttccatgcccccccccgccgcccatttgcaggcg

SEQ ID NO: 66813 - DNA, 18906 bp, Oryza sativa
attaatgacctctaagcatgccattagatagatctcgagatttggggaattttggaagttgaacggagtcaaacggatttacggctgggaagatattgaatttccaagattatcggatttttggtctaaaggaaaaaggattaaattaaattctttttggaaaagaaaaagaaaagaaaagagggagggaacatagacttttctcgggcggctagggcgcggcccaagagatttggggcggctcgaccgagcttaacgggccggccggcccaagacggcccaagcgcgcgcgcgcgcgggagggaggagagagagtccggtggaccgggctcaccacgcgcggtcccgggtgggacccgcttgtcagcggctcggctcaccgtgcagagggagtatgcggcgtacgcgcgtgggcggggctgggacgcggtgcacgcgcgcggttcgcggaggaacggatgcggcgggcccacgcgcagcctcacggctcaccgcggaccacgcgcacggggagaaacggagggagcggctggccgggtcggcttatccggtcgcggccgaggtggcgcctacgtggcagccacgcgggccggcgggaggtagacgacgacccggccgcgaatggacggcgggcgatagcggcgagcggcggggcgagccacggcgataccggcgaaggcgagcacaccgggtggctgcacaggacgaggggagacgagccaacggctcggattcgccggagggagtccgtcggtggcggattgcggcggtggcaaccggcggagaggaaagggggaaacggcgacgaggtcccgaggggctaattcccggcggtgagagcatcttcgcggcttcgggaactcgacgcttgcgtcggattgggcggaactacgccgagcgaggctggcgacgagcgggtgctacggagctcgggcggcgacggcggcgagcacacggcgagtgacggcaacggtcggggcggcgccggctaactacggggaggcttctcaagctactaccgaaagctagggggaggagatggagcgaggaggaagaacggagagaggcactaccgtgcggaggaggggcgctgtgacgagaggccgacggcgcgggagtaaacttctccggcctcgggccgacgaagaggaagaagaaggcgcgcccggagtccccttccgcgtccacgaacgcactggctcctccgacacgcgcaacgacgattggcgacggcgaaatagagggcggcaaaggcgcggaggcgaaaatgagggagggaagggaggaggagacggggcgacgcggcagagggaaaggagagctcggcctccgcctcttggcggcttgcgcgcggagtggcgggggccgggggatgacgacggcgatgacggtgggatggtttggagcggcgcgacgacacgggcgacaggcgcgggctggcgcggcagagggtgacggcggcggcgaccagacggtcggccactcggcttgcgcgcggcttgcaacgggcggcgtccgcgcgggcgcgcgcacgcgaacacggcgcgtgggaagcggttttgcgagcgggaagctcgcgcgaggggaggggcgctcggcgcgggcgactcctgcgcacgcgcgcgcggcgagcgggcggagcggaggggagcggagagagaggcgctcggcgcggctctcgcacacgcgagcagcgagcgggcgagactgagcggggggggaggagcgcgccggggggagagagagagagagggagagagagagagagatgggccgaggaagagagagatgggccgagcgagattcggcccatcgacctcgggggaggcaaaatagacttttgcggaggaatttgattggaaggatttggattcggaattgaacttgacgatagatcggggattgagatcttgagatggcacggacactagacaacaagcaaggaatcaaatttcgcaattagggtttttaagagataattttcccgctaggcgccacgacggaacgggcgctacagaccaacccccctaacaagaatctcgaccccgagattcagcacctaagggagcagctccggaaactcggcgcggagaagatcttctcgttcccaggttgcctcatcttcagaatgattgctccattggactttgtagaacttgatggtcttccttcgagtctgacgttctgcctcttcaagaaccttgatcggtctttccttataggtcagattcttttccagctcgatattacccagggggacttgctcttctggaactcgaagacatttctttagctgggatacatggaacacgttgtgcacatctgcgagaccttcaagtagctcaagctgataagccacttcgccacgtctggcggttatgaggtaggggccgatgtagcggggtgctaacttgccggacatcccaaaccttctcataccacggaggggtgatacccgcaggtacaaatgatctcctttttcgaactcaaggtcacgccttcgattgtcagcgtaattcttctgacggttctgtgctgtcttcaaacgttctcggatcagcttaacttgttcttctgctgacttgagtatgtcaggaccgaataccagtgcttcgcccacctcattccagcacaagggggtgcggcactttcttccgaacattgcctcattcagcgacatctgaatactggcctgataactgttgttgtatgagaactcggcatacggcaaacaacgatcccaagtgccttcgaaatccaaggcacacgcacgtagcatgtcttctaggatttggtttaccctttccgtctaaccatcggtctgcggatggtaggctgtactaaaatttagatcagttccgagggcttcatgcaactgcttccagaaccttgaggtgaactgagtgcctcggtctgacacaattttcttgggacagccaaatctacatacgacatgggtcatgtagagttctgccagtttctttccatcataggtcgttttcactggcacgaaatgagctgatttcgtgagtcggtccacgattacccaaatggagtcgtatccgctaggggttcttggcaaactggtgatgaaatccattccgatctcttcccatttccactcgggaatcggtaggggttgcagcagaccagctggcctctgatgttccgccttgactctttggcaaatgtcacacagggctacgtattctgcgacatctcgcttcattccagcccaccagaagtatgccttgatatcttggtacatcttcgtacttcctggatgaatggagtaggcggactcatgagcttcctttagaatgagatctcttatctccttcttggccggtacacagatgcgtggaccgcaccaaactgtgccttgatcgtctatggagaaattggtgtctttcttctcctgtattctttttattaactcttttatcccttcgtcgtctttctgagcctcccggatttgcgactctagggtaggctgtactgtcaagctggcagggacacctgactgtaccacggtcagccttaacttctccaattctctgcacaggtgatcttggtcaggccgtatttgagctacattgcaataggccttgcgacttagcgcatcagcgaccacgttggctttaccaggatgataatgaattcctagatcgtaatccttgattagttctaaccatcttctctgtctcatatttaactcggtctgtgtgaagatatacttaagacttttgtgatcggtgtatacttcacatctattcccgattaaatagtgcctccagatcttaagagcatgaaccacggctgccaactcgagatcatgggtgggataattgacttcgtgaggcctgagctgcctggatgcataggccacaacccttcgttcttgcattaggacacatcctaagccttgtcttgatgcgtcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcataggtctggctagcttagagaatccttcaatgaatcttcgataatatccagctaagccaaggaagctgcggatctctgacacattcttgggcgggttccaagcaagtacagcttcaaccttgctgggatctacttcgacaccgttggaggaaatcacgtgtccaagaaatgctactcgatccaaccagaattcgcatttcgagaatttagcaaatagttgatgatctctgagcttttccattatcagcctcaggtgttcagcatgttcttcctcattcttggagtatatcaggatgtcatcgatgaacaccacgacatactgatccaggtattccataaagattttgttcattaagttcatgaagaatgctggagcattggtgagtccgaaggacataactgtgaactcatatagaccataacgcgttgagaaagcggtcttcgggatatcttcagatctgattttcagttggtggtaacctaacctcaagtcaatttttgagaagactcttgctcctttaagttgatcgaataaatcgtcaatccgtggcaacgggtacttgttctttatagttacttcattcagggctctatagtcgattaccattctctcagagccatcctttttcttaaccagaagcactggggctccccaaggggatgagctaggtcgcacataacctttactttccagttcttcgatttgtcttttaacttctgctaactcattagctgccattcggtagggtctttttgcaattggtgcagtgcctggtgccaattctatggcgaactcaatctctcggtctggtggcatacttgttaattcttccggaaatacgtcgggatattcacagactatgggcaccgactccaaggaggtgacttgcaaacaggttaggatagaccgacttgcggtaggggtgttaggggtaaagcggacttgctttcctccaggtccttgcaaggtgatggacttttcggcacaatctatctgtcctttgtgcttagccaaccaatccatccctaggatgatgtccaagctttgcgagtctaggactatcggtttggctaggaagtcaacttccttaattctaaggttaacttccgggcatatttgagttgcccttatattccttccaggggaatgtactatcattggtacacgcaaattttgggttttccaaccatttcttttcacaaaagcttgcgatatgaaagaatgggaagctcctgaatcaaacagaactattgcgggtacggagttgacagagaacatacccatcacaacgtctggagcatcctgagcggtttcagcttgaatgtgattcacacggcctcgaccaaagttgttggaagcacgtgaaccttgtccacttgcttgagagctaggacgagactgagctgccgctggagtaggagttctggcagtgctgccattagcatgccctgagttggtgttggtaggattctgaggacactgtctagcatagtgacccatatggttgcatcggaaacactgaactgctgatggtccctgcggtgacttgaaagaggtaacactgttaggcgcagtattgccactaggggcacgctgctgtggctgaggtgccggacggttcatctgaggacgaggggcgtagcctggctggcggttagcctgagtgaccgactggtggtattgcatgggttgaccgtagcgagggcgaggtgcgcctcgggaagaatttccctgatggttagacttgcgtttcttgtattcttcggtagcctcttttctggcatcctcaagtagtagtgctttgttgatcatatgttgaaaagtggggaagtcatgagcaatcaactggagtctcattccaactgcgatccccttcaagaatttcctgatcttcttcttgtctgtgtccacttcctcaggggcgtaccgagccaacttgttgaactgacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgagcattgcagtaattctcccaccaatctacggcaggacctcttagctggtgagaggcgtagagcgtcttctcaaccggagtacactgcactaagttgagttttctaacaacatctttcaaccaatcgtcagcctcgacgggctcgacggtctgagagaactctgggggacgagatctcagaaagtctgtcagcttggatctgttgttgcctatgtgagggtggccatttccatgcgcattatgctgaaaattggctatggctgtggttagtccttgtaagatttgtgtctgaactgccattaagtgttgcatgttgttttccacatgaggtggggaagggaggcgttcttctccagaattgtgactggcagcggggtgagagtggtgagactgttccatctctgcattacgggaagctgtgcgatgcgagaggctgctgcggcggggttgctcgacttcggcgttacgggaagcagtacgatgcgaacggttgctgcggtgagactgctcattagctgattaatgatttgcttctggctcaactctaccatcttcaaaaccaaggcgggctggtgcacgagctgcacggcgggggcggctagccatctaaactcccagaaaagggcggggtaagagtcagataagcacttaggagggcaaggagcaaagcaaatagcaactcagatagcacacactaggcataaactggatttttcaaatcataaaaacacctgatacaacgggtgtggacaagtcacagagctacgccgagcttgactgtgcgcacaccacctaggagaaccagactaccaaacaacacccacaacaaacacacgcacgcgctacctcgccacgactccaaaagagttggcggcggaacaaaagggcctaacacacggacagctgctgaagactgcctcctctactcctcgtcggcctggctgccccctgtagtcggctcctcagtcgaagaaacgtcgatcggctggcgcgaagggaccggcggaacctgtcgagggccggcagcagcacgggccgctggcggtgggggagctgggtggcggaaacggaacacggtggaagaaccaacaatacgcttccgcgcagtgcggataaagcgtgggccacggctggaagaagcaactggggtgtgtctgggggtgtaggaagggctaactgggtgtgggtagggggagtacactggtgagtacggcgcacgcgagctgggggagcacgggccactgggagtgcgggcagagccgcgggagctgtgggaggacaggtggctggcgtggcagaggcggcctgagtcccaagagatagtgtcaactgaggtgacaccctcctcggccagacgggcctccaaagcggcgtagcggcgggcaagggagcagtaagcctcaaggagtaggtcgtgctgagtggcctgagcctccgaaagctcgaccatgcgagttagcactggctgagactcgctgtacgggcaagggtacctggcgtctgagtggccagaaggaaggcgtggaagctgtcggaaggcggagcctccgagtcggtggctgtagtcgtgggccaggcgacgaagcgcagtccaggagaggtcctggtacgcgatctggtgagtgggcctggccacggtgaagtggtgtgggcgaaggccagctccgtgtatacctccacgggggtaaaggtatacagagagctcacagtgagggggaacacggtccacggagtaccccgtgtactcgggacaagagaagccaaggaaacgggcgaggtcacgaagctgggcgacgtggtgaccctcaccaaaaccgtgggaactgaagctggcgttcactgccatctacaattttgaaggagggagaaagatcagtaaccattttagaaacaaactattgaaaataaagaaaacaaaagaaaccttagcttttcgcaagtagttttgaacttagtatccttagggtcgtcctaagcgtcgggtttcgccctagggccaagcttgtgctctgataccatctcttgtcatgccccgaactagttccgaccggaactagcccgtgacgctccaaataaacctgttaatcgataccagtcccaggagacagtgctggtatcacagggagacagaatatcacagcaacagaggtctctttattatagagtagaagtacagtcatgttgggctgcggacagatcccgagctcacaactgcattacaaaaggaaagcggaagccaggacttggaccaatcatcacaggcgcgacttgggaactaggccgaaaccctaaaactcatcatagccagcttgctcctggaagaacacctcatcagcaggatccgcttcatcttcttcagcaactgggggggattatttaaatagagcaagggtgagtacgggagtactcagcaagccaggggaaataagtgtttaatgcaggcttcaaggaaaggctgttgttttcgtaattgaatttatttgaactcttttctgaaaacaactaagtgagtgcttctcaaacgacacggatgagacagtgcgtctcgtccggtcggagtatgtgcaatgcatcagtctttagatcttgaaacagggttggcactcggccaacagctttttaaacggcctcccgggccaacaactcttcaaacggccacccgggcctagctgatcccgtcagctactgatttttcaaacatcgaaccccttttcacaacagcaatttcacaagcagtagacaaacaaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttcgaaagccgatacaggtttaccatatgccgtcgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaatttcaaggaatcggtccttaagtgcaagagcgggaaaccgtacacccggtacgttccccggtccgcggttttggaaattcatttggttcgcaagcaccgacccaagtgtcgggttttccaagtcttttgtaaaactccagttttacccaagttgttactcagattttaagtttgaaggcgaccgtcgatactcgcacagagtgctcgagtatcgaggcgcaactgggtggttacaaggggacgtggtatagcaattaacaaaggaaggatcaaatgcgaccaattaggtaggtccgccaatctgccttgcggacgggacaaacagattaagtgcgatcctatcaatgcataatattttgcaagcaacataattaaatttcaaatataggctcaagatgttcaaaggtggcttgccttgctcgagatttggagcttgatcctcgaaatcctcgcactgcgggtcttcgggctctgaaactacacgcgaaacgggacaactcaacaaacggcgaaaataaagccctattaatgacctctaagcgtgccattagatagatctcgagatttggggaattttggaagttgaacggagtcaaacggatttacggctgggaagatattgaatttccaagattatcggatttttggtctaaaggaaaaaggattaaattaaatcctttttggaaaagaaaaagaaaataaaagagggagggaacatagacttttctcgggcggctagggcgcggcccaagagatttggggcggctcgaccgagcttaatgggccggacggcccaagacggcccaagcgcgcgcgcgcgcgggagggaggagagagagtccggtggaccgggctcaccacgcgcggtcccgggtgggacccgcttgtcagcggctcggctcaccgtgcggagggagtatgcggcgtacgcgcgtgggcggggctggaacgcggtgcacgcgcgcggttcgcggaggaacggatgcggcgggcccacgcgcagcctcacggctcaccgcggaccacgcgcacggggagaaacggagggagcggctggccgggtcggcttatccggtcgcggccgaggtggcgccgacgtggcgctacgtggcagccacgcgggccggcgggaggtagatgacgacccggccgcgaatggacggcgggcgatagcggcgagcggcggggcgagccacggcgataccggcgaaggcgagcacaccgggtggctgcacaggacgaggagagacgagccaacggctcggattcgccggagggagtccgtcggtggcggattgcggcggtggcaaccggcggagaggaaagggggaaacggcgacgtggtcccgaggggctaattcccggcgacgagagcatcttcgcggctttgggaactcgacgcttgcgtcggattgggcggaactacgccgagcgaggctggcgacgagcgggtgctacggagctcgggcggcgacggcggcgagcacacggcgagtgacggcaacggtcggggcggcgccggctaactacggggaggctactcaagctactaccgaaagctagggggaggagatggagcgaggaggaagaacggagagaggcactaccgtgcggaggaggggcgctgtgacgagaggccgacggcgcgggagtaaacttctccggcctcgggccgacgaagaggaagaagaaggcgtgcccggagtccccttccgcgtccacgaacgcactggctcctccgacacgcgcaacgacgattggcgacggcgaaacagagggcggcaaaggcgcggaggcgaaaatgagggagggaagggaggaggagacggggcgacgcggcagagggaaaggagagctcggcctccgcctcttggcggcttgcgcgcggagtggcgggggccgggggatgacgacggcgatgacggtgggatggtttggagcggcgcgacgacacgggcgacaggcgcgggctggcgcggcagagggtgacggcggcggcgaccagacggtcggccactcggcttgcgcgcggcttgcaacgggcggcgtccgcgcgggcgcgcgcacgcgaacacggcgcgtgggaagcggttttgcgagcgggaagctcgcgcgaggggaggggcgctcggcgcgggcgactcccgcgcacgcgcgcgcggcgcgcgggcggagcggaggggagcggaaaaagaggcgctcggcgcggctctcgcacgcgcgagcagcgagcgggcgagactgagcggggggggggaggagcgcgccggggggagagagagagagagggagagagagagagagagagagatgggccgaggaagggagagatgggccgagcgagattcggcccatcgaccttgggggaggcaaaatagacttttgcggaggaatttgattggaaggatttggattcggaattgaactcgacgatagatcggggattgagatcttgagatggcacggacactagacaacaagcaaggaaacaaatttcgcaattagggtttttaagagataattttcccgctaggcgccacgacggaacgggcgctacaatatgtaaattacttttagactttactaaatttacttttatatgtctaagaagtaacttggtgaaatctaaaaataatttagacatatcataaaagtaatttgtgattttttattaaaatataatcatgtgagatcttgttgtaaagatttaattattacaaacacaacggtgtaatcggattgtaaatcagatgagtaatttaagagaaaattttatttgaagcatagatgataggaatatttcccccacttgctcaatggattaatagcaaccaaaactcctaaagtactagcacgtggatgtctctggttaagactaattggagaggcctcttcaattagatttaccgtttgatattggtacaattttttgtctggatgcatgcatatgcatgtgtcggcgacatgggaccgggagtatcatgactagaggcttgggcagccgcgatcacccacgtggcctgaccccctcgggggggtcgggcccgagggtgatgtggccgcccctccctttgtctccccgaggggtcggaccgctcccgtttcggccccgagggccggggcgccccgaccccctgtgggtttggcgccacgtggatgggttaggtgagcacagcggggctcacctaaccgcatttattgcgggttggacgagcgcgtcacgccgcatgtaatgcagcgcagcgcgctcgcttatccggtccgtgaccgggcgcagtgtgtgaccggtcacagatcggtcagatcgcgggttaggtggtggcaggcggcctgttacacgcctcgccccgtcccgtcgaattgatgagagcttccaggcacttgtccctagccggagacggcgtgccagctcctgaagatggcacgtcggtcccggtcagatatatgccaggcttcatcgcaaccattgcaaggaagtcattgtatgaagaagggcagacatgcagcttgctgaactgacgcgtggtggacaagagtgaccggtctgtgactggtctgacgcctgtcatgtcataggcagacaaccgcgctcccgttttgcacctccttccagcggagtggaggtagatatgacccatcccatcggagggtcattcggacagcagctattgcaaatctccgcccatttatgaagggatgacagggtgatctccgaagtcagacgagtgaggacgcctggccacactcaagaacaagctgtgttttagcttccaagagaaggcgagccaagttttggtgaagataggatgggtccccacccaaaagaaaagtaggtagaagtggagcatgtgggatccccttgagttataaaaggaggaccttgcccaccaaaaaggggaaccaaaaaaggaggggatcgaaaaaaaagggagatcagaggaagacaactgagagaacacctgagctctctagttctccaactctctgtaattccttcacacacagatccaccagaacactggagtagggtattacgcttctcagcggcccgaacctgtatacatcgcccgtgtcttgcgtgttttctttctcgcgaacattccacagaccaagggcttagaatctcactcagcgcccccggctgaaccggcaaaggggggcctgcgcggtctcccggtgaggagccccacgctccgtcagcatgttttccttctatcgcataacctgacttatcatgtcattccgtgaactttaatttctctgacttatcctcagaatctgcataagtcggcaaagaaaaggccggcaatgttacagattttggcagcaaagcaagcaaataaccatgaatcgatgaaagcatatggctattagaaccaaggccctcaaggaaaagctcgccacccgctcagtgatacttcaacaagtccttaaaaaaaattcaatctgctcaatggtcaggagaaaccctccccacaggcacttaaaagatgtgagtaattctacggtgtttgagaatgtacaaaaaaatttagtgtaattgctctaaagatattgcaaaggcgtgcaaccttgatgcgaaggccacaatggaatgggccggaaaaggtgctcagccaagccacatgatcagtgtaagcaaagctaccacaatctcgaatttctcttatttacaagaatgacacttgacgacttagaagcgtttatagagtatcacttggcggcttagaagcatttaaaggatgttaatggcgatcaactgccagtggcgtgcccacatacaacttaccggtgtcaaagggcaccgggtaaaattgttaaattctaactaatttatgctattttgattagtatactagtgaataagtagataactactatgtagtggacgccaagtaatttttgttctaggttcgccactgtcagcttcgcccaacctttattgctttcggaccacttctattacctgttatactacctttaatctcttttatgttcctctagttatttgtagtaagtaccttaatgctacctcttagtgtcttcagaaccttttacgaatcctctacaacgagcaagatgaaaaaaattagatgaaaaaaaatgaaaaaaaatattaccaaattcataagaaaaggaaaaaaaaaagaccgaaataatatcctatagcgggtgtggtgggggggggggggtttgaaatttcgttccgtaattttagacttatcatcgactccttgcaaaaaaacacacacataggcatgttctgagttctgaagtactctgcaccttatcacctcggccgcggcctcccgatgcagggtgtgcaatgctgtctcctgcgtgtcgcggcggcacgactcgacgagctcgagcacttggtcgagggccttgttgagaatgttcgtccttgcctgcagcgttgggtcctcgtcgtcatcctgctcgtagcccttcacggcttgggcgacttgcttcgcgtgctgggcgagctcatgcatggcagcgcttcttgttgttccggtgagccctctgctccgccttgtcgatcttgctcgccagattcactatcgcagtgacaacggcaagcagctccatctcgtatccttgatcacgtacccttgcttgcgtgcttagtttagagagaagaaatatggtgccgttgctcctgagagaagtcttagttgagttgtcatctctttgaaccatgtctcatatgattggaataagtctatattgcatgctgatcgttggatcgggtcatgccgggctggcatatcgtgcaaagaaagaggcccaaacacaaaccaatagttgggccggatgacttcgcctatatgtgtcaacatcaagctctcgaatggccgcgggccaacgacaatggctatggcgatggtgatggagtccgaagccatgtacgaggaaagaaagctggtgaggggattagcaagggacggccatggcgcggtcgccggcacaaagacgagcaactacttcagttgcgttgttgatgtcaatggggttcggagtttaaaactccgaccccctctaccatctccgatcaagatagtgcccgcaatttgagcacttagcccggtgaagagcaccacggtggactcatcgtagttgaagagtacatgcaacaccgacgaggttgccattggcgagtagagagagcacatggcaagggcagtgacgaggccggagaagaacacgatcatcttgtcgagttgttcagggagatggatggtcgagatgttccagttctgggctgcactttttcttaataactacttcatccatcccaaaatataagcatttttagcgtagagacaagttaaatttttttaactttaactattaatagcaaaaaaaatttaaaagatcaatcatataaaattgaagatattagatttatcattaaacaaactattataatatacaactctttttatataaaacatcttacttttgttgatattggtgatcaaagtagcatctcgtggactgtgtcagggtttaaaaatatttatattttaggacggagagagtaaatatattggtcaattaattaattgacgatgattactcattcgtggattgttagggattaccatttttcaagattcttaattatgttaacaccaaatcttgttttatcattttttttttgtttccatatgctcccagcgttattagttggaatggaaataagagagcgagaagttcttcccggaaaatttccctatccccacacctcgctcaaaaccgtaaaccctaatctcgccggctcgccgcgcagccgcaggttctccccagcgagatggacgaatctccggtcgccaccgtcaccgatgactccgccgagaaggtgagcctcgtcgacgctgaccggagcggggataggagaaaagcagcggcggccggggagtcgcacaccagcgacgacctcctcctccgccgccgcctcctgtacgagctgaggaggctgagggaggcgaagaaggcggagcggaagcgcgacgcccggtcggcgaggctgatcctcctgtcgctgctgctcgcggtggcgacggcgccggtcctcctctggctctccgccggcggcgagccgctgctcctcgtgtggaggctctcctcaccgcctacctcttcctttgcgccgccctcctctccgtcacccggggcctcctcgccgccttgcttgcttacctcgccggccataccatcaccccgcgcgtcggtatggtggtcgtcttcctcgacggatgtcttcctcaactccgtctccgcgcgctgctgccgtcggtatggtggtcgtcttcctcgactccgtctccgcgcgctgctgccggatcaccatggccgtgctctcttcccttcgttgccaccacggtgttcgtcgcgtgggagctgatctcgtggtggctcaccatcgccgatttccccgtcgacgagatcgtcggcgacctgtccatcgtcgtcatgttatatgtcttttgcttcctgctgcaaatcggagaggaaaactcacttgtactctatcatcgccgttttggtagtcgtcgcagctttgcccctatttttctccatcgtctttggtatgttgccccctttggggggccccccccccaaaaatttttggggggggggttttttggggggggttttttaccctttttttaacccctttgggggggaaatttttggggttgggttcccctttggacacttagaacctgtatttccttgggtatcgtctgcgactctactcttcttaccagcagcacaaggtgatgatgatgaggtactactacataggagtaataatctatttgaccttggtattgcacattttgtggatttatattactactcccatgttacaaatgctagtaatgctgctctatgcctttgttttgccatgttacaaaccttgttgaactactgttttgtatgcgctccttccttgtcatgtatgagcagtacatacggtggagtacattatatgctggagctgaattactacttctactgtttttgttttatactacactggtgaagaaaccttttgtagtccgggttcgtaccccccctttagtcctggtttccaaaccggaagtaccaatccgggactaaagatcgctatctttagtcccgggtgaaataaccgggagtaaagatcgatctttagtcccggagctgaccttttttttttgcatggccctgttgctgcatggtttatatatatatatataacccatacatatatatgcatacatatatatatatatgtatatatatatatatatatatatattatattatattatatgtatatacatgcataatatatatgtatttatacatatatatgttatgcaaatgcatatgtatatagatatatatatgaccaaaatatatttacattatagaaaatgtgtacacatgcatatagaaacatatgtagtcatgtattaattacaatccattatatgtcctaggtagctacgatttcgacgtagtagtactcgctgctagctcagaagctaaggaccggtgaattgtgtttccgttgtagtagaattcacccttgggatcaaggatttcttcgttgatgaatcccatgagttgttcttgaaccgccgcgataaattccttgtgtgtggtcaggttatccctcatgcgaataaactatatgaatgtatgaaattgattagtaattaaacaagaaatcgctacgtaatgaaattttgaatttatttgtacgtacatcgagctctcttgtggtaatgatttggtctgcaaggcagtggcaatactcgcacacgtaatagccgcacaagttagttccctgcttttgctttgcgcactacaaataaatgacaaacaacgagagatctaattaatatacacttgtatgtatttgaatcggagaaatataaatgtagagcatgtgtactcacaggaaatttgaacttccgcctaagtctttctctccatttgccgcggaccaaatgacggaaccgataccaagccctacatggagtttaaagctatgattcgtagtagaaattaacataacaagattttcttaattaacaaaggaacttatgacggtacctgtctataagttcgaaaaccttgttaaacgtagactcttttttatccattgagtcatatacgttgacggtgcaggcctccaggtcgaagagtaaaagcacccagtggaatctgcaatgtgcgtgagatgcattacatatgaaacacttagcaagttcgtacgggaatgaaatttggtatgtaggaagacagtaaaattaaactaactctgtgttgtatggcaacagtatgaacgtcttgtaatgctgcgccttcaggagatggacgagattgtcctctgcttcttgtggatattggtcgagcattgcgacgtttactttccaagggtcgatgaatccagtatcgaaaaccctccgccgtcgggccctttgaatctccattctacaatgataaaagggagtatattattttctatagtctacttatatacaaggatctaattaattaaaggagacgtatagtaag

SEQ ID NO: 66814 - DNA, 75496 bp, Oryza sativa
  unsure (1)..(75496): unsure at all n locations
gccattagcaaatatttatagcaccacgttatcaaatcatggagtaattaggtttaaaagattcgtctcataatttacacgcaatctgtgtaattaatttttttatctatgtttaatactttatgtatgtatcaaacattcgataaacattggataagatacggtgaaactttttgcgtgggcagagtaggactagtattttactcgtaccagcagccgggcctatctcacttcgttgtctgcctttcacatctcgaattctcgactccaatctccatattttccatgtgcttttcctctctgactactaatatcactttatttctgctgatgatgctgtcactttcacactgaagctctcagctcaagggccaatgggccatgttggtgactactttagtgagcaactttctaaaggaaacatgaagatacaacaaactacacaaaagaagttaggcaggataatcaaatctgaaggtgaaattgcacttggagatggatggacagagtcacacagggcaacatcatgaggcacctcagcattttacttgcaggcacaaagtctggagctggaaatttcagggggaagggggaccattctgacctgaaactgaacctgctgggaagagcccaaaggctactacccaagttacctgtcctgaaaacagcgccttttaaggatctgtctcacctgagctgttgcccatcatgcgcagcaactaaagttcagtcgaagttgccacttgccagtaggctcttgcctagtcagagcatcttcgtttcaacaccgaggaaagatcaaagatgagagtttgtgacaacatgggctcaactttcctgttgaattctgtgacaagaacgtacaccaacggcagtcaacggcgtcgttgacggtcatatcagataatcttatgtttacatttttacttcaactcctaatgtatgtagctttatgcaaagggtggtaataatgtacacttcatggtcattcctgaatcctgaaccattgtgctctacctatatgatagctgttttctgggctaaaacctgactgaaccattggactgatgctttgggtatcctcgtcaggttgttcttgtagtcaatgtagtagagaccgaatcgcaccgtgtagcctgagttccattcccagttatcgagcagggaccatacaaagtaaccatggacgttgcaaccttctttcctgcagtaattcaagtcggagagttcttaagtagccgtgaaacatatggtcataactgtcaacagaagattgatgcagtcatgctaactgtagctatgtatgcaatcatgatggtgtgtaactagcttctcccgtgtcattctgggggtctgaatgcaacaattcggtgaagctttggtagaaggcagatgcagattatgtggacagtgccgttcctgcggttatctcaggaactagagagctatgtgtatgttttaccagatttattgtatctgctttgcacatatggatgcccattggtgcgataagctagcttgcactcaagaacaacaagagttgtgaacctactgccttcgttcccttacgctgtatctatgtgccaattatagctcccctatgatggaaagtaagcttttggcttcccctctcgaaagaagagaactgctgatgattttatatgttccaatgtatgtacacagaagtgaaacttcaccttatagcatccaggagattagacatataatcattgtggtactgtatccttttatcatcttgtaggacgtcttctaatctagaaaatgggtggttggcatcatccatacctgccataaacagctccctttgttaactattattatatgctttttaaggaaagaattcttatctactgtcaataatctccagccaacataccattttcagtaatgactacgggcgggtttccatacttttctttcacatgtttcatcagcttgaacataccccatggaactatgtgcagccaacttgatgctgcctgaaagttgatcaatacaaattttagtttcaaccaatcatttgactagaaatagcataaatgaaaggataggtataagtataacaagtcttagcaacggcaagaatggctttgcaaattgtaccgtttctcctattttcttcccatgtctataagctgccatagtgcatgcagagaagtcagtaatactgaaaacagaccaggaaatttagaatctctttatttatcaagactgaccagttggtatgacagcagaatcggttgaagcatcatccattacaagtttcctgatccgcaatctatcgtttctagcatatagtgtagtgtagtggtttatgccaacaaaatctagtgatccagataccaactttgatgcgtgagttgaaaactgaggcagcctatcacctgcaagtttctgcatagaaggaggatagtggccgaacattaagggatccaagaacctgtattcacactagaaaaatgtcataattaatatacgtccagttgctatttagtgtaattatataggaatttaaattaattgatgtatcaccatccaagctcaaagtccattgctcgcgctgctgcttctgtgtcttcatcggcatttgagaacggttcataccatctagaattaagcgcaatcccaatgaggcctccttgttcattctgcaattcatacaaaaaatgcatgcatactattgtcttaattgcttctatttttaagaaaaaaaacattactagaaaatttagtcacatggatcaccttgaaatgttgttcataagcacgaaaagcaccagcatgagctaaaagtatgttgtgagctacaatatatggttcagttgatgatttaccctctctacagaacacatgtgacagaatagaacatctcccaggtgcttggatgccaaggtcatagccgtcaatcgcaaagttgtaaggctcattaaaagtgatccagtgcttcactctatctccaaattccttgaagcaagtaaacgcgtactgaacaaaatcctcgctgcacaattaagatgtcataatcactacaaaaaagaatagaaagagaaattttgatgctacctaaccgtttaactgattatctcagctaaaggaagatgatgtgatagtcttccatacatgatttctgagttcaaccagcctccgtatctgtcttcgagtgcttggggaaggtcccagtggaagagagttacatatggttctatgcctgatccacaaatatagagaacaccaaagaaaaaaagttcatattaatggctgttggaaacagtttgcattatgcagacaccaaacaatagaatacactagacctttatctaacagggcatctatgaggctgttatagtaactcaatccttcttcattaggttcacctgttccatctggcaagatgcatggtggtattagtgaacaataacaaaaaaaaaaagatagattttgcacataatttacataattcatacttggaaagatccgtgaccatgagatagagaagcggtatgcatccatgccgatgtcattcattaactccacatcttcctgccagtttatccatttagttgatgtccttatttcattacaagctcaatcaaagaaatagaatcgactgaacaaataagacatgctctatccagaaagccttcttgatgctccaaaatggcatcttgtatttggaaaaacatcagaaatggtcttcctgttatcttagttttggaagcagcatgctagagaagtggatttgcacaattagtatactagtaattcgtaaattagcagtttagcatgcctacagtctctacacatttaaactgtaaatggcccagacaaaacttgcactgggataatttcctaacaatataatacgtcagacattgatgcttggagatacaaaagtgcgcaagcaattagttttcataaattactagaaattgttgaagcaaaggttggcaaacatttgacctaacttccaggatgcctggatttgcacattcctggttaaatgaccagttcagatttctttgaaaaataatcaattcaggttccatcagatcatccgtaaaactataattcaaatttaaaagaacaacgtaattggtcaaggcaaagttcacatttttaatcccaacataattagccaaaaggtaaacttcatgtcccagattacatatcaggaacaaatgaagtaaataacataaaggaggtacaggaattcatgaattatggataactcaccttgtagcgatggtagtgatcaacagcaacatctgcattgctgaaatcaatcacccgacctgaagaaagattacattgctcatattgcagtcatagtttgcacctcagattagagtacttctacaaataaatccccattactgaacctggtcttttcgtgagagtatcccatatggtaggtccacgttggccctcattcacggcaccttcatactggtaatatattgaccagaaatatccatcagacatccatctaaaagaactcaagtgaaattagagatcttttggtaacactagacctggtaagctgaagaagctgtgccaaagataaaaccgggagggaagtctgctctgcttatagcttcaacacaggcagaaaagctgacaaggatatgaacaagtgttaagagactcatggccttcccttcagtaggtagcactaactactaatgtccacagtctatagataagtagcagacaggattgtaagatatatataaaccttgttgagttggtggggtgtgggaagcaactgaaggctgatcatcacttgtcttggaatccaacgcgcgtctctgctaagtagctcttgtggaggtgacaggttgcaatatctctatcacactggacattttatcaaaaagggaaggaaactttgacatgtccaactctgaaagtgtcacgggtgtagcaaactaaagctttacttgagtgcaacaattccaggcgcattaaggatttcccaggattccagcatttaagaataaaaattgtgtaactgagccagtctttaggaagctacaccagtttgagaggagtgcaagcaacatggaagaaaggctgtgttaatatcacgataacacatttccttcctaaaataccatcctgcagtattgaccccccttttttttctcttatgcaatgatgctaagtgataatgacaataaggagcctaaaaaattatgattaggaaaatacagtggttaaccccaatataataggaatctttgttatccaactagtttggcagcacggcataccaacaaacaagtactactaattattgatcaccacatttgttgcattgatttaatgagtggataaaccaaaactgatagcaacgatttagtgatgaatttatcctgagattatagcacagtcacacacttatcccattggaaagaaaacggtttgcttgcacggcagagcctttcaagaattgaatagctccagtgatagccacacgaaagggacaggagcgatttgctgatggtgaccagtggaacaggcaagaatgtagtgcacgtgttatccatgaaatccctcacatgtacacctaaggtttatcactaaatacagtaacacacaaatacacaatgcatataaacgtagacttttgagtcaacagttttgtttatcacgaaatatagtaactaacactcaaatacacaatgcatagaaacgtagacttctgagtcaaccgtgttagaatagcttggccaaagatgctcgatgattcgaaatcttcggtcaaaaagcttggaattcatagtataacgaccactgtcactatgctatttggttttaggtagagaaaccaagagttcttcgattcgaaattaggttggttcctcaacctcctcacatggatcggaaggcttcgattcgaagtcgtccgattcacatcggtgccatctacctacccatccccattccccaccgcccacgcccaaccctatcaaatgaaacgcgagattgcaaccccccaaagagaagaaaacggcagcggaaatggcgacgtcccgatcccccacgcggcgtgatggggaagaactcctcaggcgtacgcgcatcggcagcgtcgtcaccgcgaaagcgccccccaaaagagagaggaaatgggtcccagaaaagcgcaaaagggacggaacttggggggttgcttgcctccgcaactgtcgcttggcttgcgcgcgtcgccggcgacgtcgaagccgccggaatccgggaggcgccacgcctgggcgcccccgccgaagcagcatctcgcggcgcgtggcgtggtgatgatgcgtgtggagacgaagccacgcaacgcaacgaggaagacgacgagcgtatgctgggctgggccttatccgaaaacgggtgtcggcccatatcaacccaggacgttcggcccacgttacttgaccacaaacgggattgcggacgacgagcggcccacgacatttgggccttaaccggattgctgacgtgcgtgatagtaagtctattttgcctccctcatgttctctgcgagtcagcctgccacgtcaacaggaaccaccctacaaaccatctaagggttgatctgctacggttttcgcttattcgaatcgtttattagcaaataaaaatttatttatgagtaaaatgtttatatatgtccataataacttaaagcaaatgttgtaaaatataagcattttaaaaaaacaaaaaagcaaattcaaaactaagttctcaaattcaaattttggctcataaatataagcataaccaaacaataagaccgattttcctccattttgcggttgagggaggtaattcaatcaggagcagagatgagaaatgtacaatagattttatctgtgtaggtgcgacctgttcttgttgggtcgagacgggattgcggcttacgtgaggcccgctatatttgagcctgaacgggatcgcggctgacttgggccgtaaggtccgttgtagttgggctggattacgataggcctttcattaggcctttatgagtcttacaagtgggccaatccattcggcctagaggcccatttgtcatgtagaaaagcgctcgccattatcctgtccgcgagcacacgaaggcgttcgttatcctctgctgcttctctgcggtttgagcgagcgagggaggaagaggaggggaggagacgaagatggccggggtggcggcgttgcagggcgcgatggcgtccctctccatctctgcgccgggggcggcgagcaccagcagcttctggggccacccgctctccaccttcgccgccgcgccggctggggtttgtgccgactcccaaccctgattctcatttttcgcattcctttatgtttgctctgctcttatgattcgctggaaaagtagaaatgccagcttgcactgagatttaggattttagagctcaccaacagcgtggcattgcaatggtgatgtctacatcgcctcactgtactgttgttgccttcaggagttcaggctcaggacctcaactagccaacaaccaacgttgtgtcaaaattttgtggtatattttttttagagaaaaggtctcaaggattttgtggtatagttgaacctagttggctagtataaggagggtttatatgaattaatgaatgcttgaaatctcaagtttgagtatatcaactgagtgaattcagaagttagaaattgtgttgtctaccatgggatgtggcctgttatgtttcagtttaaacttgaatattatttttttcctatggtggtataagcgatggatacccaatattcagcctttcaagcagaggattatttttctgaaagatgtgccctctagtgagacagaccatttcttgttctaacctgctgtatagatcacatttcgctggctagaaacaattttgcctttgaactttaaattactcaacagtagaaatttcacagaagacttccatgggaaaatgatggaaactcatttcactcggggatagcctgtagcaaatgattggcacactcggtatacttatcagactgaacttgttctatcttttgtatattctttttggcgttccttagctcttctagatagtctactgcacttcgtcctcagaatgagactcactcacgactaattacttacctggaaagtggtgatgagagaaaataaggccgaataattgctcttgaatggagtgactgagctatatatggcacttatatgatgaactgtactaaaatctgcacttatatgaagaaactcgtactaaaagatcatatgattatcctagatattcttgcctaagaaacatcgtgagcatgattcatgtcatatctcaaaagcagctgattattacattttatgtcattttcataagaaactctgacaagatatgcataaatttttatatgcaggttaaatttatgatcaagacatgcccaattcaaatgagggtaagtttcaattcttttttggtctgcagcttgctatttactcaaatgtctgaaatttccctttttccaatgcagcttaagcgatgggagaggaagaagtgtaaaccaaacagtcttcctgtcctgcacaagatgcatgttaggattggcgatacagtacaagtcattgcaggccgtgagaaaggtaaagttggagaagttacgcggctttttaagcacaacagcactgtaatagtgaaggacttgaacttgaagtccaagcacaagaaaggaacagaagatgaaccgggtgaaatcgtcatggtcagcattgtttctcttgaaacttctttctgtgctgcttctagctagtgtcgtatatatagtttcagatgcctgatcgttaacctatggttgttggtgttttctttgatcagattgaaggccccattcacagctcaaatgtgatgctctactcaaaggaaaagaatgtggcgagtagggttggacacaaattccttgaggatggaacgaaggttcggtacctggtcaagactggtgaaataattgacagtgctgagaattgggtcaaggtgttcaaggaaggaagttcggagtgatcatggtagcatgggagtcctgcacattttctgaactgcactttttgtatgcccaaatgagttgatgcttttctagattcagatttcagagtcttgtaaatttctatacagttgccaacatttttttgtatccaatgacatgcttggcttgttaaccagctactagaatggttcagctacattcgctcatacaaatgattttgtaatgttgttgctgtcccctgtcctgagctattattcgcaaccattgactaatttggtccatttccatatagaaatatagatgagatgtacatataaaacccatgaatgattgataagttcttttttttaaggagtagtaagataggagtatcataaaagaaacaagcttagcaattttttttttgaaacaacccgcagcgatgtttctattgatatagtaggaaaaaaatacaaatatatagtgctaaaagatagcgatgtttctattgatatagtaggaaaaaaaatacaaatatatagtgctaaaagattatagtcagaaaaaggaaaaaacaaatctgatttgccattgataacatgaaagctcaagagctcgtgctgacggctgagaatcaacatagcagatatggcacgcaaatatcaaatccaggtgatcgtaagcaaaccacagttttctgcttgcgttttgctccgcgagggaaacctgacacctgtccagatcccatgagacgaagatgcaacccatcaaggtcacgaaaacaacgggaagtcggcaacctgtgctgcacagtgcacacagcctttgacagcacgtgcgcagcgcgcgagccagatctagctggtagtacagatgggcagcatcggcggcggcggctcgccggaggagcgcgcggcggccggtgggccggtgtgcgtgacggggtcgaccggctacgtcggctcgtggctcgtccgcgccctgctccgccgcggctaccgcgtccacgccaccgcccgcgacccaggtacgccgtacgcgcgagctcgctcgctagcatcgatgaagctcgtggcgtggtgaaactgacgatcatggcggccggcggccggggtttggtggcagacaaggcgtggcgggtgttctccgccgtggaggaggggaaggaccagctgcgggtgttccgggcggacatggccggcgaggggagcttcgacgccgccgcgaccggctgcgtggcgttcttccatgtcgccgcctccatggacatccacgtcccaccccagaatggcaacgacaacaacatcggtaatttacgaagtttaatctccgccaaatcaagattacttccatcaatcgctactaaccgcatgcacatttggattagaccgtaattaattagttttcgtgttcttgatggattcttgaagaggagcacgtgaggacgcgggtgctggagccggcgacgaggggaaccatcaacgtgcttcaatcctgcgtccgcgcggggacagtgcgcagggtcgtcttcacgtcgtccatcagcacgatgacggcggcgacgacgacggcggcgaccgggcggcgcaaggccgtcgtcgacgagtcctgcctccgcgccgccgccgacgtctggaacaccaagcccatcggctgggtgcgtatacataggcgcgcgcacacacacacacacacctgctacactccatgaatcctctgaaaaacttagtgttccatggatcaatgaacattttgcaggtttacatcctgtcgaagctgatgacggaggaggcggcattcgggttcgcgagggagaatggcatcaatctggcgtcgctcgtgctgccgacggtggccggcccgttcttgacgccgaatgtgcctaccagcatccagctcctcctctcaccaattacaggcaaacaaattctccatcacacaagtacataatcatgtacagattgtactaatcttgcaatgatcaacagcattgttctgaaaatcaatttgtgtgttcatctccatatgcaggtgatccgaagctgtattctctgctggcatctgtgcactccaggttcgggtgtgtgccattggcacacatccaggacgtgtgcgacgctcacgtgttcttgatggagacggagcaagcggatggacggtatctgtgcgccggagggagctatccgatggcccagattgctcagattctgtccttgcactaccctcctttcaaacctgcaaaaaggcaagcagctgtcaaccagccacatccatgtctttcagatcatagtagtagtatttttttagggtcaagttgatcttgtgcttttctggtgtttgattaggactacgttgatctggtgtgttttggcatgaagctgcaggttaagcaaagatttccatggctcaaacccgtcggtggtatcgtccaagcggctgagggatttggggttcaggttcgagtatgatgttgaggaaatcatcaagaacagcgtcgtacagtgcgttgatcatggattcctgcaggatcccgacagttccaactgttagtggtagtagagtagtgagtagtgacgctcagtgagacagtgactgagccaagttgctgtctggttgggcctgaaaggctttctttcttgtactactagtagttagtacttgtaattcagtaatgtattgtattgacaagagatcaaggcggtatgaaatcagtttcagaaccacacacacacacacacacacacacacacacattttcagtattatccatgcagctcaacattcaccactatctcgaattgatgccatattcctaagcaccacaacatcatgcaaacatccactgataaacacacgcatttgcaaatctaaaaaaaaaaactgctaaaatcatgtgctttttttttctgaagaagaaacaacagcaaaatgtacatactaacaaatcgccagcatctaacagaacagaacaatacctgggatcagatcaccactctaaacaatgattcgattcctcaattcttaaaagcagttttgcagaaggaatcatcaaggtttacagatgacgacgaagcaagggaggagagctctcgggttgagcaggtagagctcctcgatgctggcgtaggcgcccaccttgccggcgacggagtcgaaccccggctgcgccgccacttcctggagattctccagcggccggtggatcctcccggcgaccaccctgcacaccagcagcgccttcctcacgcccgcgttcgccgcctcgtcgccgtctccgtctccggcgatgcattccagcgcgcgcttgctggtggaggtggtgaacacgccgacgccgtccttgatctctctggtcgccgagaagccgtggcggatgatgcggcagacgctgcagctgcccgacgtgcagagggtggaggagtcgccagcgccgagggagcaggcgagcgtcgtggcgtggaaccggaggagctcgttgccgtcggcgaggcagcgcgggtgcttcttggacagcctcgccgccttccccttcaccgcctccctgaactcctcgaaccgcgccaccgacctctccgcgttgtgcaccttcaccacccgctcgatgcggcccagcgcgttctccgtcttcgcccacccggccttgcagatgatctccaccaccttcctcgacgagtcgccttccaccagctcggtcactgcaagaacgcgcgccatggatgatgaaacagagaggcagagcaaagcttgccttgagagttcgtccatggtgtttggtgctccgcttaccggcgtgtctggagtggtggtgcgactccagggcgtcgtggttggcgaagcggtcgccgcagcggtggcaccggatgccgacctcgcaggaggccctggcgggagcgggcgacggcgcctcggcgttgtcgtcgtcgtcatcggcgcggcggagcggcgacatggcggacggggacttcctcgtcgagacaggggtggtgctgcaccgcagcaggagcgggctgtgcgggaacggcaccccgccgccggcgccggcccacgcgccgcggccgggggtgctgatccggagctcgcacttcgcgtccgacctggcggcgagcagcacgtcgtgggtcaccgggttcagcacgtcgttgctccctatcgacctcgggctaccgcatcccccatcgccttcgccggcggcggcggcggcgacggcgtcctcctgcctccggctgccaccgtactggctgtggaacacgtccctcaggttggcgatggaccgcgagcaccccgacctgcgcagcgccgccgccgacgtcgacgacgacttcttgccggctgtgacgccgccctgagattcctcccgctcgatcacgccgcaagaatcccccgatttgcagttgagcgacttcttgagcgccgcccacaccgtcggcatctcccccttctccggcgactccccttcctcgccggacaatccgattgctgccaatcaaaccactccatttttaacaagacacgcaacacacattccatgattccatctagagaaaaaggatccaaaactaaagcagatagtactaatcactgtatattcaagaaagaaattatctacaagatgaacagggggaagaacctgaatactgcaatgactgtgcactgctaactgtaagtctgtaactgctaatgtcattcattcctcatcattgccttcttcttcttctaccttcagctggccagagagtattactgtctccatggatgcaaagttcaaactgaacgggtctcattggcacatgcagctagctagaggccggcattatcttggagtaaactggtaggtaaaaacaattgggactggctggcctctgaaattgctctttggtcttatgcatggactatgccagtgacatgggctcactcttcagtcttgagacgttttgctacttccaaggggaccagaaacggacgaacggatcgtaaatgggtctgcggcttaggagaatctttggcactgcgtacaatgcacactctggtctaatctttgaacaaaatacagtaataatactgggctatggggattaaaaaaagtttgagctgatcggtaacagttcagttcgtgccaatgggctaagctatggcctgattgatcgacaaccggcactgaaatgcggcagggttttgttcatttgtcaccgcataatggcatgatccaaccacgcatggccgttagcaagtcctaggataccgttcagtaagcggtgatgcaacgtgggtgctcagttggcacggcatgagctgatcagattggccattttggctccaggattcatagtcaaaagaaattacatgtcctgcttaaacatatagtaataaatgcaaaagaaaccttgaaaatctaccaaaactcaatgagctaaacagtgtgaaacaaattaattttagagtgaagtgcttgccggtctctagtccacttgtgtcctctaaattcccgaactttcaaaatacattttcaagtctccaatttatcaaagtttatcattttggtcctaaattgacacgagcctattggattctacgtggtgattatctggcatgccacatgaacactaaagtgacatgtcagatagatattctagtcttttttttcttcttcttctttttccttcccttcttcgtttcccttctgtcgttttttccccacatgaatgggaaggaagacaagaaaagaaaaagagaaagaaaatgagtcaataccggcatgccacgtgagcgtcacgtaggatcccagaggagttgtggcgatttaggcactttgataagtttggagacatgaaaatatgttttgagagttcaagtacttgaatgacacaagcaaacaactttagggaccgaaacaatacactttactcttaaatttaggctatgtgcgacaaatgggttataagatgtgtgattggaaaaggaaaatgaatgaatgtctaggattaaatgaggtgtgaataataaatagctaagatacaataatgtcctttgaataatgttccatttgtcaaatgaatccttaaggcatgcatgttgaccagatgatcaccgaagcattaaatttgacaaaaaaaatctctggaaaaaaaggcgtatcaaacaaggactattttaccatcattcgaaggtggtgtcaaattatagccagccaatacatgaacaagttagaaaactgtcaaaacccaattcatcaatagttgagatttggtggtggtatattttttttccttttttttgattatgaccttttagggttgtaatcttgtaattttttttctctatcaatggaactttgcacggttgttaaaaaaaaaacagttgggacttttcaagaaaaaaaaaacggccggagcactgtcaaacgaactcactaataggcctcgaaatctgattgggcttttcacgaacaaaggcccataaaatgtagcccatttaggcccaaactgtacatcacccgtgattaaacggcccagcccaaacatcataacactggatagggtgcagacaagggtcccacccgtcagatcccaacacgtcatcattgccgatccgcttccagaagcagcggcaagtttccatctccttcttccccttggctttttatcgctcgatcaggtggcagcgacaacgagagggagagcgagagctaagttcgccggagaagatggcgatgcggcggtggagagaggatgcggtggcgctgtcgctgcgcgggtgcggattcggcgacggggacgacgaccggccggagaagccgcggcggtacggggtgacggagatgaggagccccttctacgccttccgccccgcccaccacgcgctccaggttctcggagagccccccgcctaatccatccccatttttgtttcatgcttctacgaatcgctgctgggttgtggaatttggtgtagttttaacttttaatcgcgttctgattcccaccgaatcgtgtttgaaatgaagccctatctgctgcataattcttcgtgacttgattgtttatttgttaattcctaaacagggccaccatattggaatcttcagtctgtgcgatcaacgatcagtgtcagtttgtagatcaagtggtacatttgtggatgtcagaatgcgtagcagctacagctagttttatcagttagattcttaaccaagctgttccctcttatgtcgacatagcatggtcccgtgattatatgaagtgcttaatgccatttgagaatttgagaattgaggatgcttacttgcaatgcaaatgaactttctggctactttattgctgcattgaagctgtgactaggaagattttatattactgtttcctttcaaatgaagaaaattctagaatctagataggagtacatcacttgaaaacagaatgaacctcctggttagggatttcaaggaataaaacagctcgttctcaaggctgtcatttcctgttctatttcaggaaatattggattctctaggtccttttgttgatggtttgaagtttactggtggatctcatagtttgatgggaaaagaactggttagagagattactgatttagcacacaagcatgacatatatgtgagtacaggagattgggcagagcatcttctgcgtcaaggaccttcttttttcaagcaatatgtcgaggtatgcaggcattttgtttgttttgaggtacattggtagtggtacactgtgatacacacttgtctctgaaaattctgaaaccacatgcatgacattagatgttccgtttcaggagtgcaaggcattaggatttgacaccatcgagctgaatgctggatctctcaagctcccggaagaagctctcctgagattagtccgcctcatcaagactagtggtttgcaagcaaagcccctgttttcagtgaagtttgacagttctgatattcctccatctggagatagggcatttggggcatacatagttccagtgaagcagaattcaggtaactataataagcaatcgctttctaatgcccttgtttagctacttctctgcgtactaagcaatgtaagtacaaacgcaagaaaacagcattaagggaaaagttgctcaacatacatttgtcaacatcagtttttccttggggaatttagttacaaagcaatttaatactatcaccgtatgtttatttggctatgctgttggctctgtgattgtactgtctacattttcctatgatgccttcctcactttgatgtggtgcagaaagagtcgaggatgttgacctgttgataaggagggccgagaggtgcttggaagcaggggcagacatgatcatgatcgatgccgacgacatttgccagcgcgctgactctctacgggcagacatcgtcgccaagattgtaggccggctcgggctcgagaagaccatgttcgaggcttccaaccccaacacctccgagtggttcgtcagaagatacgggccacgggtaaacgaatcttcaattcttccctgagaccctgaagctgtgcacaatgctatgcttattacaatgctatgctgacagaccattttgcaagcaagaagcttagactcgttcatgaggcatttccaggtgtatctaacgtgttgcgttgtgaatgtaggtgaatctgttcgtggatcactccgacgtgatgaacctggagcgtctccgaggcttcaacatgcgtggagtctgcaactctcccttattcggaatcggctcgcccttcttcctgatgtgacgacctccctgaatcctcctgatgtatacgaccttcctgaatcgtgccagtcctatctcgcatggaatgctgtgttcgtggtgttgagatgccttcctgcaataactggatctggatgatgtgtagtatgaaaaaaatgtactcctgtctgctagcagtatcagctcatgtatcgtatgtactcttcattctctactcctgcccggaaacttattactccttgtcacagtttatagggtgttcttttacaagaaaaaaataactcggtaaatgtttgactaataacaattgcccctaatcgtcgtattaacagtgctaaatattatacacgttatcttactagattcatattttgaagcattcatcgggaatatagcatagaataaattaatggttcaagtatgcaattgaagattgtgtaaaaaaaaaaagaccacctataatttggtacggaaggaatattatcattggtttgggcttgtttggttgggccgctaatggtgcgcagagaacatgggcctgatttgccgggccacatgggccggactttgctatgaggcccatttcgtcgtcgtcgtcgtcgtcgtcccgtctcccgaactcgccgtgcggcactcgtgctttgctcttctcgtctccccactggccgccgccacgtctcgtctcctcctcctcctcgccgccgccgccgccgccgcgggagaagggttgggttggtgaaagagagatgagggagatgatgggtcctccccgccgcggcccggcgtacaagacgaagctgtgcgcgctgtggaggcaaggcgagtgcaaccgcgcctcctgcagcttcgcccacggcgacgccgagctccgtggcccgccgcctcgttccccgttcccgcctcgcggtggacctggtatgcgcgcaccccctctccctcctccccttccccgtctcgctctccccttcccatctgcttttctgcttctcggcggttgccgtgtgctctcgatccgcagctaggtggctctaaatctgttcttctgcaatggaattactgtctccgccgatgttctattgtggacagattgtgccgattgttttctaggaaattattcagacggagtgaaactgggttgagtgtgatctgctatcagtttgaaaagtttgggggatattcatattttgagaagattcatggtgtcctaccatggccccaagaaagagcattctttttaaaataggagtatacatcgtttcatctgtttatgttggatttcgtttataaatcctgagaggatgggctgcatatgtggggaatatgacagacagtgcgggatgctggttgtacagcgaagtgaaagagatatcaattccatctgcgctgtgtgctttctgcagaaacttttggaaatgttgtggaactgagctagtagtaagagaaaatgattagaagaataccaaccatggtaacatctgacaagagctgccctgtaagataaacactgatgacctggtttctatctctggctacttgttggaagaaatatactctacagcctgcacctggtcatgtgatatcagcactagagtcatttatatacaaaactagagcgtaataattccatcagtttgtgtgatatcattttgttgtactgttttatcgcccatatattatccttttcttatagtactttggctgccaaagtttcatgaacaatgtgacatctttgctaatcatatttttgctactgtacaaattagctgttcccagagagattttctccaaccgactacttgcagaggatgacgcatcctattttcattgcacaccttttcagttggtaatcagacattttatggtcgctggaatgcttatcttgctacaggagatttcttgagggatatcatgtggtttcagtcagatgcatgttatcttaatgtgctaaagcacctagcagcttttgcaactaattgtaacaaatttgctgaatacacagcggcaaggtctcctcttgggctttattcttgcctgccattccaagtatgatcacagaaatataaaatttgaagtcaataccaataatatctggacaagtggaattaggtttgttcgacaatattggaatttggaagatctttcttcgtgataatctcagtatgatgtcaaaaattggatattccatccattattcacttctcatgactgacacgttacaaggtgctggatttattttttaagtggtgcatcatacacgtgatatgtgatcatatattggtctccctcatgcattagtctcattggatctgctcttttatgcccccctggggttatgttggtgcctctgctacttactgataattgaataatcatatggctcaaggttgtggtaagcttaatgggtttgtgtgctgcctcatatgtgtatagctcctctatcttttgtggcatattgcttctttgtacatatatgtatgtaaaaactaccatactgaattgtagggagacgagaccatagacctgatgactttagaggtaggcatctgagaccccataggaggaattcccctgaaagagatgccagggatcatttgttccgtgatcacagaccgcgctctcgagatagaggtaatatgctaccaataaaattcttcgttgtaactagtctattctatttttaaacttctatataatctctgaacttttgtatgttgaaatcttccctgcaggctctagtcattcaagatctcccatcaggaagaggtatggggctagggtatacatacatctttgtaatcgagtccttacatgtggttatgcctgtttttatctattttattgggcatataatctaccttcatgtgaccgaatgacttggttcctgctaattgttaatgccctttgcttgtgatgcacccaagggttagcaggtagcctggggcatgcttatgttaaaggcacttgtgcttgttgatatacttataaattacaaactacacaactacatacacatcagagtatcagacaaatataaacatgttgctcttaggcttccatgcaagtaattatgttcacaggaccattttgttaaatatgcaagctgagaaatgtgtatattaatcctctcatacaaatgattcttttttcaaaattttcaagaaaattattatttgttgcaccatttaatgcagtgtttatacagcaacctactgtagagtataatactatcttatcttgctctgtttaatgagggaaccctttgggtttgttgttttcacgaaagatagttctactatgttgccatgtaaccgctgcatgtttttgtcttgcaatttggtcgtttggtgcaattgtatttatgtattccatggatctttcattgagggaaggcatagaaagaagcttgagggtggaaaaactaattcatcagaaagtttgaactcctctgataacgaagatagaaaaaaggatgatagattcaacaaagctgatgataaacatgataatgaagcacaggtttgattatgatctatgcaatccatctcgctagcaaacagttatagtcgtcccaatgctactgaatctcttttatatatttgcttatgttatgcagctgcaacgcattcaactggatatggaagcattacatgaggagaaatcttcactggaggtataatgttcttcatacatatgttacatgtccagcacaaccattagttacttctgctttattattatatgcatgcacatttgaaaagctgatacctgcactacatggattgtgttgagcattctaccacttggctgcaatttatgtttagtttatataaattttggactgctccaatttttctgttttgttttcctgccttaactataatgattatctgtgggaacttttgtgttgagtaaagttcataagatgttcaatccattcagatataatcagatggctccagatatgatgtgtcaatattgacgttaactgatgctacaattgaacaaattgatggctagtttacctttttaagtgacaaatgatacacttcttgaatctcttttagttgcgcctgttgcacttattgtactcttgaggtgtttcaaattcttcttattgttcattcttgcctgtatgttgatattgtaccctattgatgcatccttcttccttgtattataggtgatactgaatggcaagatcaatgaagcatccaaactttctagcagaatagctgatcttgaatcacaattgaacgatgaaaaagaagcttgcgaaaggttttttatttctacaacacatgagcataatcttctctctttttgacaaaaacatcagtttgtggattcttcagctgattaaaaatatccccatgtcgtctgactattcataatactgctctgtcacttaggatggcctcaaaaacaaagaaactcatcaaagcacatgcacgctatgtgaaagctcaggatgatttaaagaggcaggtttcctgtttgtcacctatctgatctgcatacttctattttgtctatatgagaagacaaccctttttttagtctttacatctattaacacattaaagggggtgcaggtcgcaagctcgttttgagaggttcgctgatttgcttgcttcagataccttgaagccgtgtagcaaggatcagggttctagtgctgctaaggaagatccatataatgcttatgaaatgagtccaagtgatcaacggcagaatcatgaaacaactagaaaaagatccgttgccctctcaactagcgaagaaggaaggaatggtaagctaactagatgacatgtttggagatatctatttaatagtcgaatggtttgtccgtattaacgctgccaactagatattagacacatccatgattttcctctgtggtaaataaacaaatgattgacatcctgttactctcacctgtggcttcttcagggaagaaaaggagagagagttatgacaacagggatcctatgtcagagaaatatagaccagaagatgctctagaaccttttcagagcagcaagggaactgaggcaaaagaactattatctgtgaagaagaatttgggggatggtgacaacaatgagaaaggaaatgttgtttcttctgcaaatgtttttacagatagggtgagatgctttcttgcttattctctttatattctctgtggttgctagttgctcgttgctatttctcagtaaaaattagctaatgttatgattcaaagttgatttcctttttgtttattatcaaatctggtagctcgtttggctagaatcaaatccgataatctaatgtttgttcattagcagctaataaccagaatactataatccatcagtttcaaggttttgctgattggttctaaatgaatcatttgtgttctgtgatccaagtttgataactagaataacttcgtgacaccatatggtaattgcatgatttatatgtatcatatgtgttctttatgatccaaatttgatatctaaaacaactctgacagcatttggtaattgcatgattttcttttatttcttgatctctttccatgttttaattttttttctaatatacgtcctccacataattccctcccactagtattatgcttccgtttccaaacattgccttggtatttttctcagagcatcatcctgacaatttgtgccctattttgcttacagtatgagggcggtgatgatgatgatgttcttgtggactagtaaattcatgcagatggagattgacaaagatttcagcagtaaggagtagggtgaagtatggaacatgcgttcattgccatgccagttgcgttttcacagactaacctgaaactaaggctgccagcctgttatttatcttaatgtatcatttaatacaccgggcattaggaattaagcatctcgataacttctgtggcgaagacgagttgcattgttctcaaacaggttattctcacatttgggcaaactgtgcgtcgttattaccatggattccaagtagcctgtatggataatgtatctggcagcctattcgagttaggtttggtattcatggattcatcattgtgttgtaaatttgtaatgctgcgatctttagcgtctgtgttactacagcatcccatggtttcactcggcatgaagcttcaatcctttttcttttttctttgagatggaagttgaactgtggatgctaaggccaccatcgtttggcttagaggtgaaaatggtaacggtaattcccggccgactggcgttcgtttttgacttttaaccggccgaactatatggaaatggtaatcgaccaaaaaaatatggaaatggtaaaaaatatggaaacagaaacggaaatggttttgctgttgtaccgatcattttcgtatttaccgtattcttgcgaaaattaccgtttcttataatatggtaattaccgtatttctaaatatgtcgatatttatagggcatgtatctacttgacccacaggttaaagattgattgactcttcaatcaaatccctaacttgagtgcatggctaaaatatagttatatagtacaaccctaatttatgtaaagttaaatatatgtttttatagtttaatgtttccgtatttgttaccggtttccgatctgtaccgacatgttttcgtccgtattattctgtttccggttttccaatatttccgataccattttcatttccgattttaccgttttcgattttgtttctgagaagaatatgattacggaaatggttgaggctgttttccgatcgtttctgaccgttttcatccctagtttggctaaatgcaccatatgacagcagatgttgtatagaggaaacgataggcgcttaaattagaatgtttcaatcccgcgtgagcctttgtgcatacagtattttagaggctttttgtaggaattctatttcttcaaccccttaataatgttgttcttcgcatcggttgtaatttggtaatgccatttttttttttgttattgaccagacatatggctaatattaagatatttctaaattctgatttggttgagttcggctacaaaccaacagttgctatcaagtcaatgtggtgtttgaaagatgaatataaagattaagtgtttttacgtaaaatgagatggtattacgtatgattaattgagttttaattattacaaacttgaaaaatatatttatttgatattttagagcaacttttatatagaaaattttcgcacgaaacacaccgtttagtagtttaaaaagcgcaaatattcaaattttcatccaacttttgttcaagaaaagaacagggcctcttttcgaaaatcagctatttacgagggatgtttctgtaatttcacacaaagaagagggtacaagctctcgctctctctcggagtctcgggaatcctctcccctccaccgccgccgccgccgccatcaccggcgctccgagccctacctccctcccctcccctcccctcccaacccggctgtctcatggaccggcaagcccaggactacgcggccgcggccatggcgtacgcgcaggcgcagcagcagcaaccgcagtacggcttccaccctcaggcgccgccgccgccgccgcagtacccgcaccacccgccgccctacgccgcgccgctccctcagtacgcgccctacgcgcgcggcatgccgcccccgcaggcccagcagctctactcgcacctcccgccgcaccagcagcctccccacttcgccgcgcacgccatgccgtcgccctccccgccgccgccccaccccgcctacatgcacccgccgccgttcgactccgcgccaccccccgccgcggccccgcccccctccgacccggagctccagaagcgcatcgacaaggtcgtcgagtacatcgcgaagaacgggcccgagttcgaggtcgtgatccgcgacaagcagcacgacaacccggactacgccttcatcttcggcggcgagggccacgcctactacaggtacaagctctgggtctcgccgcggccgccggtggcgccgtaccctcccgggtcgatgcacatgatgccgccgccgctgggtccgatgatgcgtgggccgccgatgcaccagccgggttacccaccgttctacgaccagcaccagcatttcggtgctcacggccatggggagtatgatgccgcgccgcagcaatccttcaagggcctctccgggccgcttccggtggatgtcgcagctgagctgcacgacgtgcttaccaatctcaatggcaccaaggagtcgatcaagggtgccaagacatggttcatgcaaaggtcgccgttcgcgccggctttggctgaagctctgaaggatagagtgtttgctttagaggattcggagaggcagctccacattatcttcctggttaacgatattcttttcgaaaggtatagcttcgatcggcatctgcttttggtatagaattgctatcctctgctgatgtgaaatgaaggcacgctgtctgatctgattgactgaataaatcacatgatacgatgaagaaagcaagaaaacattcctgctgcaaagatatctatttgcctaatatttagcaactcctttcatggtactagttaggacttaggactacttgtttaatcctttgtccaacatggagatgaatgtctttaggtgtttgttggtccttcaaaaactttgcgatgaactgaggtttattcctagtagatctgttatgtcatatgttcttttcctgaaagtcaattctgttttagcttgtgcttatatccatttgtcaggagggtccataatcagatcttagcttctacataatgtaaattaacattagaataatttgattcatcaagatgttagcaatagcaaaatcagctcattgcagacaacaatgttgaagctagcatctgaggataaaattcaaatgcaatgcatgttttatcaataatagcatgaatgcttgatgatgatatttctgctatatgttgtcaatgtttgatgataggtcatatggatcagtagatcgctttggtttgtatcactcattgtactgttttattgataccttttgtgcatttgatctggagaagctgattgtggcatgaaatctttattaattaaattaatatgtcacgactacatgacctttaatcgtttgtttttacatattcctggtcctttgctgaccatgttcgatctgctgcagcttacaaagacgaactaattctcgggaccttgacaatgaggctttggcttttaaatttgtgctgggatcaatgcttgcaaggatatataacaatccacagagcaaagatgataaccagattcgcctcgagaaaatcctgcagttctggggttcaaaggaagtttatgaccaggaaaccattgctaaccttgaaagagacatgaaaggtggggtagcatatcctttgccaccacggcatgtctcaccggatccctcaacattttcaggtgtgtcctctctctttttccatctttcctattattttatgtctgtacatgttgtctacattgaccagcacatttttctcatgtgagttcataaagttttaaggtgttagttttggcataaggattttgtttgtagttttgtgctattgtccttacttcttttgattggataactttttttttctcgaatactgatcagattactctcatgattgttatgtttatatgttaatgcctaaaaaataactttgtaagttggtatgtttgaagtatgtcggcagttcgctaaatttcaccatgcaacagttatctctacttaaatacctttgaagttcactcttattaatatgttcatataactagaaaaatcaactattagcttcttgtctgtttgttatttcctaattaaaccattgtacagattgagtccttttattttcttaatttaattattgtagaaatagatttgttgtggcatcatttctttgcaatactactaacttttatatgtatacaatggaccttttgctttttggaggtaaacctaaatacgcggttggatgttatttcaggatcagtgcatcagccctcaaaatggtcctcagatccacaagaggaaatggcaacccatcctctttctgttccaccccaacctgtgccttctgcacaatttccattaaatcaacttccagctggtgtttaccctcctgtaggtcaaactgcttttccaggatctttgccagtgcaaacccccactgtgctgcctcaaactgctgctacaccagctatcacaaatgatccaaatccacctccttatccactattcccccctggtctgattccaggaatggtgcgaaagatgcagatcgggagtggagtgccatactctcccctgagtccacttgacatccccacaatcattccaccatccactattccggagtccgagatccttgagcgtgtatcgaagttctttaaggagattggagaggtaaacccatcagaagggccaatgaagcaaagcgagcccgatgattacgataactatgagagggacattcctgctcgcaagggtggtgcatgtattcctcccccacccaacttgcttgtaaaccttgagacagggatgcgtgcagatggttcggttgatagtaaaccggggtcaactggccgattgggccttggagcgtctgccgatccaaatgagatcggccagtatgatgatgtctactcttcatatcgcaaacagaggagcagtacataccactcttccatcagtgctcgctcattagcaccaaagtgaacggcagaagcatcatatgaaccctttcctcatctgtgtaggactgtacttaaatgaacagaattggcttatcaaatgattgtacgatgcaactatgtattgtcaccagtagcaaatgatgtttcttccagtatcttcttgtaagaggggttttgatcgagctgattttgttggcgtttttagttcagatttggagttgatattctttccaagcttccagtcctaaaatgtggcttcagtcactgggacaggattgctgctcagtaaaaatatgttttctcatgtacaaaacttgtatccttgtgagtttagtcatgtgaaattaacatcattagatttttcaccaaaagatattttcataccgtacttattaatttccacgcgcacattcaaatacatatcagttgtcaaagctgaacatcccaagtcaatctgtactttttttttgtggcacccatgttcagacattgcacgtacaggtgtatgctcatgcgaatatcaggagctgtattattatctcttggagataagcgaaactcttcagcgtagttcagattttcagaattctgatctattgcgaacagatgtatcagctccagacttcaccatgcctgtgtcgtagcaacgcatatattcaaatgagaacccatttgaatttattgttcaggactgcagagtcccatatcttcagtacagttatgataattacaggctgaattattacctctggacaacgacatacttctccttttttaggtgaactctgcggtttatctgaaaaaaaggatcaccttgttctcagaaattcataattactactcgagttatattatctgtttgaggcaacaagcaagcaaaaccagagatagagcttcatactggttggactcgctaaaattgttcagcctaatcctgaattcaaattattattacgaacagaagtattaaaacagagataagacttcatactggttgaagcttcagacttcatgtgccgtaacgatggctctctttccacgtatgtaatttgagatcgtcaggattgcagactgtatttacaatcgccaaatgaaaacagagataagaaaacatcaatccaattatccaaagttggatatatgctacctgcctaattagtagaagagtaataagttcgtttgacatatgcttacctgcttaatcacgtacgaaaatcggtccaaagttcaatctggttacatgaaaattcaaactaaaatctgctttacgtacgagaaattcatcctgagtccaatcttattacacgaacatttcaaactccaaatctctacattctaacgctatggttgtctggtctggtccttggtcgtgtcccgtttcattgtgtactatttacctgtaatgtgtatccttaagtctggtttgatggtgtctgaaacgttttgctgtggtagagcagcatggaagaactataatgaataagtgatccctaatcattgtgtccaaattttgcttctgctatacccttttgtgctgtttcttatgttttgcttaaaaatttgatctgacaaacaaatttgtctaaattatgctcttgttctgactgtgtactgtacacatttgtattgctaccggtttggcacatagttttctctttgattgcagatcaaacccttctgattgcagattgcttggctatggctgatgtgctcactgttcttctttagcttgtatattgctgatggtggcttggctacggctgaaaaagttgctgctgcgccgacttggcaactgttgctccagtaatgctttgtcctctcttcctagccgccgacttggcacttggcagctgttgctcctgtaatgcgttgttatctcttatctcttgagatgtactatgattttgaggctgtttgacttgtgccagattgccagtgctgatgctatattatctcaggtttttatgctagtatatgttttactgtgtgctgcctgtgtcgagttacgtaatctattgaaccgctatgcgtgttgatgccctgttgttgcttgccagattgatgcccctgttgcttgcagcttgcaagctgtagtgaaatcctaaaattcgaagccaaatctattctgaacttttgaagatctgtgatgtccggaagaaaagattcaaacagataaacgggactctccagaatctataaaataaatgatcgacaaacgctttgctttggtaggcttctcattaacccaaacattctggaagaccaatgctggaggaaaacatagaaaaaaaactctctgttcccataaaagaaatagtactccggtttatctaaaaatatgaagaattctgtgttttcaatatcaatctaaattcagaatagctagaagctgtgtgatctggaagacaagcgaacccagagatagaacttcacactgattggactcatcaaaattcttgtgtttggtttaaatctctggtttattacaaacagaagtatcagctccagacttcatcacgcaattgccgtaactatgcatatatgatatatccaaatgacgagacggcatttatttgttcaggactgcagagtcccgtatcttcagtatagttctgataattacaaattgaagttttaactctggacaacgacatacttttcttttttgaggtaaaacaaaggaatactctgcggtttatctgaaaaaaaagagttatatgtcctcaatatcaccagaaattaagaattattactactacgagcttatattatctcttcgaggcaatcaaaacaaaagagacagcttcacactggttggactcgcaaaaattgttcagccagcgtaatccagaattcagataagtatcaggacgaagtattagcttcagactccatgtgccgtaacaatggcgttctcctctcctcctgtgtgtatgaaaacaactgcaaacttacaaattctgtcaacttatatctgaaaatttgaaaaatttcacccatgtagtttgagatcgtcaggattgcaggctgtatcatgatgttctctattgcatccttaacgttaaacgaaagcacagatgagaaaacatcatacactttgcacccgtaataagttcattagatatctcttaatcacgtacgaaaatcagtcgagagttcaatctcgttacatgaacgttcaaactaaaatctgcttttacgtacaagaaattaatccagagtccaatcttattacacgaacattcaaactccaaatctctacattctaacgctataaattgcgagcgatcccacgttgctctgcacaacaatcagccaaagccgcaacaccaatctcaccacccaccaccgatctctcgccgacgagacagaatggcgccgtcgtccaagctcgccgccctcttcttcgccttcgccgtcgtggcggcggcggcgctggcaccggccgcagaagcgagggtccaagggttcaaccatgaagcggcgtccgagcctgccattgccgcagccggggagtccaaagctgccaccggaggaggagcgccgacattgccgggattacccggcttgccgttcccgctcttcccgttcctcacgctcccgttcccgctgatccccatcggcggctcttctggcggcggcggcgccgctccgccttcggctggctctggcttccggttcccgttcccgctcccgctgccgttccctgcgcccgcctcgccgggcggcgctccgccgtcgtctgggtccggcttcccggcgttcccgttcccgttccccagctcgccggtctcgccaccgtctcaagcatcacccgcctcgccggcggcaccggcgccgccatcgccgccgcagccaaaggagtgcttgacgccgctgttgtcgatgatgtcgtgcgcggactacctgacgaacagcagcgcgcagacgccgccgggcacctgctgcgaggggttcaagtcgctggtgagcacggcgcccatctgcctgtgccacggcatcaatggcgacctgagcaagttcctcccgctccccgtcgacatgatgaagatgatgacgctccccaacacctgcggcgccacggtcccacttcagacgttctccatgtgcaacagtaagttcttgctaatcaaattacaccctaattaaaccctatcgtaaagcatgtttattatttctaatgcattgtttgtttgaagataacataatccatcgtaaaaacatgttttgtttttatgcattgtttctttgattgaagagattagtataaaccatcatgaaacatgtttattttttcatgcattgcttgtttgatgaagagattaattaatctaatctggtgttttgtttgatttgacagcgccctcggtgcctccattgatgcctcagagcccatctgctgctgctccagcgcctggtagtcccccatcgtcgtaaatattcaggtaaattcgtatttgaaaccctctgaaatttaatctgttaaaatttatgattctttttctcatctaacatcttctgattttgtctatttgtttctggcaggtgtgtcaccgtagcctgtcgtctgcttcagccgtagtcttctttagtctcaggagttttaagatatacacaaggtttagggtattaggatgtgattaagtcatactagtagatatttagcgctattaagtagcgtacatgtattttttttgtccgtgaaataaataaagtttactgtttatttgaagttgtccctccatgatgcaatacggatttgtcatttgcgtgtcaaactctcatcgtacgctaattaactgatgatccatctcgcgagtatgattattcttcgaaaaaaaaaatcattgggctgtatttggcgactagccaggtgggctcccagcctcccatcggtccattttcatactgggccctgcacatgattttaattggaacatgtacaaatccacatttttagttcaatgaataataccggtatgacatttgcaatttaaaagaaattccttcgcttctgtcttagtggaaccaatacagtacagtattcataatattacttcgtgcttatatatttggatcggaggagtattgaacatattttttaggataaaagtggcaaaccgtaaagtttcgtgtagaaaccttctatattaaagttagttgttataaatataagattaatctatttttcaaatttgtgataatgcgtggaactcttaataacaccacctatatcgttaagcaggcccacgaactaagcatccttcttaggctacgaagtacgaaatttaaccagcagagcaaattgttgtttatagtccaaattccgtctaagacgccagagaagaattgacgaattcaatttgggcaaagatgctggtaaaacttaacaatgttttagagcaagataccagtacatagtacaaatcaacatacagatttgccacaatttactttagtacaattttacttattgacaaacacattccattctccgtggtccatttgctctgattgcagaatgctccaatatgaaatccctgccgattcttcacttctgaccatgcacagttgggacggcaaaatatactcagaaacaatatcaaagcaagcaagcaataaaacatactcagaaaaaaaacttttgaactcttatttttctatagtatcggattggaaaggcctcagaccgtcctagttcatgagcaatatcaacatagctctggcaacaacgatgtgtgccagttctgaaaccatcatgtcatcaaaggcatcagatccaatccaacaattcgcattcaactcacaaaagattaatctgcacgaacagccatagaatttaaaaggagatataggttcatcaaaactgtgtcagattaaagtattctcagcacccttatgaaggaatcagacagggataactgtattttcacttgtgatttcatcatccacatctgaaaaaaaagcacaaagaatttaacaaaaatcacaaagcaaataaccttaaacaaaatcatatcaattgaggaatctatcagatcttcctattcaatatgaaagaaatgtcatggaacgccacaatccgcagattggacgctttcctttcagagtttcgcatcatttagatccccaaaagacaaaattcacataaacgaaaaaaatactatgtaaatatatgtggcgtttccaggattagactggcaccaagaacgccaacaatcaggatatgaccacacatcagaagaatatcatctggcgtccgagccattataccgtgaagaactgaataatcctccggaattggtaatggacgcatctaatcaagagatctaaaacctaatcgaaggataaacaacagcctaataatctaaaagcaacagtatgttttgtgagatctggaagctcagacagccaagggtttggtcttcaactaccacaaagtagcagtatcagaaactctagtccaaataaaaattgctcatcaccgctaccaagatctcaaatcagctgccgcaaacagaaatataaaacaatctaaatctaattcagaatggtcgtagcgatggatagaatgaggagctcagacagccaagggtttggtcttcaaatactacaaaagtagtatcagaaactctagtccacaaaaaattgctcatcaccgctccaacatctatttgtctaccagcgaaacgaaaatacaatagaaatcaaaccaaattcgagagcaatcagacgaaaacgagatcaaaacgggaagagattacggaggaaacaggcgacgggcggagaggagatgggcgctatgcgtcgacggcttggcggctctcgcagggatttatagaggaggtaagcgtttctagggtttcttctcccgtgcggctagtagatgggcccgtttaggcccacataaaataagatggaatttgcagcccggcccactagcttccgtgccggatcgtggcctttctgcgtgcaaggtttaatttgacaggttgcacctaaagttcattttatattcctcacatattcgtaccacagtaccaagatataacgcatactcctcaacatgaagtactcgctaatttcatctgatccaagctcatgtgacgtgccattatccaaaacgtcaagaatacattcaatataaagtataggaagtactcacctcatgtgaagtactcccatgctcgcttcctcaacatgcatcaacatgaggtatatacagtaccggagggagtatgggaggaaggagtacttcaagaacacattaaggctgtgtttagatcagcacaaagtttaaattttggttgaaattggagatgatgtgactgaaaagttgtgtgtgtatgacatgttgctctgatggaaaatgactaaagtttggattcagactttggatctaaacacaacctaaatgcatacttcctccggtaccatagctttttgacgttttggataatgacacggtctccaaaatataactttgactttatttttctattataatatatataataaacaaatgcatgtttacttttcttattgtactttgaaagataaatctatatgtgttgttttaattactttaaattaaatatttttatagttattgataatcaaagttacgaagtttgacattaactttgtccacaacattaagaataatggaaccgaaggaagtgagagatagagagaagagaagaaaattatactagtagttaataaccatgtaactcttctactggtacatgttaacataagctcacagttgagaccttattagttggggaatttttttgggtttggttatcacatcggatatacggacacacatttgaagtattaaacatagtctaataacaaaacaaattatagattccgccagaaaacaacgagacaaatttattaaggctaattaattcatcattagcaaatgtttactgtagcatcacattgtcagatcatggcgcaattagacttaaaagattcgtctcacaatttacacgcaatcggtgtaattggtttttttcctacatttaatattcaatacatgtgtccaaattaacattttatctgatagcgtgaaaatttttattttgggaactaaacatggcctgactctactattaaacttgatctaaaggcctgttagagccgccaaaagggataggaagggagtaacaactgccggaagtttataattttccatatcatagtctacgtatatacacacagaaaacaacaattaatttttttagctttgtatatatagttactccagcaatattagacgattaataaggaagtaaggccagtttgcgtgctattttttccgtataaaaatgctatatatgtggaaaaaaattgataatataccttcctttggaatgatttgcatttatatatatgcataagaagaattagcacaaatatacccgtacagcacgatgggaatgcgggagtgctacgtaaccgccagccgggttgttcacgcatgttgaacgagcggcaccactgcggtccctgcggcaccgcgtcggtgccgtggtctgggagagcgggaacgtggtggcgaggcggtgccgcggctgtgtcctgcgggaccgtcgcgtccccgcagattggtgatgcgggatggcgcatgctcctccaatacatgcatgcttacgtgcatatgctttgcacgagccagccaatggaatgccggctcacaggatgctacactacgcacgtaatctaacttactgctaatgcatgcatgccactaatcccgcgcaaccaatccgcggaactgcgtcggttccgcacaactgtatcgcggcaccgctagactgacacggtcccgcgtcttcaagctgcgccgccggtgcggtggcgcgttcccgttcagcgggaaaagtatattttcacaacaacgttagaaacatgtatatatgtgtaaaactacgaaaaataatgcatatttcaaaatataattcatatatgtgagcttcgatcagcatcaaaggaaacatatattctttcttaaaacataccttccatatagaaaaacatatatatatatatatatatatatatatatatatatatatatatatatattatatgcagatctaaagactcgaatcatacgacgaccaactattaattgttcattgtcgagatggccacaatccttttcgtcggcgttctcctgatgagctgctgcttcgtgcttatttcctctgcatctggcaatggaacgatcaggccgatcttttcgatgaaccaagcggtatgttacactacacattgctgattgaattgcttttaatttggtatggttgcatgaagtatcggtcgatctattctcaaattaatttcaatctacaaaatcatatatatgtactcttgggattggttcatcagagaaaatgtggtgcaattggaggaacagcgcgctgcaaagagatcgttgacggatacattattgaagacggcagtatctttcaggtgagttcttttattgtaacgaacccgcgtaagtttgcatgcagttgtagtttagatacaatcacattgatcagaacgttataacatgatcccacgtacgtataatctatctctatttatttttttatgttaatgtggttttttttttgctttggtcttctctttaattaataatgtaatacagtatataataatgaatagattgacataagaactccgtactaatgttgtttggcatactgtaatatttttgggaatttttttttgtgcctctaaatctttgccctatgctcatatctttttcatacccctgagtttgtcatctctcttatgtgttttgatctactttatgtctattctattagctggccgttagattttttccaatgaccatactacctcttcctcgtacataaaaagctaatttgaaaagcataagtgcaagaacaattttagattaaaaacaaatcaaggagataaatatattaccccaactttaaattttaaaatgaattttaattaaatttgatgaaaattttaatggtatttgaccttctctctccatggacacatgtcttccaatttggttgaagttctttaaaaaaatatccttttggtttccaggtagaggagaaataggaaaaccaaatgatttttttatgcaattttcctaatttaaattttattaaatttgattgtaattcttttagaaaagtttaaagtttgatttgtcaaacaattctatccattcaattaattgtaatcgaatcttttgccttcgtagttatatttttataagagtaaagtacatcaccggtctctaaacttgtatcgttgtgtcatcccggtccctaaactcgcaaatcgaccgttcaggtcctcaaacttgttcgactatgtcatcccggtccctaaacttgtagatcactcgtataggtcctccaatttgttcagttgtgtcaccccagtccctaaacttggatttgaatatcatctgggtcaaataggacggtctaaagactttatatttaaaaataattcataactttttcatgtgaactctaatgaagataaactttatatcaaacttgtagccctcgacgcgatctataactttgtagttgatgttttttttattttaagtcattttttgtcccaaaatgtaattttaaaattaaaattacaaaatctataaacatgcaacaatattttgggaccctaaacagttttaattcaaaaaattttcaactacaaagttgtaggtcgcgtcgagggctacaattttgatataaagtttgtctttattagagttcacatgaaaaagttatgaattattttttggtataaagtttttagaccgtcctgtttagggaccggggtgacacaactgaacaagttggaggacctaaacgagtgatctgcaagtttagggaccgggatgatacagtcgaacaagtttaaggacctgaatgatcgatttgcgagtttagggaccgggatgacacagcggtacaagtttagggaccggtgatggactttactatttttataacaagcgttcccatatagaaagagagagtaatatagtcatttcagaaaatctaacaccaaaaactcaagggtatataagggagatgataaaagtcaacaacaaaaaaagataggctttattattcataggcgaaaaagattgttctcatcatttttacttgtatttatgtacctaatctgttgttttttctttcagtcagctgggtatataacaaaaacatatgaggcacactatggatttatagcaacaatggacgtttacggcttccctcttagcccgggccaaattgtcagttatggttcagcttggatcataactgataatgttgatgatccagtatcgaatttagaagtcattcagatcggttggagggtagattttttggtttatgtcctatatttttttcttaactaggaaagcattagtttctagttaatcgtcttaatatcctcacaggtcgagccaggtgataaacgcctgttttcgacctctattgcaatgtgagtgatttttctacacatccagcatttcatattctgtttactaatactcttgcagccactaaaaaatatcatttatctcttcaaaaaagacatcgggtcctagctttccgttaacagatccctctcacgtggacaaaacctgccctggttttcaacccaggatcggcgcatacatacgtcctaacgattctatccctggtatttcccaaccaaatggaaccaaggaatacatcacactcaaaataaccaaggttttgttttttcaccaatcccaaaaaatcaatatcgtatatcaatggataatactcctatgtgagaacaaaaaaggtttaatctatttttctctttttgataatgatgtacaggatataacttaagcgaattggatggtgcattatgggtttaacagggatcctgatctcattggtcgcattcccatgtcgtactacagtacactatctaactcagcaactaacatctggtttggaggcatggtggctacaaatgctacatttcaaccgactcctccgcttccgatgggcagcggttacatgccagctgacaacggtaacatggcagcgtccatgaagaacattcaactcatcgatgagcaagggcgagcctggtcagcaggaaatggtttagttggcttctccaccaagaaggatgactacacctttactcctattgttggcgatcagtttttctacgggggccccttccagctcacaagctcgggaaccatgttgcgcgctaatgtcgtttaccctcttctactagtgttgtttttttattatcttttctcatagctacctttggcataggttgaaaaataatttagattatgcctattgaaaaaaaatcactatgtatatttaaatatttcctctgttttatattatagtcatatgattttttttcttagtcaagcttctttaaatttgaccaagtttatgaaaaaaaaatcagcaacctctcctccacgttgccccgtcgtgccggtcaaaacctggcggtacacggtgggtgttgcggggcactaggttgtgtctgagccgccaatggtcgcctccgcctccccgctgtcccgcgaagcgggccaatgtccagtggcacgaggtgagggcgtgggctacgagcagagctgattgaattttatggtggtgttctcggtccgtttagtcctgcatgactggattttgtattgagttttgcccgattgaatttcttattatcgatatttaattttatgatttttccatcgtacgcggctggtatatagagcgataatggacaaaaaatcattcataacccttagtaaagcaaaatcggactccaacctaaagcgggggcaacatcatgcttacgtaagcgaatgatggatagtagaaacactactaatgtttaacaaggtatatatctatatctataatctataactaatataaagattcatatttttcctttcgtcatagtaattttgggtccgtcaatcagaaaagcggcaccctccatatacacgcgcaattacatccgtacgacggccaaagcctactcgtgtacgccggacagataaaaaaaaatcaaagatcgattaacaaaccaatcgaacaatcattgtaagtattacaactacaccgaccgataatcctaacaataatctaatctcatagaaccacttcccaaaatcagactttcatagttcgacacaaccaaatccaaatcggatgcacaacaccataaggcaaacacaataaccaaagattcacccaaataaaatcaacaaagggatccatgggagaactccaatccaccccaacaaaattagcattgcaacctaaagcaattgacaaatcccttcttacatatccatcttgacctctttcttcagcttcttcaggtccggcactagatcgatggcgactagcctggatagaagatgaacagcgctggaccacttgatgttgtggtcacaccgttgccgcctgcgcttgcaccttcctccattgccacttacaaccaccagatccggagaagttgaggtcgttgccagccttcacgctgccctccaccggtccaccccaacgccagcctccgccttgctagatccaccatcaccatggccactgctggtctgctgccgccttcttgtccccttcgccgtggtcgttgcgaaccggacgctcggggcgggaggatgagagggaatgctcgaggcggaggatgagaggtggaggaaaggagaggtagaggtagcgaaccggacgctactgcttgcctccttgctcggagtcagaggattcgagattgggatgaggagaagtgggtttggtggcggcttgggtcggtggggagtggggactggggagcggacggggattagggattaaagaataaagaccgtgggccactagatggcctccggttttttcttttccgagcttcgtatagttgatttttcttgtactcatcactgctgccggcacgattcgtctcttgcagcaggcacgcatcactgctgccaatctgccatggtgccaccacatcatttataattgtgaattggaaataagcagatactgtagtattatatatttgacaatatatttttttatgaatctataactaatataaatattcgtatttttcctttcatcacatctaattttcatcatgttcgtatgcaatccgattcggttagcaatagccatggaaaaaaattgcaaaaaaaaaaaaaaatcggtggccgccgacgccatcaccgccaccggagggaaaagagaggcagcaaagggagccgccgctgccggatccacccgcggtggccgccaccgccgacggatccacccgcggatgaagccgacgccgtcatcgccgtcaatgccgtcgttgagagggcgtcatcaccgtcaaggccaacgaggagagggagagggggagggacggccgtcgctgccgtctccgtcgcaccccgccgtcgctgcgccgtgccggtgagacgggaaggagagcgggagacggagcgcgaacgccaacgccgtcgtcgccgccgttgggagggcgccgtctccgccgcaccctgtcgtcgccgcgccatgccggcgagaagggagggagaagggaagggaagcagcatcggtggtgggagagacggcgccggtggtgggggaggcggccagcttgggggagggggagaagcgggagatggggagagggagcggcaccgccggaggggaggggaggggaagcggcgccggtggggagagagggagggggagaggaggcgttgggcgcagggtggtggccggctcagctgggggaagggggagggggagggttagggtcatcaatttggaattgatctgagccgtccatcaaaatgaacggctcagatcgatcgagggtttgggccgcacgccggccggtggactagcaagtgagaggaggagtatgggggtattaagtagacttttgcgcttgcaggctaaagaagaaaatgggctgaaaagggcccatagagaaaaatgatttttattttgacttttatttaaataaatgctgaaatgatatttgtattatcaaaattaccaaaattaccaattaagctatgtaaattccaagaaaatttcaaagagtgtaattaatatagaaaatttaataaaaattaaatccaaacataatattttatttctcacacttactttacttgaacattaatttaattatatacctaccaacataaaaataccctaatattccagaaaatgtgtatttcatttaattagaatttaatatgttttaatttaatttaatcttttttttcattccgttgcaacgcacgggcacttttgctaaaatttcaaagtgtataattaatattgtagaaaatttaaatttcattaaattagaatttaatatgttttaatttaattctcttttcttttctttccgttccaacgcatgggcacttttgctaaaccaaacaacacttttgatcaatacacacactccgtaatcacccggtgcaacgcacggacacttttgctagtaaagataaagataaataaaaaataaaaaataagggactagctataaatcactcaaaagatgtttttataaaaatcatatgaatataattacggtcaattataatagttacatcatatttacatatttacattgtaattacatgtttgggtgcatatcaaaacaaaattgatacatgtctcatttggtaatggttgcatgctctccaccatgagatcctagaaaaaatgttttgggtgagatatagcaaaatcgaaaaaataatatccctttcccgttcggcttaaagtctctctctctctccctcctcgctgtcccacggctctctttctttccccctcgtgggccacgcctcctgcactagcccatcttccttcctctctctccggcccacctccgccttgggccgcctcgcccagctagcccagggcagcccctcccgcaccgacaggtggggcccacctgtcgaaggcgtcttcctcctccagccgagtctcgttcttctccccggcggccgacgagccctaaaagccgccaccgcatgcatccatcggcctccctgatcgtttcctctcccatttgaatgcgaaaatcgattccccactcccatctcatcatttgaaccataataatcccacccgatcgggcccttaatcgcattaaatcggcggcgaaccgtaccggcgccgaagcttctcaggttgcagtttgccatcgggtttgccgtcgccggccacctccgtcttctcctcgccgtagagtcctcattagtgagcccgccatcctctcctctccttccctatgagctctccatcatccgttgtggcacaaaacgccggcgagccctggctcccatgccgccggacgccggtgccggtctccagccttacctgcttggcaccgcgtggggccgacatgacgcaataaacattgttttgtaatatataaaaaataatttaagaaatttggaacatccattttaacaaccataaaaattcaattggtaatatctttgccgtttgaattccgaattaacccatttaagtgtctgatttttcctaacaatgaaaataacctattatgagctttgctgcttgtatagtttttcttaacctagtacccctctgacggagcgtggggctcctcaccgggagaccgcgcaggcccccctttgccggttcggccgggggcgctaagtgaggttcttcgccctcgatctgaggaatgtcagcgagagaggaaatgcacaagacacgggcgacgtagacaggttcgggccgctgagaagcgtaataccctactcctgtgttctggtggatctgtgtgtgaaggaatacagagagctctggagccagagagctcgagagcgagagagagttcagactctccaatcccctccccagagttcgacctcctctctccctctttaggcctgggccttctttttttatctggttaggggtcaccacacgggcctctcgctacctcagaaaagaaacatgctttttacaatgagggctaatctacagccggaaatgacctctgacaagcagtacgcacgcctccttctccgcccgcccgctttttccggggatgcccacttcaaccttcatttactggccagcgacttccttgccatacttgcgctgaagcctggaatgaatctgaccgggactgacatacccactcctggagttggcacgccggctccggctagggacgagagccaggaagctctcatcattccgacgggacggggcgaggcgtgtgacaggccgcctgttgccacctaacccgcgatctgacaggtctgtgaccggtcatataccgcgactggtcacagaccggataagcatgcgctgcgccgcattgaatgcggcgtggcgcgctcgtctagcccgctataaatgcggttaggtgagcgccgctgtgctcacctaacccacacacgtggcgccaaaaccacagggggtcggggcgccccagccctcggggccgaaacgggagcggcccgacccctcggggagacagagggaggggtggccacgtctccttcgggcccgacccccccgagggggtcaggccacgtgggtgaccgcggctacccaagcctctagtcacgatacccccggccccatgtcaccgacaccctccgtttcatgttacaacgcttaaaatttgactaaatttataaaaaaaattagtaatatttacaacatcaaattagtttcattaaaaatatttgtcttggattaaaaatattactattttttctacaaatttgattaaacttagagcatcaaaacgacttataacctgaaacggagggaatatattttaatggcaaaatttactacaggacactcaaaaaacttgtaattggctgagagtcaccgcaaaaacaagacacagctgatggacactacaaaaaattatgtaattaggtatagaacaccgaagacaatattttataatatccgggtctgaagaggtgagaaatttttcgaaatagcaagattgcccctggctccatcttcctccacctgtgagcagggagcagccgccggcgagtttgtcctgtggagcgggtagcggcaaccgcgcgccaggagcggccgacggcgcgaaggcggacgcggtcgggccggggagggagcgcgagggcggtggcgtggagcgctagcaggaggcggctacgcgtgaggccggcgacggccattcgatgcgtacgtgttcgacatcagcaccgaaaaccatttgacgcgtacattcgattaacacccaggctcagccggaggaggagtaggagggcgtccacggcggcaggcggcgtcgccggagcgcaggtggaggcggcgctgaaccgcaagaacgtggaggcgctcccggaggacgagacggtggagggcggcccggaggacgcgtgggtgcccgaccacgagtctggcggatgaggccgccgtctccggcaccaaaaaccatgaccactgcggagcggcggcggccggcggctcgccgtcggtgcttgaccaggctgtgttcgtccgcgaggaggacatggaggacgtcgagaggccggccgtcgacatggccgctgccaatcacaagcccaaatgagcatcaacttcttgcagcaataaccaataaagccaaataatgccttctgaaatctcatgtacagctagaagtagaaaatttccagtggaaatcttgcatccttggttctatgaatcttgttatctacagtgatcaatcgatcaatcggataacctgttctttgatgaatcttgttgtgtttttatcggatggaatttgctgggattgctttgaattcgtgcacgacgccgtcgatctcgatgaggctgcagtcggggaccttgtcgatctcgttcctcctcatctgcctcctcaccttcaccacctcgccgtggcggccattcgacgcgtatgtgttcgacatcagcacgtagtcgccggcgtccgcgtcggcgtcggtggtgcgccgccacatcacccgctcggcgcgctcgacgtcgtcatgtgcgcggcatgcggcgagcagcgagccccagatgagcgcgtcggggtgtgctggcattgccgcgacgagctcctctgcctcgtctagtctcccggcgcggtcgagcatgtcgacgacgcagccgtagtgctcgatgcgaggttccggcatggcgtcgagttgctggagcccctcctcgacaagtccggcatgacagcacgccgtgaggacgccgaggagggtcacctcgttcggcgtcacgccggctcgttgcatgccggcaaatagagacagggcgtcctcaccgtggccgtgcattgcgagacccaagatcatggatgtgtaggtgtaccggcgagacccagcgaccggcggccatagcaagcctcatatcggccagcgttcaacagcctcctcgcgcacggccacctcctgctcgcgctccgcgccgccgtcgccgccgccctcgcgctccctccccgaccgcgtccgcctccacgccgtcggccgctcctggtgcgcggtcgccgctacttgctctcttgccgtggacaacctcgccggcggctgctccctgctaattttttgtgtgtgatttcaggtggaggaagatggagctaggggcaatcttgctatttcgaaaatttctcacctcttttgacctggatattataaaatattgttttcggtatgctatagccaattacacattttttgtagtgtccatcagccgtgtctcgtttttgcggaccaattatacgttttttgagtgtcctgtagcaaattttgtctattttaattttgcgtttgctgtgtagacgtcattgtttcggaagattggttgttcttcgctgctgatccagaagactttataagcaatcaagtcatatcatacattaaagcatgttgaatcctaacatagtgaaaactatattgtttcgttgttattggatcgcttttataaataataccgttactattctctctccctcatggtgccatcccccaaagatggcgtcgagcactgctgtgaccttagcagaggaggaggccaagccagagatgggaggtagtaggatgcgggcctcctcgtcggtcctggcatctagttttgctgcgagggagaaggtgacaacggggtggagaggaggctctacgcgagattcgtcagccagcgggggacggtcacttggtcagcattgaggtgagtgctttagaagggatttgcttcaaagaccgttgtcaccgttgatcgcattgcctgagctccaatctaccttcaaccgttgctgagttccctcgtctatcctgttgttgagtagaaatagagaaatagagaaggcggagagatctgacatgtgggttctattattattattattattattattattattattattattattattattattattattattattattattattattattattattattattattattattattattattattattattattattattattattattattattattattattattattattattattattattattattattattattatactgataagagtgccggttgcaccatgtgtgtcatctcatgccaaaaccgcctaaaagagtgttcaaaggataatttatttggattaacgagtttgggtagcctggtgtaaccgttcagttggtaaattgtcacaatagtttagaggagtaatttgatattttgttcaaacgcggtagtagtacttctaatactattactgtattgttagcaataagcttatgtttcaataagaaaacctttttttagataataataagaaaacattttataacgaataacgtatgtattactatacagcattcatcatgtgaagatgtaatatagtttcatgtcgaaaaaaaattatataatggtattgcgaaaagatttgctatatagaaataatgatgatggtcaacatatgatgatccagcagtcagcggatgagtttgtagtgccagcgtcaatgtcactcttgccgagagaagtactaggagagcccggtgtgccactaccatgcaggccacttccaaatctaaccatatttgattagccactagtacaagatattaagaggctcatggcacgtcatcatatatttttctatcagaaagaccctgtctctttcaactgatctgaagcgtctctttcagctgatctaaaccttggcctgtactggccttttggctcgatgatcggaataaacagttgagatgctccaagaggtgtcacattcaaccatccatatatacctccctcccccctccatatatagcactagtatggaagccagtggcctaatgctgcatttgaaaaaaaaagaaaagaaaagaaagaacaggcccaaaacaagagaatagtggagcctggagaggctggcctggggatgcagaggcagcagagctaggtgggtcaattttagcccaacctacccattctaatctgggaaggaaaacctgttctgctgggttttggacacaccaagacaccatgagcagagggaggaacctactcattctgggaaggaaaacctgttttgctaggtttttgacccactatgagaagaggaaaacctggttttttttgacccatcatgagcagagggaggaacctacacattctgggaaggaaaccctgttttgctgggttttttttggcccaccgtgagcagagggaggaagactacaaaaccctcccatcttcttcttcgccggcgtgcgctctgtctctctctctccgcgactctgtcgccctagcttcatcctctccaccgcgtagctcagatggattatatcatctccggtgctccccctccccctgcgatcttctgcccaccacctctctcaccgccgccgccacctccacccattttctactctccaccagacgtttcgtacttctctccacccgcgctcccctgctatgctggcttccctgcatgcactggcggcggcggcggcggcaatgatggttctggcggcgacggccattccggcggggatgagcgtcgcgtgttcgtctgcaactgcaagtcatggtcatgggttcaagtgttcgttacgatgatcgcgtctctcttctcggcgtgcggtggcgcctacatctaccggagccagtgctggaagagcttgaagaagaagaagaagccaccgccgccgcttcctctgtatcgtccgcgtccgccgccggctggagacggtcgacccgacgtcaccgtacaccatcatcaccatcactatggcgccaacggcggtggcgggcacagcgccaatggcggcggcggactcgacggcagcagcagcatcgggaccaatggcggcgacatcggcggcaacgacgacctctacggcggcggcggcaacgaaagcttcggcgcagcctccgacgccgaggcgtgctcgatcatgtagcgcgccgacgaggcgacgccggtggcttcaaggcggcggacggctgcacgagatggggggggggggggggggagacgatggcgcggcagcggacgacagccagcgaaagttattctaaccttttttttttttaatctagaactagcacaatgcaagtgtttcactaaaaagaatcacccgtcagcgagggatatttggaagggagtatcagcgagagggattgcgaaaaagacaagcataatgcttgttgctttgtttcccttgttttcctaaagcatcactcctcaccatcaggattattagcattgcctcctaattcaagtggcttcttggttagcgttctcaacttctcattggctcattgctagaagatgatcgcatttaccaaggtgcatctacgacaccaccctatgggcggaacgactcaaaataatagatagaacccgactcaaaaggtacatgttttattcaatctcttgaaagtgagtgtgatctaagctcccgacaaaaaaaagaaaaaagaacacgagtggtttgaatgtttagtacacacatgttctattcaatctcttgaatgttttcataatcatgcttaactcaaaaacgaacacaactggctagttgctcaaaattatgagcaaggaaagcatgttaatctaatttcaatccctgtctatccccttctctatgattttcatggcaagggggaacaattacagtaactgtactgatctcgcatccttatacattacttgataatatacattatgaaaattttcctcgaaaaaaatatacattgtgacaaactccaaagccaagccggtccttattgaacagcaccagtagcatttctatcacttggtaaatagactggatcatcaaccatgctagtagcatttctatcacttggtaaatggactggatcatcaaccatactgacgataggagtttcctgctcttgctgagaaccctgtggagtgcctacaggtatgttgatgccagcaaaaccgaccaacacagcagcagctccgatgtagtccaatagatgaggagcatgacctgttagtgtatccacaatggcagcaattggaacttggatcgtgagaccagccgtggctactgttgttgttgtgagaaggattgcttttgcccacaagtagtcactcaaaacattatctaacaaacctgtaaagaacacaacagcttgatgttagtgctagtccatggatagtttgagcttttatgatcttttacgaagttattccgttatgacttcctacaatgttatatttaaaacaacgcaaaggtttacacacacaaacacaatgcattattatagctcacattatggtcatgcgtaaactgcaaacctaccttttccaacaataagaccaacttgctcccatgtcagcctgtggaatggctccagcttggtgaaattcaagaacaatgcaaaaggaaagaaaaataacatgttaaacagtccaaggaatccaagaaactgagccatgctcacttcgccttgaccttctttctcatcaggcagctttttccgtatcaaggtgatatacacagcatacaatccagctgaaacaatagaaaggacatctccaagtagaggatttgtggcaatggtattcgctgtactacctgaatcagctaggctaacaattatcgttcctcccatgcagagaagtacactgattagtttcaaccacgtgaatgtttctccaagaaatactagtgcaaccaagaaagtgaagaggctagacgtgctgctcaatatcgtatttgactgcaggtacaaagaaacaaggacatgttaccaatggacaggagcgaggttaaataatggcatggaaatgcaggccttagtaacacttactgtaacagtggtgtatcttagagacaggttgaatgtaagctgagcgagaaaccagaaagggcagactaccatgctgactctagccacacgagcacgtgtccagcgcccttttgcatccaaccctttgctgccatctgctacattcagctcggcctggacagggaagactgcttctgaagccaatatgtcttcaggcaaccttgttggtgaggctgtattgccctcttgttcacttccatggagaagatttatgctctccagatcagcagactgctccaggtccgcaacatccttgcctttcaactttgtccaaaagttgttgatagaatcctcaaagtatcgtgcagcctcaactattgggatgtaaataacaaatagagaattgcatatgtaggtaatcaagaatggagaaacaccctcatccacaacagactgaacaatgtagcttgcagcaatccatatactcgcaacagcaacaatgtaaatcaatcctaaacaccacctccacgaatctgtgctcatcattttggcccacctactgccattgacgccaggaccatcatcaaccttcatgcttcctatcaatacgaaaatcttaccatttagcattatacaataaataacagtttcacatggaaactatggctttagttatctagtcctagaaggaaattagattgcagaaggaacaggttgtcatggcatcatgcacatcatttgtgtccgaatgatcacacaaacaaccttaattcagactgtattgctgagttttaacatagctcctaatcagtactcatgcaatctttttttcaattcacaaatgtgtttgcccatcagttgggtcatcaatttccaatgaattgaacatctagaaacaggtgcagacctaaagggtgctcaactctaaaattttctccagcaaagtccggatggatctccaatctacaggtgcagatcccctagagttggttccaaatccacctacgcaaatctggaccattacttcttttttaggcgttagatgtagccatttgcccatgtcaccctcttcttccctaatcccacacataatgagctatacattcataactgacaagacaatgaataatttaagttatggcataatgcttgtgccgtattttataattttcgctgttgatctgctaataatatactcccaccctttccttatatttgccgtcgggagtactagtattcaatcaattgcggtaaatactggtgccccaagtttctgaaaagtaagtaatacataactatcatatgatgatgttcccagtgtcatatgtatttcacacaagatgtttcttctccaatcaagttctggttgtcaactactgatagcccaggaaagctaataagatacagattgacatgtcgcaaagcagtataggattgaaatgatgtggccaccccgagtagatggggaacaaagtgacttgcttaatccgccatccatagaaatcatcagctgaaatccaccccggtggatttggaggtcaaactccaggggatctgcaaccccaatctacactggctcatgaaatcgcggagaggtggagggagggaggctacgagagtaatcaataccttcaaaattcgactcgagccaggatgctggccggtggaaggagcccggccgcgtcgccccctccgaacctgctcctgctcaccggccgccgtgcgtccgagggtgccgcgccgggggaggaggccgcttcacgcctttgcctctgggccttctcgccggccgccgcgggtgtgaggagacgaagggcgcgggagaaggccgccgcgcctccggctccgacgagcggcggaggaggaggaggagagggggatccggggatggagaatttggagggagaagaggtgaggccgtgagggagggggagacagagattagggggaatttggtaattctccacttcatcaattgttttaaactggtcttacaacacaacgaataggaggagggatttgataatttgacacttcacagagtgaactttcgttttgagtaaatttcactttgcttcacattttactattgatatgtgctttggatcatcctttaatctatttttatataataaattggatatagttggataaaaaagttatcaggatggtccaaacatcatggaggtaaaattacttgatccaaaataaaacattagttgaaatgtgatccaaagcgaaatataggtgataaaatgtggcccaaagtgaaatatggtgttttgtttatctgataaaaactttaaacgttagctaccataatatagtaaattgcttaaattggatgcatgaaagccacaattttttcttacaaaataattgcacaatattatatttttagttggtttaagaagtaatggttaaagttgaatttaggagaccatttgaaagctgttattagtttcagagaatcaggctgtgtttagttccttcaaacttccaacttttccgtcacatcaaatgtttggacacatgcatgtaacattaaatgtggacaaaaaaaaaccaattgcacagtttgcatgcaaattgcgagacaaatcttttgagcctaattacaccataatttaataatgtggtgctacagtaaacatttagtaataacatattaattaggcttaatatatttgtctcgcagtttacaggcggaatctgtaatttgttttgtttatagtttacgtttaatactttaaatatgtgtcgtatacattttttttttttgccaaaacaactgatcacagcctcactacaaaagtttatatttaaatatctaaaattattgaatggtcagctggattagccgagctccgtacgggtgcctacctaccgggtggagtaccgccctgtcgagaaggcagcgcgtggacggcgacagccaccgagccgccgacaaggaggaccacgtgcaaatacgattatatggtcataaatactcctttgattttcagtattgtatggcgtcgaattttaaatatacgttttactttttattatttaaattatgtaaaataaatacaagaatatataagttatgctaagattatcttcaatgtttaaacgtacaattcataacaagataattaataattatataattttaataagacaatttattatattattttaagtaagatgaatgattagtacgttgaaaatgtaatggtgtcagatattaagagagagagagaaagaggggagcaatttaactttagaataataaaacttagttaattttttaaactttaactagtagtaggatctcaaattctagtttaaaaaatcaatatacgtaaatttgtctagtagaaaagtaaaatcgtaaatatatcaaaacattttaaaatttattttaatataatattaatgataattaatctgaatattatcctaaacattaaatatctatgactaaaaagtgaattattttctataattgaaatatattcatgggcacatacagaaatagttacagttgctccaaaataaaacagttacaatttggaaacaaaattacatagagagagagaataaacaggatgacgatcgaattaagttacatgtatatatatttctactgaaattttatcaagcaccgaggagctgaagatcgatgagctagtgataatactagtagtggatgtcgttgacgagggcgcagtgcttcctgatctcgccctcggagccggtcttgacgccgaccatgcccagcttcgccatggacctcgcgaacacctggaagaacacctccggcgggctggacaccacgctggcgatgttggcctccgcggcggcgtcggtgacgagggcggcgtcggactggaagagaccgcggcgcctgaggaggccgcggtagtagcccaggtcgaaggtgaggaagctgcccgggtccatctccacgatcgtcgtgttgtccgacggcgccgcgcacttgctccgccgcaggttcgccgcgtactccgcgtccagcgacgggtccgcgtcgccggggccgcctttcccggtgaagttgtacagccgcttgctgaacgagttgcagtgcgcgatgccgatcgtgtgcgcccctgcacccatcaactcaattagtgagttcagaagtaaattaaaagcatctactaccttcgttcgttttttaataaatgacaccgttaactttttatcacatgtttaaccattcatctttttaaaaatttacgtaattataatttattttgttgttagttgttttatcacttaaagtattttaagcatgatttatatcttatacatttacataaaatttttttaatagatgaatgataaaatatatgtttaaaagtgaacagtgttattcattaaaaaaacgaagagagtgcttttcaattactatattagattatttactccacgtctaaaaagaaatgttttctcgaaaaacttttttttctatgatattgcttctaaactacttattctacagcactatacttcttcactcagcatagtatttgttattttgttaagtaagtttatttctaaaagtatttagtttatccttatatgaaaataatccaaataacccatttcaaatggttcggtgacaaaactgagtggttgaatttcatagaaaaccagtgcaagtgcagtttctctgaagtttgtacctaaaaaccatttgtatattatcttagtccaaatcctcaattgaaatctacaggtagatggttgttcagcagtttgcggatttcattaactgatcagatacccagtactctgcaattaatgggagaaaacgagagatgtactggatatctgtttttctggaccatgcaactatgcgcaagtactacaagatattcagctcctgcaatggcttgcacgtagtattgtcatctagctaggaacctcaagtatgtggacggtagctaagctaggaatatcttaagtgatatgtatgcagtgttaattaagaatgcaacgttagacctactacggagtactatactacaacttcagaaaacatcaaaacatccatttaacgctgacatctacgtgactacatcaacacgagggtgtaattagctgtggcatgcagatgcatgtctacatcacaactatcattgctcactggtactacatagtatctatctactccatccatcccataatataaggattttgaagagatcgatgtgaggaggagggggtatatttgtatgaaaattttgagaatcaatgacgcaaactactagctagtgttggaattaatgaatgggccttagcccactcgaagattaattctttggaaaatcacaaaagcccacctcataggatggcatgcatgtggagtttagtaccaccttgcttattctaggagagggggacctccttaaaagggaggatgccctcctagccacttgaagcatgtgtggtggagagaagaggggaaacacacgcgcgctcgctcgcctcgcctggcagggcagggcagggggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgtttttctacgtagtttacatgtgtagatctaatgatgcgttcatgctagttttcatctgtaatgtcatgatttatttatggaataaattaaatcattatatgcccataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttatgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacaacgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctaaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtacttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcaccatggtgggggtgagggagttattttgtgcttgtatgttgacgacatactgatatttgggacaaaccttgaggtgataaatgaggttaaatcattcttgtctcaaaattttgatatgaaagatttgggagtagctgatgttattttaaacattaagctaattagaggtgagaatgggattacactcttgcagtctcattatgtggagaagatcttgaatcgctttggctacattgatagtaagccttctccaacaccttatgatcctagcttgtcgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagacaattttgacgaggtcaaccatggaagcagagctaacggcactggatactgctactgttgaggcagaatggttgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctctaagtgaagatgcatatactctcgtgagctgcaaggcaggttggctatgccttaatgagttctgttggctttaattagcaaagatgttgtcctgcagagcattcttgaaggaactcacctttgtgagcttgactgttggtcgcagtccatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcataggatggcatgcatgtggagtttagtaccaccttgcttattctaggagagggggacctccttaaaagggaggatgccctcctagccacttgaagcatgtgtggtggagagaagaggggaaacacacgcgcgctcgctcgcctcgcctggcctggcagggcagggcagggggcgcgcgtgcacgacgtacgcgtcgaatggtccgaaaaattggctcctcacccttgcgcagatgcagcctccttttgcagttttgttttgctgcaaattcggattcgtttttgttttggaaacgttccgaaaaatccgatgcgtgcaaacggcgtggagtccggataagttacgcgcgacttatccggttcggttacgcgcagtagagatcgtgcgggcgccctgatcaagcgacccttctctatataaaccgacccgccgtcttcacgcaatatatgcgaaaatcaatctagggtttgcctcctactctgtactgcgccgtcgctcgtagactactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggttttttcgtcacctcggtacgtgttcaatatgttgcgcatatttggtctgttcatgtttttctacgtagtttacatgtgtagatctaatgatgcgttcatgctagttttcatctgtaatgtcatgatttatttatggaataaattaaatcattatatgcccataatctcaacagctagtaggcatatgcatgccctctgcacttgacgtgtatgtatatattatttcagcttttacacattgaataaatacaatgtaactcatttcttgatctttcaaattaaggattagtaaatagtcactctctcagagaagtaggaggccagttacatcacgtttctcccttatataagctgcatcacttccccccttttatagaatctagctagctactaatttgctactaactcacaagtacagatacaggacagtacaagagctgaatgtttgtcttggcattttttgcacacctttaaccactaacgttaataaaaatcttggtcagttagtgtgtcaatatctgtgctacactctctaaataaaacagcactacatcaaaaaccttatataaagaatcttttgtagagacaatttttaaaatgcctctaagttttgaagctctatagtctagagacactttttagaggcactttcaaaatcgtctaaaatatttttactctagagacatttttagtatactttgttaagtttatctcgtagagacacattttcggcactttaaaatttgtctcatatgtaaatgcattttcttaaggcatttaaaacgatgtaaaggcattttttcaaatattaatatatatcaagtaactagatataagtaacacaaatcacatacttacatataattatatgaggttgagatggttagtgcgtgcctctatttgcatagagacatcttataaaatgcctcttagttcgtagaaacaattcaccaaaaggcacttatgagatactcttcaaaatgtcctcttagttcgtagagacaattcacctcttagtttgtagagacaattcaccaaaaggtatttatgagacactcttcaaaatgtctctataacactgtaaaggcattttaaaaatgcgacaattcaccaaaaggcacttatgagacactcttcaaaatgtctctataacattgtaaaggcattttaaaaatgcctctatagtattagaaaaatgaaaatatctctataagatatatttgttatagtgcagtgttatgaattgcattttattgcacggaacagacttgccagccgtcaactaaaagcctcgttatctgttggttagatcgctatacctactaaactgtttttaactttgatttgatgcgatacccgtgaacaagattcagctaagttttggccttctatgaattaagtagatccaaccctccctgttggacgtagctgtctgttcaattctggattgtcgtggcacgagagttttttagataatggatagaaattcggcatctgtagtgttcctattaggatcgttgtttgttagtattgttactacatggaaatcggtgtgattgaggctatatatctttcatcttctgaatctttggggacagcattactggggtgtgatgtgagtgagagtgagagcgtgtcctagttgccgactcaacacacaaagaatttgcaaaagttaactatcgttctctgcatattgcagattttgcagcacgatatcacatcaccaattcactatttgtcggtggcttgtactacgcatttgcaaacaccacatagctagctacatcaagctagataaaacaccaaacctgatcgagttgtgtatcctgaagactagtaatcaatcgacttaattaggatataacgtgaaaatcgatctttggctgccgtttgtgtcaagttaaccaatcattagcttaggtgaatggttttacttttcttttcagaaacgatgctgtcataagctgaaactggggttttgatcgaccgcaactaattttcaaaatataagcaattttagaatagtgtcaagtcaaacatttttaattttaactattaatagtaaaaaaataaaaaaaaatcaatcatgtaaaattgatgttactagacttatcattaacaaactattacaacttttttttatttaaaacatctcacttttatagatattgttgatcaaaataccatctcaaagactatgtcaaagtctaaaaatgtttactccctccgtcccattttaagtacagccatggttttccgcgttcaactttgaccgtccgtcttatttgaatttttttttgaaaaaaattaaaaacataagttacgagtaaaatattattcatgttttatcatcttataataacaaaaatactaattataaaaaaattttaaataagatggacgattaaagttgggcgcggaaacttatagttgttttggaacgaaggaaatactattgatggtgaagtctgaactctgaaatggatggtgaaattaatactgaaattaatatatggaagagtgaatagttagtttacctgacaaccagatgaggtcggcgaggtcgaggcccttgctctggaaggaggagaggaggtcggtgaagttcatggtcggcgccgggatctggtccagcgcctcctgcttgatcgacaccctcccgtcgcgccgccccgtcgccacccgccagaacggcccgccctgctcgctcgccgtcagccagctcgccggccatcgcaaatgcgggagaggaggaggaggaggagcgaggtgctagcttacgatgacggagatggcgtcgcgggtggcgagcgcgaggatgtcggcgcaggagacgacgccggggcactcgctctcgaccacgctcttgatgcggtcgatgaaggcgaacccccgcagcgtcaggttcggcgccgcgtccttctccgcctccgccccgtccgtcccgttcagcaacaccgacgcgtcgcacccctacaattcaaaaccaccacgccatggccgccgtcgccgccgtcagaattccgccgccgcgccacgccgatcgatcgacgagctatacgcgcttaccctgacgaagcagtcgtggaagtgggtgcggatgagggtggcggcgacggagggggcgagggggacgtgctgctccacgtagtgcttcaccagcgcctccgcgcgcgggcagctctgctcgtagaacccctccttgagcacccacccctccacgccgccgccgacgaagacgacggccaccgccgccgccaccaccaccaacgtcagcggcgcggccattgccatagctaagctcaaagctgctttctctgacaatctctgagtggcagtgcactcggctatatatagagagagacagtgagaaatacagtgatgttcagtgtgttgttcagttttggtgtttgtatttgtatttacttggggtttggtttaggcgccattataattaggggagttacgcaactgaaaataatcagacgagtttggtaggtagaggagaacgtactaatactatatacacacacaagtttggtaatggacagcttcgttagcatctagtaggtgatcaagtcaccaatggcatctgagacgatactgccaatcaaagaattacactctgaaaaatagaccatgtactgattcatctgaaaaaaaattacactctgaactagtatgttctaacttttataagcgaaacgatgaatgtattgtgtatccattgtccctcttatacatattattaattataagcgaaacgtcttattaatgattaaaaaataatttatgaataaaacttttatatgcatcatgtatgttcttagcgatttaaatacgaatgatggaaaataaactactctaaaattaagttttaaaattcaaatttgcgcttatacttataagctcgaggctaaacgatggggtactcagtttcagatattatctgaaaaaatgacagtacattcagaatttcatattcacaacaatctggtgctgtaagcctgtaacattggtcaagatggcaatacatgccaagataggccttatcacaacctgcaagcttctttacaacacttcctagctctcctctctgtctgtatctagcatatgatccagctccatccataatccgtattcagtactccaatgtgaagaaaaggggagaagaatggatggtccacatgaacgcagattaaatggccacccaatgtgcaatgcatgaacaactgtgatgaacatgtccatctctgcactttcctttggcacttgctagtactagtacttagtagttgctacaccctccagtacttcagaagttcagattgcagcatcatgtacagctgtacattttgtactgaacaaattgtctcacattcagtataccactccaaacattcagtattggagaagaagcagcaaatcgcagcagatttggtgatcagtaggatattctacctgttacaatttaaaactgaatagcagtagcaacaaggacacaaagctagtataacagtagacgatgcatggctcacattgtatctatcacaattcataatgggtagggcatgcatgcgaggcctagttggaatctgaatatctatctatctgattgggttgcaaggatggacgaaactcaactccagctctaattggtgaaactgtcccagctcaagaagtttcctgctccggtctcttctgttacaatggcagtgtctgtacctaatctatcagtgtgcccatgaaaaaattcaggttaggttaaaggccatgtcattgcttaccacattgctatgttcttgggctcttggttgatgattcttgtcgagcaccgacagccaagtctgattgctaccggttgtcctgagtcctgacaattcagattcctactgtaaccagaggggttgggttagcatcacatttttaaagttttcatgtatgttattgctgataattgaatgaataaatgctaagattaaaagcaaccgagatttcgctttttttagccgacattttggcatcacattattgtcttcacgggcatgatatctatctcctgtgagagataaggttggtaaacaaggctttacagagggaaaagaaagtgaacacatcaaaagcaacttcctatagccttcacatcttttgttggctacctatactgcagcctagctacgaatctcttccaagttcagagaattgaaacaacttttggaataacttgtcaccagcaaaaattacagtgccgagataactatgtattacacgcaatgccaatatgtatggtgtgctcctacttttctctgatgaacaaactagtaggttcagttagtttcagttatttcgatccagttcaggaccactctagaatctacatgttcatctttcttctcaagagagaacagaatcagcaagacatctttatcagtatattagtccatatggaccatgataaagcaatgtgcatgctcaatgtagtgaaagctttaagctgattacattgatgaatgatgatacagccataataccggctggcttgtcattaaggaaggcataattcaggccaagaaatattttgctccaagtctctcattgttatcaatcttgatacaagttggcagcctactgttgtgaaggaacaattatttagatatatttaaattaggcaaaattggttatatagcatcgaaagttcacgtttttggttttatagcacctaaagataccggttcactttaatagcacccaaagtttaccctgttcctatttttagcacttccgtcaatttttccgtccgtcttaatcgttattgacccagctacgcacacgatatgacgtttttacccctcattgacatgcattctacttgtacttgtgaggggtagaaacgtcatatcgtgtgtgtggctggatcaccacccccacaaacgatcgagaattgacggaagtgctaaaaatgggaacagggtgaactttgagtgatattaaagtgaaccggtatctttaggtgctataaaaccaaaaacgtgaactttcgatgctatataaccaatttttcctttaaattatgaactcatggctaagaaacctccaataattaggctttccttttcttctgtcaattcttggggtacaattcaatcctgccctcttgtactcatgttggtgctatatgaaatgagataatttgaaatgttgggtgaagaacagtagactggcttccttactcacatgaagatcatttcctaactcacatgaagacatcatacttcatttaatacattcagtacatcctccttgcatagtctacactcatagtacagtgtatttggtggggtgcacaccaagagttcaatcatatccctctggtccagatgcagaattcaatcagggaggtcaagtggaagtttagtttggatctgcttgacacggcattttaaatgtaaaagaatattagttttatggcattgtattttgaaaatacacaggaaaaatgcatatttctccattggaagagaggaaaaagaaaaggactgaattacatcaaatcataaaaagaaaacaccatcttccaaccactaaactcaagaagggaatggcactggctaagtttgaatctgtatgttcctaactcgtgtctttttttttaagataatggaatgaaacataaaaggagggtaactcatgtctcatgcacggaaaaggagggtaactagacttactagcatatggttaattaattattactttaacaaaatttaaaaacagattaatataatttttaaagcaactcttttacaattatttaaaaaaacacattgttttgttattcaggatacgtgtacatagaaaacgatggagtaaaatttgagaggagaagttgccgaacactggataagaccttgttggagagcttctattaagcccagcttctctcagaatttccaacacttccaaagtctaaacagttcagattagtacaaagattctaagactaattagttacaaaatctagaaaataaactagaaatcagaagatgagtaaaccagttttttttaaaaaaaaatctaacaaaatgattactcatcagctgattctcggaatttttggctcgtagagtaactaagccctaaacaaactcccaccaaaactgcacctatgctttgatcttgttcacaccagtagcttcagcacagttgttttatttctgaaaattcaccatttcacaaacaccaaatggatcgtaacacgaagatcacaatggagaggaactgaggaaggtcttgttggctgtggaggacaacagctcttgaacggcgaaccagtaaccaccaaatgcggaggtattgcttttcaagaccagccatcaaaaaactggaaaccagtctgcctcggaaaccacacattgtacagattgtacactgtacaagttcactcgtcttcacgtatgaaattatggatacggcctggcgaatacgaaatgtaaatgtgtcttattcacctaagaccaagtctaatagtatagcccactattaactccaatttatctatagccaatctaatagacaattcatacaatagttgtttatcatactattaatatatggtcccacctgtcatacacacattgcgtcttagagtccgtgctgcagctggctacatatctgtagctcgctcatcttctctctcatcttttatctcattaaaatatgtttatagctggctaatagcctgctattatacctgctctaattcagctcgtgttcatcacaacttcccagctcatagacgtgacaactgatggactgagatggcctataacctgcccgggtcaaatattttgcttagaggtaaagatcattgcaaattgcagctgtgctcagaactaaattaactatgagtctgaacggaggatgtacacttgagtaattaacaagatccaattaacaattaacaagctgtagacaggctaatttctgaacctggtccttctgcttatctgctcccatcattgaaggctcacttaggtagatttttggaacaatatcactccatatcatattcagatatcatattcagtagagtgtagaccatgtcccttttctgactagtacaagatacctgcggggatcacttgcaaggccgggcaagcaagcaagagaaaagatgcagggacaagcacagcttcagattgacatttcctgcaaaaaaatcagcaatttgtgttactttgcatggcaacggcaagcccttttgtgtgcatgggggaatccttggaaacgaccttcatctttactacatctctttcagaggttggttgtcaattacacctctcactttcagctttatattggatcccctaaaatatagtttgatagatgataacagttaacaaaaatatattccactgtcagagatttgtgctaatcatttagtagctgtaatttaagtagtgaacctaacgattctttacaccacttatagccattccaatcttttaccatttgtttttttgatggatacaactgtaaaggggggaaaaatctcaagaatgcaaggtcacgcttacgagtaggagagcacaacaaagtggaaaagacgttcaaaagggttaagatgaatgctgaagagaccccatccaagcatgatccacccaacagttaaaagaacagcactaacaaagacacacacttttctgatcaagaaacgaacaaaaagggagatgtataaataaaaaaaaacaagtgataatccattaattgttcaaggtgtcaatgataccatctcacgagctgatgagcttagtagttggtatacacccgtgagtgtgtggctgacagctaggagtagagtatatatatgttgggctgaatgatgctgtttgttgaactgtgacagtactagtacaaatatactccctccgtttaagaaaaaactcaatttaaaagataatgtgaccctcttaaaataataaatttgaactactctttatctagattatattaggagggatcatatcttctcctatattaagtttttttttatacggagggagtatacaggagagtaccaatgtaagtggatttggttatgcactagacgtagtacacataagtaggtgtaggagaaagaagataccatttggaatttgttctagaaggttaatttggttttattattggttgcgacgttgccgtccgaggagatcgttttctattgtttagaggtgaagtctacctttttcatgtattcgacacgcgtaatttctttttctacgagatggcatgcaatttttactttaactccctttatcgtgaatatgtggatttaatttaaaatttggtggagtggtacatgatattatactcaggttgtagaccttttcccgtattttctgtattatactccctccgttttaaatatttgacgccgttgactattttaaatatgtttgatcatttgtcttattaaaaaaatttaagtaattattttttttctatcatttgattcattgttaaatatacttatatgtatatatatagttttatatatttcacaaaagtttttgaataagacgaacgatcaaacatgtgctaaaaaatctacggtgttaaatatttagaaacggaaggagtatttgagagccacgaggaggatatgggccaagcatgaaaaaaggccaacttagtcttggctctcagttcagtttgcattccagcttgtagcctgtaggcccaaatatagcccaatgaattattttcgaggtagaataactggctagatgagaccattgcagtgcagtaatattgtcaaatcaactaatcacaaggacaaaattcactaaattattatttattccatggacaaaaaattacatagactctgcacaaatatctatcatgacttaatcacatctcaaaaccctaaactctgagtactatatttatcgaaaactccttagactaaacttaagacgacgacaaccggcacatgcggtgagtggtgacggactaaggtgacacacctgccaagaataaaatcaaaaggacattttagtataacatctcaaatttttaacagatcgcacaaaattcagagagtttcaaattcaaatatgaatttacctgaagatctatgaagatgggggactagcaggcgctggagcagcggaaggcatcaatggcggcactgatggcgctgtcaaatcaaacacgtcaccagattaatcagattaatctcttcaaacaaacaatgcattagaaataataaacatgctttacgatagggtttaattagggtgtaatttgattagcaagaacttactgttgcacatggagaacgtctgaagtgggaccgtggcgccgcaggtgttggggagcgtcatcatcttcatcatgtcgacggggagcgggaggaacttgctcaggtcgccattgatgccgtggcacaggcagatgggcgccgtgctcaccagcgacttgaacccctcgcagcaggtgcccggcggcgtctgcgcgctgctgttcgtcaggtagtccgcgcacgacatcatcgacaacagcggcgtcaagcactcctttggctgcggcggcgatggcggcgccggtgccgccggcgaggcgggtgatgcttgagacggtggcgagaccggcgagctggggaacgggaacgggaacgccgggaagccggacccagacgacggcggagcgcccccctgcnaagcggccccaaggaacagcaaccggaggcggaacggaaaccgtnagccanaaaccaccaaaaggcgacggggcctcctccgcccaaaaaccgccctatgggtatcaccggaacccggaccttagaaacggaaaagacggaaacgcaaagcggtgaatccggcatggtcggcttcttcctcggggcagtttggaatcccggttggaaaggnaggctcgcaccccttttt

SEQ ID NO: 66815 - DNA, 753 bp, Oryza sativa
  unsure (1)..(753): unsure at all n locations
acgttggcgcagccgtttcaagcagtgcgccgccgtagtttaagctgtcgcggtcgctgggaaagaccgccgtcgtgcttggcaaagtggccgccgtcctggtccgccctatcgttgcgtcgaagaccaccgaagcatcgtcgcggtcgtcaacccgaaggtagccgccgcttccttcttgtcgcagtagtcgtccgttccttttccaccgccgttttggtcaccggtgtgttcgccgcgttgtcctatacgtgctggtgccctcagttggtcccgtggaaccgccgttcgccggcgagtgtccaccgcccgagccgttttattcgccgagccgccgcagtagtcggtgatgtcatcgttgacgtcatcgggatcttctcccgtgagccggtcatggaccgatcgattttgacggtcagatttggatcggatcaatttcgcccgtccgttcgcgtgaaccgccgcccatgcgcccggtccaccaaaccatagcccgctgacgcaataaatccccttttccttttcaaaaataattcattattgcgtcataattcaatttaaaccgatttaagtgttttaatccgattcctctcccaaacttcataagtaacacatctaagctccgatttagttggttcaattctctaataaattctaaaattgagattgaccattaaaaatatccacatgtgctgctctgggnatactctaaantnngcnnggtgcgagtacgaggtacttattccagcgcgc

SEQ ID NO: 66816 - DNA, 9321 bp, Oryza sativa
  unsure (1)..(9321): unsure at all n locations
ccccaaaagcggagtgcggcacttccgaccataaagtgcttcgtaaggagccatctgtaaactagcttgataactgttgttgtatgaaaattctgcataaggtagattcttatcccaacttccaccgaaatttagagcacaagctctcaacatgtcttccaaaatttgattcaccccttcggtntgtccgtctgtctgcggatgataagcagtactaaagttcagcttagaacccatctcttcctaaagtttcttccaaaaatttgaagtaaactgactgcctcgatcagacactatcttcttagggacgccatgcaaacacacaatccttgccatatacaattccgctaagcgacttccggaataagttgtctttaccggaatgaaatgagccactttggtaagtctgtcaactattacccaaatagagtcatggcctgatgacgttctgggtaaaccagtaataaaatccataccaatttcttcccatttccattcaggaatcttcaaaggttgcaacaaaccggcgggtttctgatgttctgccttgactcgctgacaaacatcacatactgctacgtattctgcgatttcacgcttcatacttgcccaccaaaatctttccttgagatcctggtacatcttagtactaccagggtgaatggagtataaagtatcgtgagcttctttcagaattgcatcctttaaatctttgttgtcggggacacagattctctcacccaaccataccgttccgtgctcatcctccaagaaaccaatagcttttcctcttctcatattcttcttgatctcttgaatatcaggatcattattttgggcttctctaacttgatcaattagagtgggcttcgcttctaaagctgcaacgaaacctctaccgacaattcccaaatttaatctttcaaattccttgcataattccaatggcaactgtcgtccttctgtagcattgcaatagccttttctgctaagagcgtctgctacaacattagcctttcccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcaaaacacaacctaacccaagtttggatgcatcgcaatacacttgaaaacccttctttggatcaggcaaaatcaaaataggagctgatattaagcgacttttcaattcttgaaaactctgttcacattcttccgaccacttgtacttcacatctttctgaagcagtcgtgtcatgggcttagcaatcttggaaaaattctctataaacctccgataatatcctgcgaggcctaggaaactgcgaatctctgaaactgtctttggttgcttccaattggttacggattccacgttactaggatcgacggcaactcctccggctgagatgacgtgaccaaggaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatggtctttcttttccacaaaaataaccggagctccccatggtgatgaactcggtctgatgtatcctttctgtagcaaatcatctacttgcctcttaacttctgccaactcattagctgccattcgataaggtctcttatggatcggagttgttccaggtaccaaatctattctgaactctatatcccttttaggcggcataccaggtaaatcatctgggaacacatcagaatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattctaacaagataagattggccagaaatggtactcctttaatttctattctgaccgaggggctacgttgcaaagagagtgcttgattacttggggtactaaccatcaaaggacgtctaagatcttctacttccatcccatgatttcccgcaaaactcatagataagaatgaatgtgtagcaccagaatcgaaaagtactgttgcaggaactgagttaacaaggaacgtacccaaaattacatctggagcatcttgagcttctgcagcagcgacatgatttacacgagccttggatactggtacagcagagttactctgggcagggacaaccttcacgcgacggggcttcggacacttgtcagcataatgtcctgggtctccacagttgaaacacaccacgggcttgctgccttgctccctcttggcaggttgttgctgtactggagctgcaacaggacgtggagctttattacggatgttgttggcagcattgttgatgaaaaactgacgttgcggacgaacaacagacgaagaacctacctgtggcatagactggggtcctaaagtaagacgcggcttctgaatatttccctggtgtgtcttgaattgaccaatccgacgtttcttctgctccatgcgattatacttgtcctcctgacgaatagccttatccactaatttctggaaatcaggataatctccaaccatgagtgggtaagaaagctcatcattaagtcctcccaaaaacttctcctggcgctcttcatcattgcgcacatcttccggagcataacgagcaagacgattgaactcgtgcagatactccgtaacagagcgagatccctgagtaagcgacctgaactccttcttcttgagagacactactcccgatggtatatgcgtctttcggaaagcagcggtgaattcaagccaagtgataggttcagcagtagtcctgttaaggcggaagtgatcccaccattcagaggcagggccatgcaactgatgtgatgcaaaagataccttctcctgatcagtgcactgaagtaaatccaacttcttctctatggcatgcagccaatcactagcttcaacaggattagtggtactagagaaaacaggcggcctcacacgaagaaattctgctaacttgttctggggaggtgcatgattattcccttggttttgctgattctgaaattgctgcatcatcatgttcataagctgtgtttgttgagcaagaacttgagcaagagtgggattctctccattgttgttattggggttgttgggaccattcccattgctacgagtgttcaccatctggcatggacagggcacaagaagagaaaacggggaaaactacttaggacagagaattactttaacttttattgatcttaactgagtttcattattacaaactgaagactctcacaccactaaactcaccaacttcctaacactcaaaagcaaacaaacgcatgcacttacatcccaccactgatgtaaatcacatgcgagccacacacaagcaaactttaagcaagcaaactaacacaacgatctatgacaacgacttaacaagtcactctagttcttccaagcatcggaggtcgattgaaggctcgtcttcatcatcttgggttgctacccactcaatcttggaattgttgcgcttagattcttcttcttcatcactacttaagatgatgaccggaggatccgcttgagctggggcaacttctttctccaccacacgaacctttggcgccagttgatagcgagggacaaatagagctctcttccttgcggtaagacgaatcctggccttctgcggcggtgcttctcccttcaatgcggctaattccttctccaaacgatccaccttgtcttctaacttgcaaatcttaccatgattccggtcttcacgatcttgagctgctaacacagtctccgcacgactttcatccatagcccacaacatctcaaccaaatgtcttgtggtaacataattctcaattccttcagtctcaagataactgccacggtcacttccctggggttggcgaggatggtaacgatactcagtgtcggccaattgatcactgtagcgatcacggagctctcctatggcgatccttgccacctcctgacatgcatggatgtagtttcttcctccagcttcgaacatcactgagggaatatcttcactattgctgttcaaggtgactttgactcggcacttctcttcatgacgatcatgaggaatctgggtataaaaaggggcagtcccaaatccaatgacaaaggacatcgtacgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcaaagtaaaaagggaagtaaataaagtaaaccaagctttgcaaaataaattaaaacatttggaaacgaggtcacaaattttgtaattttgaataactggtttcaaaagagatgaaaggaaattataaaatcaacatactaaatttattttattgcagcaagattaaataaaacagtattgtaaaacttttgctgataaatgagccattagtacagtaatagatgtacagtactaataacactggaataaatttttaatgaaaaccattaaaaaaaaaattatgaagtgcatgtgccattagtttggttaattaaaagagaaagggaggagaacagttctacttttccaatatttttcagagggcttctttgggtaaccatttggtataacctagggtcaaaggggctctgataccaacttgtcacgcccggaatttctatccaaaattccaaacgctaacatgtgtgtgaaccctcgtccaggaatcagccgaggcacacaataacaaattgataatagagtacaaataatactctaattaataagcgaataaaatgtcattacagaggtagatagttcttctcaatcaataaagttctaagcagcggaaattaaataaacggcgcagacggctccactccacaggtagcttgaccaaggctacacctaatcctccacaccatcagcctcattgtagaactcttcttctgatgaatgattgcaaggtgagtatatgacatactcagcaagccacgcagcaaatatgcaagtgcacaggataacaaaggatggcataatatggttgtatttgcaaaagcagcatttagcaaacatttgagaatttgataaaacagttaagtaattaaacaatattaatccaacgctatacaacataccctgttgtataggcccaaccattctgaacaaccaccccggctgcacagttctatctccaaaccaggaatgtaccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaaccgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataagtgtactaatgtttctaagcagggctaagcaattgtatctaatatctagttgaaccaatataaataaagctcaactagtcaaattgtaataacccaaggtatcaaggaataaggtaatcaatgtacaaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccggaaacgacggaatctaagcaaaaagaagcaaaatcaccaaaacagcacataaacaagcatgaacagtacatgtggatatttttaatgtgtagatctcaattttagaaaaaattagagaattgaaccaactaaatcggagctaagatgaattagttatgaatttttaaagattaaatcggattaaaacacttaaatcggtttaaattgaattatgacgcaataatgaattatttttgaaaaggaaaaggggatttattgcgtcagcgggctagggtttggtggaccgggcgcatgggcggcggttcacgcgaacggacggccgagattgatccgatccaaatcggacggccaagatcgatcggtccatgaccggctcacgggagaggatcccgatgacgtcaacgatgacatcaccgacgacggcggcggctcggcgaagaaaacggctcgggcggcggacactcgccggcgaacggcggcaccacggcaccaacggagggcaccagcacgtagaggacaacgcggcgaacacaccggtgaccaaaacggcggcggaaaaggaacggacgacgacggcgacgagaaggaagcggcggctaccttcgggttgacgacggcgacgatgctccggcggtctccgacggcagcgaaggggcggacgaggacggcggcgacttggcaagcacgacggcggtcttcccgagcgacggcgacggctgaaacgacggcggcgcacggctggagcggcggcggcgacggcaaagctagggcacacggcgctagagctcttccggcgacgagaggcgaaggcgagggctgcgacgggtagaggagacaccgggggtccttttaaaggggctcggaggcggcggcgaaggcccacggcgacggcaacggcgaaggaaaccttcggcttggagagagggaaaaccgatccgaaacgaactcgtctccgacgctttccaaagcgatttaaccaaagattccaaaggagaaaaggtagaggagatcccggagattgtttcccctctaacaaatcggccggagaaggaaaggaacggccggatttggaaagcggcggcgacggcagctcggcggcgcgaaactagggtttcggcccgaggaagacgacgactgacgggtgggccccacctgtcagcgacagcgcgctcgcgcgggcggctgcggactgggccggactgggctgaggagagagaagggattttgggccgactttcggcccaaagccaaaagagactttttaaaacctttttcaatttaaattatttcttaaatgcaattccatttattaaaaatactttcttagctcaaataaatcccagaaaaatctaggaattatagaattaagcaaagtatttaatgaaattttatctggcccaattttatattggaatttattaattaaaattagattttcttttcaagacttttaaaattatttctaaaaattccatttaaacaacaatttatatattttgaattttcagggtgtgacaaacctaccccccttaaacagaatctcgtcctcgagattcggaagaactggcgaacaggtgcggatgagctgacttcaattcatcttctcgttcccaagttgattcttcttccgagtgattactccacgggactttgcaaaaacggataactcgattcctggttcttctctcacttgtttccaggatacggattggtttctcaacataagtcaaatcctcttggacttctatctgctcaatattagcttcttcggtaggtacccttaaacactttttcaattgcgacacatggaacacattatgtactcctgccaaagattgaggtaactccaactgataagcaacctctcctgttctactgacaatcttataaggtcccacaaaacgcggtgccaattttgctttggtatgaaaacgatgaactcctcgaagaggcgtgacacgaagatacacataatctcccttttcaaaactcaaatctctgcggcgattgttggcataactcttatgacgagactgagccacacgcaatctttcttgaatgagctttacctttacttctgcttcccttacgatatgcggttcgaaaacctgacgtcttccgtatgatcccacaaaaggcgagtgctgcacttccgaccatacagtgctttcgtaggagcccatctgtaaactaacttgataactgctgttgaatgaaaattctgcatagggcagattcttatcccaacttccaccgaaaactagagcacatgctctcaacatgacttccaaaatttgattcaccctttcggcttgaccgactgtctgcggatgataaacatgactaatgttgatctaagaacccacctctttatagcgttctgacaaaaatttgaagaaaagtgagtgtctcgaacaaactactatctttttggggacgccatgcaaacacacaattttg

SEQ ID NO: 66817 - DNA, 2749 bp, Oryza sativa
actattcttctaaaacattaactaaaaaaaagtggtacagaaataaaggttgctataccaagttcaggtgtattgttgcacttgaaagaatgttgttgctgtgagctaaacacttctaaggtactgttatccatggacgaaactggcatatccacactttctaccgatggaacgtgtggatcaataacaacttggatgccttcaagttgtcctgaagaaagtttagagaaaatctaccttttgaactgataaaacacaagatatgtgcaatagaaagaaaagaccaactaccatggtgcatcaagttcttgtccaaagtgtctggctggaatctatatggcacaccaatgtctgataatccaacagatccatcataggttgatgaaatttgcggatgcattccttgcacatcaagttgttctgtgagattttgaagaatcaagaactaatcaagaagcatttaacagaaactaattccagcagcaaattatgatgattggatattgggagcactcaaattactcaagagagggcaggtcgaacctaccttgtagtgtatggcttggttgcattgagaatgattcctgaaggcaatagctgtcatttcttatagaaagagcctcatgttcatgagacacactgctctctttaaggcaactagagtaaactcctggtctacatttctgagcatgagcaatgatcaaatcccaatcttggtcggaaatcttccccaaaatctacatagggtgatattaaaaaaactatcagtaacattgcatagataataaattagctagcaaaataacaatgttaataatcaatctcatactttacgcagatcatattcgctattattgtagaaagataagaagtcctccactgtcttgataccattctgctctagtaacttgtgcctgtcaccgttctttgcaattttactcaatttatatacagcatcacgtggggatggattgggattcttctttgttactgcagataaagacatttgatgtagtcaccctggattaggatagtttgacttggaacaatactcttatctataaacttggtcgaacataggatagttttacttaggataaaaccagagataccccgtgtgaatgcatgggttgtggattaagttgttctgttcttaagtatttaaacagtatgaagcttacatatatatagattatgtaacataaatagcctgtgtgaatgcatgggttatggattagtagtcataatagttaaattgttcttactactcatctgcttgccccttccctaaatgttaatggatgtactaatgctagaatagaatggcacgcgtgaactcacagtatccccgaacatccttcacggcaaaagattcagttactccttcttgaattcttactgagattctttcatcagctgccataacccccaacttgaactttctgcttggaacaaaactagaattgtcttggaatttggcactattgagataacccacaccattttgcagtctaaaatacagcttcccagacagcaaatggcctttatgaggtcgtccaggtactattttactatggaaatactctttagtccactgtcccttgttatcatcgtcaaagtcaccgtcaatggctacaatatgaactctcatcgaagaaaatggttccattgttacgatcttgtcgttatgatcatatatggctacctgaagggggttctcatcatctgcttctattttgtgtgttgagtacttatcgttactgcatgaatttacaaattgtaatcgaagtggcacggtgcagttctgatcagaatcatcagataacatcctgaaaaatagtgcaaagaaatcaaacacataatgatactaactttaatttatggcagttattatgtgttctcccaagaaacaaagagatataacaacgatacatatatcttatgcacatggaataggcgtactgttcctttctctcaactcttggcttggctactttctcaagaaaaaagatacttgttttttttcccacatacaccaacaaatttttataagagcaacttggcttaatttttgtccctcaactctaaaattggacaacatttttctctgaactctcaaattattaaaaggaaaaagtcagttttactcccctcaagtatgaccctggagcaaataaccccctaacctttaatttggtttacttaaccccctaggttcttaaaaccggatcactattcacctttctaatctaatacaatccgctttgctgatgtggcacatggattaggtggttttgcttactaggttggatctaacgtggagaaagagaacccaggagattaatcacacgtcgtattctcctccatgcgttggactcttctccctcacaagtcctctcatcatctcctctctcccttccgacggcggagaatccaggtgatgatcgtcgcagataggcggtgctgatccgtgagatcgcagccccgtggtgcgtccctccccctccctcccttcctccctccctcctccccactccatcttggcatgctttaggtttagggttgttctagaaggggataataagtgcgtgtggcagttggttgatgaaatttttttggttgatttcgttggtggtagggcactactgagggttaggttgttgctatcccttgctgtttttttttcttgcgagctcattatccatcgtcagatgccggcgctcggcgtgtgcgtcttgaagccgtcgcg

SEQ ID NO: 66818 - DNA, 16857 bp, Oryza sativa
  unsure (1)..(16857): unsure at all n locations
tgcgcctcgatactcgagcactctgtgcgagtatcgacggtcgccttcaaacttaaaatctgagtaacaacttgggtaaaactggagttttacaaaagacttggaaaacccgacacttgggtcggtgcttgcgaaccaaatgaatttccaaaaccgcggaccggggaacgtaccgggtgtacggtttcccgctcttgcacttaaggaccgattccttggaatttcatccaaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtatcggctttcgaaatgccttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgtctactgcttgtgaaattgctgttgtgaaaaggggttcgatgtttgaaaaatcagtagctgacgggatcagctaggcccgggtggccgtttgaagagttgttggcccgggaggccgtttaaaaagctgttggccgagtgccaaccctgtttcaagatctaaagactgatgcattgcacatactccgactggacgagacgcactgtctcatccgtgtcgtttgagaagcactcacttagttgttttcagaaaagagttcaaataaattcaattacgaaaacaacagtctttccttgaagcctgcattaaacacttatttcccctggcttgctgagtactcccgtactcacccttgctctatttaaataatccccccccagttgctgaagaagatgaagcggatcctgctgatgaggtgttcttccaggagcaagctggctatgatgagttttagggtttcggcctagttcccaagtcgcgcctgtgatgattggtccaagtcctggcttccgctttctttttgtaatgcagttgtgagctcgggatctgtccgcagcccaacatgactgtaattctactctataataaagagacctctgttgctgtgatattctgtctccctgtgataccagcactgtctcctgggactggtatcgattaacaggtttatttggagcgtcacgggcttgttccggtcggaactagttcggggcgtgacacatatattatagaagtaacttataaaagaagaaaataactttaattaatgccttttttcattgaacaaattatctataaatatatatatatatataagagttacttttaaatttgattaaaatacttcctatacattcataatgctctgaagcgattacttttattaattttttttagttaattccataatttgtgctgattaatttaatttctagataaagttatgtttttatctttacaacggatttacttcaaatgacatgctaaagttatcttcgttttgttctaagttacttctataatatatataaattacttttaggttttactgaatttacttttatatatctaagaagtaacttagtgaaatctaaaagtaatttagacatatcataaaagtaatttgtgatttttcatcaaaatataattatgtgagatctcgttgtaaagatttaattgttacgaacacaacggtgtaatcggatcgtagatcggattagtagtttaagagaagattgtatttgaagtataggtggatggtgtctcttatagatgaagtggtagctgatttatcctagctgtgtagttacgtccaatatcaaaatatgtgcttcttcaaacactgaattgcaaagtattatccttcatctcctcggtactatacactgaacaataatactaccaataatgtcacgctgcatcagcatcagtaacatatccatgtcacatacatggggccgtcttggcgtgacaggccgggttcgaaccagatggcacggcctaccttgggagtttctcataaggataattctaccgtcttaagaagatatcagaggtattatattttttatataaaatttaatacctttaaatactaaacttttttaagtataaaaaatttttagtgtaaaatctcgatacctttagatattttctcaagtacataaaatttcttttgtcaaaagggttgggagttttcttctccaaaaccccctttccccctcatgcatgcgcctctccggagcaccgccgcatgctttcagcccctcatctacggcggctgtaaccaaacgaacaccctaccacgaggccacctcctctctacttctttagcacacgagaagaggaagcacctgtttggcatggtgaccccagccgtcggcgactgataacgaaatcgctagttagtgactagtcgcgcgcccttcttcccgcgcggatggacgcgtggcgcgcgtagaagggaagggggcgcggcggccgcgcttagtgggggtccacattggtttttttcgccgttttttgtggggtttcatacggttccttttttatgttttttcttttttttccgtactttcagttttcagttttctttttttttctgtttttcctttctatgtttttttagtttttttaaggaaaaagtacgaattacccccccccccccccggaactattccggtagtacgatttacctcctaaactacaataccggacatttgacaccccaaacacttaaaaccggataaattacaaccctaactcgattcgaacggttttcagcctacgtggcacacacgtggcggtacagtcagcaaaaaaaaacaaataaaacaggtggggcccacctgtcagcatttttttttcactcctctctgaccctctctctcggagaacacagcaagcggagggcgggcgaggagccgaccgacgacgccgacgggcggtcggcggcggggatggcggcggccggcgggcgagcgaggatccgacgccgacgggcggccaacggcggggatgactgcgggcggcaggcgagcaaggagccgacgccgacgggcggtcggcggcatggatggctgcgggcgggcgaggagccgacgccgacgttcggccggcaacggaatggccgaaaaattttggggggggccccccttttttgggccccccccgggagggggggggtttttttgggacgaccccccggggggggggggccccccttaaaagggccgaaagggggaaaagcccccgaacccgaattagaccggggccggccgaccggtggggatggctgcggacggcgggcgggcgagaagccgacgccgacgtgcggccggcggctgcgggcggcggacgaggagacgaggccggaggcgggcgggcgcggagggggctgtgagcaccggtagatgaggttggcgctcgatgaggttgcggcggtagagctcgaggatgctggccatggcggcctcccgctcctcggtctcctcgtcgttcgtgtcgagctccttcaccgcgaacgttgtcctgtgcatgttcctccccatcacgatctccctcgtagtcgaagacccctcccctccgtcctcccccgtatgcccaagcgagcagtcgtcctcgcccctgtccgccgtcgtcgccgcatgccacgctccgctggctctgtgtctgtcacgcccagaaattcacaaataatttccgaacttatttgtgcatgaaatcatcgtccaggaatcagccgaggtacacaaactgacaatttaatatacaaatctatcataataataacgttacatacttacaaaagaaaagaaaacagcagcggaataacggtctagcgatggcttcagctccgctcccacaggcggctcaactggggtataagccaaacgtcttctccttctggatcctttttcttcaactgaggtttgattgattattgcaaggtgagcatataacatactcaacaagccacacagcaaatatgcaagtgcacaaggataccaaaaaatggcataatatagggctcatttgcaaaaacagcatttagcaaacatttgagaattgtaaaacagtagagtaattaatcatcaattttaatcaacaccgaacaacacacccatgctgctcaggcccaaccatcctgaacaaccatacccggctgtacagatctatctccaaaccaggaatgtaccattccaaaccaggagctaatcaaattagcagttatagcattatttattatggtgagaagtgtgggactaatcacaaaagacattgttagacccgcccataaccgcgggcacggctattcgaatagttttactctggccagaggtgtaccactgtatccacaagacacagccccacaacatgtcaccatgcgcctcaataccaccacggtacctcagaaaggagctgtgacagtacccctcgcacaacacaatccaccacagcgcaccattcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgattaatgttttacaaccgaaactcgtgaaccggtccttaattttcacaagcatgaccatcaaaaccatgtgctcacaacccaccattatcaagttttaattggcaagtaattaattaaccaatcacgattgaccatcgtgagcttccattaaatatccataagtgatagtgaagcatgatttatcccattagtgagctattgtttctaagcatggctaagcatctattttaagcatctagctgaaccaaaccaatatataaggttctagctaatcaaattataacccataggtaaataaagtcatctccggccataattaaatgggaaaggctcaccacccagtgacattcaaaaataaatgcacagttgaaataaatagagaatttaaatataggatcaacatgctcaaaggaattgtgtttgggatctgtgtgacttgccttgcaataattggtcttcaattatcttcttgaactcttctgacacacacgcgaacctttgaaacgacggaaacgacaagctaacacgcaaaacgaggaaaaatactaataaaaaccaaataaacagaacatataaagtaaacaaacatgtagatcatgattttagatgaattatgagacttaaacggcctcattccgatttcgtatgagttaattacgaattttacaagatttaattccaattaaagcctattaaagaaaagactattccaaattaattaaacaatttacaaatgatttataactgagataaaagattaaaacaacctccggaaatagattggatcatatttgatagatgacatatgttaaaaagaaataatatgccactgaaaaaaaagaatgggtttatatggctgagactaatcttgaccgagtcgaccaagatcggatggcttggattgacctggcaagcgagcctcacgacataccgattgaactacgtgacacgggatcacccaaatgatcaaccgaaaccggcgaacggaaccggcgctatgaacggttctaaactaaaggacgactcaatacggacgaacgaacgaaacacggggaaacacctcgttcaaacaaacgagcgaacaactcaacaacggttgtggctaaaccggtgagctagacacgattcacggtaaagccccggtacggcaaacgataggccggtaggaacctagggatgcacctacggctttacaactcggctaccgggctacggctaaagcggtacacgggtggacacgacacagcagcgacggcaaacggtggctacggtagcgggacggcaacgacttggcacgcacgagcagcagcagcacggctgtagcagggagcggcacagcgacggctaggcagctagcgcagcggcgacgctagggcagcagctagcggcacagcaatacgacaagcggtgcgcacggcagcggcacaagagcggttacggtggcacatatacagcagctgcgcaatggcaacgtacagcggctaaacagcgacgcggcggcaacaaggcgccggcggcagcggcggtgcatacggcagtcggcaagcgacgcggtagcggctgctctagggttagagcaatagcggcggcgacatgaccgagggattgaaacctaacccgagggaacacggatagaagtttcaccgaaccaaagcgattggagagggagagatgacgacggcgacccggcggcaacacacggagacgacgacaacgctagacaaacaacgaattagattagattggattaataccctaggaaaaaatctacaccggtgaacgacataggagcggcggttgccggcgaaccacggcacaataatgcaaacggtgggcaccgggaggaagaggagattgagaggattccattcccgcaactaatttggaaagaggagcaatggggtggccggatttgaaaggaggaggcggcggcaacaggacacgggcacagcagctcggctctggctggaggttgaagatgcactgtagcgaggggatgcaaaacagacttttggctgggcttctattgcacagcctgatagatggagggatgcaaactagaattcggggggataaggccggccgaatagaaggaagaacgggccgaggactaaaggtgaacttttcctatttcggcccgaaaaggaaaagcggattttaattatgtcacatcctgatttttgtttcaggatttataaattatttaataaattattattagaatttatattaaatgttcattaatttacaagtgaagttaaatgtgggaaataaaatttcctaaatataaagcatggatggatttaatttttattaaattctccatggttaattatactctctggaattttctcggatttttcggagctcaattattaattttaatcatacaaagagaagttcagcaattatttaaatattaaattaatcattaaatggtctgattataattttgttaagtactttgagtgtccaagtattttcaggatttttcttgaaattatttgagtattggaagtatttttaacaattcaaagatcatttcagtgattattttaattggaaaaagtttttaaatccttccctaagtcgttgggccgatttcggcccaactctttctctctccgcgcggccgaaccggcccaatcggcccagcagccgccccctcctctctctctgtcaaagtctgttttgcctccctccttcaatcgggccgaggaaatgaagcccagccggaaaagtctacttttcctccctctgctactgttcatcttccagctctggacagagcccgagctgccaccttacgccgccttccgcctccaaatccgctccaatccgaccccgtttcttccggatttttgaggggttttgatcctctcatcctcctctatcttttcccccaagaatcggagcaaatcgttgggtattttatccgaatcaaactcgttttcgagtttatctccaaaaccgagttttgattttcccggagcgatttcttgcgggaggagtccgatctcttcaatccaaggctataaataggaccccctagtcctcctctttcgtttgccccctctcccgtcctctcccgtgacccgtggagccgtcgccaccgtgcaagccgccgccgccgtcgcttcttcgtcgccggccgtcatccgtcgtcgttcggcacttcggtgagcaccatcgggttcgtctcgtcgtcctctacgtgtacatgccctccaaatccgcagccagccgctctatctccggcgaggtcgccatcttggttcggccatgggtgatgtcagcatgacgtcatcggtttttctttttctcgtttttctaatagattaaatcttcggaaaatcataactaaataaccgtagatccgtttcaggtggttcaagttgctaaatttttctaaaatcaagatctacatgttaaaaatatccacatgtactgtttatgcttgtttttgtactgttttgttgattttagtctttttgctttagtttccgacgttccggaggagagcgttttcgttgagcaaggttcggaagtgtttgcggaagcccaaggcaagtcacacagatcccaaataaccctttgaacatgttgaacccgtttaaagctattattttatttcaactatgcattatttttgaatgtcatcgggtggtgaacctttccccgttaattaatggccgaagatgatcttattttcctatgggttataatttgattagcatgaaccttatataatggattggttcagctaaatgctatatgtaagtttgcttagctatagaaacattagataactaaaggggttaattataaactatattatattattcttattaattatggttatatttaatggtagctcacgatggttaatcgtgtgatgttaattaattgataattaaaacctggttaaggtgggttgtgagcatatggttttgatggttgtgctcatggcaattaaggaccggttcgcgagctactgttgtgagacattaaccgtaccaaccacaagccagcgtgggcaacggctttatcttttgtatagcatgattcattatagtgcgccagactgtgaagtggcgagaagtccatgggggtcgctggggagtccatgccttgtttataagggggtgactatgatccaggaacggtgcactgttttgagttgtgttgtgcaaagggtattgtcacgatttccccctttgcaatgccgtggtggtatttcggggcatagcaacatgtgtggaatcgtgtcttgtgggtacagtggtacacctctggccagagtaaaactattcgaatagccgtgcccgcggttatgggcgggttgagcaatgtttttcgtgattagtctcacacctctcacagtaaatatggatgttaatacttggtaataatttgtttagctcctggtttggagttagatctgtacagccgggtatggttgttcaggatggttgggcctgtgcagcatgggtgtgctgttcagtgttgattaaaatttctgattaattacttcactgttttacttctcttaaatgttttgctaaatgctgcttttgcaaatgagcctatattatgccatcctttggaatccttgtgcacttgcatatttgctgtgtggcttgttgagtatgtcatatgctcattcttgcaataatcatcaaacctcagttgaagataaagggtccagaaggagaagacgtttggcttataccccagttgagctgcctgtgggagtggagctgaagccatcgctagaccgttaattccgctgttgttttcttttctttgtaagtatgtaacgttattattatgatggatttgtatattaatttgtcagtttgtgtacctcggctgattcctggacgaggatttatgcacaaattagttcggaaattattagtgaatttccgggcgtgacaaattacttttcccaattaaattaatcactgaaatgatctttccattattaaaaatactttcaatgctcaaataattcaaagaaacttcttgaacatacttggacactctaagtatttaacaaaattgaaaccagctcatgcaatgattaatttaatatgtgaataattactgaaatattctttatattattaaaattaggaattgagcttcgaaaaatccgagaaaattccagagagtataattaataatggagaatttaataaaaattaaatccaaccatgctttatatttaggaaattttatttcccacatttaacttcacttgtaaattaatgaacatttaatataaattctattaataatttattaaataatttataaatcctgaaacggaaattcaggctataacagtgtcccacgtcgccgccgcctcctgattccacgcgcctgccggctcttgtgtcccaggtcgggctccgccaccgcgctccgccgaccgcccgcgcccgccccctcgtctcgcgccgccggctcgtctctggcccgttgccaaccgccttgcccccaacgccgcggtccacctgtccgccgctcccttgtctcacgccgccgccatccaccgatgcctccgccgtctagcgcccgcccactcgtctcacaccgccgcttgcccaccgccgggccccgcgcgccgctgtcatccaccgggaggcccccgaggtcgacgtggtcgcggcacgcagccccccggcggctgccgcctcgcctcacctcgatgttgcccgcgctcgctgcctccgccgcgtctgaactctgaaggagaagagagagaaagagtgagggatagaagagagagagagagagaaaaaactgacatgtggggcccacctgttttttaataaataagttgctgactggactaccacgcgtacgccacgtagaccaaaaccaccgcggattgggtcgagggggtaattcgtccggtttgcatagttggggggtgaagaatatccagttttgtggtttaggagagtaattcggacgaccgcgatagttcgggtgtacaaatacaaaccttatatacacaaatacaaactttgtatacgtgtatacaaattttgtatatgcgtatgcaaactttgtatatgcgtatacaaactttttatacgtgtattttttaggttttatacgtacgtatactaactttgtatacaccttttcagttttctctttctgttttagtttttttccagtttctcttttttctccttatttttaagatgtgcgtatgcaaagttttttggttaatttaaccgggttttgggaaaaattaatttttttattttttttgtttgtttcccccttttttaaagggggtttttaaattttttttgggggggtttttttttgtttttaatacgacatatacaaactttgtatacgacgtatacaaacttttgatatatcatatatatatatatatatatatatatatataaacttggtatacgcgtatgtatatatatttttatacatataaaaatatattttttttatagtagtaccagcagtatactaatagtaggtactagtagtaatagtagtagtagatactagtagtagtaatagtatagtagtactactagtggtaattagcagcagcagcaggtgcggaccgcgcgaccagtctggtcgcgcattagctgcccccgactgataagagtacggcgttcttgccacgcccgctcgcatgacagcccggccctgtttcgcaaccgtatgatctcgccggtgtaggttgacatcatgggccgaaaccgaatcaaccccaacggtacggtgaacgaacgaacattaattactttacgagacaatcgtgccggcgagcacgtaagccgcgccgatggcgccctagcttctctagctagttctttaccatatatggattcatgcatggacacggcaagtaattaagttcctgaacaattaaacttgaggtcatcgttgtattcgtgtccttcgtcgatcggcctatatatatatgcaggcgtggcggtgaccacgcgggtggccaccacgggagaagatatatacttctatatacccctgcagcggcatgatcaccgtggcgtacgtgcaggccagtcgccatggcccaaaccagacgagaacgtaaagcaacgtcgtcgatctgtgtgcacccagccggcggccatcaccgacgttcaactgtgttctttcccaattttcctaacacctcctctcgaacatagccttaggctcagagatgctcgccgcaccctgcacgtgccaacggtcataagaaatcctcgagttttaaactcccaaccctttcccacgtgtgcaatacctcatttgatatttgattaatttcgttattacgtaatggaaaaattacaaaaaccaccccataaatcacttgaagtttaacatttcaccccataaatcatcttgttgcaaatacccacccctacttaatttgttgcaaaaaccatcctaatgtgcacacgtacttaatcaaatcaatttgttatcggtgctgtatggttatcacaagctaaactagccaagtaaatattgtccaagcgtttgcattagacttatttttcatatttgattgaacttttttttttcatatagcaaaactcagtgcgacaatgtttaagctctattttgcaattttatttgtggaatctcaccgaaaaatatgaagaacactctagaagtatttaattttggtaaagaccatattaacggctcacactttatgaaatcatattgatttggttaaacatgtgtttattgggatggtttttgcaacaaaactgagtatgtgggtggatatttgcaataaaataacttatagggtggaatgtcaaacttcaagtgacttatggggtggcttttgcaattttcccttacataattaatgcaattaatttaaacaaaacaagccaagcaaaagaagtcgagatcaactacatatatatgcacgcatggttagggaacaataatctccaacagaagtactatatatatatgccggtgtcaccgtgtcacgcgtacgtgttccggtgttcgttcgatgagtccactgtggtgctattcatcggttcactgtttgaatctgccggcgaatgcttgatagaatatggctgtcagagtcgtagatggccgaaccggatatggattttcatctttccagagtaagttctcccattgtttgtatattattttagtagttattaaaaaaatttaaaatgacttaacaatatagactaatataaaatatatcactccatacattcaagaccacattcgacttttacaagttaaaaaaaataaattgaaaatagttatcatatattcgtggctatatgttatttttgttacaactcgcggatattgaatttaacatgcatgttttggggtgatacatttcacataatcacattaatctatctttctaaattatttttttaaaaaaatttaattatttagatgatatatacgaaatgaggatatccctctagctataccccttgttggacgcgaaagcagccgcgcgccgtttgttcacgcggcccagacaccgtcaaagattattttcagcacatctggatggcacatgccgagacttcagagtgctcaccctgaataacctttgcctaatgtgctacacgtgttcagttacaataatcttcaaagatgctagaaagggttcggtgtgtaaaactccgaagcacccatctatatatatatatatatatatatatatggcgccacaaaatttagttagaaacagtcggattgaacttcacaatgattaccaccatttcaaacacaaagttgaccactaatgagccacggcaatatagcaaataagtaacttgattataatacacaatataaattaaatttaagatagaaaactagcgatcacaaaatttacacttaaataaattaaaaattacactgtaattattagtataagtgcagtataattttaatgtaagtacgatgtgtaattataatataagtgaggtgtaagtgcagtgtaattatagtattaaacactaatttctcaatgtaacttttcttatgggccaccatattttttatcaacatgtatttacattataagtccctaaaatttacatatgtaattttaatatattttcactgtaagtcacaaaattacatatataattcgtatgtaattacaatgtaactatagtgtaatttttattacttataactactttgaggaaagaacgagtaccatctttgtggtcagttggtcaaaagcgtgctgctgtaactcatcgatcacacgatagactccccgccaccgcgccttcattgctcttggagagcactcgcacgaatctcgatacaccgccgcacgcacagacgtccgacgaaggtcgcgtcgcgtgcgccatatttcaacgcatgtgtgcgatttttgtgcaaggagtccgtacgtgataactgtcagctcatctgtcatctgatccgtatacttgatcgagagatcccatggggttcggagttctcttctccggatcccctcgacacttcgtatccagcggccacgaattacatgcaccctgaacacgaaagcaccgtggcgtggacgcatggtgatcctgttcgcgatcgagcgacgaacgagagacattctcacctcctcgccgcgccctacgcatgcagtcgcagtggcatgaaatgcatcatctatcctgatcgagcagcctcgacagtgccatatctgaatatatatggccatcgccaatcacaccaacaaaatttgacatggacttagtcgtttcgtatctgagttccgtaactctaaaagcatagccatccctctttcgattttatccatctaaacgaaacggaagagctcgactgacagaactcaagtcacgacccgtttgttacaggtcgggttatggaaaaatttatcactccacaaaacatacaagtttaattttaacttatacaagttgtaataaaaatgacaatttttactaatagttagattttaatttgttatttttgttataacttatagaaatcaaacaatctcttcaagaaattgataaagcaaaaaagacatttactataggttggtaatgagaacatgcatggtgggaaacgtaattaaggccaattggtctaaggtttgttctcctgttcagtatggtggcctcgggatttcaaacttggaacaatttgctagagctttttggctagggtggctgtggttcaaatggaggacgccagaaaagtcttggataggaactgaaacaccttgtaatgaattgaataaggatctgtttgtggcatcgacgaaagtccaaattggtgatgaaaaaaaggggagcttctaagaatcaaactggattggtggtcaaagcctaagaagtcaagcgccgaacctctatataggcattctaagaggaaaaaccacactgtccaagatgccctgcaacaaggaaggatggatcaacaacatccgccacagcctcactattcctctccttgatgaattatttaatgtttgggaagttctagcacatgacaccccacaactaacatatggggcataagactcgattgtttggtgatggacaacgatgaggaatatagtgcaaaatccgcgtatcaattccaattcaacagaatggtatagtcgccatcaacaaagttgtcttgggaggcatgggctccagcaaaatgcaagattttcacctggctggtgcatcaaaaccaggtgtggatagctaacctgtttgcagatcaagggatgggcaaataactatttctaccaattatgttttcggaatcttaaactgccgatcaccttttgttcgaatgtccagttntgaagcaaatctggtttggagttctcacttggctgcgacaaaggcgtatcatcctgaattgggcacaaataacaagcgacccggaaacaacaaaacaaaaagggctcatatatctcttcttgctcgtcgcttagaaaatctgaaaggaacgaaactcaagaatcttcagaggaaaagagacgacggtgcaccaaataatcagtcgtatctaagaggaattaggttggtgcggtatagctcgaggaacacgctcgatatatacggattcaacgattgacgtctgtcttcagctgcagtgatcttcagtcttctccggccaagtgtagatggcccgtgtgtgcgcgactggccgagatcaagccagacttcaacccggccttcctgctcagcccaagaatttattacacgtgttttctttacctcaattagttattcttaactcatatctgggccgcacaggtccgatccaacagctgcaggtatcctagaaggggttggagttttggtcatggacacagcgacgatcgaggagatcatcacacgtgtcctgtgtcctctcctctcctctccttacgctcaagcctcgccggcgccggagttcccacgccctggccccgcccctgatccagggaaaacctgatgaaacaagaatgtgcaaagtaaatacttgctccgtcctaaaatataagcatttttagcgtagtgccaagtcaaccattttaaaatttaactattaatagaaaaaataaaaaaaataatcatgtaaaattgatgttattagatttatcattaatcaaactatcataaatgcaactctttttatttaaaatattttatttttatagatattgttggtcaaaatagcatctcaaagcctgtgtggaaatccgaaaatacttatattctagtacggaggggtaaataataaaccaggtttcagatctttgtgtatgaattgtgaccaaacattcgatgcttcaaagaaattgcagacacgaaactatctcccccggaaattaaaatatcagttttaatgaatttcgtcattttctaaaaaaatgggtcaaggtttgtttaaatttaaaatatttcctttccaaaatttctgagatcggaaattaaaatctcagttttaatgaatttagtcattttctaaaaaaatgggtcaagtttgtttaaatttaaaatatttcctttccaaaatttctgagatctctgaaatttcgttgcccccggatagggctgcaggaa

SEQ ID NO: 66819 - DNA, 5007 bp, Oryza sativa
tgcctttcttccgtaccgggtggtttgttgcaaggaatcgacgatgacccatgtatacaaccttcctacagtgcttaagatacgtactttctgtttcatccatacagtgagtgcaagccttgtaccccttgttggactgtccggataggttgctaagtgcaggccaatcgttgatggttacgaacagcagcgctcgtaggttaaactcctcctgtttgtcctcgtcccacacggggacaccttccttcttccacaactgtttaagatcttcgaccagtggtcttaggtacacgtcgatgtcattaccaggttgcttggggccttgaataataatcggcatcattatgtacttcctcttcatgcatagccagggggggaggttgtagatacacatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggggtgtctcagcatcccgtcctgttgacgctcttcagcgtgccatcgcaacattctagcattccccttgttcctgaacaaacgccttagccgtggtattatagggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacgttgtctcgggcaatttgtttccccccggaagaatgttcttgacgagtttcaataaatcgccaaatgccttgtcactaaccccattttttgccttccattgcaacaactccagagtggtatccaactttttgtgcccctgctcgcaacctgggtacaacgaagttctgtggtcctccaacatcttgtccaatttatgggcctccttttcacttttgcagtcctccctagcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccagtcagcatacatccattgccgatccatctacatgagtcaaaataaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcatctccgatttgtatgtaatcaccaaaataaattcaatagaaattttggcatgacctcccatcttttttgaagaaattttgaagcttgctcgggcagctggaggaggaagaagacatatatataggggtgggactttagtcccggttggtagcaccaaccggggctaaagatcaccgggatctttagtcccggttggtattaccaaccgggactaaagttacgactttagtcccggttggtaagatcccgggggggcctgacatgacctgacagcattcgaaccgggactaaagatgatctttagtcccggttggtaacacaaaccgggactaaagatcaaatatgcccgttacccttttgaaccgggactaaagatcatttttagccacggtttttattgcatccgggactattgtggaaatcggccgatcgacgaaagatggtttctccaccagtgctaccagtatatactgatagtatataaaagggtatgttagaaatttgatagaaaataaaataatactttagtaatttttggttgagatagaatctaattgggagtacccggtcctggatcttatcgtgcactaggggaggagcatcctgagcgtcatttgatgatgaagcacgtggcgatagcacgatttgatgatagaataacgaagaaaagataaaattaccctttcaaactttataccacaatctaattaacaaaaaaaattaaagcaatctacaccgttagatcatatatacttgcagcagtatattgtaccgtaaaagtccgtcaggatgtttgtggacaacgtgtatgttctcagtattggatttttctttttgggacgaaggcatatatatggtggagctgaattactttaatttcaactgcttctactaatacattaattgacgtgcaatctcgcaaaagaaactcgtactgttctgatttccttgccagagtaacacagtgtacatatggtgtatagctgaatatattaatgtacttgtaatgttttgttttccttgctatgtatatgcaggcctgatgacaaactggacgaccagaaccaagagctggccaagagcaaggatacaccagctgatgctgatcatgaaccggtggaagcatcgtcgtcttcctcaccaaggtcgtcgtcggtgccatcgcctccagcagctggttccccaccatacattcacccggaggagcctatcctctcctgatgggagcggcaagaagatggctgtgcaacgcctgagctttgtgtgattgaggtctgaatctttttttttcttttgacatttgattgtctgaatcctccgggcttgtttggcacagctacagctccatctctcctggagctgaagcttagataaacagtttcagctccacttaaaataaaaacaaagttgagtggagcgctctcacaaaagctctatagagatgtggagctgggttttgactactccacaactttcacttcaaactcatctcctgaagctaaattttggagttgaacctctagcaaacaggaccggagaatcagagacatgatcattagtattcactagcaacatgtgtataagctactagtacttttttttttagaacagctactagttctagtttgtgcttgccaacgtattagtatccacatcatagatcgatcattaccactttatcatgttctactacagttagtcgtctttactagtactccctccctcagttttttatattataaattatttaactttttattaagtaaaattgtattaaatttgatcaggtttatagaaaaatttaacatctaaaatatcaaattagttacactaaatataacattgaagatattttaataataaaatttgttttgtattgaaaatactaataaattttcctatgaaattgatcacacttaaaaaagtttgactagaaaaaaagtcaaataacttctaatatgaaacggagtgagtacatactaatgagagctaaagagtacaatgaaaacgaatggaagaaaaaaaaagaaatgaatggaagaaagaaaaaaagagaggagctagtgtctggcggtgacaggggaagtttctgaacctcattggttgcccatattttgaaaaaccattctaattttgaaggatccaaaacggaaaaagtcttgtttgacctttataagactagcccaaaaatgtgaatcccccgctttccaataggcttgagataaaggttgtgatcccaaatatttatagcgtaatagttgttgctatattccatcggtgataaagtagtttgtataaccacttactaatcaacactttattctttacctcgaggtcatgaattcctagccctcctgttcttagggacgacaaataatgtcccacttagcaagtcggtatttcttcttatatccatctccttgccaataaaacctagatcaaaggtaattaagttttttaagtaccccactagggattgcaaggaatgacatcatatacattatacattagaagactgctaagtactgagttaatcaaagtaagtcgtcctcccaacgaaagaagttttcttttccagctacttaatttcctctcaaatctctagactacttctttctattccgtatttctcaacttcctataattgatcgaaatgtcaagataacggaatgggaagttgccgacctagcagccaaaaagttggttgtattgatcactatattcaagtgcttcacaaaaaggaggactgcatggcggatcctggtcactggtctttaggacctgctttatcaagaattaaaaactttctgcagggaagggaagttcacatcaaatggatccccagagatctcaacaaagttgcagatgatttggcaaaatcggcaagacaagctcaacctagcagtcgcttggcttgactgttctaatgtttctcatatttgccaaagggatatgtgccctgttaaaagaggcattatcaatgctccaaagggagatgcaactgtaactcaatgctatatgtttctaaactctgtttttaattaataaaatgtatgagttctaaaaagaaaaaaagaaaaaaagaaaaggctttaaggcatcccactcgtttcatc

SEQ ID NO: 66820 - DNA, 1309 bp, Oryza sativa
  unsure (1)..(1309): unsure at all n locations
ccgagtgattgccagtgagtaatcacacttactataggcgcgcaattcgagactcggtgacccgcacagaccngctcttttggccttccggctttcgctcggtgcagtgcacctacaagcgaggtggtatgtgcttcactcctcggcgtatgtgagggccaccacccggcagtacaatcacagaccccggccatgcaaggtttttacgggggtccgccttctgcaaaccaacagtttccgatgtcacgaccaacattttagcagccagtgcagaccatgccgcccccttctatggcgggttttggcaatcaagcggcatatgcgactggggggcctcctacagggggcaccctccagagcttagtggaggacttccagtcgctctcggttagttctgcaccaggatcgcttgatcctggtgtcgacgtcaaaaggctgccaaggccattggatggtgacgaggaaccaactaagggtttggaggcatatccattgaactgccacccgaggtacttccggctgacaacccatgcaattccagcatcccagtcgttggtctcaaagtggcatctgcctcttggggctgtggtacatcctttcgcagaatcacctgatggggtaatgacttttaggcactctatttatcttttaccctcttgtcaaagaattgttctgacattcatgtttctcattacttaagaaggttcccggtattaactttgggtcagctggtgtcaatccgttgcccaagatgtagaacatatataaacccttacgcaacattcgcggatgcttgaaagaaatgccgctgcaaactttgaacgctgttaaatgatggaaatatttttgggccttaagctcaataattcatgtggacctgaaatttgaatttccgaagaaaaaacaatcgcacaacagatatttggttattttgctgaccatttttttagcttatgcaactatgttatccacattaaagaagaaattggagtttgtcaactaactttgggttggtggcgtgtcaaaaccaaaggttttcaatggtcaaaaaactttaataattctgaaagaaaatatttgcccttaataaaatattggaggggaaagcgggaagaaaaatattaagggtgggctttttaaaaggaaaaatggggtggaatcttttgttaccggcatcttaatgttgggatttttatggggcggacggcttttaaaaaggggaggacccttttttagagggggnggggaacacaattcaaataggtggaaacaaatcttttaaaaagggaatattagagatttcttgtaa

SEQ ID NO: 66821 - DNA, 2729 bp, Oryza sativa
  unsure (1)..(2729): unsure at all n locations
cgctgcccttgaanatgaanancgatgacgnacnccgtctgaanannnganttaggaggaattgtgcaggatggtccaggaataagcttatgaagcaacacaacgcaacattactcatctttatcattaaaacttgtgtgcgaccatgcatgtgtatccttcaaccttagaggtgcgggcactggacacaagagtgtgaaacccttatcacataccttcgcttcatcgggaagaacgagcttgcgtgccttctctaatgcctggcaattctccaagcctcgtgacctggccggtagcacctctggtttaacatggcgtagcatatcctctaaatcaaaactaccatcgaaatcatcactatcggtggaaacatcgacaaccattctttcacgcgacatgtcttcgattataaaattctctgcctcattcatctcgaaacataactcttcatcgtcatctttcggattggcgaattccctgtgataggttcaaaccttgtagttggcggtgaatccgtactccattatgtgacccaatatttcaccaggatctaccaacaatttctgattcttgcaatgacggcacggacaaaagatctttgtcatattctccctcaaagcatgcgccttagcctgatcaataaatttagatgcttccttaataaatatcggctgcgttctccacatctcatacatccatgacgactgatccatctaattatataaaggcaaaaaagttacaaataaaaaaatagaccgcaggtatttcatacaaaagtttaaatgcatttgtctccaaaaaaaaatacaacaatacatgtaactagtatgtacaattgattacatgcaaaatttgcccatcaaaacatatattttgaagctagattttgcaaaaattagttagaacaaaccttgtcaaaatattaaaaaaactccactttccaccaacgaaatataacaaaaatggagccaaatgaaggaggatagagagttcttcacctttcgtatagagttcaagcaaaaatttcgagttgaaaacctcccccctaattggtgcttgctttaggagagagaaagcttcgttttcaaatggtcaagctcgggcctggaggagcatatatggccgatcatcgcatgcggtcccttaagccagccgcatgcgaagatccattatcgcatgcggctgcttaggacagccgcatgcgaagatcagccgcatgcgataatgggcctattttcgcatgcggccgtcttaaggagccgcatgccctaatatatgcggccacttaagacggccgcatgttcgcatgcggctaatcaacccgcccccggggggcggtttttgcaggcgccgccacaagcggcccgcatagaacctaccgaccccctcgtacagaaaaacgatttttgtagtagtggttgccgccgcaggtgcagaagaagccaccgccggatgccgccatcttcgaggggatgccgacgcgagtcgcggtggcgagacgcaggcgacccttacgcgttcgtgggcgcggcgggagaacggcggaggccggtgcgtcgtggccggcagagagggcgtggagcgcagcgatggatagtgcggtggcggggccgaggatggcgaggacacggccgttctcgtggctcgttttcttccttccgacggccaaccttccacggcggtctcgatctccgccgccgccgccgccgctccggccctcacccgcacgcctccgtcaccgctccagtgccgctcctgggtctccgtcgccattggcccccgtcccacactcgcggagagaaagagaggggaggatatgatttatatgagccccacgtgtcagtgggacccacccatacttttggtgaatgataaatgggtcccacatattttttatttctaataccacctaagtgccacgcaaacgccacgtggacaaaagaccgagtcaatactgccacgtaggtgccacgtcagcgaaatcgccctccgaaaccaccgagggagtcaaattgtatcggttttaagagttgggggtcgagatatccgattttgtggtttagggtcacggattagatttcgatcacttttgagggtcacgaagtgaacttattccttctgacgtcgcccaaccctaacgcgtggcgacccgagaagccgagagcccaagaggccaagagcgtcatcgtccgtctattcgtttgtgcactggtggagaaaccatctttcgtcggtcggccgatttccacaatagtcccggatgcaataaaaaccggggctaaagatgatctttagtcccggttcaaaagggtaacgggcatatttgatctttaatcccggtttgtgttaccaaccgggactaaagatcatctttagtcccggttcgaatgctgtcaggtcatgtcaggcccccccgggatctttagtcccgggtggctgatcgtaacgggccaagtgctatggccgctgctcatctctccaaaaggattcatgccatccgtactcaaaccaaaccgtatgtttcgtgcgtcctttccaaattctttaaattttctgtcgatgtttcgccactgcgaaccatcggcggngtggtttagcatcccgtnctgttgacgctcttcagcgtgccatcgaaacattctagcatttccctttgttcctgaacaaacgcctttagccgtggtattattaggaaataccacattacctttacaggaattcttttcttt

SEQ ID NO: 66822 - DNA, 3681 bp, Oryza sativa
caagtctaacgcgcaggcttttagggaaatatatgaaaaggttcttttgtctgtcccgtcatggcaagaatcaaaaattgttggtagatcctggtgaaaaattgggtaccataatggagttcggattccccgccaattccaaggtttgaacctttcacagggagttcgccaatccgaaagatgacgatgaaaagttatgttccgaaacacataaggcagaaaattttatagctggcacggtctgctgtaaaagaatgttggcatatgtttcgggggggaccttatgtcccggtgggaggcaccaaccgggactaaagatcccggtgatctttagccccggttggtgctaccaaccgggactaaagtcccacccctatatatatgtcttcttcctcctccagctgcccgagcaagcttcaaaatttcttcaaaaaagaggggaggtcatgccaaaatttctattgaatttattttggtgattacatacaaatcggaggtgcctaaaaggtttgcaacttcatcctccaatgttttttttttgtcatactacatttgcacctatgttttgcacactttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaagaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtacggttttttttgactcatgtagatggatcggcaatggatgtacgctaaccggcggtccaaagagtttattgacggcgtgcactattttttgagagtggccgaagctaacaggcaaaggggttttatttgttgtccatgcaataagtgtaagaatcagaaggagtattctgcatccaggactattcatttccacttgtttgagtcggggttcatgccaagctataattgttggacatcccacggagagcaaggtgttgaaatggaagaagatgaagtggaagacgacaatattccggactttgctcagtatgttggatttgaaggaaatcaaacgggcgaggaggaaatagctgctgatggtaacgacgttgcggatgatcttggtcagatgttgcaggacgccagggaggactgcgaaagtgaaaaggaggcccataaattggacaagatgttggaggaccacagaacttcgttgtacccaggttgcgagcaggggcacaaaaagttggataccactctagagttgttgcaatggaaggcaaaaaatggggttagtgacaaggcatttggcgatttattgaaactcgtcaagaacattcttccgggggaaacaaattgcccgagacaacgtacgaggctaagaagatagtctgcccgttaggattggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcctgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaggaaggtgtccccgtgtgggacgaggacaaacaggagaagtttaacctacgagcgctgctgttcgtaaccatcaacgattggcctgcacttagcaacctatccggacagtccaacaaggggtacaaggcttgcactcactgtatggatgaaacaaaaagtacgtatcttaagcactgtaggaaagttgtatacatgggtcatcgtcgattccttgcagcaaaccacccggtacggaagaaaggcaagcacttcgaacgtaaggccgaccaccgtacgaagcctaaacatcacagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattactcgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttcgcagaaggtcatcgatccggatagattagaagcccttcagaatgaagtggtgcaatgtctcgtcagttttaagttgatatttccaccttcatttttcaatataatgacgcatctgctttgtcaccttgtgaaagagatccgtattctcgggcctatgtacctacacaacatgtttcctttcgagaggtacatgggcgttctgaagaagtatgttcgtaaccgtgcttgtccagaggcaagcatcgccaagggttatggaacagaggaggtcatcgaattttgcgtagaatttatcgaagaccttcgcccaatcggggtacctgaatcacgccatgaagggagactacgggaaaagggaactctcggaaggaaagcaataatgacagtagacaacaatttattccgtaaagcccatttcactgttctgaaacactcttcattggtagctccttacatcgaggagcacttggctttagttcgcgccaggaacatcggtaagtccgatgcatggattacacggcatcacattgatactttccccgcgtggctacgacaacatatcatgggtaacgagtcgatcaaccaacaacttgccttcctggcgaggggaccgtttgggtcgatcgcgacattccagggatatgagatcaatgggta

SEQ ID NO: 66823 - DNA, 1356 bp, Oryza sativa
  unsure (1)..(1356): unsure at all n locations
ctgaatgtcanttgtananccnncatcnngttaagnatcctcnttgtcgcatgccggcaggctcgactttagaggatcccccgatcgaacgaacgatagcgagaacgaacacgtcaacgtacgttgtccgagaacgtgttcgagaactataacgatcgaacgaacgagagcgagaacgaacacgtcaacgtacgttgccgcgaaaacgtgaacaagaacgagaacgatcgaacgaccgagagcgagaacgagaacgatcgaacgaagacaagcgagaacgagggaacgaacgtgaacgagaacaagcgaacgaacatgaacgagaacgagcgaacgaacgaggacgaacgttaacgtgaaatgcaatatatatatatatatatatatgttacttcgcatttatcctaatacatctttttgtatcttgtagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataaaattattttattgcaaattagacttagtatgacattattgactacggaattggtgcgactcctagcaattgactattgtagtcttaattagacttagcatatacgcacgaaacacttagcatacatgactattttagtcttagcatgtaatattatttgagttttaatataagattactttatttgtaattagacttagtatgtaattattgactacggaagtggtgcgacaagtagcaattgactattgtagtcttaattagacttagcatatacgcacgaaacacttagcatacatgactattttagtcttagcatgtaatattatttgatttttaatataagattactttatttgtaattagacttagtatgtaattattgactacggaattggtgcgacaagtagcaattgactattgtagtcttaaaacataaatgtctcgtgacttagcagatgtttgttgtatcaacagatggctgaccgcgatgaggaacagatattgtacgatataatcgcggagggaagcagccagtactggaatgaagaagaggggaacgaggatccaaaccagtacttgaacgaggaatggaacgttgagagggatgcggaggggaaccaacaggggcacgtggaaaggtatgtggaggggaacccatgacgaggaggctagtggtagtcaacacttcgtttgacagaagatggcacgccgcaacgaggtgcaacga

SEQ ID NO: 66824 - DNA, 9583 bp, Oryza sativa
cgctgccactatacatcctctatgacccatctgccgcctactttttattgtcattgggactctaaaaatcgaatataactatcgttggaatttaatttttacttatagaagtcccaccaaccatcgacgggtctgccattgtactcctgtacgacccgcccgctgcctctcatttttgttgtcattgagattttaaaaattaaatatgattatcattggggtttattttttttattttctagatgttccgtcaaccgccttgaccgattgcttcacgacctgcacgtcgtcctttcttttaatcgtcattaggattttatttagtgttttgttaatagtttttagatgttacatcaaccgccaccactctatttctttatattcatgttatttaattaatatcgtcatgtgttttagattactctgatgattaaaaaaagtcataattccaataattgaacttcccatggtaatgtactaatatgtgctaacctcactgtttatttaatgtaggtttagagagtaatatatgacatgctaagctgctatgatctcattgatgtcctaattgggtttagtcaataagatggatgcgtccaacacctcgcacgcatgtgttattgtcgtttgtttttcatgtgtgcacgcatcatattgtcatgggtatggcgcatgagacagacacggatgctagttttacacgtgattaccaaattataccacaaacaaatacaactcagttaccgatttacgacttaatctatctatctatcaactccatccgtttcagaatgtaagtcattctagcatttcccatatttatattgatgttagtgaatctagacatatatatctatctagattcattaacattaatatgaatgtggaaagtgctagaatgacttacactgtgaaacggaggaagtattatctatctatctatctatctattatattattaaaacagctttgaaaagaagcaccactttcactgtggaggctagaaattccaacattaatcggagaaaaagaaaaaaaaaagaaaaggagagtacaagtagaaatacaatctaaaaatagctgaaattcagaattaaaaataagctatattgaaagaagtttccatataagaacccaatacgagattaatcaaatttcgaaatagaataaaatccaaaattagaaaaggaaaggagagtccgagtagaaatacaattttaaaatagctgaaattcggaattaaaaatatgcaatattgaaagaagagtccatataagaacccaatatgagattaatcaaaattgggaataaaaataaaaataaaatatgaaattagcaaaaataaaaaagaagagtccaagtatgaatacaatttaaaactaactgaaattcagaattaaaaataagaaatattgaaagaagagcccatatcagaaccaatacgagattaattaatattaatttggaataaaaataaaaataaagtctgaaattagcaaaaagaaaagaagagttcaagtaggaatacaatttaaaattaactgaaattcggaattaaaaataagcaatattaaaagaagaatctatataagaactcaatacgagattaactaatatttagaataaataataaaataatattcaaaataagaaaaactaaaagagagttcaagtaggaaaacaattttgaaacaactgaaattcaaaaaaaaagaacactatacggtattaattaaaatttgaatttttttctaaaattagaaaaagaaaaaaattcaattaggaatacaatttataaataactaaaattagtgataaaaaataaagactgttgaaagaaaaggctatctaaaacacatgacgagataaattaagtaacatgcatataaaggagtagagtaacagcggcgtataaaaactgttaataaaacacaaaatagaatcctaatgacgattaaaaggagggacagcaggtaggccgtgaagcaaacaggtaaggcggttgtcgggacttctagaatgtaaaaaaataaaccctattgataatcatattcaatttttaaaatctcaatgacagtaaaaaggagaagcagcggacggggtgtataggagtatagttgtatagccgccgacggttggtggaacttctagaaaataaaaaatgaattatgaattccaacgatagttatatttgatttttagaatcccaatgacaataaagtgtaggcagcgaatggactttagaggagtacagtggcatcatttgacgggacttctaaatattataaaaaataaaacccaacaagacaataaactctaaaacctacaaggttcattttttaaaggttcggaacttctaaaaagtaaaaaaaaaaccaatgataatcatgttcgattttaaaatctcaatgacaaatggaccgtagagtagtatagtggcatcgtttgacgggacttctaaatattataaaaattgaaacccaacaatacaataaattctaaaatctacaaggtccattttttaaaggttcggaacttctaaaaagtaaaaaaaaaacccaatgataatcatgttcgattttaaaatctcaatgacaataaataagggaggcagcgggcgagccataaaggagtacaatggcaaagccaccaacggtttggcgggacttctagaaagtaaaaagttgaactcgaacgataattatgttcgatttttaaaatcccaatgacaattaaagagaaaaaatagtgaacgggccgtagaggagtataatgatagtgtttgacggaacttctataaattataaaaatgaaacccaacgagacaataaactctaaaaactataaactataagatccaatctttaaaggtttcaaaaagaataaatagaaatagtggtagatcgagtaagcaaataaagaacaatatgatagaagtaaggggtaacagctggtgtgactttttaaaactatataattagaaatacggggataataaggtttggttttcaaaatcttaagataaccagatagctatttaataaattttaagcaaaatcatactgaaaagggattgcctacacatttgtcgggtgatttttaacaagaaatcacccagattttttttacacttagatttatatccaacggactataaaataaaataactaatacaaatttgcttattcaatatttttatcaaaattatagtgcacttacatatcatatcaactaaatttacatgtgtaattttagttatatagaactgtaattttatattttaaatacttacatgtcatatcaactgaatttacaaatgtaattttagttatataggactgtaattttatattttaaagaaaataacaaatacatatttacttacactttatttttataaaaattacagtgcacttacatgtcatatcaactgaatttacaaatgtaattttagttctataggactgtaattttatattttaaaaaaaataacaaatacatatttacttacactttagttttatcaaaattacagtgcacttacgtatcatatcaactgaatttacaaatataattttagttagtgtaattacatacaagttgcagtgtaattacactatgagtgtattgtaattacatctgtgaaatttctagaaaaaaatttatcggcaaatatatatataaaaaattgaatagaataggtttctagcgatggtagatttgttaggcatggccgcatggtggtgtaatctagtgtgggatcctagctttggcttggttcagatttatgcacaagattcaagtgcagagaaggtcgtcccgtccggcgatcgtctccactcatcatgcccaaagggacgagcacagtgcgaacaagatcatcccgaccggctgaccacgcatgcagcctccaccatcgtgcggtcagcaaatccgtgaaatcctggagaagatcacactcaatttctcccttaaaaagggcccccggggtaaaaaaaaaaaattttttcacccgggggttaaaaaaacctttttgggaaaaaaaaaaaaaaaataatttaattggaatgtcttggttataaggggtcgctagccgcgcaattgcgtgggccacccagctagttagcttaatcagcaggaaaattagatctctattctattctcgtagagttgtattacctataaaaccttttctatttataaattaatttggggactatctatacaacgttcgactgaaaattagcctaaaaatctgtcaaatgtaactgtaacataattacaatgtaattttcataattacactatatttatactataattacatatgtaattttcataattacactatatttgcactataattatatatgtaatttgcatgtaactcgcatgtaattatagtataagtaagatgtaagttcaaactagatcataaaaatattgtagcccaatggggcagtcacgccttcatcccatgaggtcacaggatcgatccctaaatatgattttgtttttcttcctaaaagcacatatcttgatgcgtattagactgttagcatgaatctaagacacatccaacggtttagaaagtgaaagatttagccatcaaaaatctgtcaataaatatttagcaatccgattaatttggtctttttttttcctttcccctcttattaacgtgaacaaacttttgcgtttatatcacttcaaaaattaattatctattctgatttggattcaaggtcagtgtcaggatgtcatgtgattggttcatcaattgctacggtttcacactcctatccgtttcatctctttaactttttaaattttaattaaatcttaaccgttaatattcaggtatatcacaatcctatgcaggttggtattttcttccttttgtttaattaacgtgataatttctttacatcaaatatatcacaatttaagggcacagatattttattatacatgcatgtataattagctagatttagtgtacaactcttatcttctgtttcttatagataaaattgtagtagcattaaaatttagtcctatcataatctattggtatagattttaatctaccattgagcgcttaatagttaagctaatttttgcttggccatatgcatgcaaatacatgcatgtccgattcctagtcaaattagtcaaagttgccttttttattttaaggatattggctggtcccaatctctctaagatgttttttttgggctcacgtattttcctggttgatctagaccatccttttttttctagacaaatacgatccaacgacacatatatttttcctttttttccgattaacgtgggaatttctagcctccacagcgaacgtggtgcctcctttcaaagctgtttttaataatataatataatatataatggataaatagatagatagatatatagatagatagattatatacaaaggcaaagcttttgtgcccttatctatctctactattataaaaattgaatatgtttttaccgatattttggtatatcatccgtgtatgagtcggttcttaagttcgtttgcttttggaaaaacatatccgtatttgagtcggtttctaaaatcattcacttttgataatacagaaggaatcatataagaaatctatttaaaataactcgcatgctaacttgagacgattggactcctaactgcagcttatgattttctaaaaatatatatatccaagagcgaactcccaaaataaatttcattttaattaaaccatataacaataataatattaaaatagatttcacccgttgcaacgcacggacattttttttctatttttttaaaaaggcaaagcttttgtcggccttataaagaaaaaaaaaatcatttcacaatccacaccaacccatttccagaaaattcctctcactgcgtcatggcttggcgtctctccttcctggaccgacccttttatttgtccatccataataattccgcgaaaatctggtagcaagaacacaatcctcctgagttgagagactactgccatagtgccatgcatggcgctgtggggagggctggggcaagcggcgacggtggcgcagctggtcggggcggacatcggaggcctcatcaccatgatcatgcaggcggcgatgacggctcagcagaacaaggaggagtgcgagcagctccccgccgcgtcttcaccatcgccgagctgctgcagcacctgcaggatcccgatgtgctgcgacggcctgagatccggcggccgctgaccgggctcgacgacacgctccgggaggcgcgcgagcttgtgctggcgtgccaggacaagagcgccgtgtacaggttgtgtacaggttggcgatggccgggaggcaggctgaaaagttcagggatgttcagagcaggatcgactcctacctcctgctcttccccgtgatcagccacatggacatcactcgtcgtctcgatcgaatctacaacatcctggttccgaacgacatggccgggccagctatgtctcctgtctccatgccccaattccccgtcccagcctcctaggtacattcgaatgcatgcataatataacctcaaactttcaattgcaatttgtacttggctccaaagggaagcttagaattgaactctaattttgcctttcttccgttatctgcacatctctgtactaggatgctgctaagatgtattggaaggaaccacatggagtccaagagtttagttttaacgagctcgcaaaggcgaccaacaactttgcccctgaaagaaagatcggtgaaggtggcttcggctcggtgtacatgggaaggcttcctgatgggcgggtggtcgccatcaagcaccgttgtcggaactcagatcagggtatggaggtgttcatggtagagatcacaatatcctctcccccatccgctacaagcacattgttccactatatggctattgtgatgtgttggtcgaggagaagcagcggcgcctcctgccaccgttccggaaggaaaaggaggagaaagagcatctgcttgtctatgagtacatggagaacggctcgctggatcaccacctgcacggcccaacgtcgtcatcgtcgtcgtcgccagtgatggcgtcctggaagatacgcatggagatactgctataggtgtgtcgcgggccatcgagtacctgcagtcctgcggtgagcagccgattatccaccgcgacatcaagacatccaacatccttctcgatggcaactgggtgccgcgcttgacggactttgggtatgcgttcacctgggaaggcccaggcactgatattaatgttctttgtggtaccatgggatacatggccccggagtaccttatgacatgggctctgaacccgacaatcgacatctacagtttcggtgttgtgatgctggaggtattgacggggaagaaaccatatctctttaaagaagaatggaaggaggagaagagagaaaaatgtgagcaagatggaaagaacacagaagaggacaaggaggagagtgaacgagaagaagaggagaagacaacagaagaacaacatgagtggcaaaagcgggacgggtggtctagtggtcacagcttggcgtctttaacgccactgattgaggcggggaagtgtggaaggtgctggacaggcggccggcagcggagccaacggcgaggcagctgaaggcggcggaactggtggcgcagacggcagctcgctgcctgcggctgcggtgggaggagcgtccagccatttcggaagtcgtggccaatctagagaaggcgctcgagctcgtccgttgcgacgggtaggcggtagcatagcgtgggctcccgagacatcttatgtgaataattgggcaatgtatattctcatcatgtaataattaacgctgttgcttctcttctcttttttttttgtgcgcatacacaattaaacataccaatgtggtgtgatcaacgaacagaatcttatctttttttgctgatttctaatgtccacttgtgcagctgtgctgaaccaacaacccccccggatcacttgctcttagcttgtgctgtgaattcaactgttaagctaggtgcctcccaatatcttcctgttcacctgtttgagtgtaagaaatagttgaagacgcacgaattttaactggttttgctcccattagcaccaaaaaaatcaacaaaatataaggccttgtttagttggggaaaatttttggatttggttgtcaaatcagatatacgaacacacatttgaagtattaaacatagtctaataacaaaacaaattacatattctgtcagaaaactgcgagacggatttattaagcctaattaatccgttattagcaaatgtttactgtagcacttcattgtcaaatcatgacgcaattaggcttaaaatattcgtctcgcaatttacacgcaatctgcgtaattatttttttcctatatttaatgctttatgcatgtgtccaaacattcgatatggcagcgtggaaatttttgttttgagaactgaatgttccgaacgttagcagccctgctactgctctttcttcgtattgtccccacaccttctccctgctcttaaaactaagaatctcatgcatgtctgtgcagcagaatcctctgtccgtctggcctgttgcagcaatatcctgcaggactaaaatttagtcttcggatcaaaacaccacctaaagctgggttcatagggctcaccggctcagaatgtattcaatggatgattgcaaccgacgtattttcccggaaatgtttatcaaaaacctgataatagttggggtttcaaataaaaaaaaacctgataatagttacagtctgcagtaacggacactgggcttcctttgcgcggcatttcatcgaacacttggagctcaagaccaatcataccagtataccgtagcctctccggcgagtcaaaccttccgctccttctctctttcaagagagctcgaggcgaccgcaaagccatggccgggcgtgttgtggcgtgagactgtttgcactatctgcccgattgctcccctgcagccctgccgacgccgcctccgcggcctcgtcatcgtcgagggattttgctgctctagtggagacgaatcgctaggccgaaacggggtcgcggttgacgtgcctccgtatgggccagaattgcggtagtatgggccggccctataagtaagtggaccggggggggggggggggggtcggagaagagaactactagtactccagttccagtattagcaagcagcaggttactcgatcgatcacgttgcagcgttgcttggtttgcatgctagcggatctcacaaatgccatgatgccaactgggatcggaattcaaaactccgacctcctttggcatctccacaaaccgtatattcatcaagcattcgcggccagattatttaacactgaaccgataatgctatcaagcattctataaaacagagtcagtgatcacttgggtgttggtatgttcatgtgcatgccgcaggggacagctaggatgcggcggcggggctgcaggaat

SEQ ID NO: 66825 - DNA, 29746 bp, Oryza sativa
ggatgccggctcaactacttcccggtctctctccccggtgctggtactgcggaggcggcaacctctcggatggcggcgagttcgggggaacctcctgaccaccctccccctggtccccctcccgacgacgctgccacttcctcccttctcctcagtccgctcccgactcatttggaatgaatgaagccgaggtcagtagcagctgccagtccagcgccatcccactaaggtttgtgagcttatcccaaaatcacaactggagacaggattggatcatagggacgcttatatatatttgtcgacattacaaactattagtgcaataattcttggtgataaatgctcaagggttaagcttatataaattgtagttgcatgaatcatattagcaactcattggcttcctttggatgagttataatctataatgtaccttttggcttattagcttcatttggattttaattatataatgcaagctcattcatctaattagaactttagatgaattctatttatagttagagtaattctacggtccttgaggaggtaccatgaggtaccaaaaatttagtgcaaaatttggtacctcatggtatctcatagtacctaggtaccaaaaggtaccaaatttacaatagaaaaaatggtacctccttaaggaccgtaaaattgctcagttagagcaatatatacggatatactaaaaattagagacaactgaactaagtttttttagcaagaactcaatatgttaacaatcttgtttatgtgcattttacatatcactgtgccgatcgagctttgcatgaaagcttgtgagggtttgtatttaacatacaacaattggcaggagggttggtaagataatgcccaagaatttgtcagttttgtttaggcatgtgaacttttatttgacaggcaaactagatttgtgaaatatactcatctttctattcagtttgatattgtaaatatgcccaggattccaaccttaaagagtgttgattttttttcaggttttggcggcatacatcagaaaactaatgatgtattgtatgcatggttgttagctcttacatgttaatgtaagggttgtttgacaaaaaaatctgtcgcaatgtgagctgggtcagtttgcattttgccaaggtgtgtttggaggctgcagtctctaggcatatgtaagctgtgatgtgaagttctgtgttttatgtattttttttcaacttcttcagggttaaatgtgataatatgtatgactgttattgtggtcaaaactgctcgtcatgggtgcccatgtatagagggaaggttatgccaaaatttttaataaattatggaatttgtgtaattgtgtggtttgctagctcttcatgcttgtgtgtaaaaaagccatttaagcgcctatattaaccagcgatctctctttcctgtataagcgcataagttaactgatgatctctctatatccacataagagcatatattaacgggtacccctaatgggcgatcgatcgccgtagggatggggtagcgatcagattcgctccccacctcccccctccctccctccacctggtttctttttttggcaccgcattactttcctattttaataaatttatacacctaaagtttatgaaactaaagtttacacatctaatgtttagagaccaaaagtttataagtcaaaagtttatatatccgattcaaatttgaatttaaatattttttttatatagtatttttgtacatctaaagtttatagacctaaagtttataagtcaaaagtttatatacccgtttcaaatttgaatttgaattcaaatatccgattcaaatttgaatttgagttgaaatacttttcatatatagtatttctatacatctaaagtttatacacctaaagtttatatacccgattcaaatttgaatttgaattatatctgattcagatttgaatttgaattcaaatattttctgtatatagtatttctatacatctaaagtttatagacccaaagtttataagtcaaaagtttatatacccgattcaaatttgaatttgaatttaaattttttatatatagtattttctacacataaatttttctaacttttgtttttcaaaaaaattttgtgtggtctactgtagtagaaagaggagaggagaggaggaagggggagagggtggacgggtgatcgctgggcaggcggggagcgatcacccgcccattagcctttccgcgcgttgttgggccagatgggatgcatgtttggtacgggtttgctcccctagcccgttaactgtgtgtgggcttctttctctcgcactgcacagctcgcggggaatctcgtcgtagcccattatgacaagcagcccacgcaccaccaacccattatcagcctttctggtttttgcaaacctttaacgctttgtacactctgcccgttagatgtatatctaatgcacacaggatcgactgataaaaccgaagtttgcaggcacctgcgggataggcggtcacattttatagggatttaatttgtgcattaatttactggaactgaaacgatattatattgagcgaccatacagtagacatactagatagatagcccgatcgaagtagaaaacccgatcgaagcttacatatgcatctatgcacttacacactcaacacacaggaccaagtaataagtatataacattaacgcaaacacacgcgtactcgtttatttagttaggtataggactaggagagtacgcactatagtattacacacatatatatatgcatacagatacagtcgtcgtgcgatcagctcgcctgagctccgtattcagattcagggatcaccatctggcgcctagccatgacggggaggacctggaggtaatactccatcttgtacaccaccgtcagaatctgctcggctggctgctccacgcctctgccgcggccgccgctgcaggatatcaggggtagcgggatcatgctcctttgcggctgctggctgtaccacacgatcatgcgggcgtcgccgaggacttccttgaggttgttcaccatctctctcgtctccgcctcgcgcgttagcccgtacgcctgcgggtgctgcatcaggtcggccacctgctgcgccagctgcttcagccgctgcacatgcccctggttctgcctcgcgctcccggcctcctgcacgataagttcacaggtttgcaccacctccttcgcaagagtgtcgctaacgccgccgccaccactgccctcttctgctgggattgatgctgcgaaccggctgctgcatatgatatttacaattatattccaacatacaaagaaaaacggaactttacttaaattaacagtatttaagtcatgcatgctttcagcgtacttagtacccctccgtcccaaattacagggcgccaagtaaaattaaacttggtagctttgactaataatcatactaactattatgtatgttatatcactatatattcatattttgaagtactttcatctgatgctatttcatatttattatgatcatagaataaaatacaataccgattaaaatatgttattgaaaatcatgtgtaaaaaaatataagccttataatttaggatagatggagcactagttttaagtatacgtgcatctgttcttacccgttcccgtccgcgaggtccttttgtatccatcccaacacccatttcgcgtctgtggacatatcatcacgatgagtcaaacctctgatgtatgagttcagctcatttttcttcctctgaaattagaaacaattattattccagcttctttctgtgcgtgtgtatataaaaacattattattctataaaaatattaatttttgataatcaactcatgaggtcaactatatatttcgaattcttctcaaacttattcaagtatcaccaagtttatatataaaaatatttagtagcatttttaacacaaaacaaacctaatatcagcatatattcatgttagctaattccgtgttttggataatactaaattttcatataaacttagtcaaacttaaaaaaaagtttgacttgaaaaaaaaaactctaagcgacttataatataaaatgaaggtataatacaactttctttttttaaaaaaaagtctattccctctgtctatataaaataaacatatataagctcaagaaaatactaaacatgaaaccaagcacaaaattattaattcagacttagttgagttgagataacgtatggaaacaggtaattaattaatgcacaaactacctccctaagtcccaaagcacaagacgtatctattagcttttatatgacatgcaacatgtatatacataccttgaatattaacttctttcataatatattacaaaaatctaagaaaaatatttttaagtacaaatatatataatggtattacatgcgtgacacaaaatttgtatagtatatattattagcaaaaataagctagaaatgttaatttaaaaataatataagctagagctctatattaatttacctctggcaggttcctgcaagcgccatctccaagtagcatcttaagaacagtcatgaagaaacgatctttgtggatgttaacgatgagcaccatgttggcgacatggaactgctgcaggatgatcgagatccgtttgtccagggcatcgaacttcttggccttcttagagggggccaaacgcttataccagggcttctcgatttggcatgcctcaacgagcaagagcgcgtcgtcgagggcagtttttaggctcctcagcaccccttccgtcgccaggtcgggcgtccactggttatccagctgcgtcaggaggtttcttatgttttggacgtgttcactcagaagagagcactgctccttgcttcgccgagctgaatccaccatctccacgattcgactcgccaggctgaggatcgccgtcaccagcccaacggtctctcccaccatacccatcatgtctaccgatcgcgctccgcgcccgtgacactcctttccaaattaaattcactcagattgcttccaaaataatcacttatatactcctgtggtttgtaacgtaaatgactgtggtttgtaacgtaaatgactgaaatctatccccatgatatactccctagtccctccctttctaaatatttaacgccgttaatttttttaaatatgtttaactattcgtcttataaaaaaaataagtaattattaattatttttctatcatttgattcattgttaaatatactttcatgtatatatataattttacatatttcacaaaatttttgaataagacgaacggtcaaacatatgctaaaaagttaacggtgtcaaatatttggaaacagagggagtacttaactagcattatggcctgcattgtgcagctagtatcattatattttttttatctcacgtaataacatgtatgcatgcgggtgcacgctcgtgtgtgtctgtctataggaaactactacacccaccctgtatacaatttagttaattaaatggtaatttttttaccacctcaaggagcccgcactttcccttatatggattaattgattgaccaatatgcggggagtttttttttatggattgattgaccaatacgcgaggagttttttttttttttttgctggattgattgaccaatattctcggaggttttttttttaatggatggattgaccaatatgtgaggagtaattcttttatttgcatcctttagatagagagtggaagctcttggatagtgaaaaaattactctgttagtgcaagtttaatagtatagccaatacaactattagctccaaatcatttttagccaatctaatagttaatttatataatagttacctataaatatatattacaccattaatatctggtcccacctatcatatatacatagtgttgtggagttcgtgttataactgactacaaatttatagcccgcttcttttctctctcctctcttatcttctccagtagtacttattgtttatgttgtacttgctctaaggtgagggttgagtgttgcattctcctagacgaggctccttcccattaactatatgtggtaacaaaattgcaattcacatgtcaaagtgcagtcaaaaagtttacggttgatctatttttgtccaacccaaacaaatactatacgtgtcgtttttataacaaaagattattaaatgatggttacagaagttatacatgttggtaaaataataactagacgatgaataccgaagttatacgtggttagtaaaatgatcgctgaacggatggatgtgggagtgattcgtgtcagtaaaaaagttactaaaagatatttgcgggaattctgcattggtttcttcagggaaaatcctccgaaactacctatacttaaaaatataggtgaatagctaatacggtccggtccttgaagttatgttttgggcttagttagttcttgatgttttaaattgtccaaataaatcattcaaattaattatttggtataatatattccttagacccataaaaatatcacgtgagcatgctaagtcatcctcgcatgcagcagtacaaatgaaatgaccattgtacccttatataccatttagaaaataaagaaaagacaaacagaaaaaataacatgccagcccaggccaaacattgttgcgaatgggtggccgacaaaggaatttacacgatcagtcataagtgacaattccaaaacgatcatgcacgtgtaaaacatttatcttctttttttttcttttctatatggtatataagggtagaatggtcatttcattcataccgctgcatgcgaggatgacttggtatacttacgtggcatttttttagtccaaggactatattaacccaaatgattaatttggaggacttgtttggacaatttgaaacatcaaggactaaactgagcccgaagtaaaacttcaggggccgtattagatattcacccttatctatagatgaaaatctaatattttttttgctttcatccttattatgtgcatcactttgaagttcgaattaattccttaaggtatagaaaatgtgttgcctctgattaaagatactaaggggagttgaatcttaaggtatcagattttcttgaaaccccttttattttatcagacaagtcaacgtaattagactcgctcatgaaaatacgcagacagttccctgtcaagacataacctcatttccaccggtgggtggcttaaacatgcacctatgaaaatcatttttttacaagcgggcggcttaagctactcgcctatgaaaataaaatttccaaaatttaacacatatatacacataactttttcgtataaaatcatatgaagacaaactttatatcaaaattgtatatctcgtcaagatctataattttgtagttaacaacgtttttcgtttgagatggtttagagatacaaatattcgatctattttataaaatctcagaattatatatgtttcaaataacctccaataaagatgtattaattctatatcaaagttgtagggctcaacactagatctacaacttcctaattgataacattttcatttaagatcatttggaaaggtgaagtcaaaagaacaacatcttaattataaactcttggtagtgtgagatggttaggatatatggatgtgtggacatgagatcttagttgaaatcttatacatcgtatgtgtccatactttgtgaagaaatggtatagctaatgaatattaatttgtgcctactaaaatttaaaatattttttcagttttgttttggcgcaaaataaaatataaaaagtaaaaattcattttgacgggtgggaggcttaaacgaccgtacatgaaaattcacaaacatgcaggctgttcagtcgtgaaattttaacagacagttgctcacaagcggctagccgtttgtgaaaaatgagttttagtcatatgataatcttttatgtaatcatgaactaattaatttaatcttacacgttaggaccatccggatcgtaaaaatgcactccctccgttcatgttataagtcgctttgatttttttcgtagtcaaactattttagtttaactaagtttaaattagcaatattatgatataaaattagcttcattaaatgtaacattgaatatattttgatagcatgtttgtttggtattaaaaatgatactgtatttttctacacatttgatcaaacttaaacaagtttgattaaaaattcaacgtgacttataatatactccctccatctacttttgatagtcatatttcatcttggcacacagatcaagaataagtgattctacttatcatccatttaaacatgctactagtcattcctcgtaaacaaacgatttattaatatttacatttctcgataccaatgtaactaatcttgtgtggaagaatagagagtcacgcattaaatccaagaaagacattaagatgataagttattggattgaaatatacttatcaaaaataaaatttttagatttgaaaatatgactatcaaaagtagatggagggagtaaaatattataaaacggagggagtacacattttatacgtaatatcatcgttcatctgtaaactgatcgagacgacaacaatatagtagagaaggttacttcacgattagaaataatcgaaactattacttacttttactgatcgtaatactctctccatctacttttgatagtcatattcccaaatctgaaaattttatttttaataagcatatttcaatccaacaacttatcatcttaatggctttcttaaatttaatgcgtgcctctccattcttccacacaagattggctatataggcatcgagaaatgtaaatattaatgaatcgcttgtttacgagaaatgactagtagcacgtttaaatagatgataagtagaatcacttgtccttgatccgtgtgacaagatgaaatatgactagtcgcttaccagccttcgaccttgtcagaactcgtagcgatatataggatatagtatagctagctctcccgagcactaaacagatggatgagatctcgtttgcctttgcttctggcaaagcttacaggcagccagcacgggctgcacggtatttattcttgcacgcatagcatacgcctgaaaaacgccaaagcagtccgtgtcgtgcatgtctgttctccgaatgaatcacatatctataaaagattatccctactgagtatacttaattaattactatgcgtttttattaagtcacatcatcgtaattaattatttctataaaagattatccccattgagtatacttaattaattattttttattaagtcacgacaccttaattatttttttgtcctcagataattaatctatttttttcttgcattaagccatatcaccttagttttagttttgttttgaattgaatgatcaatctatatatgacttaaattattataaatacaattataacttttaatcatcaaagatgaaaattatataagtatataaagttatctcatctagctaacttatattttatttctactagaaaagatgcttgtgcgttgtaacgggtaaagtcaatttaatttgtacatatgtgtcggtggataaataattacaatctactgttttgtttattcttgtccgaatcatttataactaagtaaagactattttgtgtgcaaatattttttatgcatgttcttaacgactcgaaagcaaatactataaaataaagtacgataaaaaagccaaaaagtcaaatttaaaattaagttctaaaatttaaaattggcttataagaataagcataagccaaacaatgaggcctttaaacatgagcttgatttgtcgtccaattttatctcaacttaggcaggaattgatgattcgttcatcctttatttcggttggcattttcttttcaaaagtaaataatgattattatggattattgtaacgatatccctgatagtgggatagtacgtatgagcatgtgtggaaactgacttgaaatcatgctaacatgtcctaggaattgtgccgcataatatgaatagaattagatgatctaggcaactatgtacgtgatatccacatggactatgcgagtttcattcgcttggtatccgcatcacacggactctctttcgtagttcgctcatgagtcatgaccttgcaatgaatgttaggcgtgacgggaatccgatacggacaacataccatagttttgacaaaaacatcttcaatttttaagtcatggacgaggacgacgcagtcccaatcgggcactatcgggtatacggaaaatcgcgtgcgcgagggcgttgcaggcccaatcgcggcggcgcgcaaaggcgcgtgtggaaaacagactcgggcacgggcctgattgttgcctgcggcaaggagcgcgtgaaaaggtgcgggcccaattaattcatgcacgtctcggataagagggacactctaacataagaaaaaattaaggaaatgatttgatagaaacataaaactaaaatcgattcaaatacggatgacgtatcataattctagcggaaacaactttaatttctataatactccattccaaattgatctacatatagtttttttgaggttattcctaaatgatctacatatttgtgttcatttattagagtctattcgttatttgtgcattggagtaaatggacattgatgcatgcatccatgcacacaagtatttataacccacatgcaatatcttgatttgctattggctaggaaatattggtgcatgcattgagtttgttgctagagtaaatatagtatgagagagttattagcttttcttggtctttgtgtacctatgaaatatgtagatcaatttggaatggagggagtagtagagataagcatacaaagttttcgccacaacacgtagtgtttcatctagttttcatacagtatcagctaccccattgttaacgaccaaatttggtaagatcgacatcgaggaggaagattagatcgaagtggaatccaagacgaagattatttcagaaacagagcaagaatcggctagagtccaaatcggttatgttcagatcgactgagttcgagttagataaggatagccgatgcagccgattctgacaatatgactcggtatacgtcatcgagttaagttggtgtgctttacggtgattgctacgtaaggatagagtcctaaggaggcgattgtatctattaattaggatattttatgtaatttccttagagatatgtttgggcaaaagtctgccgtaaagacttatgatatcttagagtttgttagagataatagtcgtgtccggtatggacatatcttgtaattctcgagtataaatagatcccgagccctatgtaataattaacacacacgttcaatacaattcggcgcatcgccacctttttttgctttagttttatttcaacgagttcttgcttttgggttgagctgcatcggtttcgatcttcaacaagaggtaaaacttgttatggcggcttgcgttctcgggattagtgcttccatctttatgacactctaatcttgtttatgtaatctgttgagttatcatatattttatataatctctaacaatatcgttatctaacctacaatcgaccagcatctgtcggtagattgcagctgatcaggttagatattgacgtttatttagattatataggatatctaccactctataaaacttccagtggcttgattgtctagatgttgttcttcttttcatacttaatgttgtatcagttgagtttgatctattaagtcgtgcttagaatatcaatttctagcctgccttctggttgccgattagggtagtatcggggtttcagccgatcttacctgatttaactacttttattccatgtgcatgattgacatgttaagtctgccctttacattaagatcttattatatttgagtatattaagcttttgtttgatatattttacttgttttaatatcttaatatagagtggtatcggagtattagccaatacatgctagatctatctgatcggctatgctatgaacatatatagttctattattaacatatatttcgatctaagtgatttatactttctcggcatggcgtccgatctatcccaatcacttgatttaagtatatgtcaatatagggagtatatattgttaatatctacagccgatcgagtagatttagtttttccttatttattcatgattgccgatcgatgcatatatgacatcggctcaaaggtaaatgatatgtcatcggcatctagccgatcggctatcgtttataggattaactgcggtttctttgtctttatttcttgttgattgcaggatcaaatcaactggcacgctcatacacccgaaggcgagttttggacctgcactggagttaagcaaatctcccaggccgccgtgttcgatttccacatcaacacccatgcgcttctatcaagagaagtaaatgctaataagtactgcctccattccaaaataaaaataactttgttttttaataaactgcttgtgtccagatgtggtataacttttttttaccgaatctaggtattttcagctaatcatatgcttaagaaaggaatctctaaataatttaaactttgatcactgaaataactaacaaggaatgtttttccataatctaattaatatttgctaaataacctgtgggaccaataggccttgccagcgcaagtcttcgtccaccctaggtcttcgtccaccctaggtcttcgtctgccctaggtctacgtctattctcgatttagtaagccaggtcttaattggggccactgccagcgacagtcgtaagtccaccctaggtcttcgtcttcttgtcggcaaactgtgcatgtgtacagaaaacgtacggagcttctagataggctgtaagttaaaatgtatacatggaaatttacgactgtgggagggtaaactcctcaagtggaggacagccgaggctccgccgggagtagcggatgagattcgagagcttagtgaatgaagctatgtaatgtagagggggtcgggccccttgggaacgatgagacaaaatgagtttatacgagcggcggacagcctccatggtggcaaggtgtggcctcccctcctcaggtcccgattggtggcgggcagcctaccctcttgctgggctcggtgggtggcagacggcctcaacaacagtgcggcggatgaccttccaatgtcgctacaccagtagctcaaatccatgcgtcctcgtcatcggtttcgttctcttatttccagtgatttttagttcttgatgctaatctgtgcatgtttgatgtctgtgtgttgttagatgaatggatgatggcgtggttgttgatgatgaatgagttcttggatgtggtgctcgggatgcttaagggatgttatcgcttgggatgtgttctctgtgttgatgctttggggatgttgacgtgggtgttggtacgttgatggctgatcgagccgatgcattgatcgagcagtcaagcctttttatgtttgttgcatatgcttcatagaagtcggttgttagatgcttcgtatatgtatatactaggtgattccccgcgttttgctgcgggaattactaagtaattctcaatttgttttacatttaagttaggagtaaaaaaataaaacatcaggatttattagtcaaatgatacccgtgttttaatgtgaaacatatcgataagtatatattaaatattgtaaaagtgatagatagatttatgaaaatattgtgcaaatgatatgaggggtgatgattggatatacttgtattttgatttatagaattaaataaattatagatcatgttgtatgcttgcatgagattaaacatgtaattattgctagtaggtgatgatgtggtatggttgcatgttgagttttaggcttagtgggcattaaccttatagaaagcatagatatgtatgtgtgtgtgtgtataaaagagaatgaagaaaaacataactagttacctagttagaagagaggagaacaatcctataaaaactgactgaaattaatttaaaaatataatagcaaatttgtaccaaaaattgatcaacaaaagctataatcccccctcccctccaaaaaaacactccaaacacttttacgacgtatttattttttatcaaaaggacaggagctataaactaacaaattaaggagaatagaacaaagtctaacatggatcaaagaaagaacattgaggagaaagaaggctaaacttatgtgatactttttaaattacttcattattcatacaatatgcatatgccatttcataaaattttaactctaaaattgacccatatgttagaaactaaataaacaaaaagataaattcaactggaaatattcacacgatagactttttttataaagcaccagagtatataaaaaagagtattgttgacaactaaaatttggctagatatggaaaataacctgagccttctgcatagtgcaagtccgaccaaaggtatacggccgatccgactagcaaccccaagaccgagtccaattaagtctattcttgtgtttacttacttggacccgatgttttttgattcctatttgatctctaaacccaataggatgtggaggaaacttatagatgcaagaccaacacttttataagggttatggctgatttaattctaacccctgaatcctacacttgacaatcaatcgaatcgttgtttttcctttatttttcaaccatattttctactttacattctatagctgcatatagtacctaattcatccatctttgtcaatttatggtgtaaatcatccgtcctcgctacgagagtgcgatacccagcccttgtaggtttgtcctctaaattgatctaaatcattctaaaggctggtttgatctctcattggctccgctagtcgattttcatattttctaaacccatcctaatcgagagtttttctatatcaaggtggttgatgactttgttagcatcacaaatatttaggtgagaccgtgttaattgcaatagtctccaacacaaattgacaacactgttgatcaagattttcagccatccaatatggccaaaatgaatctacaagctgaggaacgagcttagctcggttggaacattcgctgtggtgtgaacggtcggtcgctagttggactcatggggcttcacctcgatgggtttttcccgtcttttcttcggggttgtccttagggtagtctcgactagaaaatagggtacacatgcgtacgcgttcagtagcggtcctgagtgtctctactattataaaaattgaagatgtttttgtcggtacttttggtacgtcatccgtgtatgagtcggttttcatgttcgttcgcttttggaaacataaatccgtatttgagtcagtttttaagttcgttcgcttttagaaatatagaaggaatcgtataagaaatcttttcaaaaaactcgcatgctaacttgagatgatcagactgctgtttgcagcacatgattttctagcaaaatatatatccaagcgaatttaacacagtgaatttcaccttaactaaaccatatctctatctctatctctactattataaaaaataaatatgtttttgccggtattttggtccgtcatctgtgtttgagtcagtttttaagtatgttcgcttttagaaatacagatctgtatttgagtaagattttaagtccgtttgcttttggaaataaaaaaaagtcgtataagaaatcttttttaaaaaaacttgcatgctaatttgagataaatgtcagactcctaactgcttctcatgattttctaaaataaaatatccaagcgaatttccatggtgaatttcaccctagctaaaccgtataacaattacaagattaaaataatatttacccgttgcaatgcacgagtattttttgtagccttaaaaaaatgaatctacaagctgttaccgctgcatatattaatcagatcggcaagatcgtttggttcttgccgctgatctatccgaccgctttcgcggaagccggtctaacctacaccataataccagtccgaccgggatgaccgacaggcagcaggcaatatcaatctgttagtgtatgcgtgtgttcttaccgaggacaataggaaatcagcaaagttaatttttgatcaaattggctacatacaaacatcaagtgtaccaaagaaatgtttctgggctgaggttaatacggctgaaattaatcaagggaggttttctccgactatgacaagtgaagacgagaaggacatgctcaccatggatgactaaatattgaccgaggaggagcgacaagagcttcaaaacaagtggcaaagattgagaaggcaatgctcacaagctttatcaagaccaatcaaagcatctctaaaagagacttccgacctgctacctcgaatcgtcgtctccaaaagtgacgggttgcgactatggtgcattaccgaggcacgaacggatacagaacaagatttaaggagaaactcatctctttcttacttattcagtcctcctactcttctctttctctctattctttctctttcatctctccttctatcaatggtaatccagcgaggtaggaaggactcgagtcccccgcacccacgctggatccgccctgcgaggcaccaactatatgcatgaagcacgtattatacatataggttggaccatcaggtggaggtcagttagaggctggctgggttgacatgtggggccgattggcccatccttaggtcagtcgggcactcttgtgctctgttagtgattacgtttagatgattgtgactttagatggtttggattaactcttgatgtggatcggatagttggtttgagcaaatagtcagggccagccaggcaagaaatggaccatccgagctgcgcaatgtggtcggcctaggtggctggtaaagaaggccgacccatcaccctcttgggggaaatcaaaacggaacgggaacagctcgattgacagaactcaagccaaactgtaccaccttcctcggcccaaggactgtgagtcctctgggccgtagcgaacggcccaagatatcccaaaggggtttggagttttcttctccgaaacccctgttcctctcataccgcctcgccagagcgcctccgtcggtagcacaaacgccactgcaggagcgcaggtgacgccgcaacatctctacatattgatcctcgaggcctccctgcgtcacggtcgccatctgcaaccatcctcctcgcgcacacacgccgcgcggcggtcgcggacgtacgagacgacggaggagcaacacatacagagcgtcggcgtgggctcgtggcgaccgcgcatggccagacatgcagcgcagtggccggagacagttgaggagatgcaaattttgtataaggccctgtttagatcacactctcaaaaaattttcaccctgtaatattgaacgtttaaacatctgcatgcatgaagtattaaatataagctaaaaaaataactaattgcacggattgcgactaatttgcgaggtgaattaatcttttaagcctaattgctatttgatttgacaatatggtgctacagtaaacatttgctaatgacgaattaattaggtttaataaatttgtctcacggtttactgatggattctataattagttttttattagtgtctgaacactccatatgacaccctatataatacccgatgtgacacgccaaaactttacgcccctggatctaaacaccccctaagccttaacattgcgatgagtagggttccccttaccgttttcggcgtagttatcggtccaccgcggtaaggtggataccacggtaactgcgaggtaaccgcgagacattttttttttagaactagggccagaaagcccccatttctcttactagaaatgaaaatatccttactaagtcagaaaggcaaaaacaaagaagaaaaaaaaaactaaaaagcttatccagatgcctcacgggctggatggctagacacgattacatcattctgacatcaaagggataaaacagatcacaaaaaaaaagagaacatcttcatccttctatcctcctgatcccaggtctccatccatgtcttgagcaaaagatatcacttgccatctgtcttatgagtctagctcccaactgttattcagtttgcttccaacttctgcaaagatgcctaggaatccacccaggaacaagccataaagaccaaatcagtaggatctcttggaattttattctcaaagcatgttttattcttggacttccaaattgtccaaatgattgcagctaagccaatcacaatcaagtgtttcatgtttttatcatatctatcaagccagtgtcaaaaagatcatgatgattcaaagttggaattatatccagagcccaacacatgatattccagagtaatttagccaaaggacaatcaaaaacaagtgttgtatatcctcttttttgtcacaaaatggacatttttcatcccccttccttcaaccttttttgtacagatttttccttagtgggaattttgtttttaacaaacaaccaaataaaaattctaattttcagaggaatcttaaatttccagattctcttttaaggaaaagacacctgatgcattttaagggctttataaaacgatttcacagaaaagataccatcccttgtcaaattccaacaaattttgtcttcagagtcatcctataagatcagactttccaaactatttttgattctcacccaatctctcattttatctccatccagatcccttctgaatttgatacattgcaagcctttcattttcacctttgcaattgtcacatgtttggtcaaagttatgttatacagatttgggaactgaatgttaagggggtttccacctatccagctatctttccaaaacaaagttcttttcccatttcccacttttttgaacaaaatttaaaaaaaatcatcctttacttccatcaacccatgccagaaatgagaattaccctgtttaaaagttacctcagacaaggtgaagcatctaggcccccggtgttaattttggtaattaatgacaagtgctaattgtggactaaccattcttttgagctatattttaagttagattgacatcatgtgtgtgcatggatgattattgatggattaaaattgacggcgcaaagcaaaaggaagagaagacgataaactagtgttttcattttgaattgatcgaggcgtggggcgatcaaaattgtgctagtttatttttagcttcgccatactattaagaggggtaatgacctagcaaagggatgattttaattgccaaattaggtcatttgcatttagacttgtgctcacatttcacaacatgcacttgctatatatttgtcactgctctggactgccagggccggtctgaccgccggacagattccggtctgaccggccggtgtcaccagtctgaccgccatgtcatggccggtctgaccgccgtatcaatgccggtctgaccggaaggtgttggccggtctgaccggccggccatatggccgggatggcatgctctaggatggccgatcccgagccgccggagccgtattcggtcagaccgagctgaggacggtctgaccgagccgaggccggtctaaccgggcaccccatgtcggtctaaccggccgaggcagtggggcccaatgacagccctacaacggctagaaaactagccgttgtagagtagcacggtctgatcgggcacatacctccggtcaaaccgacagagcactgagttgggggatttcgcccccaacagctagttttggtgggtgggagtataaatactcccccaccagcagcaaggggactctcttggcacccaattcaattgcatacaccccttgtacctctctcacacacctttgagcttagtgttcatccattgtagtgattgaggttgttctagccaagagtcaagtgcattgcttccatttgtagagctagtgtggcacttgattaatcatctccacgccgggtcattgcttgttactcttggaggttgccgcctcctagacggcttgtggaggagttgcccggtgacctctccgagaagattgtggaggaggccaggcgtcgaattgtgagtggtttggagttcaccaccttcggagtaaaggaagaactaccccgagtgatcgaggcttgggtagtcctctccgtgggccggctcccgccttgcccaccccttgacgaagggggcgtgcggtggcttcgtggttgggcggtggagttggactcgcctcaacggggagtaggaaaccggcaagtttccgaacctcggtgaaaaatctcttgtctccttgtctcatttgattaccgcatttacatttgtgcaatttacatttctagagacatacttgagatcatatcaccctaggtttgctaaacattaacataggagtgtgatttactttcctagagatataattgagccactatcaccctaggtttgcaaaatataacttagttgcttagttagagttgaccctcaccaagcctagccacttaggttagtgttgattaggtgtcatttagttttaaatcgcttattcaccacccccctctagtcgacatctcgatcctacacaaggttttatttttcaaatattttcccctaagaatctcctgccaccaaccttctttgttttccaaattccatatccatttccccaacaaggccttattcataatgtctaggtccagaacacctagaccccccgatctcttggtgagcagatgatgggccattgcactaaatgatattttctgatgccttggtcttcttgccaaagaaacctcctaaagaaatccattttttctttcacccctttgggtaacttgaaaaaggagatcatatacatgggaacactgcttaaactagaattgatcaagattaatctccccttattgactgaagtttcccttgccagcatcccagtttgctttccattttgttttcagcatttctccaatctttctttgtaatgcgtttctgatctattgggatccccaaatatttcatgggcaaagcacccacactgcaagtaaatatctgactgaaaacctctgccttatcagcagtctcaccaatgcagaacacctcacttttattgaagttgattttgagaccagataattgctcaaacaaacataagatgtattttagatttttttgcatgtcttattatcaaatagaagaaatatggtatcatcagcgtattgtaaaatgaccatcttgttgttatcattatcccccagtactcctatcagcagattatcctcagctctttacactagtaaagttagtacttcagctgccaaattgaataaaagaggagatagaggatctccctgcctcaaacctttatgtgttttaaagtaaggccccactctatgtgttttaaagtaaggccccacttgatcatttacctagacatcaactttactacccattatcactttctttacccaatctgaaaatgtaccgcgcatggtaactatgataaccacgtgataaacgcatggctgacgacgagattatatccacgtgagaggatgatggttcagatctaatcgatcacaaacaatgaaacaaatattgaatcagcgaatcagagtggtcaggaaaatgtaacggaaatatcgattcacgctcactcactcaagtaggtgagcagtgagctgagtcagcggtcgatggatcttcgaggacgcggttgttagtttggtcaatgagtttgaggctgtgtttagatccaaactttacatctaaacttttaactttttttatcacattaatttatcatacacatataactttttagtcacatcgtatcaatttcaacttaaacttttaactttgaaagaaactaaacacagtctaagcttcactgtgtaatgccagtccactacgcgtcaaagtgtagtgggctttcagccttgaagggctaatttcaatgggcccgggattccgtctatacaaggcctcgtctggttttgccacgtaagcgaatcacgagttttttttatttataattttttttattaaaagttttacaaaaataattttccattttgaaaattgacggaaatagtcgcctaccgccctctgggagggcgatttttagagggcggcgtaaatgacgtggcagccggccgttcgctctcgggcgacggccgtcaacgaaattagcaggcggcccccttgccgccctccgctagggcggttttctactgtgcggggggccgcctgcaaatgggcggcgagggggggcatggaattttgcaggcggcccccttgccgccctccgctagggcgattttgtactgtgcggggggccgcctgcaaatgggcggcgagggggcatggaattttgcaggcggcccccttgccgccctgggggagggcgattttgtactgtgctctatatttttttttatataaatagcaatagttatgaaatctttttatattgaaaactatacaagattaaaatctcaaagactggtaaaatacaattttattattttttagggcatatttggattgttaccgtacaaatattttgttagtgccaaaatataagcaagttttggtagtactaccaaatatttagtaaggtaaaattgcatttgatcatatttggtttgctgccaaaatgtaaaattgtagtgaagaatgttatacataatctcaaatctaaattacgtattaccaatgaataggcttccattttcgtgtgtggtgagctagtgggaaagaagatatgaagaggttgccttcagattgtcaattatatagcgtcgttttcactgcaatatatgtgaaatcaatgagatacattattcattagatgtgacaagacgatcacgcgtaggcgtgattcactttatgtcaacaggcagcgtcgaaagttgatagtgataactcgagctgccgcttttcatgtgtgctgttgtggactgtgcgcgctactggatatggcactaccgtgaagcgccgaaagtgtgttgttgtgagcataagttgttcaagcaccatatgaatgaaaagaactacgtagacgagacaaacacaagtagtactgcagtagtaatagcaaaagtagtactgctttgcaagtttgtaaggcagaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccgagctgagaggagcctagtacgtcctggtggtctgcaccgtgcaagtcgtcgtcgtagaactggctagtaggaccagtcctaccggcgtgagacgaagaggccccagtaccgaagatcccggctgcatatcctgctggacaaggaccatcagattcgtacaagtatttagcagtagtaataaaaagtaaagtaccgtgtgggcgagggaacgacgctccgtgagaggaagagctggcgaacgcgcccgaagaggtggcgaacggccctgcggagctagcggaagcgccggtcgtgcctgcgaacgcgctcgaaggcagacgaggtcctgcgatgaggaaacgtgcagttaaaacatggtgacacattcgtgcaaaagctgaaacaaaaatgaactaatatcttggctgaactgtaccgtgcgaaaccggtgctgtaggtcgcactgctccgaagctaggggcgctcgaaggcaaacgaggtcctgctccgacggtaggcgcgcgaggccgtgggtgtaccggaccagctggaggtacgacgtccacggcgctgcgacaggagaagacgcgcatgaccgcacgcatcttgtcctgcatccggtcgaaggtcgccctctgctcaacgtcagtcaagtgcaaacctctgttcaacctcacctggacagcggtgatatcggcactgatatcccgtgcggcatcagcctatgcaagatggaaataaaaaattcagtagttgtcctattttatgcaagataaatgaaataattgttggaagtaatacaaattggacgtaccgccacgaagtagtctcggtcacggtgcgtgggatacgcgtccgtgacagcggcaacgtgcggctctggggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgatgtaattatcataaaaatttcgaaatgaacaatccgaactcacgagtggtcggaaggggggacggtcgtctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgacgtcgctcggctggagacggtcaaactcgaacacgaagtccgggtaaccacgtctcacctgcacgtgagcgtaacgacgctgcaataaacatgatcggaattagaaatgttatgtgaaggaaaaaaaaaagaagaggactgataaacttataacgcagcgaagttgcactaaccccacgtcgacaccagtaagtccccatcgtgggaccgtcctctggccactgcgcgctgcgaccaaccccgtagggtgcgctgtccaccactggtcgccctatggcaaacctctcggctgcccaaagctgaagcaacatagggcagccagcgatgatcgctcccgcgtcagtcttcgtgcacgcctcacagagggcacggtacgtggctgctagcacggcagaaccccagctccactgcggcacgtcctgtggctgagcatccgcgatggaccgtgcgtagtggaccagccggaagtccacagcgtgcccgtgggtgctagtgaacatcacccacccgaacaaccacaacaggtacgcctcaagggagcgtcggaccgagtaatcatcagcttcagggtgcagaaggtccgcctacagttaagaatgaaatgttagtacaaaacactcatccggtcgcaaataatcatgtatgataataacatcttatttacttacagtgaactggagcaaccaagccttgctaggcccgactgtagagtacggaggaagggtgctggtcggtcctaggtgtggaaggcgcatcacctgctcgaagcgcgcagtgatatcctccttccacccaaaaacaccgtccacgggaccaactggtgctcccgccagcggtagcccgagcaggtacgacacgtcctgcagtgtcggagccatctccccacagggaaggtggaacgtgtgcgtctcaggtctccagcggtctacaagagcggcaaggagtgaccggtctgcatcccaccgcttcgcagggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcgcacggttcaacagcgccggtgtgtcgtacgccatacctgcatcaaatagattgatcagaaacatataaataattagttcaacataagtaataaatgttcataagcgaattactaacacatattaaacaatagtacaaacaaacaaaagtgtcaccatacggaatatttctgattacaacaataactgcagttacacgatatgagtacttagtccgaacactcatcacgataacattatgatacaacaccgaatagttcacaatactactagtacaacaatagtcggaggtactcattacaacaacattgaattgaaattacacgatagaagtatttagtccgaacactcattacatcacaacagcattttatttcctaaatcgaaagcattgttacaccatcgaatcgcctgctgcgcgacgacgccttggccttgcgcgcctgcttgttgttccttcaccaggtggtcgcctaccatcacttgcctgtccagatggactggcatctgcgccgcttggaacttctgcatttttcgggcatttcttgtaagtatggccgcgcagatcacacttgctgcagcgtaaagtcctcccacctgcttctgactcatccatatcatttctgatgcgtctagtttggcgtcgaccctttttcacccttaacttagatggatcaggaatataaaaaacttgggcactcagcgttgtgtaagatcctgagatcccgaacccatatatttcctcactccatgtatgaaagattgcttctttcctgaaaaaatttgagacgtacacattgggagatatgccacaatcaccggcagcagcaagaacgtgtgagcaaggaaggtgatgaagcttcggcttcatacaactgcaggtacatccaccatccgccttcaagacacattcctgcacggcttgcttgcgatagataccacgcctgctcctatcaacatacattatttcataccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtaggcttgcgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgactgaaatttctgatggacgaccctgacctccttctcattgttggtgggtcatcatgtaatgcaccaagaggtatgggaggctcgtcaccttcaacttgtggtctgcgagattgctcgtctgtttgcttcgttgtcaactcatccaacttgtcccacaactcattaaatttcttctcttggttctgtgcacagagcctcttaaagagctccataagatgcttgttcttgaattgcttgtagaaatttgcacccatgtgacgcatgcaccaccgactccgaacatcaggccacttagctggaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaaatgtatgtaggtcatagtaagtattattattcctctgggcaatggtggctaacaaacgaggcaaattatcataagaagcttcatatgtgccatacctcatctaaataatcttttgtttggctctccaggcctttgcatagcttatggtgtacttgaatttgttctcgatgtgcctaataattgattttggttcaaagccaatgttaccaacaacactgctgtacatctcacttgccacaaaagctgaagtgatgtttcggtgatacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgtaatgaaactgcccaatgcttcaccgcctccttcatctcatccttatgagcataccttgcaccctcaattacctcgttctccttatactcccagggtacatgatcaccctctgatatgacaagtccagagaagtcctcatttgcccaatcagtggccattacatcaccttcctcatcggatgatgcgtcgtcctccgcttgctcattatccgaatcttccctctccatttcatcaacaattataccgactctctccccctcatccgccatgcccatggcctgctcctcccttggttgattttcctcattttccatcgatggtccaacaacatcccctgcattgctaggaccctccacatcttcggttcgcattgaaacatttgtatctttctcttgtaccgacacaaatataacgaggggccatgaccgttcaaaagccatttgcacataccgtctccagcagcagtgctgtccatcggcattagttcccaaaaataaccttctattgcacgactcactacaacagatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacattaactgcgttaacctcgcatttctgtactacgccttaagttacattctctacaatattgtcctctaaatttctaaaagtacgttacattctccagatcaaactaaactacatcttacaattaacactactgtctatgtctcaattcatactattatattctatgctctggatctacacatatgtgctaaaatatatggaactaaaactaaaacgcaacatatatactcaatcataacatattagtacaaatgcaaaagatgtatgggagcatacctgtgatgaagtgagcgaaccagcagggcttcgccgctccgcttctgctgccctcccctctctctctttcgttttttctggatttttagtgaatataatgaaatttaacagaggaggggctgggctttataggggggggcccaaaaatcgccctcccccagggcggcaagggggccccctgcaaaattccatgccccc

SEQ ID NO: 66826 - DNA, 18832 bp, Oryza sativa
cattcgcggccagattatttaacactgaaccgataatgctatcaagcattctataaaacagagtcagtgatcacttgggtgttggtatgttcatgtgcatgccgcaggggacagctaggatgcggcggcgttgatccggcgaggcgaacatgagtcggtggatgggggcaaacatgggatctcagtcgttcgagatggacggcggcgagcaacttcagtcatgttgttcatgtcaatggggttcggagatgaaaactccgaacctctctagcatctgtactgcccatttgataaagctagtgtagtcgtagcacagtaaacttagccttaagccaactgccagaagtttgtttatccacagaaggccttaagcctcttctctctctatttggttgatgcgattagcactcccatgcagaaacgcccttcagctggagctcatcagtcggttgatgcaattagcgctcccgtatagaaatggccttaagccggttgatcctggaaagcatgaacatgttgctggtagcaatgtggcatctctgccttattttggtggttcgtatggttaggtaagcgacgcacatgtctgaaatgatgacacagttgagaattttaaactcgaatgtgtgtggcttaaacaatccagctagagatgttgtctaagagacaactgaatttcctagagtacagatcttatgtcgataggaaacaaaattaagtaaatgtgaaaagagataggatttttttaaatttttaattctattaatagacctttccaaaaactgaaccttttggccacgctagcagcgttgttttgccaccctagccatggtggcgtggcaaaagctggacaacactgccacaccatctgcgcgtggtgtcacaaagtgatttggccacgctaggcgggctggtgtggccaaaaggtttagatttgaaaatacttttcggaaaggtctattataaaataaggtctaaaaaataaaaaaatttcgagaggtaggggtaatagatggtagattttagtatcttgcctgcagatggaattttgtgtttttttttaggctatgataataacgcgtcctgtagataaacatatttttttggaacatgccaaggtgtttttttaggtagtagagcgagtcaaagagacaaaatccatagaaaatcaaatttttgaagattataattcgcccagatttcaacaaactggaattaaaaccgttagtccatatttaagaatactagagcgctcggacaaaactatcatgtcgaacacatacgtgttcatgtattagttcataacacgtgccatgtgttttaacagagccagcgacatctagcaaattaagaactacttactactagataacaatgtgaactactaaataaaaacaattaagttcgtctccggtgccgaaacagagaatatcaattataggcaatgtaaaattatccctaaccaaaaatttcctgaactactctttataccgcgcgctgcagccctacagtctcatacaaatcatccaaatggacgtatcaaataaatattacactttatttatttctaataagatagcttactataaaatctcgtataaacctgactaacgcaatcgaccacatcgacaacaactattcatcttagcccacaagagtaaaatgtattttgcaaacctttctaacccaaacaaccgcaccacaccctaaaggaaactgctcaccgcagaaaagatgtataccatttgcaacataataacactgaaaattttagcacatatagagacaatataccgagaaaaataagtactataatatattaacataaagaagaaataataaatatgctacctttttattatgtattagtaaataatatatacgggctataaactagccggtgtgctaacaaacatgtttattttctaattatattttcagaggaaacaaatagttctggagagagttcaaaccattacactcattaataatagtcatgtcctatgttctacaaatcataagatgaagttattatacacaataatgtggaaaccatcttaaatgcgaatacaattatctcatcattattcatgtccttgtgaatttgtgaaaaatataaaaataatttgtctaagcgactcgtaggatatgagttataaggatggaaaaaactagaggatgtatagtcttgtactagtggcacgaaagctgggacgaacaattgtagaacgtgagtaattattatgaatattatatacaaatcatttgcttatacgataggagctaatgcaatttcatatcaaaaatggtggatgcaatctctaataataaagaccggaaaaaccgaagactacaaatcaatcagataaagtttattaaatttcataaaataaggctttatctgtgacagtaacacgatatgtattttcatcccttaagaatatccccgttttcacattgtcattcaaataatcactaaacaatgtgaatttttttaacaagatagattaatatatgatatatcactctacaaatacgcaatttcaattcaatatatacaaattgtaacagaaataactatgaatattctctgcaaatagaggaggctttctcttgctatgctatgattatttagctctcatgctcatgctcacacattctcatagcatggcaagagaaagcctcctttatttataggcctacctagccattggatctttgacaaggattaagacacttatcctaatctagagttttcacttcttgctaaaaatacacatgtgcatccactattattaaaaatatatatttactaaaagtgtttctgataattttattttactattgtagaccatttgtgaagaaacatctagtccgtaaacattttggaatattcaagaagatttgggttgtctgcttttactccctataattaaatctaactagtgtgaaaatttagaccctctttggagaaagaaagaagttctcaaattctaccatgatttaatttatgggaaaaaatcaattcataatgaattgaaaaacaaaccatctaataggttaatgcatatgttaacttggtaagaactggttggtggatctaagatgaaaacaatcacggaaatttgccaattgattaatatggtcaattttcgactgaaatttctaaagatatgctaccagtcccgaccatttttatccctagatctatctatattttcatgaaaaacacaacatgcaatagctgccaattggggtctgtctatacttgcatgttggaaaagcaagacatgtaaagtcaataacttaaatctaggtagtcaagatccaccaaaaagaacataaccagatgagctaccttgaaagattttttttctcagttgatgtgatcgatcgaagcaactccgtactccttaccaagttaggtgtgaattgtcataccactgcaggccgatcgctcctgtgacgccgtgtggcaacaagtacttccttctcatggtagaagacaagagacgctacatgtggctcacgctgctcctatccaaggctgcgatcaatcgattcaaggcgtctgcgaaggttgaatccggcgacgcctcaaggcgctgcacaccgattggggcagtgagttcacctacatcgccttcaccaattactgcgcaaatgaagggagtctagtgacagctcatgaccccctactccccaccacagaatggggttgtagaacgccgaaagcaaaccatggtggcgatggtgcgtaacatgttgaaggcgaaagggttgtcggatgcgttctgggggaggcatgacgtcgtatgaggcatggcacgcttcctccaggttgtgcactatctgcgcgtgttcgctgcatcacccacatcaaggtcgtcatagctcgtcgatgatcttcatcaggtacgagcccggctccaagttttattgtgcgtatgattgttgacggtcgttagcgatcagttccgaccgtcaatatcaccaaaatagagaactagttatgcttgcaatgcatatccatgttagaataataatattgcactagtgtttggttcactaaccttttgcagagaataaccataaagtggaggagatttgacatcaactcagacgataaatcaatcggacgatgttaggaaccagacttgtgcatgaatgggccaagaactcagaattgacacgatgaattgggcgaaaattcacaagtctccgaagaaaagcagcagaggaggcccccagccaaaacttgggctggttgggccgacccttggttcgaccgaatcccccagcgccgttgatgcagggttgcgactgaacgctgtggattagctcccaatgacggttggagggtattttcgaccattccaaccgtcattgggaggctatataaacccctccctctcttcacttcaacacacacctcaagcaaagctctctcctattctctcaagtttagtttagtgttcccaagctagtggaatgggaatagagtagaaatcagagggtttggctctagtagctcttctcttctcttgtgtaagctttgcactttatttagaatactctcctttatacatttatggtattgaaatactttccgagtatatgaatgccaactttacattatgtttatgttatactgattatactgctagcttatctgggagatgcatcggtacaggtataatgtttgcttatacaattactctatgtcatgatgatattatagtagtatctggtagtttaggcgtggcgtctaggttacgggatatcattatttgaggttatatgctgcggatgagaggtgggccgctgatggtgacagctcagtacgggtattcctctgcgcgtgtatatagtcctaagttaatttcctccctttcctagggagggtactcatccgtatttagccccggttatatggtcatgacgggttgtcgtaaggaactcggctgtcaggggtgacttctcaaagtaccaggagggcattggatagagggtattagttagtatgtcagataactaggatgtatgtatactagaagtataggaattgattctctttctcttttctttccacttagcttagatattttagtatgagaataagtagctccctgcttgtgtgtcactctactgttggattatcttaacccctgcttagactatgattattacaagcaacatataaattattagtccggttatctctactatgatcttcccacgggattaaataaatacgatacccttggaatactctcgggtgaaatgctacaatggtatatccgtgcgcttgcggatgaactctgtaaccataatatattaggagtatttctgcgccattgctgggaattatatttctagcaatgtcattaagaaataccaacaataatctggtgtcacaacgaatatgcatgacgtgatgtcgtgttcaacgaggcagcctagtgggactgggaccagaatgacttgcaaggtatgccattgtctgaaaatggtttcccaatgcaatacttgtcaatgcctattgccagattgtccctgccactgtgtcgaacaccttcggtgcaagttggtgcggagccggaggcagtagaacccgatgggccggcacggacgcgagattcgcctcgccgcctcctaacttggaagagaaccttggtgttgatcatgacgatgacacgcccctccgtttccacaccgtcgatagcctactcggtgaggcagcggctccggggttcgcgatccgtgagctcgagatcaccgaggagcttctcctcagtacaccgacgaacccacaagcttcaaggaagcgaagctagatcaatcctggcagaaggccatgttggaggaaatgcgatctatcaatgacaaccacacattggagcttccctctttccctgtcggccaccgtgccattggcctgaaatgggtgttcgaggtgatgaggaatgaacacggagtggtggtgcactacaacgcgaggctagttgcgaagggttacttatagccgccgggaatcaactttgaggaggtcttcgctccgatggcacggatggagtcggtgcacctcttactagcaatgggggaaaacgccggctaggagatgcaccacatggacgtcgagatcggagtcgctcaggtggcatcggggttccaggggcgaattcttatccctggagattagttgaggtagttaggattgcatgtgcacgtttgctttggattcttttccttctatatttgagtccgagctaggcgcgccaccagagcgcgtcgtgcgccacgatcgggggtgtttgggatggcactcacctcaaccggccgtggcgcataagcaggatcgtggcccttaatccacggggtgtaatctagcataataaaaggagaagtaaaccgaaaagtagcaagttgttacacgctccaccaaattctctcttgcattctctgtgttcgtgcgctccaggtgttcgtccgaggttctcgtgcccagtttcgcgtgtgttagttcttgtgctgatcaagtggacgctaacaactaatgctctggcgtggcgagcagggttcactttatcggtttagctcatttgatcggaggtcaccgaaatcctgaatttttggtctgaaatttttaaaattttgaacacaatttagttgaatttgaacaaatattaccaaaattcatgaaaaatttgaaaaatttcggccgaagtaatatcgtatcggagtggaccgaaatttcggaccctgtggcgagcaacaggtgatatatttatcataatatatttttttgcggggaaagagaatgctttattgattactcatcagtgtgattacaatcatttgccagagccccaaagacacaagagggagcctgcatacgccaaacagctgaatggttcgtacacatggcaaaattagctagatcatgggctactctattgcattctcttctaatcttctgaacacggaaatcaggcagagcttggagtaataacttaatactccctccgtattttaatatatgacgccgttgacttttcgaccaacgtttgaccattcgttttattcaagatttttatgcaaatatgaaaatatttatgtcatgcttaaagaacatttgatgatgaaccaaatcacaataaaataaatgataattacataaattttttgaataaaacgaatggtcaaacgttggacaaaaaagtcaacggtgtcatacattaaaatatggaggtagtataatactctggaggacatggcaaagctgcgctccatatactgaccatgatatgctatcaaggtctgattcagttccaatatatatagagggacggtcgacggagattcagtgcccgtgttggtagcaagaacgtaccaccaccgctgcgcgtcgacgcggcgcggcaggcggcgatccaaaataggggtcgttttatcttgcagttttgagttttgagacgaaattgcaaaaatactatcagtactaaaatctctgatccggagaaattaaattcgtatatggaacatgcaaagctttctcgtttctcgttagggatggatcaaatcactttggcaataaaactcccaataaaactttcgattctgaacagtgaggccgtgggtggggttcggagaagaaaactccaaactcccaaggatatcttgggccgtttgatgcggcccagacgactcacactgtaatatccttggggaatccgagaaaggctgtacggttgggcttgagccggaaagtttactactccctccgtttcagaatgtaagtcattctagcatttctcacattcatatttatgctaataaatctatatgtctagatttattagcatcaatatgaatgtgtgaaatgctagaatgacttacattgtgaaacggagaaagtacaagcaaatgcattgatgtcaaattcaattggtgtgtgactggacatggctaatgaggcatatgcctgtaacgttcttctcttcttcagggagcagggttgcagcttaattggaatcttctgcacatcagcacatccacctcattgtcaaattaaattcgacttcaggtttctcaaagaaacgtagatggaccttagaatatcattacagggcatacgcatatactttattcaagcttattaattattactccctcgctcatgcagatcgtatgaagagcatactgagatacaagatggaggaaacatgaaggactacagtacatagacatgcagaaaagagaaagacaatacagactcgatggtgatcacactacactacaactgaatgattgaatccaatgaagcttaggaacggtaagatatacatgtccaaatctgaatttgatgaagaaactaaactaattaaccgatcacatcaaggagtagtaggggacgagggattaattgttccgtccagcgtatcctgcggggctgtggcgaacgccagaagcgagccggtcgatcgtgtatatatatactaatataaaatatgatagtcataagaaaatttggaagtttaaaatacccctgaagataaaaatctttctctggctcatgctaaagggtaaaatcttgactaaagacaacttgtttaagagaggatggaggaaaggtgacactaagtgtcaattctgtgatcaacaagaatccattcagcatctctttttttattgtgttatggcaaggctgatctggaacattatttcctgtgctttggatttgaaacctgtttctgatagcaaccagctgtttagttcctggatttctgcttttgggaagaaacttaaaaaacttgttgtcactggtgtggctgctgtgctttgggccatttggaaatctagaaacaaagcctgttttgaaaataaactacctaatgacccaactgatgtgattttttcggtttgttattggttggaatcttgggttccattgcagagactggaggaagatcaaagaaagctgctcttgggggccaaactcataaaacaggtggcaagtgaaatctttaactccaagtatggatggagggccgctacaagaaggattggatgctgaagatgtctctcttgctttaggtctggatgtcagatgcaactacaaaaattaggttttgggtgatgatcgctgtatctctgaatcaccagctggttatgtttcagggttttagtccttagagctatatgctgttattttgttttgtgtgatgtcatctacaaatccagctatcttggtagcttgtctaagactgctctgtatctgaacctgaactttgtagttcttcatttctagtaatggaaatgggggcatgatgcccttgatcaaaaaaaaaaaaatatgatagtcgtgtgccaccatcaccaccaactatcatatgagattcacgaacggtgagattaaattttacttgtttttgggtccttatatacatacatacatacatacatacatacatacatacatacatacatacatacatacatacatacatacatacatatatatatatatatatatatatatatatatatagacacacacacacacacatttatatatatatacacatatacatatatatatatatacatatatatatatatacatatatatatatatacatatacatatatatatacatatacatacatatatacatatacatatatatatacatatacatacatatatatatatatatatacatatatatatatatatatatatatatatatatatatatatatcatagaacccgtcgaaagaaaaatatgataatagaataatatggaatttttttttatctttacgaaatggtagcaaaattagcacaatgataatttattacttcctccgtttcatactataagactttttagcattacccaaattcatatatatgttaatgaatctagacatatatttgtccctagattcattaacatttatatgaatatggacaatgctagaaagtcttataaactgaaacagaggtagtagataattaggaaaaaataccagagcgcctcggaagagaaggatatggctcatggctataggtcaacgtcactggactttcgggtaattgggtttgatcgatcacttgctttcttctacaaggttttgcgatattttttttgcaaattatcaaggggaaagagagagacagctatggaacaagctagtctagattatggatatgtacttcacttaagtcaattttggtgatgatgataggtaggagtgcaatgcagacatgcagtagctagctaaatgactgaagctggatatgtaaaaaaatatcaggaggtgccaataaacgggattatcgaaaatatcgaaattctatcggtgataaggaaaaaaaattggacaaaatttattaaaatttggctaaatctatgcaggaaatcaaatagattatagaccagttggtataaaaaataacatatataatttgcaaaatgaccacggtaagtgcagagtatcatgcatgtagacggtcaaagattataatgtcactcacgcatacagattttaaaaaaggctaatattttaagacaatactcattgataggggtgggcagaaaaaaccgagaccgagaaattcggtgctaggcagtgaaagaccgaattttattcggtcaattcggttagtctcctcggttaacccaatagaccgaaaataccaaattatcaaaaaatgtctaaatgcaacctacaatccactatgtttaataggattaaactcgaattttcacatccctacttctaagcatgcttacgaatttttttgtgatttttgtcttgaaaatttccattatttctttacatatatgaaaatgttgttgaatttcggtcaggactaagaccgagaccgaaagaccgattctgaatttgtcggtcctgacatttttacgttgaaattcggtcttcacttttcaaagacctaaaagaccgaaagaccgaagactgagaccgaaatgtttggttagaccgaatgtccacccctacccattgagaaacctgaaatttagaaatatcggaccatgtttcagtgacaatttgagccacctggatctgttattcgtgaatgatttaactagcctctctgcttctccagccaatcaatcatcttttgctggccggtcgctcccgtccaacaacgccttattgtgaatgtgggttggtgctgaagcctcagctgacgactgtcacactgatgtgtgctctaccttatgcataaattcccctgctgctcgcagtcttagccagatctaggttcgtagcgtccagcttctcaggcggtgacaccacaagttggctgttgtaatgtatggaaagcaaaacaaacaatataaagagtattcatttatttaaaacacatcacaaattaagtactattcaatgagattggctctgctggtacctcatcttctgattctgattataagtaaacgccgacgcaatatccaaacaagacggtgaggactataataccaagccaaaccacaacgatcccaacaacattaccgaaaacatggtatcataccacaccgatcctaacaacatcaccgacaacaatcctaacaacatcaccgaaaataccagcgaaaaacaagggtaaaactgtgatgaaggcgaacacgacgaggaaaacgtgaaatccacgtaccaataagagctcatcgcagcaggtgacgcgtgaccaaagtcgtcgagaagaagagataagccatggtgtaggaaaatcacgcaggatatcctccacatggtaaccatcatcatcaacattagtggcgacggtggagtgcggccataaaatcatccaagcaacatataatgtcgggacaagcaatgtcatggagatcaccgccgccgatgagatgatcacggcgcgcgtgtactaaatatatatagttctaaggagagctcaaaccattacatagaacattcaacttttagtaatgttatggtgtgtcctaatgttgtactagtcataagatgaagctagtacacacaatcatgtgcacatcagtttaaatgtaaacacaattgtcttatcattatttatgtctttgtgaatttttgaaaatataaaataattaatctaagctattagtaggatatgagatgaggaaaactaaaggatatatagtcttgtacaagtcacaaaaacaattgcagaacatgagtaatcactgttaatattatatacaaatcatttgattatggaataggagccaatgcaatttcatataaaaataagaatcaaagactgcagatcaataagataaagttttttcaattccataaactaaactaaggctctatctaatacagtaacagcaatatgtattttcatctcttaagaatatctctcgttttcatattgccattcaaatagtcactaagcaacatgaaaaaatttaaactaaattgcgtctacactacataaacttggtaggtgggtgcgatctagtgcaaaaacttgaaaattgagcatataggtgcaacaacttggctagtgcgtacattttggttaaaagattaatattccacaccatactttttatgccatataaaaaaagccacccatgtcatctcaataaggatctacatatattatgtattgcttttaattaatttgttagttataataataaaatgatctatcgatttgaaaccgaaagttatttggttatcaaaagtaagtacatggaaataacataaatttccgagcgattcaattaatcaacatattcattatcttgggttatgaatatggcaaaacacgaaattaaatccataaaccaatgatctagaagttaagcttataataccatgattaatcaaaggtatgtatcaatgtttttgactaaaatgcacgtgattgtcaattttatgtaccaatctactcatttttcaagttcttgcactaaatcacatgcacctatcaagttcttgtaccatgggtgcaatttactaaaaaatttaataagatagattaatatatgatatatcactttaaaaatacacaatttcaattcaatatatatacaaattgtaacaaaaagaacaaatatgactatgaatatgcaggagactttctcttgccatgctattactatctagctctaatgctcatgctcacattctcatagcatggcaagagaaaacctcctctatttataggcctccgtagccattggatctttgacaaggactaagacacttattctgatctagagttttcacttcttgctaaaatgtgaggatgatcatcgtggcctcccggtccctgcggtccctccccgggtcctcgctgagcttgctcacctcggcgcggcggaggaggtcgctggtgtagtgcccgtgctcctcctcagccgccgccgccgccggtgctcgtgtcacatccccgatccggtgatcagcgtcgacgaggctcgccttctcgcctaggtcggagtgcgggatctcggtggagatgacggagtggtcgtcgatggcggcgaccagggattcggccatgtcggtggtgcacgacgagattagggttttgagcgaggtgagtgttggggatattggagggaagcttcatggctgtttcgcttcgactgccctctcctccttttcggccgttggccgcgataaatgaggccctgttgagtttccaaaacaaaatttttcacgctgtcacatcaaatatttggacacatgcatggagtattaaatgtagaaaaaaaacaattacaaaaattgcatgtaaattacaagacgaattttttaagcctaattacgccatgatttgacaatgtggtgctactgtaaacatttgctaataacggattaattaggtttaaaaaatttgtctcgcagtttcctggcggaatctgtaatttgttttgttattagacaacgtttattacttcaaatgaaatgtgtgtccgtatatccgatgtgacatcccaaaacaattttttttgccaactaaaccaggcctgagttgggttctgcgcttccaccgcgggcaggacacaattaaaacagttttgcccccattaaaataggacacggtcaaacctagccggcggggtgggcgtcggcgagcgagcggcggcggcggcaacggaaagtgggctaggcgcaacccctccctcaagccattttcaccgcaggcttccgcttccgagctcgaaggtgagcgccaccgcgaggaggggaggaggaagcgggggcaagggtttggtgggttggggattgtcgcgtcacgggggacgggattatggagtaccatatgaaatctgtgtgcgatttgaagcatttgaggttgggcttcaaattttctgcaatgtccaattgtgtccaatctatctattatctattattattttattaaaatagctttgaaaggatgcaccacatctgctgtgagagctagaaattcccacattaatcggagaaaaagaaaaaaagaaaaagagtgtccaagtagaagtacaatttaaaaatagctggaattcggaaataaaaataagcaatattgaaagaagtttccatataagaacccaatacgagattaatcaaaattcgaaataaaaataaaataaaatccaaaattagaaaaggaaagaagagtccaagtagaaatacaatttaaaaatagctgaaattcagaattaaaaataagtaatattgaaagaagtttccatataataacccaatacaggattaatcaaaattcaaaaaaaaaataaaatccaaaattagaaaagaaaatgagagaccaagtaggaatacaatttaaaaatagctgaaattcggaataaaagtaaataaatccaaaattagcaaaagaaaataaaagaagagtccaagtaggaatacaatttaaaattagctgaaattcgaaattaaaaataagaaatattgaaagaagaatccatataagaacccaatacgagattaattaaaatttagaataaaaataaaataatatctaaaattagaaaaactaacatagagttcaagtagaaatacaattttgaaacaactgaaattgaaaataaaaaataaaaacattaaaataacacaatacgatattaactaaatttttttaaaaaaaattatgaaattagaaaaagaaaaataagatttcaattaggaatacaatctataaataactaaaatttgtgataaaaataaagattattgaaagaatagaccatctaaaacacatgacgagataaattaagttacatgcctataatggagtagagtggtggcggtttatacgagatataaaaattgttaataaaacaccaaatagaatcctaatgacgattaaaaggagggacgtcaggcaggccgtgaagcaaacgagtaaggcggttgccgagagttctagaaagtaagaaaaaaacaaatcccattgataagcatattcaatttttaaaatctcaatgacaataaaaaggagaagcagtgggcggggtgtataagagtatagttgtagagccgctgacggttgacgggacttctagaaaataaaaaatgaattccaacaatagttatatgttcgatttttagaatcacaatgacaataaagagttggcggtggacgggctgtagaggggcttcccgggaggagacggcgaagggacgcgcgtccgcgggaggtccgggatgggatggcgaggtgatgcccgcgacatcggatggacggcgacgggacaggggatgacgagggtgatgtggcgccgtgtttcctggaaggaaaccggagcgagagcggcttggcgcgatgcggttttgggacggcgcgtgtgttggcgcgaggagcggtacacgggaaggtggctcggtgtattgcggctcggtcacgaggcgaaagtggtgcgacgctgggtgagacatttcgtcgaacaccttgcgtgcgtgagctggctggcctgaggaggaagacaaacagtggctgggctgagctgggccggcctgctaatgggaggagaagagaggagaggatggaggggagttgggccaggaaagaaagagaggaggaggcccaaattgtactgtgatatttcacaattatctcaaggatttggggtttgaaatttggggagatttttgggaggatttgaatttgaatctgccctagggtttcatggaaatttgaaggaaattctaagagaggattgagatctaatttggcacaaaaacaattaagaaccaaactaaactccaaattttaaatgacaaacttttaaataaaagcacataaaatatgggtgctacaaacctacccccttaaagaatctcggaattaaaaataagaaatattaaaagaagagtccatataagaacccaatacgaaattaattaaaattcggaataaaaataaataaatccaaaatcagcaaaagaaaataaaagaagagttcatgtaggaatgcaatttaaaattagctgaaattcggaattaaaaataagcaatattgaaagaagaatccataaaagattaattaaaatttagaataaaaataaaataatgtccaaaattagaaaaattaaaagagagttcaagtaggaatacaattttaaaacaactgaaattgaaaataaaaataaaaacattaaaataacacaatactgtattaactaattttttaaaaaaattctaaaattataaaaagaaaaataagatttcaattaggaataataagtacaatttttgataaaaataaagattattgaaagaaaagaccatctaaaacacatgacgagataaattaagtaacatgcctataaagtagtagagtggtggcggttgatacgacatataaaaattgttaataaaacaccaaatagaatcctaatgacgattaaaaggagggacgtcaggcaggccgtgaatcaaacgagcaaggcggttgccgaggcttctataaagtaaataaaacaaaccctattgataatcatatttgatttttaaaatctcaatgacaataaaaaggagaagcagcgggcggggtgtataagagtatagttgcagagccgccgacggttgacgggacttctagaaaataaaaaatgaattccgacgatagttatgttcgacttttagaatcacaatgacaataaagagtaggcggtggacgagctgtagagggcataatggcatcgtttgatgggacttctaaaaattataaaaaataaaactacatgtccaatttttaaaggttcggaactactaaaaagtaaaaaaaaacaatgataatcatattcgattttaaaatctcaatgacaataaagaagggaggcagcaggcgagccgtagaggagtgcactagcaaagccgctgacagtttggcgggacttctagaaagtaaaaatgaacccgaacgataattatgttcgatttttaaaatctcaatgacaataaagagaagacacagtggacgggccatagaggagtataatggcaacctttgacgggacatctagaaattataaaaatgaaatccaacgtgataataaactttaaaaactataaaatttaatttttaaaggttccaagaagaatgaatagaaatagtggtagatcgagcaagcaaataaagaaggagatgacataatgggtagcaacaggtgtgacttttataaactatataattagaaacacaaagatgataaggtttggtctttcaaggtcttaagacaatgagatagttatttaataaattttaagtaaaatcataaaaaaatatatgattttgtttgggtgctagccgcgcaattgcgcgggccactcagctagttgtttacattgttccgtggatgtcaaatttactgctaatgtacaacgttgcattatatagacgttttagctttctggtgaactcttgttatttctaggtccacatgagaattctgaactttctgttccggctaatgggggaaaaacataattaataaataaatatgggaaatggtatatatgtcctatttaacactgttaactcctacatttaaaataggggtaaaagtatctttcggttaaaaaagtggaaataggagaaaaatcaatattagagatagtgaggaaaaaggaaattgtctctaagaataactgtttgaggtcaaacacacgtataataaattctggggctgagcaagaaggaaggccttgaagtctggctgatctcggccagtcgcgcacaaacgggccatctgcacttggccggacaagactgaagatcacgtacctcgatcgtcgccatctgcagctgaagacggacgccacgtactcgtcgaatccgcatcgagccgagcgtgttcctctttctccatctccatgatgaataacacgacgattcgaacatggaccagattgtctcagcctcggcgagagctccggcgccgtgtcgtaaatacatcgagtaccggtatcaatggcgcgcggcggcgccggcgggcagatagatatacacagttccttccatctcgttcactgttctagtgttctcagagcactggagcctccttccttgtcgtcgccggcgcggcgatgatagagtggtatgggcaggacatcgtgaagtatcagatgttacggcggcggcggcggcggcgcggcgctccggcaactcgacgaggcacgacatgaggccgcggtggcgctcttgggggttcggagtttcaaactccgactccccgttgggctatctgcgaccgtttgatcaggcgcgtgcggcctagataagtgggaaaatatgtagtgcaaaccacatgcagtggaaacttggaaac

SEQ ID NO: 66827 - DNA, 12060 bp, Oryza sativa
ctgtataagggactgttttttggttgatttttattttatcttgggatgagttgtttatgatttggtagataattgctgcttgattaatgtttcattttttaagataagtttactgatgatctcattgttgccatgttaggtgtaatggataatttggatgtactttgtatccggtttcactttggtggggaatttgattatgatggatattctgtggtttataatggtggtcaaactgagatgtcatacatagagagggacaaggtggcattgccagagatcaaaggataccttggagaccatgttttactaagtgaagaagatgaagtgattttccattggttatttccaggtgctgaactaaacaatggcctgaaagcactatcagatgataaggaatgcttatatatggctcaatgcataatcatgggtgatgtaagctgaaatatatgctgaaatactcaagcacaatgaagatgataatgttgtgcttagcaatggtgtcagtgatgacagtgatgttgaagatgacattgaggaagaatatgacagtcatagtgatgctgaagattctagtgaaacagatggtattgctgaagatgatgaggagagatctgaagatgatgaggaagcacaagaaaatagacagcatgccaacaaggttaagaagaatccatgtgccactattactgtaaccagtgacaacgctgttcttgtcagtgacccaccaaataaacaagatgataagggactggatgatgacactgatacaccatttctggactcaagtgaagaagcctcttatgatgatgcagaagatggtgaagcaataagaaggaagagtagatttccaaagtatgatagcaaagcacacacacctaagtttgaaataggcatgacatttgcaggaagagcaaagtttaaggaagcagtaatcaagtatggtcttgtaaccaacaggcatatcagattccccaaggatgaagctaagaagatcagagctagatgttcatggaaagattgtccatggttcatatttgcctcaaatggaacaaactgtgattggtttcaggtgaaaaccttcaatgatgtgcacaattgccctaagagaagagataacagattggttactagccgaagaattgctgataagtacgagcacatcatcaagtctaatccatcatggaaactgcaaagtttgaagaagacagtgaggctggatatgtttgctgatgtgtccatctcgaaagttaagagagctaagggtattgtcatgagaaggatttatgatgcatgcagaggtgagtactctaaagtgtttgagtaccaagcagaaattcttaggagtaatcctggtagcacggtggctatttgtttggatcatgaatacaattggccggttttccagagaatgtatgtatgttttgatgcttgcaagaaaggttttttagctggatgcagaaaagttataggactagatggttgttttttcaaaggtgcttgcaatggtgagctgctatgtgcattaggaagagaccccaacaaccaaatgtatccaatagcatgggcagtagtcgagaaagagaaaagacacttggagttggtttattggactacttcaaaaagatctgaatattgatcctcatggagctggttgggttattatttctgagcaacaaaaggtaatgcatccttgatatctacttatttttatatgatcaacaaaaatacatgaatattgatcctcatgtgttttgtttaccaatgtagggacttgtaagtgcagttgaggaatttttgccacaaattgagcacaggatgtgcactagacacatctatgctaattggaggaagaagtatagggatcaagcattccagaagccattttggaagtgtgccaaggcatcttgtagaccatttttcaacttttgtagagccaagcttgcacagctaactcctgctggtgccaaggacatgatgagcactgaacctatgcactggagtagagcttggtttaggatagggtccaattgtgatagtgtagacaacaatatgtgtgagagcttcaataattggataattgacatcagggcacatccaatcatatctatgtttgagggcataaggaccaaggtttatgtgaggatacaacagaacaagagcaaagcaaaaggatggctaggtaggatatgtccaaatatcttgaagaagttgaacaagtacattgacttatctggaaactgtgaagccatttggaatggaaaagatggatttgaggtcactgataaggataagagatacacaattgaccttgagaagagaacatgttcctgtaggtattggcaattggcaggtattccttgtgcacatgctataactgcattatttgtgagctcaaagcaacctgaagattacatagcagattgctacagtgttgaggtgtataacaaaatatatgaccattgcatgatgccaatggagggtatgatgcagtggccaattactagtcatccaaagccaggaccaccaggttatgtcaagatgccaggaaggccacggaaagagaggaggagggatccattggaagtaaaaaaagggaagaagttatccaaaactgacactaaaggaagatgtagccagtgcaagcaaactacccataacattagaacatgtccgatgaaaggaaattcaggaaaaaagatatcagtacaagagagagcaagagaggcaagtaatttacatgctacatatataagtggttgagtattgacatatgtgattctgatctctacattgaatgcaggttcaggaatgtagcaggccgcagaaaaggtttaggccatctgtagctgcaggaacttcgcagcaaaagttcatgtaagttgcaactacattgcagactatattccatcacaataaaggtgtccaaaatatatgatcttttttttcatgtaaggtgcagactgatttgccatcccagagcagcagcttgtcaataacaaagaagggacaaatgatgaaagttgcaagaacaaacacaacaaagaagtgaagatttggttgcatatggctgtaggaataagtcttggctggttggtcttggtcttgtggtgccttttcctgcttttcagctttctaggacagcatctctactttcagtttggatgctctaggacagttaggacagcagtttgttgagatgctctaggacagtttgttgggatgctctgctctaggacagtttgttgggatgctctaggacagcaccctcttagactagcatggctgcatggctcttagactagcatggctgctacaagcagctataaatatgtatccaatcctctttgggaggatatggcttttgtgctttgtgaatgaagaaaaccagaaaattgccccatctcgagtgccatcctcttctcaatgagagtaaccattgaaattctaacatctggtatcagagccacactttcctgtaggctaaacatctcttgttccaccccttcccaagctcggttgagctctcagccagcagcaccggttgctcctccttcccctttcccttccccctctccacacagcagccccccggaggtgcgccatgtccgacgctcggtctcggcgttcggtcgcctcgagcactcggcgtcagcaggacgccgagctcgccgcagcagaagagcgcaggcgagcaacggctcagaccgctgcagcagcagcgagggcggccagactggcggcagcggagttggcagcagccagggcggaggcggaggcggaggcggcggaagatgcggcacgtgcggcggaggtagaggttgagaccttgcgcagcagcatcaacggctccatcgccggcgacatcaccgccgacagggagcttgaggagctggcaagaggaagggcacgggagcgagcagagcggtgggcagcagcccacctccacggcggcggcggcggcccaagggaccgcgcgcccgccgacgggaacccagacgggcgcgggcgtgccggcggcagcccggagcccgcacgcggccctcgcaggcggcacggctctctctcccctgaccggcgctatggtcaccacggcgtccagacggtggtcagggactttggtcccggcggtgggtggcctaccctcaccaaaaccaactacatcgagtgggccgcggtgatgagggtgaggctccaggtgcggcacatgtgggaggcagtccggtacggcgacgtcgactacgacgaggatcggcgggcactggatgccctcatcgttgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaagatggtgcagtacggcgacgacacctacgacgaggagagagctgtcgagaagctcttccgctgcgtccctgagaagtacagacggatcgctcgctcgatcgaatctctgctggacctctccacgatgtcgatcgaggaggcgttaggtcgcctcaaggtcgtcgatggtgatgagccacagcctctctcggggcccatcaccatcggcgggaagctccacctcactcgggagcagtgggaggcctctcagggtgacgggaggaagggggagtcatcttccccgacaggcggccgtaagccgcgcaaggcgcggggaggtgtccagctacggtgggcgcgaagacgtgccgagggtggcgcccgcagaggcgcccagggcgttgccaccggcaaccacaagccggcacgagacgacacctgccgcaactgtggcaagcttggccattgggccaaagactgtcgacagccacgacgcggccaggcccacgtcgcacgggtggaggaggaagagccggctctgctcctagctcacgcaagcatcgagctacctccagcggcaccggccgcagcggctttcctccaccttgatgagccgaaggtactcgtctccctctgcgacggctccagcaacgacaaggctgatgggtggtacctcgacaccggcgccacccatcacatgaccggccgacgggagttcttcaccgagttcgactccagcgtccgaggctccgtcaagttcggggacacctccggcgtggagatcaagggtgttggctccgtcaccttcaccgccaagtccggtgagcacaggctgctcaccagagtctactacatccccgcgttgaggaattctatcatcagcgtgggacagctggatgagaacggctcacgcgtgttggtcgaggacggactcatgaggatttgggatcgccgccgtcgccttcttgccaaggtaaccagaggcactaatcgactctacatcctcagcgcgcaggtcgcacaaccagtttgcctcgccgctcgtcgggacgacgaggcgtggcagtggcacgagcgcttcgggcacctccacttcgaggccctgaagcagctcagtgccaaggagatggtgcgaggcatgccgtgcctcgaccacgtggagcagctctgcgacgtctgcgtggtgacgaagcagcggcggctcccctttccccagcagacgagcttccgagccaaggagcggctcgagctcgtgcacggggacttgtgtggcccagtgacaccggccacaccaggaggacgacgttacttcctgctgctcgtcgacgacctctcccgctacatgtgggtgatggtcctcggcagcaagggagaggctgcggacgccatcaggcatgcgcaggctgctgcagaggcggagtgcggccgcaagctgcgcgtgctgcgcaccgacaacggcggcgaattcacggcggctgaattcgtgtcgtactgcgctgatgagggcattcagcgccactacaccgcgccgtacagcccacagcagaacggcgtcgtcgagcggcgcaaccagacggttgtggggatggctcgggccctcctcaagcagagggggatgctggccatcttctggggggaggcggtggtgacggccacctacatcctcaaccgctcgcctaccaaggccctcgatggtaggacaccgtacgaggcttggcatggcgcaagccggcggtctcccacctgcgggtcttcggctgcctcgcgttcgccaaggagcttggccacatcggcaagctcgacgacaggagcaccccaggggtgttcatcggctacgcggagggctcgaagacctaccgcatcctcgacccggagacacagcgtgtgcgcattgcgcgcgatgttgtgttcgacgaagggcgagggtgggtatgggacaaggcggtggatgatggttcgactccgacgtacgacgacttcaccatcgagtacgtccacttcgagggagctgggggagtaggcagctcttctcaccgagcgtgcctaccccagtccccgagcctccaccgactccgacaccaacacaccctcgggccacgacttcgactacgacgagctcttcgtcgacaccaccccagccggtgtccccacacgctccagcaccaacagccactcctccgggcacgtctactccgacgccagctcgtgttgagcgcagcccggtggggttcgttactccgctctcccacgacgaggagcgcatcgacgcgtaccatgatggcgagcagctacggtaccgtacgatggaggatcttctcggcgaccagccggtgccgggactggtgcctcgcaacctggaggcgcagttgcaccttgcgtgcgacgacggtgagcctcggtcctttgcaaaggccgagaaacacgcggcatggcgtgccacgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtctgtgcgactcctccttgcgctggctgctcaggaaggctggggcgtccatcacatggacgtcaagtcggcgttcctaaacggcgacttgaaggaggaggtctacgtgcaccagccgccgggatttgtgattctcggcaaggagggcaaggtgctacgcctgcacaaggccctctacggcttgcggcaggcaccgagggcgtggaatgccaagttggattccacgctcaaggggatgggcttcgagcaaagcccgcacgaggcggccatctaccggcggggcaatggaggaaatgccttgctggtgggtgtctacgtcgacgacttagtgatcaccggcaccaaggatgcagaggtcgcggcattcaaggaggagatgaaggccaccttccagatgagtgatctggggcctctctccttctacctggggatcgaagtgcaccaggacaactccgggatcacgcttcgacagaccgcctacgccaagcgcgtcgttgagctggctgggctcaccgattgcaacccagctctcactccgatggaggagagactgaagctgagccgcgacagcacggcggaggaagtggatgctacacagtaccggcgtcttgtggggagccttcgctacctcacccacacacggccggacttggccttctccgtcggctacgtcagtcggttcatgcagcgaccgacgacggagcaccagcaggctgtgaagaggatcatccgctacgttgcggggactctcgaccacggtctctactacccgaggtgtcctgacaaggcacacttcgtcgggtacagcgacagcgaccacgccggcgacattgacaccagcaagagcacgagcgggattctcttcttcctcggcgagtgcctcgttagctggcagtcaatcaagcagcaagtggtggccctgtccagctgcgaggccgagtacatggcggcatccgccgcttcgacccaggcgctatggcttgctcgactgcttagtgatctcctcggcagagatactggagcggtggagctcagggtggataacaagtccgctctggccctggcaaagaaccccgtttttcacgaacggagcaagcacatccgggtgaggtaccatttcatccgaagctacctggaggaagggagcatcaaggcgagctacatcaacaccaaggaccagcttgcggatttgctcaccaaaccccttgggaggatcaagttccttgagctttgctcccggatcgggatggctcaactttcccacaagacggcgcacaagacttagggggagaatgtaggaataagtcttggttggttggtcttggtcttgtggtgccttttcctgcttttcagctttctaggacagcatctctactttcagtttggatgctctaggacagttaggacagcagtttgttgagatgctctaggacagtttgttgggatgctctgctctaggacagtttgttgggatgctctaggacagcaccctcttagactagcatggctgcatggctcttagactagcatggctgctacaagcagctataaatatgtatccaatcctctttgggaggatatggcttttgtgcttgtagggtataggaaaataccacgagttagaaaaaacaaaaataaaagaggtctaactaatagcacatttttcgagaacatgtgggagccttggttatcatttcactgagagagccttgctgtggtcttcaaaattcaatcattttcgtcattagatatctagtggaactccatggcaaaggttaagccagcaagcaagctgaaccctttgatcatgtaaatcctccaatcggcaagcaagccaattataaaactttaaagaaagaagagcggctacatagataaattaagatcatcatggttgttaaacccatagtgatgacagcatgtgcaacaccatcgcgatttttggctagtaaattccaaccctctccctaactccatcaactttgcaacagaaatgcaaatgtttggccttttgcatatgctttaagtatataatcttcttttctttttaatgactcgggattatgacttccaagtataaaatctcaattcaattgaaaacctatgtgacaaaaggaaaacaaagcaaaacaaagaaagatgcaaccacagtgtttactagttctttaccacacatttcatagttatattcaatttgaaattagtaaatggaattgtatattgcaacagaaataaaaattactgtttacactgcgtaagtttataggtgtaaatataacatatatgatacgacaaaatgaaaaactgaatgaaatgtgcttcttcatttataaataatgcaacatcatagcattagttaaaatagcacaattttttataacaattcatagctcaaagtttcaacattgcaggtatgttgtaatacgattcgatctatgtacaattcaaaatcttaatgtaaacagaatgtgttaacacaaacattaccaacctactaggtgcagcgatttgctgatggtaaccaccaaatccacttcttacctgacaatagagtttaaaggcattactttcaagtcgtaaaatgcaaattcatttgcaacaataatggaaccaattctgagaaaacccaataatgaaaatatcttaagtacgaggtagttcgttaacccattggctcctgtcctttattctgaaatcatgcacatgcgtgcatattgccacttaagcactgagcatatacataatattctccaacaaactatttttggggatcccaacatatatccatatcgggcagaaactcttttgtgtcgagttttttctttttaagattgaaaagtgaatggttttgaaagttcaagattgtatggtgtctgatattaaagtgtggtttgatgtggaagttcaagtccatgagataaaattcttcgtattggaaatcaagctgtgcaaacatttcatcccaaccatgaagactgaagcatgcagcttttgctctttgggactgaaacacaaattaagctcttaccgctgtaaggctggaaactttttcaacgagctcttgaatctccctaaacagataatccatcctctcgttttgttgctgtgtcattcgtagtatctcctggagcatgtatgtctgcttgtcactgtcatgcacacgaagaaaataattaagctcggtttttttcaatactttcttctatggaaactaggtgtatctactgtaatgtgtagtctggtaccctctctaaattattattttgttttcgataaatcaaacgtagattataaattactccctccgtttcacaatgtaagtcattctagtatttcccacattcatatttatcaatatgaatgtaggaaatactagaatgacttatactgtgaaacagagaaagtaccagttttctcaagtggcaactccctacgcacagatgaggggagagagtaagagagaggatttatttgttaactcaaatggtaggcagaacaactaaaggtggcatttcaaatcccaccgagacaagttgctggtcagctcgtctcattagtcgactaattattacagtataatttctctaataacattttctttatttattagaaaaccttttcaagttatttgttagttttataatatataataattaatccatgtattaatcatccggctaatcagctcacccagccattttatcttttagattgggtcaatttcattggtttgcccacaaataattgtcataaattcagtttcatctataaatttctgatttcagactaatcaaggggggagaagaaattatatcaacaagcagcatagcacataaacaaaaggatttgtgaatagatagaagtatagaacaaaatactgcaaaaggtcaaacataaatggatcaagatagtagaagttagctcactcgaaaccacaggagcttcgtggtcgcttcgccggcggtgatccgcgtgatccttcgtcccctttgccatccttctcctcacgatcctgaggccaggccacaggcatcgcccacggagacactgggggagaaggaattaaagaattaatgttgccttccagtgtagtccggaggccggaacaagaatactggagtagactatatgggacctgacgaagatacctttttgtttctttgaatagcgagggcaggaatactcgtgtaatcttccttctgacacacggcttccatagattatttttctttgacaaaacacagcattgatagctctgtttacttttaaatcaatccagtctctattatttttggagagatcagcatagtttcttcataatataagcatgaatgttctgtgaaacttcagtcagttgacatcaggatagcactcccaaatcaacatggagcaggtaggtatagtgtgcgttcgattccctgtgtaatctatggggtcaaaacatggctcctattatttcctaagcaaaagttgaaagaaggaaaactaaagaaaccgagtctaggtactttattgtctaacagatcatttccagatgaagcttccgtttcagcttccaacgaatgcaccaaagtctatctactatcccactggaatccaatgcgtaaccctaatatatttccaatgatcttggtgggttcagaacttacgattttgctggtgcagatcaagcatatgtgcaaacaaaagacgagactgtgtttgggttgtgcgagactttcggatggagacaagacaaccgcatctctgcctttgcggcatttctccgaacacctctgcggcgcttgtctcatctttggactcctcatctcgcatatcaggcgcatcctcaaactggtaagcagagcggtgggaaaacgagacggagttggcggcgagcttgatctcgcgccgaccgttgtcgcacccgccattgctgcgccagcggctgcggcagg

SEQ ID NO: 66828 - DNA, 19270 bp, Oryza sativa
  unsure (1)..(19270): unsure at all n locations
cccccccccccccccccgcccccaacccggcccgcgccttttacatcgttggttccgaccgaggaaaagaacgaacatctcgccatctcgcgtttccgctctccctaggtattaggtttccgccgctacatttttgttgcgtaagggttaggttcaaattcaaggtggagtggagaatttctttttttaatctttattatgtacagtaagggcgccccaatttagaacatcgtggaaaatttggttaggaaacccgtatggaaagagcgagtagtatttcttttgctgaaaaattcacgcgtttcgaacaagtgtaaggagaacacctgaaattagtgtgtgttctagtatttgaatatggggggactggattgggatttagacatttagttactactctgttccttgctgaatccaatcccctttaccaaacaaacaagtgtctccaccggtcgaatcctcatttctcatcctcgcaaaagaaaagaaaaccttcattttcttatccaaatatctaccgagatactgtgtccttgttcgtttgatcctatcaatttgggcatgttgtggtacggatagcaatggacaactgggcatgggcaaaggttaagtacaaacgccgtgacttgattctttcccctcccccagaaaatgcaatggtattatgggttgtagattgtagaattgaagaggaaattatccgattcacctctaggacaatggtgtttactgttttaccatttccctcctttatctagtattgctcaagatttacccctaaagcctttatgtgatcttttatggataatataagcctaaatttattaattcttcgattcctcgaaaaaaaaactattattcttctaaatcatttcatctgcctaattaaaaggatgtagctatattattttgttacattcagtaagtacaaaaatggattctgatgcttgattaattccacgttaatcaggtattctgatgcatcaaacaagaactgttgccagaaaaataccttcatcatacttccatgattattaaatattacttcataatatgatgatgtgctaggagctccctccatcacaatcaaactgcttgcttgctgttctgttctcagtgctgatgtggatgaaatatcaccacgagttttatctatttgcttgatagtttcagtgagaaagttcaggaatctcttctgttactagtcaactatgtctagttttatcttctgcagaactttgatttgttctctctatccatactagagtggtatatgtcgtcagtttcggtcaaaatatggatctgtatctcccgtgtgctttatttcactttacttttttgacctctctttgttgatatttgaaatgaaaagttcactttccagtttccaattaccatctcttagggcttaattcctaactctgttttttgtgcaatatctaaccgatacagtcaagcttagccaaaaacgattagatgtatcctgtattcctgtatatgcggttggtgccctgagatgccttagatatttggtgaatgctccatctcaaaacaaaaggcaataagatccatgccactagttgctagtgaaagggaagaggaatgcactgagaatgagaaagagcttccttatttatgctctcttgattcacaaaataatagggaaacttttctgtgagtttgttgtacttatatcacccaaccacaatggtgtacctatcagtatcaggcaatgttcctatattccctacaactatcattcgagttactgatcaccgatagctcatggtttagtgagaagataggccgtgctggaaagatatgattctcatggttaaagcaacagtaaattctttgtcactgcttttcttttcatccagaatgatctggagggctgtaagaataatggatatttaaaagctgagtgaacaccatcaccttcacctctgctgaaattccaaccggatacaatgatagcccatcactaagatacatcattaagaaaatggcaccgagatccaagtggaatataaaagacttgaactccagttcattattatactactatgatactatctggccagtggacacacttaatcagggttccatcttttattttgtaatgaaacgagctttgttttcagtcaacataggctggttagacagcagttatatgtcatgatggaacgaaaataggaatatatatgttccaccattttggtgctacttcatagtaaacaactaaacccccaattcgtcacctaaacccctaaagcattgttgctactgtgattgttggccaaggtaccctagaattatctatatacagttatacacatactcatttcatctcatcactgctctttgcttacttcaaaaacttaaagctactgagcaagtaccaacaatatatatctgctatccggaaattacaaagcaaaactttaaaaagctaaggtacttgatcaattttaagtcgcaaacaacacactattattcataacacagattgtctagaactactcccactggatcgatgttattgctactcagtaagtccccatatatatgcctataagatagcgtctcatgagtcccatcagaaccatggaacagtaccatagctaccgtcagatagagctgcagtggagaacatctggtccacttcgatctgcacatctgatctcttggcgaaacggcccttgatccggggtcgtgcctctgcatacgcctttcttgtttcataacgtattgtcttctcaaacttcctggccttcttcttctccctgtacctgagcaccctggcctccctgtccatggagctgaagtgaagggacatctgaagcgagggacctgagaagagattgattgctccagcaggtgtcaggattctggaatttggcatatctatcaccgtgctgtctggtactatacccgcctccattgatgagaaagatatctgagatggaatcggcaaatggtcactgaaatatgcgaatcataaggagattgcaggtgtcagagaccctgcaatgatatatagatgggcttaatttaattttacatacataagaaaaacttccaatatcttttttactgtcgcaaaagtaagatattttaaatttatgcactgggataaaatatgaattacacttacacttatcctacttttcatgaggtctttcgtgtggtgattgctgtgtacataaaaggttaacaaactcacttcttttcaattagtgagttagcatggatcgtatatgcttagaaatacaggaagtagtcaactggtctgcctaaagatcaattgtgtacttttctttaaagtattttttttatcggttccatttaatcagcctaaagatcgcagcttggaagtagaaaagtatctttgttttcttgttgagatctgtttatttatcccttcattttgttagacagtagcttttgtttggagaatgtttttccactcaaaagtactagtatgaactctaaaacattgacaacgtggcatgtagtaacaactaactaacaacagtaatagatgttcattctctgaaaaaaaaatagttgcagctagtaatagatgaactcacgctgttgctgatggaatctgtgtaagcactgacgccggcggtcatggaggcggcctggtctgctcccacaactccataaccactatgctgctgctcactcagcattgtgatctgtgaaggtaccacacactcgctcccttccttctctgcaaactccttttgcatctcctgctgctgctgctgctgctcttgctgttcatgcatcccatactgccgatcttggttgttttcgatgcggttgtcgtagtacgaattgtacccgacaagatcaaagtactcatcgacttcaccaaaatacatgccgttgttgctgctgttgctgttgttgttgtcgttattgtcgttgtcgttgttgttgttattgttgttgttgttgtcggaatctttggagaggagaagccaagagtccacctcctcgtccttgtcgccgaggacggtggcggtggccaccaccgcctcagcgaggacggaggtggccgggatggtgatggccgggagcgggttcgcggagtgcacctgcacgtcgcacgccacgcacagcgcggcggcgtcggcgcggcacgcgagcgcggccggggcgcgctcgcaggcctcgcacacccgcacgcgctcgtggcgggacgccacgcggttggccgcgtgcacccgcgcgtcgcacgacgcgcacaggtacgccgcgtccgcgcggcagtacaccacgctcggcgccgccggcacccgtcgcacggccgcgcccatgggcagccgctcccctctcctcctcctcctccttcgcctccaactccaacctcctggtcgaacacgttgccaccaaaattataattcatgaacgaagtagccttgcttgtggtagtagtagctttagcttgcaccacatggacaagtctatcgatccaagctattgtgtttgtcctctctctctatgtgtcgtgtgtgtatgcgtcttctcctgttcctctacctcgcatggctcttgtggaattttgtgagtgttttttggaaggagctagggaggggaaagtcacggtgtttttgtcctggggagtttgagtgtagagtatactaatagtaagggggtgtcaagtcgaatccagcgattgacacttggcgcgatccccgggggggnggggggggggggcgagcggcggctgcaatgcctgtcttgtggttgcctttggatgtttgctgcttcagcgtttctcttctcaccccctgatgccaatcctcaatggaggggtcgttttcagataaagattttgtgcactttggcgggtcctatggagaattggcgcccttgagctaaatctaagtatctaacctgaactgatgtcaataccttttaagccaaagcaatcgcgcttttgcgcaaaaaagctttgcattttagtgatgagtacactgattctcttttgtcgtaatcatgttccattttaacttaggactgtccctaaagagattttacagggatcaatagaatcctcccatatgcattcctaggattgtccctaaacaattcaatggacatctcttagatggaactaagcccaaagggggagaattggaagccactgtgatgatgtacaaataaagggaaaaacaaaaaagagcagaggaaagatgctgcctctctctctttatgcacattcttttgcaaaagagaaagggagggttgggttctctgggattccaaagcatgcggttttgtgccagtcattggcactcccccttagccgttccgcctttacgaacctccggtgtgaggtagccagtgcagatacatgagaaaagttccaaagcggcctgccatgtcactaaatagtttctttgccggcctccctcatccaaaaatatctattctagtggagaagtcaaattattaccaatgtgttttttttcttctgttatatgatttctcaactgctgaaggaactattatttccttgcataccttttttttgtttgtttgcaaggcctatctatatatgacatgggtcctttatgggttatttgttgcttatcattttctttgagccatctgtttcttattatagccctgctataacgttaaatatgcctctccatagagaatctacttttttttttgcaataaatttgtaaggagaacagtccacctctgttcatctttgcttttgttgttatctagtattttggtagaatctagctacatggtttgatatatgtcttgttagtaccaagttcaatgcaaccatatatctatcgtgttgatgaattgagtttgttatgctgtggttgaattaagtgttatgaaaaacataggagtaactaacaaaaagaagtggtgctattagagcaattctcctttaacactatgccatgctacacaaattttatcaacaaacttgtactacactaaacaaacttccttggtaaattggcatattgacatcatttgtttttactgtatgttcaaaattgatcttcttacccacaagtggttctttatttactagtgaaagcacaagaaatatttttctcctgcagtcctctttattccatttgatgagtgcgtatatatacagcagttccgtagaggcagtgactggtgagcttatggcagcctatgtgactgaagagtgggccccacggcccaggaattgttgaagatggtgacaactaaagttaactcgtcaggtaaggactgtgactgagatgccatatttggctttcacacctggcatatacatcttccagaattattggcttttactatattctaaaggaagaaatgcccttgtttcttcaaacagttcgatggacacgtggagttaaatgcacaaaatgtcttcgttggaagctgacctaacaacaagaggctttgcagtaccacgagccaaaatgtaagttcttagttcgaaattgtgaggtgcagagtatggtacaacgttttgaaatgctgcagtgtgctccaccccaaccgtcgtcggcgccctagccaatggcacccactctcctccgccacccacagccctaggcgcctccctccgctgcttctggccaccgaccgcctccccatcagccaacacggtgaacccaagccacggtaagttttgggaggactcgccgcctcctccaccacctagatctggagcgccccgaccgatggctagtgtcacccacgtctctgcgaccccgaagccaccgctgccacgaccccttttgtcgcttgcgaggctcccccgtcgccgatttcaattcgaaaattgctcaaccaccgctgctcccaaaattgaagtgtgcaattaccatgccgtcgccatgacgcgacgcctactggcacgcctatgagccgagagcaaggggatggataacgtctcctctaggcgtacgatgccacatcgtgccttcaagctgcctgagccaggttatctagtcgcgtcggttccatcgcccttgccactaacacaccgccaacaagggcctgagtcccttccgcctctgctataggccacgggcgttatggcgcaacttggagatctgaaaacaaggccagtggagggcgtcgtcttcatctcgacgtcacacatcattgatggggagctacgcgaaatggaaagtacagttgttgtcacctgggcgatgcgcgccccgccgtcggtcacggcaaaggacgtcgagtgtgctattgcctatgagttcggtctatgcatcagcgagctgacggtgtcgctgcacttcccggaggctttcctcctcaagtacaagcaccgccgccattgcgaggagacggtgaagcagggcttcgctaaaggccacgggatcgaggtccacttcatccaatgttgtagcttgaaaaatgccaccggctcggccctcatgtacagagtcaagctctgtctcgacggcgtgccgatgcacctgtgggcactggacattaacattcaagagagtaattggatacgggacattgacattctccgaatcacaacggtggaacatatccaacaatttgtgcatttatggtcaatgatcagaagaatgaaccagctgaatgatgaacaagacggcgtatggttgaacctaacagcaaacaggcaatacttggcaagatcggcctacagactccaattcctcggggcggcgagatccgctttcaatcaattgatctagaaagagtgggcgctgccgaaatgtaaattcttctcttggcttatttcccagaatagagtttggacggcgaatagattagagcaaagaggatggcaaaaccagaagatctgctgtcatgaggggacttaggtacgaaagacggtgcaacaggccacggcagcaacaaccttaagaggaatagtaatatagttggttttgatttagaattttttattagatcttatctctttgagtttgttaggattacatctctgtaagagctacttaagcagattagcggcaaagcaatagaatcatgcaattgagatcaatctagtctattttcccctgccgcgttcgtgcgttgcctatcacagctccgccgcgccgacgaggtccagggccgcgtcctgccaccgccttcaaatataatcttcgacgtattcctccttccaattctctagtctgtgacatctgcccgctatgctatgtacaggatgagacagtggtccacctattggcgaaatgtagagtcacaaagaggatatgggccgagatccagagatggaccagcagtgacttacaaatgaacaaatgggacgactgccactctactgtgctttggtggaatctcgtgcttgaagcccccaataacccccatcgaccactccaaacgatggtgatcctagtttcatgggaaatatgatgcgagtgtaacgtaagaatcttccgcaataccatctcaatgatagcatcaatcttagctaagattaagaaggaagcaagagcatgggtaagagcaggagcaataaagctccatgagtttggaattttgggagatatcacctagttttgttctcttccaagtgtgtcgttgttgactagccctgtacatattgttgtataattttctccatctctatctctactatctattatattattaaaggaatggaaaaaggagcctccacgttcgctctcatggcctagaaattctcatattaatcggagaaaaagaaaaggcagagtccatatagaaatacaatttagaaatagttgaaattcggaattaaaaaaaaaggaatattagaagaggagactagagtccatatagaaatacaattaggaaataactaaaattcggaattaaaaataaggaatattagaagtagagtatagagtccatatagaaatacaattagaaaataactgaaattcggaattaaaaataaggaatattagaagtagagtatatagtccatataaaaatacaattaggaaataactagaaattttatcaatatgaaacaaagtctactcaatacatgatagaaaagttacccctaatctttcacgtacataatgagcatacatgtatgttggatttctaatagtactatttggtcaaggatgttttccgattgggtgtggaataaaaggaaaaaaaaacagatgcacagtccatggaagagtccatctggactcaagttcacttagcccaaataatcttgccgtcccgctaaagccacgtgcattaattcatcttgatatcaacacctacacgacatattactgggaaaaaaagaaataatcagagaaaaagaaaagaagagtccatgtagaaatacaatttaaaaataactgaaattcaaaattaaaaaaaagcactattaaaagaagagtccttataataacctaatacgagattaattaatattcagaataataaaataaaataaaataaaatatgaaattagcaaaaaaaggaaaaagaagagttcgagtagaaatacaatttaaaaataactaaaattcggaattaaaattaagcaatattgaaagaagagtccatataaaacccaatacaagattattaaaattcggaataaaaaataaaacaaatcaaaattaggaaaaaaacagaaaagaagagttcaagtaataatacaatttaaaattaactgaaattcagaattaagtacaagcaatattgaaataaaagtacatataaaaacccaatacgagattaattaaaattcagaataaaataaaatccaaaattagacaaattaaaaagagagttcaagtaggaatacaattttgaaaaactgaaattgaaaacaaaaataaaaaattaaaagaacccaaacgatagtagttaaaattcgaaaaataagtaaataaaatctgaaattagaaaaagaaaaataagatttcaactaggaatacaatttatatataactaaaattggtgtaaaaaaataaagactattgaaagaaaagaccatctaaaacacatgacaagattaattaagtaacaggcttataaaggagtagagtggtggcggttgatgggacatctaaaaactattaataaaataccaaatagaatcctaaagacgattaaaaggaaggacgacgggcaggtcgtgaaacaatcggtcaaggcggttcccgggacttttagaaagtaaaagaaaaaccaatgataatcatattcaatttttaaaatctcaatgacagtaaaaattagaggtaacgggcggatcgtataggagtacaatggcagcgccgtcgatggttggtgagacttctagaaagtaaaaaatgaattttttttttgaagcaaaagacggcaggagctctgccggatatattagaaggagaagcagttacagaggtcaagaaagagcagaccactaggtgacattttcagttttcattttcagagatttacatatatgatgctatcaactagagctaagcacaagcctttatgtatggcgcaaaatctgaatggcatctatatttcctttactaagaaagctacttgggtggcacttagttgcttttgatggaaaattcttcgattgcgctcaagccacacctgccaccaggttataagaagtgcccctatcagttttcttcttctccttccataagttgaatgtatgattgaggtccaccattctaaaatgtttgtatcctgtagttgatttggggtctgcatgatgtccagccagctacaaacttgggaccaaaccgtgttagtgaaactgcactcctttgccaaatggtttgcgtcctcaaaagcatctgtacataagctgcaaatccaatcgcatggccaatgtcttaaaaggaggttttcagctgtgagagttctttgatgtaaaattaaccagccaaagaaccgatgcttaggttccgcttcagctctccaaagtggcataaaatttgtgttggcaactgatcctacaaactacatttcataagcgctttttgcatagtattcaccatgattagtccacttccacgtgatactatccaaagaattggggtgtaatatgatctcatgcagcttactgcctaggtgcaccagctcattgatctcatttattgaagtgattgttcttagggaagtgatccagtgattattgtgcagctcaaaggctacgcagtttgtttcctctttcctcttttaaaaaaatgaattccaacgacagttatgttcgactttgacaatcctaatgacaataaagagtaggcggcggatgggtcatagaggagtatagtggcagcgtttgacgggatttctcaaattatataaaatgaaacccaacgagacaataaactttaaaaactataatgtccaatttttaaaggttcgagcttctaaaaagtgaaaagataaacaccaacgataatcatttttattttaaaatctcaatgataataacaaagagaggcagcaggcgagccgcagaggagtacaatgacaaagtcgctgacgttttagcggaacttctaaaaagtaaaaaaaataaacctaaacgataattatgttcgatttttaaaatatcaatgaaaagagaagaggcagtggacgaccatagaggagtataatggtagtatttgatgggacttctagaaattataaaaacaaaaccaaggataataaactctaaaaactataagatcaaaattttaaaggttccaagaagaataaatagaaacaatagtagaccgagcaagcaaataaataaggatatgacagaagtaaggggtagtagctggtgtaactttttaaactataaaattagaattacaaggatggtaaggtttggtctttcaaagtcttaagacaatgagataaatatttaataaattttaagtaaaatcatattaaaaaaatatataattttgtatgggtgctagccgcgcaattgcgcgggccacccagctagttataaaaattgaagatgtttttgccggaattttggtacgtcatcagtatttaagtcggtttttaagctcgttcgtttttggaaatacaaatccatgtttgagtcggattttaagttcgtttgcttttggaaatataaaaaggagtcgcataagaaatttctttaaaaaaactcacatgctaacttgagatggaagtcggactcctaattgtagctcatgattttataaaaaaatatccaagcgaattcccacagcgaatttcatcgtagctaatccacataacaataataagattaaaataacattcacccattgcagcgcacgggtattttttctagttaatatacaaagcaaagcttttgcgctcctttttttaaaaaaaactataggttcttaagctgcaatttctgggtccgtgactcagtgttgaaggtctgaatttctctgccaaagacagcaccaggaacgtccagaaacgattaataaaatgcatgggagaagaataatttgatgcacctgatcttctctgaacatttttccaagattggtgaacctgaagccaccaaacactgctactactgcagagagagagagagagagagcctttgacccattagtttccatatcataatactctttactttctgcttgcttactctaccaaccacatcagagttagttcatctcctccttgaccgcgtttccatcactgatcaccatggaggcctcgcctcactttgctataaagcccatgcagagtgtgagaatctacccacaacaacatctggatcatccaaagaaaggaacagctgcaacttttttggtcagaaaatggctacaggtgttctgtgctccagggaatttgctctctgcctggcttgtgtgctcctggccgtgccattgctagtggctcaggacccttcaagcctgagcttggagcactactcaaagacctgcccgaattatgagcatgtcgtccggactgagatggaatgtgctgtgcgtgcggattcccgcaatgcagctctgatgcttcgtcttcatttccatgactgtttcgttcaggttagcattcaatccattttctctcttttactttgcacagatgctaatcttgttcatctgaacttcaatgtgcgtagtgggagttgcagagttttctctgaaaaaatgtgaatatatctgttgcagggttgcgatggatcagtgctgcttgacgacactgcgaccctgattggagagaagaaggcagaacagaatgtcaactcgctgaaggggttcgagctggttgacaagatcaagcagaagctggaagctgagtgccctggaacagtttcctgtgcagacttgcttgccattgcagcgagggacgcagttgtgctggtaaacctaacgatacctatgttcagaattgtgattcataagcagtaacttatgtcagacagagtttgtcatgtgttgtgcaacacattagctcattttcgctactatcaggttcatattagacattctattcaagaaaacatgaacaggcagacatacatttcaggaataactcaatacaccatcgagaaattcaagcacccgtttcacaataactatctattacctcataaaatcattgtctccattagcatattgttttgcctgcaatcatgccagcatgtagaacttgcaagcaatcaaagaacggtgcgtattccacatcaatgttattacagaatggaaatttgtgttgcaggttggtgggccttactgggatgtcccagttggaagattggactccaagaaggcaagcctggacctagcaaacagggacattcccactgctcaacagggccttgtcaccctcattgccaagttctgggagaagggcctcgatgccactgacatggtagcccttgtcggtatgttcttcttctctcttcaatgctacaattctatcattagttcaattcaaattagcacctgccagtggccttatacatgaaaaatactttcgaaaagttgacattatatccagggtttttttttaaaggagggcaaaagctttgcctcgtatattaatagagaggaaacaaagtacacagctgtatatacagggctagtctaaaaaaacgacatgcccgcaacagaaaagagctaagtgatatccagggtgaaatttgatcatataccctcctatcccctccttttagattgaaatggagaattcaccctcctgacttacatgccagtgaaattagatgacccccaagtatgaatcaaatcctcaaattgtgaactgaaaccttgttgaatttgtgaatttgatcgaaggatcccacacaatcggattcgcccggtgcgccaacttccgggacaggatctacggcgactacgagatgacgaccaagtacagcccgatctcccagccctacctgagcaagctcaaggacatctgccccctggacggcggcgacgacaacatcagcgccatggacagccacaccgccgccgccttcgacaacgcctacttcgggaccctcgtcaacggcgagggcctcctcaactccgaccaggagatgtggtccagcgtcctcggctactccacggccgacaccgtcagcaagtactgggccgacgccgacgccttcttcaagcagttctccgactccatggtcaagatgggcaacatcaccaaccctgcaggtggtgaggtcaggaagaactgcagatttgtcaacacatgatcatatgcatgctcaatcaaaaggactgcacatttgttctttttaatttgatggctggcttgtcctagatagaaataagaaatgctttgatgatgaggcccttgtactggtacatataatacgcgttgttgtcattttgtcatcactctacaagtatgttacatggagatacacatgataaggtactcctggcttttgcacaaactttttatttatatacatgatgaggaatggattatgaattgtgatgaggttttagcaacatctttggttggtgcaccaactattgtgtacgttgacaagaaaaaaaaacactaatcttcaagcaagctggatagtactatatattactcctagatggttaaggttgtcatctcttctattgtttaatataaacttgtcatgttttagaaaagagtgaaatatatggtgagtcccatatcttgtgtggtagtgtcacttaggttcatgaacttaaaaattgcacgtttagatccgtaaacttggtttaatatatcaccctagtctactttgactatgtttgaccgccaatgtggcataccacgtaggcaacacttttgctctcagccccctcgacatcacaacatatcgcatatatctccttgtagctatataatgacaccagaatcccaaaaaaattctcaaatcgttcttcactcttattcttctccttgcatgtatggaaaaatgtgatcccgattagaaattgacattgctctgcgctccaaagtgatcttatccttgcgcaacgggcacttaatcaacaacgccttctttcggtgacttcaagacaaggacgagcttggagaatccatggggatgcctagcgtgcaagccgtgttgcgttgcctcccgccgcaaatccggccgcactgtgccaccgctaaccccgctacactgcgttgcctcctgccgttaatctcaccgtcgaggccgccacagccatgtgcgaaggtatatgtggaggaggctaagcacaaaagtgttgcctacgtggcatgccgcgttggcggtcaaacgtggtcgaaggacaattggactgtgggtggtacattaaaccaagttcacggacctaaacatgtaatttttaagtttatagacctaagtgacaccacctcacaagtttaaggactgtccatgtatttcgctctttagaaaaataaaaaggactactagagtatggaatgccatccggacgagacacttaatgaatctaattcccacccccatctccgcacattcgagctcccatgcatgtggaagtagcagcaattccttagctccttgtgctcgttggttacagcagcaagaagaggaggcaccggcggtacgtggctccttggtcggccaaacaacaacaacgtggtccctacctctgtgccttgatctagtacttgatagttgatatctgcatgtaccagaccaggtacttgatgctagacatctcatactcacaagtattagagctcccccttcccatgccttgacccggtaactaatatcaggcattaatttgatactcacaagtacttgttatcttatattcgatacctatgggtatcggccggtaccattgtaccaagcctggtacccatgtaacagaccctaaagctgatacctattagttatgacatacatgcatacaacactagcaagcatagcgatgggctagcaaggagcatgacagctttcagcgtcaccggtgtgataatctcaaggtttgcacaaagaactcgacgactctcctatccacttcgtcaactccgagccctccacgccaagaccggccgcctccaccttctagttggtgccccggaccttgtctccctccgcttcgccacctccctttccttcctcctcgcacatgacaacaccgatctcaccaccatagttgactccttccttgccgacccactgattctgatgatccccgatgccctcgccagtctccactctctcttatgcccttaaatttgggttagtatgggagaaagatgataggggatgccaccgatgttgggaagatggttgaggagtcgagagagggaggaggaagacgccggttggtcctctagtgattagggaggaggatgatggagtggatggttggcttggtggtgaacatgaagggaatcggtgggagagaaacagatctagagataaacagatctaagtcacttaaatagtgttcacccttaatttatcatgtgcctccgaggggatcctgtcttctagattttctatataaaaggaagattgaagaagaattcagtaatacatacctgcaggagaaaaatcctcaaaagcttcaagaggtggaagcttgttactgcatctcacttacaatcagtcatatatattgtttcaactaataactaaacctacaataataacactctactattattaacatcaagtatatatggagacacggaaaagtacaagtccttgtcctctcctcttgtgtttgtacagttcatctaaaatgatataaatatatacgcatcactaattagtaattaccttagtaaaatataattattactacctccatttcaggttataaaactttctagcattgcccacattcattcatatagatgttaataaatctaggcatacatatatatctagatttattaacatatatatatgaatgtatgggtaatgctaaaaagttttataatatgaaacagggaagtatttcccaacctagctagctacattaatattcagacagaaagacagagagctccatgcaagcatgctgtacaagaagagccacacaccacagctactcgatcatggtggtgttatctggggccggagagctcgacggcctggacgaggagggaggagtcgtcggtgaggtcggagaagcagcggccgaaggcggcggcgaagtcggcggcgggcggcgccgggtctgaggtgcggtgggagtgggagagggagtcggcggcggcggtggagtggccggaggccttctcccagcggtcggcgaggccgtcgccctcgagcatgcggacgacgtcggacatgcgggggcggtgggcggggaggtactgggtgcagaggagagccacctgcaccatctcctccacctccacccggtcgtaccctccgcctaaccccttgtccaccagcacctccaccttcttctccgactgcatcttcttcacctgcattttttttctttgcatcatcgtcacagtttctctacattatgccctcaacaacacacaatcacatttggtggtgttcggattaagatgtagattttactttcatttttgttagcacatttttaaaactgttaaatggtaggtttcgtgtgaaaattatatatatattagttattttaaaatatcaaataaatctattttttaagtttgtaataactgaaacttaattaatcaggagtaaatggttttttatttcgtgtaccgtaacttcatcttttatcttcgatagaaaagcacaccgctgatcttagttttgtgattgatcggtttacatggggattattcgaatagttatgaaaaatttcagtgaatattatttttacaaatttccctataaaaatgagtaaaacaatctaaaaaaattaagtacatatattgtggtgctgaacttcactctaaaaaatgtattgaaaatgcgaggctaaaattcaatctgagagaaaaaaacaaaatcaagttgcgaatagttccgcgtttttcctagccgagattttatttttctccatgcctagattgaatttaatgttgcagcatctagaatgaaataaggtataatacttgaatagttacatttgaaagttttttaacaaaaagaacttgtgacaatcttttagcaatttcctaatatatcacacattctcaattttttttagaattttggaaagtattagtgtcatcttctaactcttaattacttcatccgttttgtattataagtcgctttaactctttttctagtcaaattttgttaagtttgattaaattaatagaaaaaattagcaacatctaaaataccaaatcaattttattaaatctaacattaaatacaatttgacaaatatatttgtgcagtgttcaaaatgctactttgtttttacataaacttgatcaaattgaagttcgacttaaaaaagatcaaatcaattcataatataaaatggagggagtaatcttaaggtgtttctaccgattagaattatactactccagattgcacaagctaatcgatcaaacgaattaacggatcgaattgaaatcagtagcacatatatttacccagtccagcatggcgcccttaaatttgaaggtgtttctaccgattagaattatactactccctccatcacataatacaagggattttaagtttttgtttgtattgtttgaccactcatcttattcaaaaaatttatgcaaatataaaaagcaaaaagttatgcttaaagtacttgggataataaagtaagtaaaaaaaatattcccaaatttattgaataagacgagtggtcaaacagtgcaa

SEQ ID NO: 66829 - DNA, 27904 bp, Oryza sativa
tatgcttaaagtacttgggataataaagtaagtaaaaaaaataattccaaaatttattgaataagacgagtggtcaaacagtgcaaacaaaaacttaaaatcccttgtattatgggacagagggagtactcgagattgcacaagctaatcaatcaatcaatcaaacgaattgacgaatgaattaataatagtataaaataatacttacccagtccagcatggcgcccttgtggttggacgacttgccgaactcgagcgccgtctggccggtgacgagctccagcagcaggatgccgaagccgaagacgtcggtccggtccgacgactgccccgtggacaggtactccggcgcgatgtggccgacggtgccccgcaccgccgtggtgacgtgcgactcccggtggtccagcagcttggccagcccgaagtcgccgacgacggcctcgcacgcctcgtccagcagcacgttggcggccttgacgtcgcggtggatgatcttggggtcgcactgctcgtgcaggtacaccaggcccctcgccgcccccaccgcgatcctcctcctcgtcccccactccaacgccggcttcgctgcatgcgattttatagtagcatgtttcattaatctgcccaggttagtttttggaaccgcgtcgtcagttcatcatcgtcatcattcatcatttggtcagagtttcagagtttcagagtgagtgagggagtgaaaggtataaggtaaagatttttggtgttggtttgtgtctaattgggtatcacactctacttcagggattgaaaccggcggtttttcgggctccgtcgtggtagcttaagttaggttagctgttggtgtggtgttgtagctgtggttttcgctcagttttccctaattaactgagcattgtaaggtttgatcctgttttctccttaaaatgggatatcttcttcttaatataaaacgttggcaacggtccgaccgttcgaaaaaaaaaaaaaagaaaccagcagtttcgctgttcaggcgccgatcaccatcatttggtcagagaaattcagagtttcagattgagggagtgattcggacagaaaggtataaaggaaagaacttttttgtgtttgtttgtgtctgattgagaatcacattctacttcagggattgaaaccggcggcttcgctgttcatgcaccgatcaccgtcatttggtcagagaattcagagtttcagagttcggacaggaaggaataaaccaaagatttttcttttttttttggttgtatctaattgagaatcacatcctagctccctcagcgaacggaagcacatcaatggcgtctgtcgtcgtcacaatttgtttgcaagttaattttgaaagggaaaccacatcaattcatcatcatcatttggtcagagattcaaagtgggtgagtgcagtcggaaaggaaggaataaagctggagttttttttgtgtctgattgggaatcacattctcctcttcttctcttctcgtcgtgatagataaatttagtctcctttttttaattatctttcagggcaatggaatccaattccgagctcttatcatgctccacttgtttctttgccggcctgaactgaaagcttcagtctttcgattctgcacctctcttttaggtccggtatgatatgaaaaatccagcaaagaacatatgctgctgctgctgttccactcagatttctgctgtcatatcgagtaaagaacattcgagctgcagcagattggaggaattctaccggactttctccgtggtcattgtctgaatcttgtactgcctctctctcaaaatgagttattttactgttcttaatgagatattgagatgtactatatttttcagtgtaaaatttggtatatatacctaggagttacggaaatttgcaataaattttggtacattttcatacctctcaaaaatggtaaaatttatctcttaaaatatagaattctagtagtagatgtgatatatcataatacttcaaatctgaacataatgtctgtttcaatttatagtattataatgtatcgcatctcgtactattttactttgttttaaaatagagagagtaaaatatagcaacttagtactgagatgagacatatcctaacatcacgaatctaaacagaaaatctgtttgaattcatattattatgatgtatctcatctcgtactggattgttatatattttaggataaaaaagagcaattcataatcttaagaagaaaaatagatacagtactagaaatattaatttacgaatttggtttggttacctttgaggcgggaggcgacgctgccgttggacatgaaggggtagactaggaggcgctcggtggcggtcatgcagaagccgtagaggcggaggaggttgcggtggagggcgaggctgatcatctccacctccgtctggaactgggcctcgccgccggccgcgttgccgtccttgagccgcttcaccgccaccagcgtcccgtcggggagctgccccctgtacacgttcccgaaccctcctttccccaggatgttcttcccgctgaacccctccgtcgccgcctgcagctccctgaagctgaacctcttcacgttccccaggttcacgttctcaatctgctgctctgcaattttttattttttttcccaaccaaaaccaacaacactagtctattaacattaatactcaaatttattagagatgtaataccccttgtctgaattcaaaattggagtgatttaatttatggtcctttggaaggtaccactagcgtgaatgttggtgggtttttattattcagatgtcatgagatatcaaattttatattaaaatgttgtgtacaccctatttgaaatacgatttttgcgtgaattattgaggcagattttttatacttatttaacacaataaatcaatattttgagaaataaacttcacaatagtttagaacaggtgaatatgacagcagaagttttttttaaaaaaaaatctaagaagcatggagcgaataatccgtaccaaaaatcttagacaaaagctgacaataatttctcttggaattaatgacgaaatgcaggttgttttggaaaaagattgaggttaccatcgacttcgaagtatggatgaaaacggagcggatacggatggataatgttcataccatattcgttttcatattttttaccggatacgaaaacgaatacggaaacaaatacggattatctcgaatacgaataagaatcgaatatgatcggacacgaatacggaaacaaatttttctcggaacacgaaaaccaactcaacttctaatagaaataaatatcaacatatataattagctcattttatataaaatgaggtataatttataaatattttttaaaatttaaataatattaatagtatggactagtgttaagagataaactactattaaaatctataaaggtatattgaaggttatagagttagaaagaaatagggtatgtctcatgggtcctgcggatatccgaatagcactgttcaccggatatccgaattattatccgtatccggcggaaacctgataccatattcgtattcgtatccgggagaaaatatccgtattcgtatccgtatccgaaatatccgagaattatccgatccgaaaggtatccgtatccgtttttgtccggagcggacggaaactatccgctccattttcatccctacttcgaagaaggccctagcgtaaaattaaggtattacaaggtaccaaaaagcttagaataaatagtcttttttttacgaaaaatcgtttttttaaagaagcgtggagcaaataatccacaataaaactctagacaaaggcctgaaaataatttctctaagaattatggatgatgaaatgcaggtaggttagctgcgagaaaagactgaggtttaccgtcgacgtcaaagaggatctgccggttgcggcggtggcgccaccagaagaggaaaccggcggcgaggaggaggaggcccatgcagccggcggtggagccgaacgcgacggcgaacttgtgccccctgtccctcgccgccggcggcagcgcgccgccccgcgagccgttcaggctgtagctcatcggcatcggcgccgtcccgtagcaatcctgctccctgttggcgtcgcagatgaggggattccccactatgctgcaagaaaaaaaaaaccatgcaattgttgatgaaccaaaaaaaattggaagattttttttcttcttgttggaagaattgatgaacttgaaactgcagccttacttgtaagttcttgccaatgattctggaatcgggccactcaggttgttatatgacaaatctctgaagaagaacacgagtgtatgcagagtgatgagacaaaccaaactgaatagtacacttaaaagaataagttaatatagctcaagaaagagcagggcaagacaaagcatctctgaataaatgacacaagtaagcaggttgagacaaaatcgaactgtttaattgcaacaacccaaaactgagatgaatttactcacaggaaaacaaggtgtgacaggttagctgatgcagaagggaatggaccagacagggtgttgttgttgagcctcctgatcaaatttcacagcaacagagttaactcaaacttaattaacatggcaacaaaaaaacggagaacaaccacaataactatgtgtagatatgatatgatactgctacatatctagatatcataatcaagaacagtgtgcttataattatctttactacaaaataaatggaacagtattcagaggctttgaacagtggagctctcgactcacaagtactggaggctctcgaggtggcccacagagctggggatttcgccatagaagctgttgctggagagatcaagcgtcttgaggttctccagcctgccaatctctgctgggattggcccggttatgttgttgttctgcaggagactgcacccaccagcacatcaaagaaaagagacactctgtttaagtacaagaactgaccatgataaggctatggattgatgtgaagtagaagaagaagaaagaacactactgacacagtctcaagattggtcaggttgccgatgcttggtgagagcaggccagagagatgctggcttggagcttccctgaaaaaacattcagagtattcagacaagcagcagagaagagaagagaggtgagattgagattgatactgtgaagcaatggaaggtgagagctaacatacaggccagtgacgaggaaatccggggagcaggtgatcatggcccagctgcaggggtcgacggagttctggtcccagctcttgagcacgccatgggggtccttgagcaggttcttgatcacaatcagagcttgcactgccaatcaaccagccaatcaatcaatcagcacacgcccaaatgcaagaaacgatcagaggaaacaagagagaggaagggatgaactgaactgaaccttaccttcgttgttgacgcccttggcggagaggagggcggcggaaggggaggaggaggagaccacgagcagcagcaggaggaggaagaagggcggctccattgctgagctcaggtaggaggagacgacgaagctagcaagcaaaccagcaactacaacctcaggtggtcaggtcaggtgagctctttcctgggagaagaggaggaagaagaagcagtggctgcgtctgcgcgtgcaatgtgtgattgtgtgtgtgcgctcgaactaacatggaacaagcgtgaggccaaggaaagcaaagcagcatgcagcttggcattggcattagcagtggcaggttgcctctcactctctctctctagagactagagtctagtctctctctctctctctctctctgtgtgtcttggccgcgcgcgcgcgcagtcacaccacacgcgggggcaaagccaaaatggcagagggccggggggatggggccgtgtcagagggggggcaaatgacacaaaaggcagagaaggggagagagatgctgatgctcggcttcgctcgcgcgcgaaatggagggatggaacaaacatgcctcctgcgatgcgatgccatgccacccgagctgagcgagacctgactgctgtagcctactggagtagcagcaaacgggatcagtaaaccatgggtgtttttcttctactcttcttttttttttctctctgtctctctctatcctcttttctatcctgggagcttggccgtttgtgtgatgaagtcacaaggtctgttagattttttgtacgcgatattattttttcttttgcgattatacaatagacatgcatacatcactacacttgtaataccactcatacactcgtgaatgtgccttcgctcaaagaggcgaaaaccactggatttttgtgctgacatcttttttttcaataaaatctttttttaaaaacagtagacggtaggagatctaccggatatattagaagaagagagttgaccctgtttataaggaaaaccgggcccaaaaatcatataactgcacagtttgctaaaggaaaaccggcaaaaccttacacagaagacacgaaaagcctgcgacaaaactacaaaccacagaagtgaccaaagaaagagcaagaccttcaaagcgaagcctccaaggaggtgaacaatgacagaagccgttgccgacgctcgcccaaaggattgggcttttcacccgaagggggagagagtccacaatgcaacacctctaaggaggaaacagcgcccgcaggcctcgatgttgccgatcctggaagaccagataaggctttcgcctaagactccctcaaaggggtagaacctcttagaaaccagagccagagtgataagtgttatcgtttcccggctcatcggctggacccaatgcagcaggtccgactccgccttaacacaaaaactctagcaacatagaagacaagcaccatgctcaaaactcggcactacgacaggttcacacagacacaggacacttgaagcaccggcgagacccaagagccctaacaacagacagactgaaccacgagcacggctgaacacttctcctcaactaccgaaaggctccacggccgggtggaggcggccaaaagaagggaggagcccaaaggagtgaaaggagccgtggccgccatgaggaggacgtgagagctgaagtcaggggcaacaaggaccacgttgtcttccatgattccggcgaggaactccggctattgcaggacatttcttacgactgcagcaaccaccaccaactttaccaccagtgcagagagggggacactggggtgagcagaagagcaactaaggagtgttggcgagaggaagggaggaagggatgtggggagggggaggaaggaaatgggggagcgggattcaacagctaccggcgaagggtggccggaggaagagagacaacacagagaggaacagagaaaggaggagggcaccaaggaagaagaaaaggtggttgtaggggcggcgtctgcagatgccggcgacggggagaggtgaccggaggccagactcgccgactcccagcgagagccccggaggaccgaccaccaaagccgactggcgccgctacgccgccacgcggacatcggcaatccgccgcccacgcaccggcgcccgcaccaccgcgcgtgtctgccgccttgcacggctgcgcaagccgcctttgcgacggccccgccgcctcacaagccaccagacgccgcagcggtcgcctccagccgcgcctcctccgcttcgcaccgccccacgacaccaccgccgcaggcgcactgcccagatccggtgacggcggtgccagatctgccgccgcctggccgggatccctcgccgtcgccactcctggccgccggcgaaaatctccacctcccctacgcctgagaggggggcaccaccgcggagaaagccccgccgccgccttcctagctcgccagccagctttgccggcggtgaggtgaggggagacgaggggggtcggtgccagcggtggggttcgccccctatgtcgcctgcgtgtgggcgacgcgggggtttgcacaccttagtcaactagattttgatccaatggccgaattgtcattttctacttccagctaggtgaaggcaaagagatggtgaggaggactcaccagcgatattgacagcaacttcctcggcaagcccgatgcagagacgtctttcacagtaatggcgacatgttgtatctctgtcaaggaccgccagattaggttttcgggtttaggaggaggtaggagggggtaggggatggtgagggagggtttagagggaaggccagggtagtagtgggaagcggagatgggagggcggagaggcggcaacgtatgagctgtgcggatggacgacactgggtggggtcgatagtatgggcgagagagtacatgtggttagaaggtaggggcagtcgttgaagatgacgaagtaaatgtggagcaggggaaacacacacaggagctaataaagacggagcaatggcttcgacgcaaaggaggaaaggcagaggaagggcaaggccaatgggcatcattggtgctggcaacgcggagacaatgcacggagggtcagggagtggagtacatgcggtgtttcgtagtcgcaaactcatgacgcagctaggggatttgtttagggtgaaagaagatgtgagcattatggttatgcgctagcatgaattgtgaagtaatgcaagccgtccaaaatatgcagatagttagccaaaaataaggtgattgattgatagacaatcccttgtatatataattttaggttgtttattccttttttactatctattgatcgttttgaagattctatatatcgattttagattcgtgcagcttttcaaaactctattttgtcccatactctctccccggcgcggttttcctcctagctggtacggccactcgtcaaaccttgtattctaccttttgccacccatgaacccctgtcaatctagtggtgaagccaggatttaagtacgagggacaattttgtaagtgattctgattaaaaaatgccgtaaaaagtatatgtgaattccaaggttcccaataggtaatatatcatatcaacggaaaaaacacatggtaatttaaaagatcaaccggtatatttattcactttaatttacccttatgagcaaacagataataagcagcgataataccattcgaggtaaaagcagacaaaccacaaaatacacaaaaagctagattacggcaaaatgagcaacaaactatctatcttttgcaagtattaactagtattttagatattcaaatttttaaattgaaatgttagccacctaatgatgtataaaaattaaatacacatgattatcaaataaaactcagtattctataaggaaaagaaaagtgtagttgatatgggcttatggctacggtaacaaccctttgctgcttttgatcagggattagttgccatattcttgctaaacatatgttcatgtcatctgaaactaacctagcttaaccaactaatcaattggcagaatttttttttcgcatgatcagtaccacatttgttagtttaactttggtgaaaccaaattataaggatttgtccttctaatcatattactcccatgttaattttttcacacgaaacgagaacgaaagtgtaaatgggtccacccatcgaataggccgggttgtgcagttcgggaggacgtgttgttacactcagccccttcttcttttcatttacctccatggtgacatctccgtaattcatctccgctggtgatagatgcctgatccactggccgccacctgaccacatagtcctctacattcttgcctacggcttcacatgttgccctcatctagatatacggcttcacatgttgccctcgtcttgttacccatcccctttccttctaccgaaagtatcaacaaataaaaaaaatatccactttaacaaatttgactacaaaggattttttttagataatggactacaaaggaattacgtatgtgatcctctctcttattaagacaggtagttacataaattatacgacgaagtgattagatcccaagagacaaagtgtttgtggtggtggttcgaacgacgaccgactcacttaactctgttttaattgtaggttttcattaagagatttgtaaatcacttatatatatggagcatcctataataactcaccttgtctatgagatcgaactaccaaatctgctgtgcaagatcaaactgatctaccatatagtggtatctttagtcacgaccgagatgaaaagttggcggaccatatcatttctcgttaatttggccaaaagtaattaacacgagttgaccgcacgcataaagaccttatttggtagcccaggatggcaatataattttcccccgtattaaaatcaaaaccaccatttgcccccataaaaaaacaaaatttgctagaagacgtctaaaatttgtgcagtttgctgctggacaccttgaaaattgataatttattggaggacactttcgggcgaattaaaatgagaaaagtttcaaatatatgagaataccctggggccacgtgcttctaacatggtgttgtagtgaaaatttagaaactatacaattataaaatctaccattacctaaagtacatcgctaacatgcatcatattccatgttctcgtcagccttaggttaaaagatattttagccctaaggatattctcatcttttcttttaagaatttttctttttaatcaggctaaaatatatactctagcaaattatcagttttttaacatattattcaactataacatgtttttacgatgtccaccggtaaattattcaaaattctcaaaagtgtcttgtagcaaaacttatcaaaaagaaaaaaggcacaactttattggattgtgcatgtagccatgcccacgtaccgtttgaagccctataattgagggttctctttgcaacaaaaggatcgccaaaggtgagtcgctgttgagacacttgcctcgagaaaaagcttgacacaaactcgatcacagtttctacggaaatggagggggccaggaagaaaagccatcatccatcatcaaagggtgaagcgaaaagcgtctttttagagggccggccggcatggatgatgactgccgctggccccggcggcctcaccctgagaactcaacaaagcccaaatggagaaagatatcaaggggagaattttggtctgtgtatttggttactactccctctgtaatattggtttgatcattcatccttttttaaaaaaaattatgtaattattttctattttattttgatttgatttatcatcgaatattctttaaatatgacttaatttttttatatttacacaaaatttttaaataaaacgaatggtaaaacagtgtcatatattaaaaaatgaaagtagtagatgtgttcctagtggatggagaatccgagcaagaaaggccttgtaatcatctccaatagagaaaaatgcccagctctcaagaaaaaagaaacgatctcgccacgtaattgttgcatatggtgctatttgaaataggattgtatatatttgttgtatacctcatcgacaggcctttagcttataagccgcagccaaattcttaagctgctcttcttcttcttcttcttcttcttcttcttcttcttcttctttccattttcccattttctaggtttttttaagattgttaagactacaagttaaacgtcttaccctaaaatccttttttttttggcctagaagccgtatcctaatttctgaacacgcattgtactttctagatgtttgtagctagctattgatctactagtatttcgttgcagtttgatcccattctctgtttgtggtgataagctgaaaatgactgctggtttgtgggatgagaatcgtgcactcgtttgtacaaactcttttgtttgcaacttggctccttatcctcccatgatcctgcttctcacccctctttgatagacacctgccgccctattgcaggcactagtacctgcaaaaaatatgttaaaagtttttgtgaagcatataatgatttgtccacatgctacgcactttgagttggtggttttgctttttttttttttctgattctccatgcgagctccccgaatttgattctgcgaggtcaagtcttgttcatctttttgtaaaaaaagaactggattttttttttaaccaaagtgcccgtagccattgtgagttgtctccgaatcgcgaaatagaacggaataatcgtaaaggaggtagctcaattctcgtagacgcaatattaccaaacttacgcatttcacaatggttcttattaaagtttagaggcaataatcatggtgatggggttttaaaagacttctttttggatgcaggattttaaaaggaataaaacatagtagaatgtcataccgtgtgccggtttgttaaaaaaatagaaagggaatatctatatttatggcgccatattattcaccaaaaaatagtcggcatgtatttacattgtaagttcctaaattacatatgtaattttagtgtatttgcaatgtaagtcttgaaattacatatgtaagtatctaaattacatatgtaatatatcatattattaaaggaatagaaaaaggagcctccacgttcgctctcatagcctagaaattctcacattaatcggagaaaaagaaaaggcagagtccatgcaggaatataatttagtaatagctaaaattcggaattaaaaaataaggaatattataagaggagactagagtccatatagaaatacaatttagaaatagttgaaattcggaattaaaaaataaggaatattaaaagaggagactagagtccatatagaatttcaattaggaaataactgaaattcggaattaaaaataagaaatattagaagtagagtatagagtccatatagaaataaaatttggaaataatagaaattcggaattaaaaatgaggaatattagaagtagagtatagagtccatatagaaatacaattaagaaaaaaaatagaaattcggaattaaaaattaaggaatattagaagtagagtatagagtccatataggaatttaaaactaactaaaattcagaataaacataataaaattaaaagtagagtttagagtccgtataaaaatacaatttataaataactaaaatttaaaattaagaaaaacatgggaagaagagtttaaagtcaatataggaatagaatttagaagtaactgaaatttgaaattaaaaattaaagaatattgaaagatgagtttatatagaaatacaatttagaaatagctgaaattcggaattaaaaaataaggaatattagaagagaagactagagtccatatagaaatacaatttagaaatagctgcaattcagaataaaaaaaataaggaatattagaagatgaggctagagtccatatagaaatacaatttagaaatagctgaaattcggaattaaaaaaaaggaatattagaagtagagactagagtccatatagaaatacaattaggaaataatagaaattcggaattaaaaataaggaatattcgaagtagagtacagagtccatatagaaatacaattaagaaaaaaatagaaatttagaattaaaaaataaataatattagaagtagagtatggagttcatataggaatttaaaactaactaaaatttggaataaatataataaaattaaatgtagtgtttagagtccgtataaaaatacaatttacaaataactaaaattcgaaattaagaaaaatatgggaagaagcgttcaaagtcaatataggaatacaatttagaagtaactgaaatttgaaattaaaaattaaagaatattgaaagatgagtttagagtccacattgaaatacaattagaaataataaaaattcagaattaaaaaaaataaaagatgagtctagagtccatataggaatatataatttacaaataactaaaatttgatattaaacataattaataactaacacgtatataaaatacaatatgaatattacatattagtagtttcgtaaagttattgcaaaatttaaaattatgttgtcattttaatatattagaataatataatgagaaaacatatatgctattatatgaaagaaaatataatgatgctagccgcgcaatctgcgcgggccactatgctagttttactgtatttacgatgtaagtcttgaaattacatatgtaagtatctaaattacaaatgtaattttagtgtatttacaatgtaagtaccaaaattacatatctaagtcctaaattacacatgcgtaattactgtgtaaatagagtaattacattcgttgatgaccaacacgtttcatgcaaagcaaaaaggagtcgggagcaagttgttcgatcagcttatcagatgtactttgcacgaatcatgaagaagattagatggcagatcgtcaaactggctgtatttagcccagaaatatgtcggcataattttagcaaagccgaaatagaaaacacatgctccaaatagccatttcgatggcacacacgaaaaacatataaatctgggcatagaagagaaaaagaaacatgagacatgaccacatgtttgtctctccaaaattcctattgaatgtccattctgtaatatttttaaaggaatttttagagcaaattctttcttttaaagggctctaaggaattttatctatatgattcaagtcctccagaaacccttcaatttttctttgttccaaagtcaaggaaagcccttctttttttacccgccaaaggcctcaaataaaccaatatcaaattttgcgcttttagttttcttaggttatgctctttccagcgagtttccaacgcacctctctcgttttccacgcacacgcttttcaaattttgcaaaaaaaaaaattatatataaaagttgctttaaaaatcatattagtccatttttaaaaaataaatacttaattaatcataagaaaatatgtcgctccattttacgtgcgagggaggtgagttcccaatctcaccttccgaaaacagccaaggccacttgctgcaacagttgaccaaattggattagggtgaccataatctggaacttcatgtattcctcttctagaaccataacctgaacatatgcactcaaagttgtccttattccattaattattttaaaacatgcaaaaaatgaaactttgttgaatcgattactagtaataacttcactcacaaagattgattctgaattgattttaatattttcagcctttctttttttggggtgggggaggggagggtctttttccacctctcacttcctctatcaattttgctcatctctcttttgcccctattcaattctcttttgccattaccataataccattggtcaaagttagttcaccataagagtagcccaaaaaggctattatacccttaatccgttatgtaactaaaattataagaaattccaaaaaaaatatcaaggaaaatgtaattatatatttagtttttaaaggttgagtaaacaatttatgatggaccatttcagttagttcaaaatatttataattacagctaaaaaactatttaaatataaattatttttgcttatccacatgtaatgtaagcatggcatacctcacaatatttggaacaaaaaatgaaatagcgatgcacatcccaagtacaattatttcgtgaaacatttaagaaacatatcaatcccaagatgcatttttaaagaggtaataaatataattttcctttttagttattttttctgaaaatttaatacattttaagttcccataatttattttttttatgttttgcgttcacgaaaaaattttcatgctgttttatggtatttgctaaaatttgaagtgtttttttttttggaacaatccttcgggcctagtaaataaaccagactgggctgatggttgaacccgaaaaaaccagaaccaccatccttgtggggtcggtttgctacaaagactagacatgcaatttgactgctgcgaatcgtgtgaaccgaaccaagcaccgctaccaaccagctagcttgctcatgccaaaaaggggatatatgcattgtcggtgatatgggaccgggagtatcgtgactagaggcttaaggcagacacaatcgcccacgtggcctggcaccttcggggacgtcgggcccgagggtgaggtgtccgccctcctcctgatttccccgagggggggggtagggtgactccagcctcgcccccgagggccgaggcgccccgacccctcgcgttttttactccacgtgtatgggttaggtgagcacagcagggctcacctaaccgcatttattgcgcctcggctaagcgtgtcacgccgcacgaagtgcagtgcagtgcactcgattatccggtctgtgaccagtcacagaccggtcaaatcgcgggttaggtggcgacaggcggtcagacgcatgcttcgccccatcctgtctagacgagagcttctaggcactcgtccccggctggagctagcgtgttacatcccagagatgacacgttagccccgatcgatatatgccaggcttcatcctaaccattacaagcaagatgttgtttgaagaagggcaaacatgcacgttgctgagccgacgtgtggtggacaagaatgaccgatttgtgaccggtctgacactgctcatgtcgtcagtacacagccaccttcccacgacgtgcccgcctcaggcagaagtggaggtaggtatgtgccgtcccgtcaggaggatgttcggaggacgaccgtgcaaatctccgtccatttatgaaaagaagaaaagtccagtttggaaagggaggggtgcatgtggtatccccttgaagtataaaaggaggaccttgcccatagagaagtgggttggttgattctttccagattcagagcctagaacgagggagaggtcggctcacactttgtagttccttcatacacagatccaccaaaacacaggagtagggtattacgcttttcagcggcccgaacctgtatacatcgcccgtgtctcgcgtttcttcctagctggcgatctttccacataccgagagagcttgagatttcaccctaagcccccggccgaaccggcaaaggggggcctgtgcggtctcccggtgaggagccacgagctccgtcatctggcgcgccaggtagggggctcagtgtgtgttttctgagctctcgtactcctccgtgtgcgccaagtttttcttgttcagcctaatggccgagcaagcaaaggtgcacgacctctctccgagtgcgagcggcgacgacggggagccaaacccacgccgtcgagctcgtactcccccacctcctccacaccaagatcctaagcagggggaggcgctcgagagggtcgaaaaatccgcagcatcgccagtcgcgggtggtgcaggagaacggcgagatggggagcgtcgcctcctcgtctacggcaacggcagcacgcctcagggcgcgcttcaggctgttggcgcgctcctacgtcacccgcccgtcgtccctgacccggagtctccagcccagcgatggctggacgacgtggccaacttggtcatgacggcacagcagcgcctgggtgctggtggacggtccgccaccaccaagacctccggcgccgccactaccggctccgtgtcgtcaagacggagggcgcggcgagcggcggctgttgcacaccattcggctgccactccctcgtcggcacctccgactcgggaggatcagcatggagagccggatgcccgcctcgacatcgagcgccggcgtaatagccggcgtactccccgcgcaacggagggcgcctcttcgtccagagtgtcacctcgacatggacgtgggaatcagccctccgtgcccccggttggtggtgttggctgtagagccttcgtggcgagtcttcggaatgtccgttggcccccaaggttccggcccgccatcgccgaaaaatatgatggcagcgtcaaccccgccgagtttctccaggtctacacgaccgggattgaggccgccgggggtgacgacagggtcatggcgaatttctttcccatggccctgaaggggcaagcacggggttggctaatgaacttgccacccgcgtctgtccactcctgggaggatttgtgccagcagttcaccatgaacttccaaggcacgtatccgcgccccgttgaggaagcggacttgcacgctgtacagcgaagggacgatgagtcgcttcgatcgtacattcagcggttttgtcaagtccgcaataccataccatgcatccctgcacacgcagtaatctacgcgttcagggggggtgtgcggcacaaccgcatgctcgaaaagatcgcctccaaagagccccagactaccgcagagctttttcagctcgcggaccgagtggctcgcaaggaggaggcctggacttggaacccctccggttccggagtggcagcttcggccgcccccggatccgccgctcagtcagggcggcgtgacaggaggaggaagaagaggtcagtccgttccgacgacgagggtcatgtcctcgccgtcgagggcacttcacgggccacccgaaaggggaggcctgcgagcgacaaaaagaaggaggccagcgttcccagcagggagcgccctaccggcaagtggtgcaccgtccacaacacctccctccatgaccttgcggactgtcgcgcagtcaaaagcttggctgagcggacaaggaagtgggaggaggagaggaggcaggagcgccgggaaggcaagtccccggcggttccttccggccgtcggcgaagtgaggccaagcagaaggcccccgccgaggacatcgatgatggcgataatgacctaggtttccaagaacctggggccaccattgccactgtcgatgggggagcgtgtgctcacgtctctcgccggagcctcaaggccatgaagcgagagcttctggccgcggcccctactcatgaggcgacgcgccgggcgcggtggtcggaggttgccctcactttcgaccggaccgaccacccaccgtgcgtcgcccggggagggcagattgcgatggtggtttcccccaccatctgcaacgtgaagttggggcgtgtcctcatagatgggggagcggccctcaacatcatttcccccgcagcttttgatgccatcaaggccccggggatggtgctccagccgtcccaaccgattatcggtgtgacgccggggcacacatggccgttgggtcacatcgacctaccggtcacctttggtggatcagccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctgaaagtcgcgctcgcttgcatggagcagcgcgcggaccacctcgctgctgcgtccaagcccgagggtggtgacgagaggcctggcacctccgcccccaccgccccgaggcagcggattgtcacatgcgccgaggtcccggtcaaggaggttgccctgggcgacggcccatccaagaccacacggatcggtggtcttctggatggcaaataggaagacgcgctcgtctccttcctgcgggcaaacgctgacgtcttcgcatggagaccggcggatatgcccggggtccccagggaggtgattgagcaccgtctcgccgtgcgaccgggcgcaaggccggtccggcagaaagtgcggcgccaggccccggaacgtcaagccttcatccgcgaggaggtggcgcgacttctggaggccggattcatccgcgaggtcatccacccggagtggctggcgaacccggtggtcgttcccaaggcgaacggcaagcttcggatgtgcatcgactacaccgaccttaacaaggcatgtcctaaggatccttaccccttgcctcgcatagatcagattgtcgactccacagcggggtgcgaccttttgtgttttctagatgcatattctggttaccatcagattcgcatggctagggaagatgaggaaaaaactgcgttcattactcccataggaacttattgttatacgacaatgccctttgggttaaagaatgcaggtcctacttttcaacgtactactcgaatttctttgggtagccaaatagggcgtaatgttgaggcttatgtcgatgacttggttgtaaagacgcgcaaccaagagactttactcttagatctagcggaaacttttggaaatctccgctccgcccgcataaaactgaaccccgataagtgcgtgtttggtgtacctgcgggcaagcttctcgggttcttggtctctgcccgaggcatcgaggccaaccccgagaagatacgagctatagagcggatgcgcccccctagcaaacttagggatgtgcaatgcgtcaccggttgcattgccgccctaagtcgtttcatatcgaggctgggagagaaggcgctacccttatttaagctcctcaagcgctcggggccgtttacttggacggaggaagctgaacgtgccctcactcagttgaaggcatatctcagctctcccccagttctagtcgccccggggccaaatgagcccctactactctacttagcggcgaccccccaagtggttagtgcagcgttggttgtggagcgcgatgagggcaatcctcattccgcgcacccccaccctgtgctgacttggcccgggagcgagcagggaggagaggcccccgagccgaacggtggcctaaggcccctggcgaccggagtcggccctctccccgctcgtcagatggtgctgggcgcccccgaccctcaggaaggccccgaggccactgcgggaaggctgcacctatcgccctctgaccccgaggctaaccctgtaccgattcgacccgggaaggagcagggagaagaggcccccgagccgaacggtggcctaaggcccctgacgaccagagttggccctttgcccgcttgtccgacgacgccaggagcccccgacccccaggacggccccgaggccactgtgggaaggccgcccctgtcgtcctccgaccccgaggtcatcggcacagaagacgagtgcgccccgaggggccacttggacgaggaacgccccggggatatggcccttagcgaagggaatcggccccaccgaagggtgcagcggcctgtctactttgttagcgaggccctccgggacgccaagacccgataccctcaggcccagaagatgctttacgctattctgatggcctcgaggaaactgcgccattatttccaggcgcatcgggtcactgtggttacgtcttaccccctcggtcaaatcttgcataatcgagagggtacaggacgagtggtaaaatgggcaatcgagctttctgagttcgatctgcactttgaaccacgccacgctatcaagagccaggccctcgccgattttgtggcagagtggaccccggctccagagaccgtctcaatccccgaggccagcacggacccctctcagctgcctcacaccgcccactgggtgatgcagttcgacggttctctgtctctccagggcgccggtgcgggggtcatgttgacctctccgaacggagacgtcctcagatacttggtccgtctcgactttcgagcgactaataatatggcagagtacgagggactccttgccggactcagagtggcagctggactggggatccgccgcctcttggtgttaggcgactcccagctggtcgttaaccaggtctgtaaggagtaccggtgctctgacccacagatggacgcttacgtacgccaagtgcggcgtatggagcgccattttgacgggatagagcttcggcatgtacccagacgggataacatggttgccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaagcatacctcacagataagactctacctgaggaccgtgaagggagtgaacgcgtccaacgcatttccaaacgctacgtgctggtagaagggaccctctatcggcgcgcggctaacggaatcctcctgaagtgcattcctcgggaacaaggcgttgagcttcttgccgatatccatgaaggcgagtgcggagcccattctgcctcgcgcaccctggttggcaaggcctttcgtcaaggattctattggccgactgccctcaatgacgcggtcgacctggttcggcgatgcagagcgtgtcagttccacgccaagcaaatccatcagccggcccaggcactgcagaccataccactttcatggccatttgctgtctgggggctcgatatcctgggaccgtttaggcgggccccgggcgggtttgagtacctgtatgtcgcgatcgacaagttcaccaagtggcccgaggcttatccggtcatcaagatcgataagcactccgcacttaaattcattaagggcatcacggcccggtttggagtgcctaaccgtattattacggataacggcacccaattcactagtgaactcttcggcgactactgcgaagacatgggcatcaagctctgcttcgctcacctgcccaccccagaagcaatggtcaagtggagcgcgccaatgcagaaatcctcaaaggccttaaaaccaagaccttcaacattctcaagaagcacggcgattcatggatcgaggagttgccagcggtgctctgggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagcttcgcagagatgacctcgactacttggaagaacgaaggcggcgtgcggccctccgagccgcacgctaccagcagagcctgcggcgctaccatcaacgccacgtccgggcctgatcactctgcgtcgacgacctcgtcttacgccgcgtccaaacgcgtgctggattgagcaagctctcaccaatgtgggagggtccgtatcgagtgatcggtgtcccccggccgggctccatacggctggccacgggcgacggcactgagctgcctaacccgtggaacatcgaacaccttcgtcgcttctacccctgaggggggggtcgagtgtcaggttttggctcgggccaaccccgcacccccctcgggcgtgcagggttggccgggggctaccacgcatgcacattcttatttctcttatttcagcatttcaataaaagcagtttcaatttcctaaaggttgtgtctgtgccgttttttccttttgaagaatcttgacttgaaataaggtcactcgtgctcagccttgccctcgggggctcggttcggtcagctaaaatcgccaaacggggcccagaaccgagctgtgccccggggcgtggtgaactccgggggggaatcggcaaaaacccacaatcgggtcacccataaccctcggtcaccacgttcccggcctggccagtctcgacatgtggatctccccaggcactagccccgacccgagccattagaggactgggacttgggcacgagcccttaaatcaagctaagacacaaaaagaggatcacggcacagatcatcctcatctcattcgcatagcaaaataaaattaacacaaagaattttttcatcattttttattgcagattataagttgatttatacaaaaaagaggcatgaaggccttagaagaaagaaaaagaaaaaactggagtctggagggggcctgggggctcagtccgatgcgcccgggtcgccggcctcgtcgtcacgatcgtctgcaccgctggcatcgccctcctcgtcggagttgggggcgaacgcgagccgaggggccgacccctcgaaactgtggacgatgtggtcggcggcatcccggacccgcgcgcgcgcgtcgtcctcggtcccgggagggaactcttccagcgccacccatggagagaagttggggtccctggcctggtaactcgctagtacgagttcaaccgctccttgggcgaggtccctcgaggatgacttgatggtcttctcgagctcctcggggagttgttggagagcccaggccatcttcgtgaggtgcggagcgaggccttccaggttggtggggtgtgtcattgactggcctttccagaggcccgcttgccgaccggcgcgatccaggcgggagactgcatcccaaagcatgccgggccctatctcgcccgccaaacggagggcctcggcttccccggcggatgagtctagcgcgcgctgcatgtcggcgacggtgtgttcggcatctgcgaggcgggcggctaagtcgctttcgcccgcagccgccccgccgatgcacgccctcgcgtccagctctttttcccgcgcctcgagatcggcagcccgctgctccagtgcggctctctcggcgcggacggattccaaattgcggcgggcctgctccgtcagcgctgcctcacggagggacagggagtccgccaaccgttgcgcttcggcctcgacctcttcgagagctcgctcccgctcggcaagcgcgtcttcgcggaggcggagtgcggactcctcttcggcgcaggcagactcgtgcgccgccagcgttgcctctcgggaggtgacggcggcctcgcggtccgccaggactttctccgcgacgcaggcgcgctcctccagcgccatggcgcgcgcctcgagggcctcttcacgccgccggagcgccgcttcggtctccgtcgctcgctgctctcgggcagcggcggcatcaagaaccccctgggcggcgtcgagctttttcttcagctccgcctcccagttcccgtgctgaaggcggagggagtcctgcgcctcgatcatcacagtggtggcgatgagggcagccccccgctcctcctccacctctcgagcgatctccgccagtgccgtcttgcgggcctcaagatctgagacgtgccggcggtgagccttgcggcccgcttctaccatggcctccaccgagcgccgcccctcctcgacacgcgcccatgcggcgtcgagctccgcacgctccgcctgcagggcctccacttgggcgctgaacccatctagcaccgcggtgtttgcggcggccaaggcctgcagaaggggctcggcgctcagcggggcgacagaagacgaggggaagagctgccttgaagaagacgccgcgcggctcggcccgccaatggacgcgccggcctcatcacgggccacccccggacctgtttggtcctgggcgtcgcccgaaggggtgggcccaagcgaggcgtccgcggcctcgtcgtgaactgcctcggaagccgccatcgcctcagcccgggcggcctcctcccgagcggcttcctcggcttggcgggcccgggcggcctcctcccgagcggtatcctcagcctggcgagcccgggcggcttcccgggcggcctcttcagcttcccgtaggcggtctgcggcctctcgccggtcagattcccgcctccgtgcctctgcggccgccggatcttcggcctcggactggccggacttgggatggtgggaggaacgcgatgggatatcactgaagcagaaagaaaaaccagaaggcaaacaagatgggtaagagaaaacttgcttttgggatagaagaaaagacggtcgcaatgagcgtgggacgaacctgcgagggggtcggttaaatgaccaccttggaggggaaattagttttccccgggatggttctgtctcccccatcttgcgcagccgcttcttcttgcgctccccctcgggctgcgatgttggcgcggccccctccgggcgcctgctgctggcacgcaccgccccgccccctcggggaggagatgggggaggtgttcctcccagtttcctcttcccccgggcgtcggtagggcggttgctccccgagcccccgacgcggggcccagaagcacgaccccctccgggggtagattgatccccccggcggctcccacctgcgccgtcatggcccttaggagcctgctcctctgaggccccgaccgccgtcataatggtcaagatggaggcgcgatctgggtcgctgcagagggggaggataccgtgggggatgagggacgcctccacggagttgagatttagcacccgttggaccagtatcttgaagtcctcgggggcccaatcccatctgactccctggtgggtccgcatgtagtcttcggacccggtgtactcccaggcggcccgagcgcgccgctggagcggcgcaatccgacgacggaggtagtcgccgtacaccatggccccggtgagcccctgggatcgcaggcccgcgaggcggtcgaggacggcgtcatagccatcccccagatctaccggcgcccgccagctggaggcctgcgccgggggctggctcgggagtcggagatgcgcttcgtcggcgaggggggtgtagaaccagtcgctcttccagtcatcccactttttacggaggacgcaggggatgtagcggttcaacaccggcccccgcggcaggaaatagcagccgccgaccactgacggtggcgataccgactgcacggtaaagaaccactggaacagccggagagatgggcgcaccccaatgaacatctcgcacaggtgtgcgaagatgcccaatgtcatcactgcgttgggggtaaggtgcgccatctggagatcgtagaactccaggacatccatgaagaaagaagaaaatggcggaaccagccctgccattgcgaaggggagaaagaagacggaccgccccgggtagtctggcgccgggcgtccctcacccagcattactatctcacggccagtggcagattccggcatgaagcggcgcggcaacccggcctgcttctcgctcacaatgcgagaaggcggcagcacgctaccatcaagcagtgcggagccccgtgccatggcgccggacgaagagaagatgaagagcgagcgcgtgtggcgaaagaagggcgcggggaagaaggagttaggacgcaagcggcgaaggcaagggaaatgatggcgaaaggaaggagacaaatcccatcctcagtgcctttatacccttgccaacgctgtgcccggctcctcgtttctcgcacccattatttcgccccctcgtttctcgcgcccacgcttccactaatcccattcgcccgcttgcggcgcgtgagatggatatgcggttgcggcagtcgagatagatcgtatcgtgcgcgcgttaattacgctcgccgaccgaagcgacattaccgtatctccaggcgaggcaaatcggctcgcccagattcgtgcgccgctcaggtgatgtggcagtcttgaagagaccgccccattattgacagccaaattaccattaccggtgtgcatggtttgagaccgttgggtttttgcccaaccatggagaccggtcccacctgtcac

SEQ ID NO: 66830 - DNA, 664 bp, Oryza sativa
caccaccaggaatcaattaacctgtgcaaggggttagtcaaactcaaacagcttgggcgggtcatgatgagatcatgcatccttggtccatggaaatttggccatgcatgcatgtgcaggcttgtaatattctagacacatgcatgcagggatggtcaatgtttttgatagcatatgcagccgaaatgccgaaattaatactatatactctagctagccgagatgggtttttttatgtgctagtattagtagatccacacaaaatatgcatgtaaatcctaaccagatgctcggctaaccacgcagaaagaaaaaaaaaaaaggtagtaactatattaaaaacatgatcctatgtctgcttgttagccgcaatggacacgacgattaaggtaattaattaattccataattcgatgcatgtacaggacgacgacacactacaggggttcaaccgatgaacaaccaaaccatgcgtacttaagcgtcactggtacggggactacgggttactgatcaaatatcatccctagctagcgctacgattcacatgcacaacttaattaatttttttaggaggttttaccatcggttataatacggagctagctagctaataattaaccttcaaatggactgaagcttgctgctgctgctgtcatctgtt

SEQ ID NO: 66831 - DNA, 977 bp, Oryza sativa
cccccctcccccaccacccctcgcctccattcctgtttctctatattgcaacctttttatttttgttttatttttttggatgttttttcgcacttaggatacgatacaaccagccacaaaaaaaaattaaacttgaacggaatataccacttagctagatatccgaaaatagcataccacttagcctattttacaccttcatcagaattagaccataacttctttagtaaaacctttgatcagcatgttaaatataatacactctaccactatatgaaattacttaatctctaattcaaaatataaccacatgaaatgatagccataagttaaatagtacagagagatgcagtttttttatttttattttattttttgatatttttttcacacttaggagaatacaggaaccaaccatagaaaaaataaacttaaaacggacaaaatatgtgacttgtaaaattttccaaagctctaccgaaatggacaaaatatgtcatttattaaaataggcgtaactttctcatacagactcggaatcaggcaaataatatatccacggacatctacagaaaaagttacatccaattctccctgctttgccgggttcggcgatattagaacctccaaattccgcttgcaagattgtgttttcgaggagagaagtttttcggtagagctttggaaaatttcacaggccacatatttcgtccgtttgagtttattttttatatggttagttcttgtgagttcctaagtgtgaaaaaaatatcaaaaaataaaataaaaataaaaaagttgcacatctctctcctctgcactagttcggagagagagaggagaggagaggaaaaattctacaggtcacatattacgtccatttgagttcattttttctatggttggttcttgtgtgtctctaagcgtgaaaaaaatatcaaacaaataaaacaaaaataaaaaatttcccggggggg

SEQ ID NO: 66832 - DNA, 516 bp, Oryza sativa
cttactatgtaataggaaaaattgacatgtcagctctgagcatcactgaattttataggtagatgtggagacctcttggattttctcagtgtatagaaagttgtcccaaaacataaccttcttccctatttcctaagtgtgtttgttcgttcgttgggggtgggtgtggggaagcatttttttttttgttttttgagacggagtttcactctgttgcccaggctggagtgcagtggtgcaatcttggctcactgcaacctctgcctcccaggttcaagtgattctcctgcctcagcctccgagtaactgggactacagtcacgtgccaccacacctggctaattttttgtacttttttagtagagacgaggtttcaccgtgttagccaggatggtcttgatctcctgacctcgtgatctgcccgcctcagcctcccaaagggctgggattacagagccaccgcgcctggttgagccttttttttttttttttaaatagtgcttactctttttttca

SEQ ID NO: 66833 - DNA, 1901 bp, Oryza sativa
aaatatatgctttagagatcgtattgatgtaataaacgaagtaaaaggatcggagaaaattagagcattataacccaaaatggtcttacagagttatggtacgttatattgaaagagaagtcgtgcataaaaaatacttcataaagcctttgttggaaacacacttctcaatgtgtttgaatgaccccgcaaaagcagtcgcaataagaacattggtcaacatatgcctcttaagagctacaataagataataagcgagttatatatgttatcatattatatttatacttatgtggaagaaagataagaaatgatggctacagatttgtaaccatctgcagcaaagtctccaacaaactactccctccgtcgaaaaaagaaaaatcaaccttaggttgaggtttttttttaagacgcaggagtgtatgaaagagatgggtggattagatattaatgatgtaatatatatatctataattaactattgtatgagtggactattaggttgattatagatgatgttttaatttttgaagccaaaagttggctatattattaaacttcgatgcaacttctatattattaaacaaagccatgggttaatatagtagtaatttttaaagcaacttctatgcggttcgagaaatgtgcatatagaaaactatgcacatttctcctatacaatgttttttttcctgaggaaacatgcagggagttcctacaattctttatagaagaagaaaattgatccagtactcctatacaatgttcaaaacattgcctcctttgaaatggagtactattttcaatgaaatatcaaaagattaagggtgtgtttaggcttcgttcgttcctgggcaatctgggggattgagagaaaaaagcatctcgttttccgcgcgcacgcttcccaaactgctaaacggtgcgttttttacaaaaaaatttctataggaaagttgctttaaaaaatcatattaatccatttttgaagtttaaaatagttaatactcaattaatcatgtgctaatggctcatctcgttttgcgtatcttcccaatctccccaatccccttctccttaaacatgcccttagttcacgtcaaaattaaaagtttggttgaaattagaacgatgtgacagaaaagttgaaagtttgtgtgtgtagaaaagttggaagtttgaagaaaaagttgggaactaaggccctgtttagatgggactaaaacttttaagtccctatcacatcggatgtttgaatattaattataaatattaaacgtagactattaataaaacccatctataatcctggactaattcgcgagacgaatctattgagcctaactaatccatgattagcctatgtgatgctacagtaaacattctctaattatggattaattaggcttaaaaaatttgtctcgtgaattagctttcatttatgtaattagttttgtaagtagtctatatttaatactctaaattagtgtctaaagatagagactaaagttaagtccatgatcaaacaccacctaaaccagcgtaaaagagaagaaaatgggcgtaaagccctgttccactagagtctgccatccatttgacctcaacacagtttttgcttgtacggaacgtatctttgtcacgggttcatgtccacagtccacctgcttcatctaaaaaaaagttactgtcagctcgatggtttaagttaccatctagagtagaccccacagcgctatttgctcccattgagtcgattattactacggaaatctttacaaaacgcatatgaaggctgtgtttagttggggaaaaaaatttttgggtgtcacatcagacgtttgaccggatgtcggaagaggttttcggacacgaatgaaaaaactaatttcagaact

SEQ ID NO: 66834 - DNA, 13430 bp, Oryza sativa
cccccctcccctccctccctccctccctccctccctcccaatgatactactagtgttttcgcttgatttaaatgcctttacgttttcatatgagcacatattgctcctcctctcgtaattaaccatatggcatccactattgacaaatagtactcccattttgtcttagtataatagtagtatcatatgagcacatagtgtgtgtcttagtgtgagcacatattgctcctcctctcgtaattaaccaattaactctagtatcatagtgtgtcttagtgtgaaataagatgggagtgtagctactctaaaaatagagtaaatatgacctgtttaacttacttccattttcagagtatcatttgactgagcctggtattgataagtgcttctagatgctatgatggcaaatcaactgtacattttagtttcatttgtggtatgttttattgcatactcagctaaaaaattgtattgctgaagcacttcagtgtggtattttgggtagattatgtgcattttttgctcatgttggagctttgggttatagaattcatcagattgcagattacagatctgatagagcaatctgtcaccgtattgtcaggtcttcaattgctatagtccttacaaccaattttctttggttaatacactgctattttcccatttgtgtattgaaggttctaaactaaggcatatatataatttctattaaccctagtttggattggattggacaaaaataatatagtcagcctggatcactatttgctagtatccgaagctccaatgcacaaaatgcaagcaaaccaaaaagaaggaagaaaaaaaccccgataagcaacagaggttcaaattcagccctcatcaccataatcaacactttcgcgatccacattacccacttgctgtcacacttcttcaacttgcaaaggcacttaaaagctgcatcaatagatcagtagataagcaacttcatatggtgatcgattagcagctctttttgacaacaatgccaccacaccaccttccatgtgtgatccttcattctccatttaatgatctctcaattcctggcagctacctggagctcaggcctaaagaaatttccaaaatgtgttgccatcgatagttggtggagctaccgcaccaattagcttcaatcttgaagttatgctatttttcttcatacagctactctacagcttgtagtctttatattgttgaaatggatgaccaaacagtattgcgctgccagtgatatgctcaatctccgtacttctcttagccctggctgtatttaagatcaaggaggatagacttagacaatgcctctgccactgttgggtgccgcctaaatgacagtaggtatcatgcaaaatgaaccctgacatcaagtgccacttgaatgctccaaaaaaaactccttccttcaaccttgtttaaaagaatacattagacatggaaacaacctgttgaagctctgcaaacattagcagttacaaacggattagttcactcatagcattcgatcacttgagatgtttctgcactaatgaaattaatcgcttactgcatcctttgttgagtatgctgttttggactaaaaaaagttagtagtcgttcctagctttatgctgattgttttatgaatgctgtaccataatagtaggcattctaactttccgaactgatctctatgttcttgccctgatacttgacagacatccttcacatcttctcatatctcccaagagatctgaattttattgagcacacaagcaatattggttggagggagtaagaacacttttctgccatgtgtttctgaacctttctgatattttcttcattatgattgtttctggttgcatgtgcaggtaccaaagggcgagaccaattattgtagatccagcattgcagatctcaaataaaactgaggttgtgacaacaaaggagaaaaggagcttgccttcagctttcaaaatatttgtaggtattgcctcatccttgttttctacttaggaaatttcatatattctgtactagttatctgcaacattttactgttgcctatgttgatatgttccctcttttcaaaatataatcttttcgagcacagtactgatagattcttccatatttttatggtgtatattagaaataacaatttcaatgttagctgcgttttttgcgcactttatagataatatattatatatcacatttcaatcataaaattacatctagaggttgtataaccagcaagctcaggctttgtttagatcccaaaaaattttggccaaaaacgtcacatcaaatgtttggacacatgcatggggcattaaatgtggggaaaaaacaccaattgcacaatttgcatgtaaattgcgagacgaatcttttgagcctaattacgccatggtttgacaatatgatgctacagtaaacttttgctaatgacggattaattaggcttaataaattcgtctcgcagtttacatgcggaatttgtaatttgttttgttattagtttacgtttaatacttcaaatgtgtgtccgtatacttaaaaactttacacccgaagaactaaacacaccctcattcatgaaggtaaagtagttttttgcataattggtggtacttttatgtcagagtgtcagacatagaagacttgtaaaaggggtgattgtgcaaactatttcaaaaatatgatcatacagagatctaaatagagaattcctcgacaactgaactaacaggacacattgcattcttggtcagcctttgagacaagcagcatacggaattctggctctactagattgattattctgtctacctcagatatatatgggataggaccataatgcatcccatttctttaccatttggacagctatcatcgcagttgcacatttgggtgacatctgcattatatacagatgcctgtattttgactatcaacattctgttggattatttaaaatgctcgatatattgcttaattcacagtccactcagcacagtcaatgggcaattttatcatctgtagagttgagctctaacctgtaatgtttctcctgacgcaggctcttcatgggtaatacttagccgatcattcctggaattttgcttattgggatgggacaaccttcctcgcactctactcatgtattttgccaacttcttggcatcctcggagggctacttccacacggtgatctgcaactcaaagtactatcagaacactaccgttaataatgatctccgattcatggcatgggacaaccctccacgaacattacctgttaacctgacaaccgagcattttgacgcaatcgcaagcagcggtgcaccatttgcacactcctttgccaatgacaatccagtcctggatatgatcgacaccaagctgttgaggagagcacctgaacgattcacacctggtggatggtgcttaggtagctcggtaaatgacaaagatccatgttccttcttcggaaggtcttttgttctgaggccgacgaaaagttcggcaaagttagagaaattgctgttgaaacttttggaacctgataatttcaggtctaaacagtgtatataacacattcttgttacatgtagccttgtagccagttgtagaattttgatagtgttcagaggcaagtgtgaccggaggtggagatggtttctcattgttgcggctgtaggcacacagtgacacagcgtgtcgttgtacatttgcaactggaaggtcaagtaaagtgactgaaatcatacatttacacaaaattttcatctctttcatggatacgaatacgctgcacaatgtgccatggaatcaggtaccccagttacagtggagtcaggccgagttatgggcttgcggctgaatttttcgtgtaaaaaaaaagggtaaaaaaaaaaagaaacgcctaccgagtaccgactgttgatttcgtgaatccttttaatgcagcctcgtagaacgccaatgttcgcttcacctcccaattgcagttcacacttgtgtgtatgctagcaaaatggcttcccgccttcctctgattaaaactgcatgtatatctgtataaatgcggcacaatcccctgtactgatcagcgatcacccaagcaacttctcggctctctccctcggagaagatggggtttctgccgggcgacgacgacgggccggcggtcggcatcgacctcgggacgacgtactcgtgcgtggccgtgtggcggcgcggccgcgtggaggtgatccccaacgaccagggcaacctcaccacgccgtcctgcgtcgccttcaccgacacctggcgcctcatcggcgacgccgccttgaaccaggccgccatgaatcccctcaacaccatcttcggtgagaactcgaactcccttatttgccataatgccatccatcccagtaccaaacgctagtaactactgtaactagtaagtacttgtttagcactattccttttaatttgtagaacaaacatagaaaagtttagactcaatcctatataaaaaaaagtcctataaaatttttgaaatcatattcattctttgaatctatctatctatctatctattctattatattattaaaacagctttgaaagaatgcaccacgtccgctgtggaggctagaaattcccacattaatcggggaaaaagaaaaaatctacaccgttagatcataacatatctagactacaagggttgagatttaatcacaatatatgtaaaagcttgactctttgattctgtttttatgaatcggacacgtgaaagagcgtggagttagattttgatgtgtgctacgcagcagcctttgaaatcaaaatcaaattaggaaacttaatttactgacaggagacaaacacgtcatgtctgcatagctaaattagaaataataaatatgcacaactgacacgtcctgtacaaaatcatatgtaggggagataaaacaactgggcatccgaactccttcaaccacatttaagttttgctctatcgcataatctttagagacggtatgttttttagaaaaaataaattctactccctccatctacttttgatagtcatattttcaaatctgaaaattctatttttgataggcatatttcaattcaacaacctatcatcttaatgactttctcggatttgatgcatgactctccattcttccacacaagattggctacttgagcatcgtgaaatgtaaatattaatgaatcgcttgtttacgaggaatgactagtagcatgtttaaatggatgataagtagaattacttatcattggtctgtgtgccaagatgaaatatgactatcaaaagtagatggagggagcaagtaacaagattcccaatagctttctctatatttagggtccatatgttatagctcatactccgagaatggggcagagctgagaagcgggcggaaatcaccatattaattaaaaaagtgaagtatttaaaggatctagattttaatggtgcatattgattgatataattatatacaaataaaatattctatctattatcttaataaagtaatgtaaaaaaagtctctaagtttgctctcgagacttacaaattctcagattaaaaaaaatctaaatagtttgatcatggtcatgcctataaagaagtagagtggtgacggttgatgggaattctaaaaattaaaaacaaaccaaatagaatcccaatgaggattaagaggagggacgacagatagaccgttaagcagtatggttatagcagttggttggacttatagaaagtaaaaaataaacctaatgataatcatgtacaatttttaaaatatcaaaaacaataaggagaggaggcaccaggcgagccgtagatgagtacattggcaaagccattgacggtttggcagaacttctagaaagtaaaagctgaaccaacacgataattatgttcgttttttaaaaccctaatgataataaagagatgaggcagtgggtgccccatagagaagtacagtggcggtgtttaacaggactttaaaaattatggaagagttcatgcaggaatacaatttataaataaaaaatgctagaatgaaaaatatggaattttcaaaaaaaaaaagaggacaatctagaatacaacaatgacaaacgataataaaaatgagaagcaacatgcctataaagtagtagagatgatggttgatgggacatctagaaattataaacaaaactccaaatagaatcccaattaagattaagaggaggaacacagacatgtcgttaagtagaacgttcacaatggttgagaggaggcagcgggcgagccataaaagagtacgatttggcaggacttctagaaagtaaaaaaacaaaccccaatgataatcatgtataatctttaaaatatcaataataacaaagaggggaagcaacggacgaaccatagaagagtacattggcaaagccgctgaaggtttggcgggacttctagataattatgttcgatttttaaaatctcaatgttaataaagagaggaggcaataaacgggctgtagaggagtacagtggcatcgtttgacgggacttctagataattatgttcgacttttaaaatctcaatgttaataaagagaggaggcagtggacgaaccgtagagcatagaggagtacagtagcagtgtttgacgagacttctaaatattgtaaaaatgaaacctaacaagccaacaaactctaaaaactataaggtataatttttaagttttcaaggagaataaatagaaacaatggtagatcgagcaagcaaataacggagatatgccaaaggagtgagtggtagcgactggcgtgacttttataaactataaaagtagaaacaccgggatgataaggttcagtccaaagtcttaagataacgagataactatttgacaaattttaagtaaaatcatatgtaaaaaatagataattttgtatggatgctagccgcgcaattgcgcgggccacccagctagttcctatataatggataatcttatagatattttagaagaaaattagcgagagctccatcctcatgaaaaaactagtcgtgtttttttttctatttaaacaattattcttgtatttttaacgagttttgcaatcttctatttcgtacttgtgatttttgtaaaaatgttgtgtttttgaatcgattgatttcttgtagatgcgaagcgattgatcggccggcgattcagcgacgtgtccgtgcagggagatatcaagctatggcctttcaaggtcacctccggcaaggacgaccggccgatgatcgtggtgcagtacaggggcgaggagaaggagttctccgccgaggagatctccgccatggtgctcttcaagatgaaggagaccgccgaggcctacctcgacaagacggtcgagaaggccgtcatcaccgtgccggtctacttcaacgactcccagcgccaggccaccatggacgccggcgccgtcgccggcctcgacgtcctgcgcatcatcaacgagcccaccgccgccgccgtcgcctacggcctcgacaaggtggtcggcagcagcgacaagaagaagagagtgctgatatttgacctcggcggcggcaccctggacgtgtccgtcctcaacatcgaccccggggtggacatcgacataggcatcttcgaggtgaaggccaccgccggcgacacccacctcggcggcgaggatttcaatggcaggatggtgaagcacctggttcgggagttcctgaggaagtacaagaggccggagatcaggggcgaccagagggcgctccggcggctgaggacggcgtgcgagaaggcgaagaggatgctgtcctccacggcgcagaccaccatcgagatcgactcgctccacggcggcgtcgacttccacgcgaccgtcacacgggccaagttcgaggagctcaacatggacctcttcctcgagtgcatggacaccgtcaagcagtgcctccgcgacgccgggacggacaagggcaccgtcgacgacgtcgtgctcgtcggaggctccacccgcatccccaaggtgcggagcctgctccaggacctgttcgacggcaaggcgctctgcaggagcatcaaccccgacgaggccgtcgcgcacggcgccgccgtcaaggccgccctcctcaacggcgacgccaacgagaaggaccttcgcgacgtggtccttctcgacgtcacgccgctgtcgctcgggatagaggtattcggtggcgggatgtcggtgttgatcccgaggaacaccaccatccccgtaagcaggcagaaaatgtacactacccactacgacaacgagaccgccgtgctcatcaacgtgaacgagggcgaaggccgaagaaccaaggataacaacccgctcggcaagtttgttctcaccggcatcccaccggcgccgaggggcgtgccccagatcaacgtcaccttcagcattgattataacggcatcatgaacgtgtccgcggaggacaagacgacgggacgcagcaacagcatcaccatcaagagcgacaaggggaggctgagcaaggaggagatcgagaggatggtgaagaaggccgagaagtacaaggccgaggatgaggaggagatgaagaaagctgaaggctatgtggcaccctaaagagaactatatttcttctgcgtcttctgatcatgcacgggcatatgtatggccctaacatgtgccttgtttatgctggaagttggaaccatggcttagttggtgatatggtgggagcatattattgaatgccttgcatattccaaatttgggagtatttgttttcaatattgcagaattgcagatggagttgtaccaacataacaaattatggagtcacaagctgaagaaggtaacacgggaatcaggctagaactgggatcgaagcttattcacaagaagaaatacaagttaatgctgcaggcagagacatccaacaaaatgacagtataccgcaaaagccgcaaaccacgttttatagtgtaaagaagttcagaggaaaataatatcgatattgtgttgaaatgcctagtctgagatataaagattattacaaataggccattgcattacgactccatatcatcaaggcaacaaacatcatgatcaacaaagattccatattaccggaactaaatgcccttgtctcgtgcaagtcgctgaagatggtaattgatggtctttgctgcattctttggccttcctttctgagatcatgccacaagcaggaatcagatttcaggataaaaaaatgttttgaataaacaatttgaagggataaaaaaatgatctggattatgacctgagcctgagcacaagcaaccaagagatccttctgtcggacacacttgtcatcgttctgtttgttcaaggccaggcaattgaggaaggaaaccatctcgatcatgcaaggcttcgtgacaccaccgaacttctttgggtttatgtaaagcgcacccgccttccgacccattcttgcactaaaccttcatgtgattgatacatattaataaaaagggtcccaagataaatgggcatacaagcaatgtaagaaatgaaatgtttgaaacaaaaaacatggagaacgctagaaaatggaatacacatttatcatagactgctgttctactaaatactcctataacagtaatcatgttttttttttcttctatgcatgtaaattgcaaaacttttctccaaaagttacaggtgataagtgctgattttaactgtacatagcaatcatagcattagggcgattggaatcgctacatgtacatatcttaattccccttcaaagccagctgtagaaataattacaaactgacacatcatttgttctacgtctattatctccagatataaacccaacaaatccatttagagttcaaaggaaaagacccatttgattctccaattatcatgtctttgacaatctaagcctctaaggggttatatgttcacaggacaatcctgaaatacacctataaaaaggaaaatgtccaccgttttcattttttttcatcaaaaggaagttcacgattctgaggtaaaactgcacttccaaagttcatcctatcaactggatctcttttctctgttaactgttaagcctattagcttgcttttcacaaaatggatctccattgccgatgttttcaaacatgaccagtaattccttgcacgatccataatctattacaagtaaatcccaatcgttccactagaacgatggcatgtaatctccgcttcgtacaacttcttaaactaattatctgcgtacgagcattccgtcgaacaggtcgcaggccccggcgagctgagccgacccagcaggcgctagcacagcaattcctcaacggcacaagaatcgagcgcaaggaaaagcaatgcgccagcgcgagtgctaggctcgacggttgagacgcaccaagcagtagcccgtgcgcagccgtcggcgcggccggccactccacgccggcgcctcccgagaagtccagacgaggctaggtgagtcgcgggacacggaagggtgggggatgggcgggatggagatgcggcgcgtacctcgagatagccgggggagagcgtcgccgtcgccgtcgcagccgcgcagccggcggcgttggtggggaagcggcggcgggaggatgcacgagtagtttctggagaagttgaggccttttctgggatctgctagttctgcttatttttcataaaaggtcctacataaaattgatatttctatatttttgattaaataattacataaaggtctttaatgaaaaaatatggctacggattaattccaaatagttgcgaggatcaatttgaaaaagaggaaaaccccgaaagccctagccgcaaatctcttcctccccattcgccgccgcatcgttcccccacttcgcctccacctccatctccggcgccggcgaggccaggtttgaatcggcggtgctccggtgctcccctcccctcctcgaggcgacaagttccatgggtgtttgcgagccgacaagtacaagagagagcttcacagcctaaacccaaagcttaatctccgcctctctgaagcatttcgtcgagcagttggtgcgggcgctgaggcagaggccatggcgatggcgaaggccaaattgatttccctatctttcgccgacaagtgccgggtaccgctcgccgtcaacctgaactcaccctcctcctccttcctcttcctagtgttacctcggtaagtttcgctttctcttcgcagaatatcctgtgtgcaaattgggaagcgcacctcaacactatcaaagctgacatcaagggaaggtgtgcacgctggacacttcgattcgtactgatcatataatccgcatagttcttgttttgatttttcatctttggggctccttggcagcaagggggagatttacacatcaagggtgcactacatggtcgagaggggcacgacctacttgattgttcccgaagacgacaggcacaccattgtaatgctatagtattgatgcttctcttacttgcaatgttcgatcaatccatatagtgcttgttataatgaacgaatgtgttgcttgtgtgatatccccaatttgatagaacattgtaatcgacgagcggggatctctctcggtctgcagcccaatcccaggccgccttactaccttgctcagatcactcgggaaggtagttctataaatcccgagaaaccacaattgctatacaattgttcttattgcctttttcctttatgagttttgttacaattggtggtgatcttgcttttctggtgtagttgcctcctcgaatcgctatgactggtgatgtgctgttcatgaaaaggtctaaggtacacaatgttctgagtgcctgcacatggatacccatatgcatgattgcttggtactccctccgtttcacaatataagactttctagcattgcccacatacatatagatgttaataaatctaaacacatatatatgtccagatttattaacatctaaatgaatgtgggcaatgctagaaagtcttacattgtgaaacggaggaagtataagttgtaaggtgatattgactgcttcaactattgtgcttaaggttccagttatcgccgatagcctgaagaaagctattctgaaggaacacaaagctgctagtgaagctagccatagtgtgtcagcaatattatcttctgcaagtgctgcatgcagatcacggagcgaaggactcctcagtttacttgaccaagggagctcctacaatatcttaaagtttgaaattgggtatgtacttcatactctcgtacttaatgatattaattttaggtcatcacaggagatttttagtagttgtcaatgttagtagttacaagccgctatttgtaatcgtgaaattatttccgtgcagttcatgtgtctacatagattcgcttgggagcagccataaagttgatttggataactttgaaccaccaaaagcagatctgttatgtaagctttctacttgatccattaagctatgtatctatttagagttgactgctctaaacaattattgttccttcgccttctcattttgcagtatgatattcactttccaaatatatatatattctcctctgtagtgccattctctgcgaggattattgatggcatcaaccggagtgacccaagacggagagcacttatctttttctgcttcgagtattttaatgtcactgcaacggtaagtgatcatcatatgtatcttaagttctggttgcaatgtaggataactgtataccacactgatgtattttcttatatttgaagggttttctttcttgtgttcgaaattaagaccacctattgttgtacaactttactactgttgactttgatcctctgtattttgttgaaggacgcactcttgctctctattgatcaccatggatttgatgtgctcgccaaggtccctgaaaaagcagtgctccttgatgtcccacgacagtacgtctggagagagttcaggttttcattcaaagaagctgccaaggatattgaggacttctgccgcatgttggttgagttagaagaagaagctctccagagtatgaagagctatagcgggttataggtctaaaggggggaagttaacttgtttttactacgttatgtaacccgagaatttatgatgtctctcccttatcttttctgattggaggtacatgcagatcgttcaatagattttatcttatgtctctgcatcatctttactgattggaggtcagatcgttcacaagattttgccttgttctttgttgtgcacgggtcacaggttgataccgtccaattaaactag

SEQ ID NO: 66835 - DNA, 2452 bp, Oryza sativa
aaaaaagaagaaaaaagagcaatggtataaattgctactcaatactatattaataaaaccataataatccaaactttaacaagtaaagcaaaaccggggccataatgaaagcccgtaccaaaaaagttgcaggagcactcaagaattcggtgtaaaacgaacgacaaattattgcaggtataactaaaagcgataaaagatcgatcatttagtcgacttcctcgatcttgggccctggtccgctgcttccgccggcggccgccggagcatcctcgtccatgcctccggccatgtcagctccggcgccctggtacatcttggcgatgatggggttgcagacgccctccagctccttcatcttgtcctcgaactcctcggcctcggcgagctggttgctgtcgagccagctgatggcaccgtcgatggcgtcctcgatcttcttcttgtcggcctccggcagcttggacgcgatcttgtcgtccttgatggtgttccgcatgttgtaggcgtagttctcgagcgagttcttggcgtcgaccttcttcttgtgctcctcgtcctccgccttgtacttctccgcctcctgcaccatcttctcgatatcctccttgctcagacggcccttgtcgttggtgatggtgatcttgttcttctgcccggtggtcttgtcctccgccgagacgttcaggatgccgttcgcgtcaatgtcgaagcacacggtgatctgggggacacccctgggcgccggcggaatgccggagagctcgaacttgccgagcaggttgttgtccttggtccgcgtcctctcaccctcgtacacctggatgagcacgccgggctggttgtcggagtaggtggagaagacctgctccttcttggtggggatggtggtgttcctggggatcagcacggtcatgacgcctccggccgtctcgaggccctgagacagcggcgtgacgtcgaggaggagcaggtcctggaccttctcgttgccctcgccggtgaggatggcggcctgcacggcggccccgtacgcgacggcctcgtcggggttgatgctcttgcagagctccttcccgttgaagaagtcctggagcagctgctgcacgcgggggatacgggtggagcctccgacgagcacgacgtcgtggacggtgctcttgtccatcttggcgtcgcggaggcacttctccacgggctccatgcacttgcggaagaggtccatgttgagctcctcgaacctggcgcgggtgatggtggtgtagaagtcgatgccctcgtagagggagtcgatctcgatggtggtctgggcggtggaggacagcgtcctcttcgccctctcgcacgccgtcctcagacgcctgagcgccctcgggttgcccgtgatgtccttcttgttcttcctcttgaattcctgcacgaagtggttcaccatccggttgtcgaagtcctcgcctccaaggtgggtgtcaccggcggtggccttcacctcgaagatgccctcctcgatggtgaggagggagacatcgaatgtgccgccgccgaggtcaaagatgagcacgttcttctcgccgatgctgctggacttcttgtcgaggccgtaggcgatggcggcggcggtgggctcgttgatgatgcgcatgacgttgaggccggagatgacgccggcgtccttggtggcctggcgctgggagtcgttgaagtaggccgggacggtgacgacggcgttcttgacggtgcttccgagataggcctcggccgtctccttcatcttgttgagcaccatggacgagatctcctcggcggagaactgcttctcctctcccttgtactgcacgccgatcatcggcttgtcgccggggccgggtagcaccttgaacggccacagcttcgcgtcgctctgcaccgacgtgtcagagaaacgccggccgatgagacgcttcgcatctgcaaacaagcgatcgagtgtttcagatcattgatcaataactttgcactgaaaattgaaattttaagttttaactgacaaaaccgagcagagcaggtcgatctaccttgatggtttcactaacaacttattaagtaacactaaatttaaaatttaactgaccgaaccaagcagatctatctgtgttgatgggttcaggacgatgatcaagtaacaacttagcactaaaaatttataataattaactggccgagccaagcagattgatctggtacgttgatgagtttcatggcgatggtcaactaacaacttagcgcgaaaaaaattgaatatttaattggccgagccgagcagatcgatttagtagtatttaatagagacagtgcggcgatgatcaactactaacaaacaacttaataaagccgagcagagtagcgtcgatctagtaattaataaagctgccgatgggttcatgtcgatgatcaactacaacagctagatatt

SEQ ID NO: 66836 - DNA, 9885 bp, Oryza sativa
gatgatctcgacgcggtcgtgctgccacacgccgacgcacgagtaggtcgtcccgaggtcgatgccgatcgccggcccgtctcccttgccggccatgatctccctctccctcgctctcgtcgaaagctctcaagcgaaggggaaaaaaactcgaaaaggagaaaatcgatgcgatctgaagatggcaggagagagatcgatttgtgagtggacgagagcgaggcagcgatcgttttataggtctgcgtggttctagaatgttccgtggaccggctggaccgtcggatgcgatccggacggtggttggaggggcggcgggttcgtagcggacgtgggaaacgggcgactttggagagtttggactcggccgcgcgttggagacgcggttccagagatctccggaaggttctagagacttgagagttgagacccgttgggccggtaacgatcaatcgttttggtacggggctatggcctctgccagcttgggccgttcgatgccgatcagacggatgggcgggcgaaccgccgggtttgaccgggattttctgcacggttgaagtcggccgctttatgtactttgcctgttttagggcttatttggttcagtgccctaacaatttttttggtagtgtcaaaatatagataaattttggtgctatcaattatttgatagaataaatttgtattcatcttatttggtttgctatcaaaatgtagccaaattgtgataccatagcgaagaaagttctagattgctaccaaatttaggatgggcattaccaaaatgttggcatcaatccaaacaaatggtgggtactatttaggctaccaaaatattggtagagcaaattttggtagcaatccaaaactgccctttgttaccaactttttcttcaaacttctaactttttcatcacatcgaaacttttctacacaaacttctaacttttccatcacatcgtaccaatttcaatcaaacttcaaattttgatgtgaactaaacacacccagtggtttattattactccgtagttggcaggtgttatgggaacatattactgcttactgtacaaattatttccatgtgtacgattttttttttgaagaaacatgtgtacaaattttatggtatcctataggaaactaggggtttctatgagtgaaaacagtcagaaatgatagtatcttttcgggaacaatactcgatcagtcggtaattgatcatatttattattttaactacttagggttaatattagtacgatgtataaagaaattagaaaaataaaatttatatagcaaaaaaagtaacagtcagaaacaatacccttttgcataaacggcactcggttatcgggaatttccgtgatcattttcgttcctaggggtttccatgcatgcaatttagcgttgaaaagatgaattagatttgtatacaactttttattcctatttccctattgtagttatactccatatatggttgatattaaatgtgagattggattaacgtacacctcttctcttttgtttctgatatacaattgtatctctatcttagttgcagaccacgccgaccatacctaattttgttatcttgttgcaaacagtgtgcaacgataatgactcaaaacatgtttaacctacgtcattgtgcatgacacttagtaagttgcactacaatttatatatttgttaattttagaattttgcggtaaccggggctgaacgaatccggttaatcggctttaactgccggcgcgtgtatatgtgcttggttttcgaaatttacgagatcttttaaagggtagattcgatccgtgccattacaaatttgtttattcaaataaatatcattacaatttgtttattaatcgtgccactgaaattttacaaaattcgaatggtaccactaccatcacattttccatccatctccatcttttttttttccgttttctttcttctttctaccggcttcttcccttgagcttgactggcgagaggaaagtgacgacgatgagcttgaccagcgacgatgatgatgagaaaaggaaggggaaggattaggctgggcacgcgtgttaggtgctggtaaccttgaaattcgggatcgaaatggcggcctcctccacttccgcgttgatcggcgggtgacctgctccgcttccgcgctcgtcagctgtgaccttctagcaccaacaagaaagaagacgtgtcgcaccttctgtcacggccacttgtcttggatctcctctcgccggttgaagaggacagggtttgccttctggatctgctggcatcaaccgccaccctcctcgtcctaccccttcctctaaaatgatgtcactgttgccgtggagctcctcctcctcaagggtgtgagagattattgggcggcgtgatcaactcatcaagaatataagaagagagagggaataagacagaaaaggaagaagatcgataaaaacatgatggcagtagcacgatccctgtaaatgatatggatattcatatttgcaatgatatggatccaatttaccctttttcataaaatattttgttaagcacgaattgcacttaacaaaagaaaaacggatgatactagctactcccaccgagaacacacaaattatgcacggcgcgaggcacggacgatcactctcaggatcctctgacttcttgtaaagttctgatgtggttacgtgtctccaaacaggccaagagcgtcggactccaagcagatggcagctcggctcgaactcgcgtggaaaagtcgggcaaagtgtgtgtggacagaggacgagtaggaagcctcgttgcagccactacaccgaagatcccgcgtggaaaagacgaaggccctgtttagatgggactaaaaaacttttaagttcctatcacatcggatgtttgaaaattaattataaatattaaacgtagactattaataaaacccatccataatcttggactaatttgcgagacgaatctaatgagcctaattaatccatgattagcctatgtgatgctacagtaaacattctctaattatagattaattaggcttaaaaatttgtctcgtgaattagcttttatttatgtaattagttttgtaagtagtctatatttaatactctaaattagtgtctaaagacaggaactaaagttaactccctgatgtaaacgccaccgaaaagtacgtcggccatcgtcaagtctactactccagtcagcagctaacaaggccagcaactaaacaacactgcgtcgacagtgccgccgtgccatctcaccctgctagcctgctactgctagtcttgcacggagcattttgggcatcaactcttggctaccggcccgttgcgtcttgcctgcttacataggtggactcttggtgttgggccgcatcgtttgccactgatccaacaacagcggagaaggggagaagcccggaaaacctcagcactccgcacttcagcagcatctgcatctcccatgttcaggattgatattatttttaaccataccattttttaataaattgctaaaaatatctatatttagtttgttaccgaactttgataaatacataagaaattctgttaaaattttagtaatattgctaacttgctaaaatttaacaggtaagatttattttggctactatcttaacagtccctcgcccctcggtgtgttacctgatgcatccggcagaagaccacagagacgagctcactggctggtgacgatgacctaatcgtcattgcgagtcacgactgaggaagagatggaattatttggttgcctgtctgctcgatgcgaaatgcagtcactcgcgagagagaacgggaaagtacgtctcgtgccgtctttgctaggccttaagggcggatgcggcccaggtaaactttggggcccagcatggaggacccgtataagactgcaaagctaccaacggtagcagtccgacttccgcttgttctcgtgggcgaggaatggaggaacccgtaataatactccctccattttttaatagatgacgccgttgactttttctcacatgtttgaccatttatcttattaaaaaaaattacgtaattataatttattttgttataggttgttttatcactcatagtactttaagtgtgatttatatcttatacatttgcataaaatttttaaataaaacgaatggtccaacatgtgagaaaaagtcaacggcatcatctaaattggaagacctgctgtatctactagtttttttttcaagcattataaccggattcgctgacaaatttgagagacctaaagtgaacttattatgctctaaaaattatagacagcccaagtaatctccaaaaccaacacggacagcccaatttgggtcgttgttagtacctgcgatcgagttcgccggaacgtcgtcccaatcggccagtccccgtcccgcaccgtatttgtgcggttttagttgcgagcggggcggtggtttggtggaatggtggtacgcgaaacgaaagcgacggccgctcgcttgcgttatctttgcttgccaacccggtgattgacgggcacgtagctagctaggccgggtccctctctcctacagctcgaattcttgcatgatcagatctgtagtatctttttttttccctacgtaattagctaagctatatactccctccgtcccaaaatgtttgacgccgttgacttttttaatcatatttaaccgttcgtcttattcaaaaaatttaagtaattattaattctttttctatcatttgattcattgttaaatatgcttttatgtatacatatagtttacatatttcataaaagattttgaaaaatacgaatggtcaaacatatttaaaatagtcaacggcgtcaaacattttgggacggagggagtatatatctcgtacgtaattcactgccaatgcgcgcggcttcaatgaactcgagtatttccttttaattttatgggactgtttatatatctgttgacagaaaatcctacctcccatctttcaaattttggaccgttggatatgctttaggattcgtgcacagctttaaccctaacttttttctcccattccccacctcttcgcgcattttgccgccgctgctaccctcgcgcgtcgccaccgcccgatccccgccgccaccgccccaccgcgccgccacccgcctcgccggctagccggaaggcgtcaacggcgccgacgaggccccccgaccagcctcctcccccctccttcctcctcgagccgtcggcggcgagatgcccccgccaccacgccggtccaccgccgtcctctagccttgcagctccggcgccgccaccggcgcctcgccgccaccggcgcctcgccgcccacccgatccacccaccaccgagctgtcgtctcccccgaccatccctctaagcccagcgaactcccccttcttcccctccccctcccacccttcccagttcccaccccaccccaccccaggaccctaattcgtcggctcttcgccggagtttgggtcatcgctggcgccggagaagaataggagtttgtcggagttggagaataagcaactggagcacgaatcgcgaagcacatccagtgaaccaaaatttacaagatttggaggtaggttttctgtcgattgaagcttagcaattccgtaattttatctcgcatatgctccattattgccgcttaaaactgatgtgaaaaaaattagcaaacactttagttttgcctcactacataaaatcttccataaatgcccgtgcgtgtgacatgtaaatcgccttaagcaagattctgtcccaataatctttcgaaagagaacggtttgctagctttagatcgctgtctaacggtagctatcagatcaaattcaggtccggcgcgggcgacgacactgcaggtttacgttgacgcgccgcgaaaatgcgtaggaacccggcggcccggtcggtcgcttaaagcctaaaggcgccggccggccacgaactctctctctcgcgcctttattccctccttcccttttgcacggcggaccatcagctgagagagccctacacacactgctaccaaccccttcagataacctcccccttcagccaatccggcgtccgggcggcccacacgcatcgtgatcgcacaaacaaaatccatgttttctcgcactgtgcggcaacagcggaagatcgatataataccattcactcctccacaccaaatattccccctgcagctagctagctttcagtctttcagtctctttttcaggtactgtatatctaccagcacacagctgatgcacacatccagctgagctggccgtacatcatctcctgcaaaagctctggaaaaagaaggatagacgatcgtggaagctgaaattgctttccggcatttgcagcttagctcatggtggaagctcgattgccgggcgggggagcaagctcgctagctaggcggtgaaatgctgctgcagcagcagcatgcatggctagctagcccactgggcctgcctgaaaccatggctgccggccaatcgagatctcgttcccgcgcgcccttgcatggcgtgtgcaaccactgtggcgataggggccatggctagctagctggttagctgcaagatcaaacgtactacgccacgggtgacccacgcgcgcgtgttcgtccgtgcgtgggtgcagcttgcgcgtacgcgcgcgcgccgagactgacagaccgaccacgccgcgggtggcccggccggccgaacagcaagcactgtccttgtcgccgcgctgtccgaacgtacagccggccggtgagagggttagctagatggagggaggcattggtttcggtttcagtacctggctacctgcgtgttgcattgcgttcggcaaaagaggtggctgacttgacgcgacctgatcatcagtcgggctggaaatttaatttgggttcttatataccgatgcatttttgttgctagctagctagccgaactgtttgggtacatttgatattttgatttgtttactatcgcggccttagtgtattgttttcaacaggttgactatgccgtcgtacgtgcatatcggcatgttctccttaattttgccccgttgtaacagtacgatcaagcatcgatcccaagttcccaatccaactccccggccaatctgacaaagtcgcggtgtggggctaattaatgccatgtcatgcatggaaatatggaatctggatcattccaatgtttttttaaaaaaaagaatataaaaatattgaattcccaaaatagtttttatgatctcctttatgctggaggaacagccataacaaaggctgcagttctaagaaaggcaaattcaatgatttgtcactcaaagagctaggtttattgttcatttttagacgactagctagcatatttctagtgtgttgcaacggatttttattttgaaaaaaataacatattttttatggtgaaaaataacattgattgttattaatccttttttccatcactttctaaatatatcaagcttaatgtttgcatgtctttcaggtaagaggtggaccctctggtccaatattacatttttttccttttaaaaaagcccaaaattttcctccaaagtttgtatttattatatttaaggatcatcggatggcttgaacagtgaaataaccgtcgcctttgtgatcagttggagcagcctaattttttctcttcctaaaagaacttaattacttttttcttagcttagcctaagcccaggacggttcgacccattttccatccaaaaaatccatgtgtctattcatataatatcgttactaaccgctaaaagatctagtggctgtttggatgctatataataacattgccactatttaccatattttttttgccatacttagctaattaagttgtggctaataaaaagtgagccacgctttaactagaaaaaaaaagagtgtgccatacttttttgagttgatgccatgtgaaaccatgagaaatgagaactaatcttatcataattaagtgtggccaagaattaatcaaaatatgagctaataacttggtcaaagtgtgtggtaaccggtaaccttagccaatgtttggcaatgaaccaaacagtcgtttggtttttcttgaactcatggctatagacctcaatccttcaatgcttaggttaatataataaaatatatgttaaggtgcacatatttattgcgctgacagtagcgtcatgcttcgagtactcccaacaaagtagaaaaatattgtattggccatgacaaatttgaaagacaagtgtaaatataatggtagtcatcacttcacaaagttttttgaattaatgtatatttgatatatgagttgagaaaaaaaaagaattccttatcgcaggaaggatatatatatacaaaagaacgagaaagtttccaaatgaatttgttgctccatattttcttttcaaatgaaattttttggactagtggatagctatctgcataccttttcatgtattggggagcatattcccctgccggaacaactgatgaaattccttcacaacgacatgtggctttgatacctgaagaacattttataatactaccccagaagcactggctggctagctagctatagttggagtatgtattacagtattagggtttctgaagcttcttcttttttttttgcatcaactcttattagcttcatatatttatctgaacttctgttcacgctagaaaacaaaccaaaaacagtcacccctcactagtcaccacctatccagccatttcttgccatctcagtcccctctgtatctccaccagctggttttttgcattcaatttttctgctgagcacaatgctaaacgagtacagtcttaaaggctaagcaagctttaattacacacacacacacactctctctctctctctctctccaaacattcttcccaaccccacagagagaaaaaaaaaccccaagaaatataaagccaccatacgcttaaaaggagagaagataaattcatgcttttctcctcccctttctctttcttagtttctctctctctctctctctcctgtcttctctcctgcagctgctggatgtgattctccaccacctcctccttcctagctagctagccagagtgagtactccacaccaccacctcccctctcctccgtttaatttcttccctcccagctagctgctgcagcctgcagctctcgccttgctttcttcttctctttccatacacaaatccccaacaaagaaaagtgcgaatttataaagaaaagatcagaattcaaagcagaagtaaagctagaggagataggggtggtgaggggaggggaggaaatatatctcaccactaactggcttccatggtgttcccttcagtgcctgcctacctagatccacctaattggaataaccaggtacttttgctgcatgatcttaaattcttaattgcttctccctcccttcttctccatcgaactctctcttgctagtgctgaattcacagcttgttcatggcaagagaatttttttgcaccaagaagcactgcagagagatattcttgtagtgttcttgaatattcagagtcaatatattctctcctaccttttctctcatctctgatctataacaatatgcttaattgcttacgcttatgtttatgtgtgtgttgcagcaagggcagccgcccaggccggcgaacgtaggcggcggcgatgcacagcacctgccggtcgggccgaccgcagctgcggcggcgccgggcgagatcggggggctgccaacaagcagctcgtcggccagcgcggcggcggccgcg

SEQ ID NO: 66837 - DNA, 3927 bp, Oryza sativa
ggcgcgatcatcccgccgtcgggcctcagctccatgtctcaccacctcccgttcttgggggcgatgcacccgccggggcccaacctagggctaaccttctccgccggattccagcctctcggcggcatgcaccaccacgtggacacggcggaccagttcccggtggcaagcggcggcggcgccaccattggcgcgtcactcgagcagtggagagtgcagcagcagcagcagcagcagccacaacagcatcagttcccgttcctcggaggagcactcgagcttccgccgccgccgccgatgtaccaactgggactggaagctactcgagcagcaggcaccggagcaacggcggcggcggcgttcacgttagggcagaccagtgctacagccaccacgtcaaggcaggaaggttcaatgaaactggaagatagcaaagggctggagatgagcctgcagaggcagtacatggcggctctacgccaaggagatggtgtctggggtaacaacaacggcggcaatggcggcagcgacggtggcggcaatggcggcggtggcagctggacaatgaacttccctggattccattcgtcatcaggcggcggcggcgatgatggcggcggagtgttgtagtacactacttctagctaggtcacacgattgatctggctcatcaacaattcgacaagaggtttttctaattaatttgcatggtttgagcaaatgcaaagaggaggcaaagaagaaaggagggcttgacttgagtgttaaactcttcatcaagtagaagcacacggctagctagctcatgatgatctcaggtagggtggtttaagttaaagctgctctttagttaacgctttttttccgccatttggttttgaactcaaaggtgtgccagtgttgtgtccatagtgtcgcctttttcaacttttttacagtattgtttacagggggttaatatatataaccaaacgtggtgcattgggggtatatatgatcagggatatagtatttgacttggagagattggagattgatcaaattacctctcattagttctgcaaaaacttgcatgaaattaatgtatggtttgtgtgccctttaatgtttatggtcctcttcttacaagatttatcaattacttatgcacctgaacttttgtgggttcaaagcatacacacattccttgctagccttttggtattgaataggactgtacgtacgtatatagcagtgcatagcttttgaatgcatctggactgacatgcattactacctgaaattgaaggcaactagctagtacacgttaaatatgcaacttaattaccgtatgcatcatgtggtggtgctaaccattatagttcaaacataggagtatatatatgtatatacagagttacatacattaattggcatgactacttccatcagctagtgagcatataatcgtatattcaatatctatatatgcatatctaaatcttctcatattcttaatggaaaatgtaaggagagtagcagttcaaaaatctgtcatatgctcataagccatatatatggtgaataaatgcacgcctagttggctactgaaccatttgtacaaaatcgatctcctggtaacgcttcacttcggattaaaaacagctatggtgatatgaatttcaaaatgcaagaagatttctgatcgaatcagtaaccattacactcaattaagacacccctccattgaattttgtaaggagtatctcaattcaaaaggtcaaacactatagattttaaagttgaactacaatcgatcaaaatatataagtgcattcagtgtataaattatacaatggatttatatttcaaagtgcttttacaaaatgttagttttacagccactaagaatatataagttttataatgtaagagcaaccagtggtcaaactttaatcttgctgactttttcataatttaatactctctccatttgacgtataggacaagattaagtcaaactttaaaaactttcttcaattttatagtagaataagtctaataagtttaagatattgtgatagtattttccaagataaatataaatgtaccatttaaaaaacactaagaattcgagaaattgttgatcaattgatgatcaaagttttaaaagttagatcaaaccttatcctaaatatcaatgcacgaacaagaggagtacaccctatacaaatcaacagaggtagtttttcctttagaaaaagaatcaatagatatataggtggtcctgcaggattcataggatttttcaaagtttccttctagactactatctcgttctcatagatatcatcctagaatacacacagttaaacctcgaaaccttaaatgattaattaataaaaatatattaggatttggcatcaaaaaactaatatcaggagctattcgttataaaaacactttcatacatttatattttaacaaatttaaaggttgtgatgaaacatgtgcattcaagaccatacgtgtcaatgtttcaaacgagaagtagaaaataatggatgcaatatcttctatttgatccattatttagcacacaaaatgtttatttatgggagtatatatatatatgtgcgcgcgcgcgcgcaacaaaattaattaaaactatctagctagagccatatatatagtagagtaagtaattaagagtttttcacattgaaatggtgcatatatagtacgtaaactgtagtatagaagagagtgcaggagtactttactagcaaatactcctatatagtagtatttcgccttgggcaaaaaatatacacacatatatagaactcagtactggtctcgatcgtgcatgtgtgcatgcaagcttttcctcagttttttgcagtgccagtgtgcaacatgatgtaacctcggccggtcacaaagtgccagtaccaccatgattagattatgattggaaatgatgggttttccttattgggccgatatatgatcacgaaaacacacacacacacagatatatatatatatatatatatatatatatatatatatatatatatatatatatatatatatatatatatatgcaaccatatacatgtatcaatatattcacttttcatttttcacacaactaggcacagctgcatcccatgcatatgcatgatttgccatcgggtgctcactagttaattaatgcttccattcgtactcttctgaacagaaaaaaaaaacaactactaaatgtcatgcccgttttgatgaaatcgaaaatggtgaccgaccacattcatcttaattgcgatgtgcaaacgccagcgtccgtggatagggatgcatatgctcgatcggtacatcgtctctctaggaagggctagctgatgccttgtctgctctttggagcacactctactgctcggtgaaagctcagtgtgtgtggccatagctagccatagctaccatatgcacaccccgtgtagctttgtggggcattttggccggctttgccatctatccttggatctttttcagtagagctggctggctggctgtagctagacagagctagggcgctgtgcatttcgctttgctgaaaagaaatggcttttgaccaacctggtgcacattcatgtccaccaccggtgatcgatcgatcgatcggcctgtggtgtgcaaacgacgacgacgactgatatttccgaccatctttcgccggccggcgaggtgtacgttgacctagctagctggattgttagagggaaataaattaagctttaatttctctctgcagcttcaattgatcacctccacgatcgatcgatatatatcaaatcttcttgcagcactgttgtacaattaatgtcgggaaggcaggtattctgcctggccctaaactctgttgtcagggccgttaattataccttt

SEQ ID NO: 66838 - DNA, 18269 bp, Oryza sativa
ggacgggaggggtcggcgcgccgttgacatcggcgtgtgcgggtgcggcggaagctgcgggttggtcggtctggctgacccgtcacgccaaaggtgacagtgtgacacacacccctgcgctgcgttgggggggcctgtggttacttctgggcagaccgcataggctaacacgatggtcgtcggagatagctaaagcagttgatggttaatactatacggagactattcaactctgttatgcacgatgaaagaaactgtcataatgattatcagttcaaatataggctttgctaacgatccaatgagagttgcaaggactttggtatttttattttagtagtatatattaaaaatgaacttttcagcatttgattccttactaacatacaattgaaaattatcctataaaatcgaagtaagaggttgctaattagtttagattaatccttaacggtcgagtaaaaaaaacataaagaatattgtaacaaatggacattataacattttcattacttcttcaaaaagtgtttcttttttatgtaaaaattttctttccttgtaattggacataatgcataagaagggtttaagctgctcagtaattagtatcatgtgcttgtcaggttcgtacatagatcctccattttatatttgtaattgaaagactcctttgttgctaaatactcctcaattgcaggtaataattgcatcactggtacatctacaaataaaaaatttagttagcaattatttgaatgcccatattgtatattatatatcgacaaaaagaaaaacgttgggaaaacccctcttgataggttgcggtgctctatctaaatcaagctagttaattgctaaactgcttaattattgtaatcacctccacaacaccactgatacatcttgctagattagatcttttatctttcaaggggattaatatacaatctggtactagcttttatttgtggggggagaaaagggcattaatcacaatctgctagtttatttttttttggggggttgtctggtagttataccacgcaatgatgtaatcgaaagaaatagatgctctgttcagtcactaaaaccaatcttttggatttacctctagtcgagtgacttaatttttaagctcgaatatgttctattattcatgttggataattcaaattgtactagtaatttattttataaactatacttctaccatctactcctccatcctataatatagcaacttattacgggatgtgatattttacagtgcaacgaatctggacaggaggatgtatagattcattatattataaaatgttacagcagttactaggttgctatattatgggacagagagagtaatagttttgtttcattttgcgtattactaatataccatgatgataaatctatatattgggtacaacaaagtccaaaacaacctttttttcctcatactgtaccttatccacattttttttctctcaaattgcaatcagaccacagtccacatgtgcacatgatactatatacatttccctcattttgtttacaaactagaattgttgtttgggtcgttgcacatgaaaacaatcatagatttcacaaaagctctataggcctaatttcacagcccctaccagtattcacgacacactggtccctttccatttatgcctcgatttatttggcaggtggccggtgctatagacaaatgcttggtagtgtataacacggttggctttggcttgtgaagtgtcaaataccaggacggccggcccttgcatgcgtttctccgctgtacctagcctgcaaaggtggactagtgctcgtggtggatggaagtagtactcgtacagtcgtacttggctggcatttgggtggcgaaacaactgaacccatccgatcgatctgtaaacccgagagaaagaggagtggacagtgtgtctccagcgagcacgcagtgacaccgtttttacatggtccaagtctgtgctaagccatccactgtttttccttatctgtttgattaatgattcacccgttgacaccgttgtcgacgcgtacgacagcaatttgtccccattctcctcctgagtcccgaatacacgggataaggttgatattccattaccagtctaaaaaaaaggttgatattccatttggagaactgccgggtgaaaatagattttgtttacggtttttgattagataacggcctattaggaacatcatggtacaaattattagtgctgtaattaggtgaactcgtaaaatcattcttttttttcaagcgctagataagttgccttcccattgaaaatgagttctgtagtgaccgtcgacttgtaaaaatgcatttcattcatgcctacgcatggtactcgttccaaatccataaactatccagatcccttccttttttcagttttgtcccttgttcatgctgacctgcatctttgggtggggacagattgagcacttcagctaaaggttaggcatcgtgttcttgatgaaccagtgaagctagtgggcaaaaaagccatcgcctatctccctgaatcactgagaggctgagagctacggaatggcatatcttagtcaccaagtaaaacgtccacactggtaagcttcatgtatgattaagaaaggatacctccactgagctatgagatgggcgatggcttttttgtcctccaagtgaatgtacctctattttggctgttgatcacttgtacggtcatcaaacttcacgtcttattctgccaaatccttgaacaggtccatgcaacattgatttgagttggtgttagaactagttgagggagggagcccggccagtaatatgcataggtatgggggattagggccggtcctatgattttgagggccctaggtgaacttatcgtgatgggccctctaaactatataaaaaattttgtgatatatatagacgctaattttacttgcaaaacaaaaataaatatatccatatattaaatttaatatgtctggtaattattgagaaataaagtcgactaaaataataccttagaactaatatcattaccttagtgaaaaatagaaccccatcatattcattgcttcttatgaaaagatacttctttggatatttcttgatgcaaaatcatcaagaacggtattaagatcaatagtgtccaagatatcattctcgatagagcacataaccaagccatttaacctttcttgcgacatagttgatctcaaatagttcttcaacaacctcaattttgataaacttctttcagctgaagctaccgtcataggtacagttaagagaattcgataggcaactgaaacatttggatagcaatctgtatccataacagacttcagaatctcaggcgcggacatcgaagattctgactaaaaatcattgatctaaacatcggatgagttctcatgagtaagggcccctttgaatcacagggtagaaaaaacagaggaataggaaaaacacaggattctggcaggaattgaagtgtaaaacagaggattgcaaaacacatgaaaaacacagaaatggtcgtttgattggagcgcaggaaaaacacaggaattggatgagaaagatagactcaaaggaaattttccaagagattggagctcttgctaaattttctctaaaatccacatgcaatgtgccattccataggaatttcataggatttggagagcttcaatcctttgaatcaaagggccaaataggatagtttcctataggatttgaatcctatgaaattcctacatgaatcctttgattcaaaggggccctaaatgttttcgcaaaaatcttgcagtgcgaccaaagatctacttcatcgaaggattttaaatttttagagttggccccccaccatcatgggcccccggcggtcgcctcggctgcatagggccagggccggccctgtgggggattaggcaaacccaaagcttgaagactcgggaactcgctcgggttaacaaagtggatcgtagcattgtcaacatctgacgatcgtattaacctttcatgtagtacggtttttgtctaggctataaaaaactgtagatatactacaccattgcggcattgcggtagtcggtagagacaaacaagtttgcaattatcgcgtgaccccgagttcggtggttgacatgaacggtggccactggccaccctttttgtgctccagagtttagagagctactagtacagttgagttgaaaagggcaaaatgtatatttgccaatacgacgctactccgtcagataattcactggcagattatagacaattcaagagggaggtttggccgtgcgggagtgtttctttaccgacacatgcatcggcattcggcaaaaccacctgctacacccgtgattcatttcaggtggatcttcttgttgctttgccacaaataatgtcctaactaagagcatcctcagcagatgcgctatccagtccttcgtataagaaatagcgcatgaaaataaaaataaacctctagcagatatgtcatcacattcttaaaaaataacgtatccgctaaacatgagagatgaatgccaaatttgatattcctctatcctcacgccaaatcgcaacgaccatgtttgaatcgagctcccgtcctcatcctccggagttccagatcaaccccggcatgtcgttgtcgtcgtcgctggccaccaacgaaaacgagtccttaatgacgatgcagagggtggagagggagaggcgtaccagatctgggagctcccatcgcccccttgcacccctccacgctcgctaggtgccgccgacgggctcgcttaagccgtccaccaacgtctagcggcaccagctatcgtcggccggcgtctctttgcccgtgagttgttgacgtcgcccctctgcgctcaccgggtcaccgacgggctccgcgatgcggcgcctactctggtcgttatcgacaccaagatgtggcactagctgccatcggcgcacctttgcctgtgagctgccactgtcacccctgtgcgctcgctcccacttcctgttggagaaggagaagagattgaaggatagaacagagagaaaagtagagaggaagaaaggcagtggaagaaaaaagaggaaaggtttggatttgagaaaaaagagaggaacaaagcatgcctgttgctaaactcttgttgtcaccttacttatcttgatatgattacaaatatgtctgttaaaatatactcatttgaaagattttatgtgataaataacattgtaaaaatttagtcgttcaaaatataacccctgtagaagaaaataacacaaatatattattagttgaaacatattactcgaatagtaggatgttatatgaatgatatgttggagtgggaagagatatgaaggataatttttttatgactatttatatgaggatatggatgatcaaatttggacgaggtgttgggatactctaaaggctttaatttggattggtggtaatttttgtctaattaatattttggtagtgctatatagtatgggtaaagttggatcaaattaaatgtttatccggtactatttaaaattgccataaaaattaggagggtaaaaattggctcttagtccaaaacaggcctcagctacgaacgatggcagtgttatcctgtctgagaaaaaagtagagtgttatcctgactgtcttttggcacgagaggaaagacgctcgacacgtagaataaggtcatcatggtctgatggcgacactccatttcgtcccactcaaacctgttttctgaagatcattttgcacctcaaagcgaacgaaccgccgtgcaatttcttctaccggttattatataacgtggactagtgtgtgtgtcgagtagaaacttgttcagtcaactggccttggtgactcggggtcacctctagctagtgaaaactttgtccgttctgccggcgggtgaaaagtgctttgtagtatgatatctatctagaaagttacttcgtaccacccgtttgcccgtatcattatactgtaaatgtggtatggccaaatcgtccagatagctaatttattctaggcacatttctgcattatcatataggcaccggacagcttattggtattgtatggaagtatgacgtgtgcacataacacttgcaatagaaaagaagacaataccatcatcaagtctaaagacaagataaaagaagtggaggagaaacgaattccggcgccattgataggatggagtggttgacgatgacgtcaggggacaccatgagaccaatggtagtgagttgtggtcacgccttaaccaaataggagtatatttttagctaacagtaacaatattaaacacatgttgcaactggagccaggtgtcccatgtgagctgcataagtgagctaactaatcacctacttatcgtacggcttccatccataatactccagttaatcagcctcctgtagttagtaaacgagtataaaatttccctgtgataaaacccgctaataacacgtgaaaccggataaatctcggaacttgatgtatttcagactgatgaaatccatgaagtaacatgggttttgtacccgggcagtggatgacaaggcccaccacccagacgcgatggcagattggcggtccagcagcagcacaaccagccgcggcgctcgcggctcgcctcacgctcacgggccggaccggaagtggtagtaggaaagtgtaggcgttgctggctggctcgtgaggcgcgggcgtaaatgcgggcgcgtcctggcacggcgtggccgtgtgcgtacggcggcgtcatacgggagctgtacccgcgacctaactaaccggaaatctgcgccctacggcgaataaaaataggagtaccaccgccgtaggtgccggacagcaacatgatggtaggagcaggacaacttgcgattgggttttgtgacttttgtcccgagtcaatccaccgacgctatctagcacgcgagtgccattacagagttacaggcattttatcgtgttttatttatggggcaattacgtttttatcctgttttggtgcctatttttaatttggttctgtttttttaagtttgcttatttgaccctcttttttaaaaataaagatcaggcttgaccctattctgtgaaggcaacctaacggcgttagctcatgacaaaaataccgtttatgcccttgctcatttgaccctacttttattattatttttatttatccaggtttgacaaagcggtgttatatttgagaaattttgatatgggtttgataaatttaacatacgtttgacaaatttcgataattttgacataaattttatatatttttgacaaatttaacttacacttcacagatttggtaaattttttgtaacatcaatctcaaactgtacatatccaagaaaaacacaaacacgtagttaaggtatccccgcaggcttaaaaaaaatccggaggctaaccagatggagctcgaatgctagatagccatctcccgcatgtcgttgctgctgcagctgagcagctcctacgcgccgccgcgggagcactcgcgcgtcgtcgtcggtgccgcactacgcgtcgctgcaactcctgcatgccgccatttgctgcacctgcatactgtcgttgtcgaagccctttcgcccgcacatgccgccgctgtagcacccgtatgccgccaccgcagctctcgcgagccgtcgccgccgaagccctctatgtacgccgcctccgcagctcgcgccaagtgctatctccgtagtccctaccgcgcggcgcccgccgttgcagccccgcctcgtgccaccaccgcagctcccgccgcctccgccatagccgaagccctctctgtgcgccgccaccgcagcccccaccgagcgtcgacgccgctggaccacagctcccatcacgagccgccgccgccgccctcaccgtgtgccgcctccgccgaaccctagctgcgccgccaagaaggcacgggatgaaaaatttgaccgtggggtgagaaatttggtgtttgatttggtgttcactgctcagggttattttagtcagtttatattataaaatgatttttttttctgtttcctttaaaaaaccctaacggtggagtggaaagaggatcagacggcaatttcgattttagaaagcagggttaaatgagcaaagtttaaaaagtagggttaaattagtagttggacttcagaacagggtcaaatgaacaattgtccctttatttatctagtagtattgcgatttgcgagtagtactggagtaactgtttagtaacaggccaactgtgtacgggccggcaagttagatttagtagtattgcgtagtaatgggccggtctgattgtttcctcttccttttgtggtggaataagttcactttgtggccatcaaaagtgattgaaatctaattcgtgaccttcaaccataaaatcagatatcttgacccccaaactcttaaaacaggtacaatttgactccctcagcggttttgctgacgtggcatccacgtggcatccaagtcatcacataaactaaaaaataaagcgggcctacctgtcatcttcctctctctactaatatatctcacttctcatccgatcaaccctctctcttgccccacttttttcttggcgtgacatccacgacgccaggatgatgatgggcgacggtggggctctcctcagaccccagccctttccaccccgtcactggtggcagaatggtcgggcgagtggggattggtcggatatgcagcttcctcgccagaagtcattgatgggccgcggcggcgggaggaagttgaggcaggtggatagcttgccaaggtcgcccatggcgctggcgtcaagggcgtcacttgccaagacagagtcgatagttgacatgcaggaactcggcgttgtggactgagcgtcggctattcgtttccgctgcaaggacgtaagaaggaggggcacggcacaggcggcgtgccccgcgcgtgaaggcggtcctcgaggggcctcaggcacggcgcggaggtgagagaccacgactggggtgacgctccgtgtggtgggcccgtggcatggccgcctcgcgcgtcctgatccggggtggcggtggtgctcggtaatggcccaggcatctattgccgcacctgcgtcgcctaggagcgtgtctgcacccagccatctggtctcccgtcctcccgattgccaccgccaccaccgccgctccggcccttgcgcacccaccgccgctgccgttccatcacacatcctctcccgcgcgaacatctcctccccttggccctcgtgatggcgttgagtatctgcagcgccatggcgtcgtcatcgccgccctcctcgtcggtgctgaacgacatgagtggacggagcggcaaccggaggtggccccgaccccacgggtgcagttgatggagatgtggtctagcgactcgcgagccgtcggagaccacgctggtaactgcgagggcgaggatgacgagcagcagcgtgggccaccgccggcgttcccctcgtcctccctctatcgccagcctccgcgacagagccgccgcccctggtttctctacgccccgatgccgctctcaacaaagaaagagagaatataggagggggtcactgacaggtgggccctactttttttaaagtttatttgacgactaggatgccacgccacgtcagcgaaaccaccctataaaaccaccaaggagctaaattgcaccggttttaagagttgtgggtcgagatatccagttatgtggtttagggttacgaattagatttcgatcccttttaagggtcacaaagtgaacttattccacagctcggttcggtggcttgagcagctttgcaggcttgcagcacgtcggcccatcccaagtcccaacccaactggcaaacgtgaggcaactgccgtcgtgaccgcgcgtgccggccgaccgccaaccacggcgcgccgcacttcgactccagcgagcgagaggagcgccgcgccgcgcgcgctggtgggaccgcagcccgcaggccaggcgtggcggccctgcctggcacagatgctgccccgccagcgccagaagtggaggacgcggcggcgtccgcgatccgctttagcgccacccgtcgcgactcgcgacgaccccgctagtccgtcggtccgctgcatcgccctgtggtctgcgtgactgcgtcgccttgccttgcgttttcagccctcgatcacatgcgcatgcgcgaggccgcggaccacgcgcacaagtgtcgcggccacggagccgtctcccggctgtttcctacagtagtccacgccgcgcgtgagcgcgtcccatccattcacatgaggagaggagaggagcgtcctgatttccctccccaccgtcggatcagccagggaccttcacgacggcgtggatcgcccccccccacccccactccccctgcggtggttggccggtgggccctgactggcctcggggaacacgtcagaccatgtgcgcgctaggggcccatagggggataggcccaggtagcccgcggcggcggctcgcgtacagttggccagccgccgcggccgcaaggaaaaccggagagtatagccgatagcgagatcaagccaggctgccagccagccagccgcgcaagctgggagccggctatcgtacatgcggacagacgcaacagctgcgcgagagcgacgtacggggggagagaacgcacttgcttggaaggaaggagcatacatttcggcggattccttgggcggcggcaaaaaggctctgcatgattgcagctggagaacaattcgatctgtaaaagcttacgtgcgccggcaatatacgaattgggcaaatgctctcgtgtgtccttttagcttggaccaggtgtatgttattatagacaaaacctaaagaaatccccttcttttcttgtgtagcggaaccacgacacgtatgattaggccagtgtttgcatagtgactacgaataatgataaagagttcacgacgaggtatcaactattagttgggttgaatctcacataatataatactcatgtatatagctcaagagatccttaaatacgacaagaatgtatacgaatgtatttgctgattatttttgggagaaaatgcaaaaggtaccatgtcattcgattacaaatgtatggctgcactgagaaacagtttctggacaggttaacacataagcaaagaccatttcataatgcacatgctcttcttattcttcttgtcgaacttacatatgtcattgacaaagtggtatccaaaaatctttgatcactatcatacgttaccatgcttgtttaatttgaccaaataaaacttttttttaaggattggtttccaaaacttatgacctagtccattacgagtcacaatgtctatgatttattcagaatacggcgcaataattttatataacttgtccatcatgaatataaaacaaaaaacttgtgtttaaaaaaatatgaatatatagttaccattagagcaaataaacttgtatacttaaaaaatcgttaggcaccggtgaaaggttcaatcgtaataagatacttcgtctcaacacgtcaaactaggtgaaatagtcggcatgcaggagattcgaatccaggctgatgggatacatgcattgccagctgcccagccattacactgtaaacgcatctcaaataaacttgtacgaacaaatatctatactaaatagaataggtaactaaagtataacaaaacaacgattaaaaagaaaatcatttttggacatgtgctacaacttgcaaagtttgagctctgattagagtgtggttttaggcgaaaaaaaagtccagtcttgtcttagctaagcagacagatcatcacgcatctcattgtgcttttgaagtccctatccgtccaaattaggctatctctaaagattaactaacgagccactcaacgaaaaagccaccaaaatctaaacactccagccagcccaaaagccacgccgtccactccatctccgcctccagtgggtcatcatatctcacgattaccatctcacatagtacaccggtgtggccatctgcaccgtccattgctcatcgagattattccaactcccttggtctacacctccggtgcacccgcgcaccagccgagccgagccggcgccgcggaaggaggcggcggcttgcgtaagcccgtataagttcacgggttacactgactggtgggaccagaccgggtggcccactggcaggaggaggctatactagtcgaggcgatgaaaagccactaatctccaacctcgtctacacttctccaaatccccccacggcgcatcgcccgctcgccctcgccgccaccaccacccgcctccggccaccgcacactagggcggcttgagccccagcgccgccgccatggacgaggaagcgaagccgaaccctaacgccgacgcggcgcctgctgcagcggaggcagcagcgtcttctccgccgccgctttcgagctcggagtcggcggaggggaaggataaggaggaggagaaggaggaggaggaggaggaggaggcgggggatttggtggagaagctggtggagttggtggaagagatcgccgccatctcggacttcaggaatgcataccggcggcagttctgcaacctgtcgcggcggatccggctgctcgcgcccatgctggaggaggccaaggaggggccgcggccgctgccggatgtgtcgtattccgctctccggcggctcagggaggcgctcgctgactccagggagctcctccggctcggcgtcagcggtagcaagatctccctggtgcgtttctcgcttgaggctcgttgttttgttgccatatttggtcgttaaaagattacatttcttctgcttatggcctttcgagtttatttaggatttaataggagaatttgcctcaagaattggagcggattttagtgcgttcatactccaaacttcgtattagcacttccaattgtcccctgtgatatgaccattttagataactctttgacatgatctactgtatctctacatttttaaaatattttgttgtttcttaattgttattttgtggttgtgaagtaagctcaagcttaataatacatgctgaaggttggaccaggttttgttatacctgggtgtcaaatcaatgccgggccagagcagttgatgctgtttagcaacaagcttgtcaaaaacattatctcattatatttttccttttcgctggtgggtcagagtgaaatcggcctcaaccatggtataggaactaattctgtcacataagttgtaacgagcttaatttctgacgcaattttgtgcgcagctagactaaaattcaattgaaactagagatgtatttgataaacagtcttgtttcgatcttttatattattaggagaggtcagtaaggatccactaagtttgtactggacaccaataatttgccacgttaattgcagaaaaagagaaatatctgcaccgttagattgtggttaggtcaagattacaatggggtagatttatcatataattttatacaatgtagagttgcatctatggaaacaaacatgtatatgaaattctgctcttttataatctatagttgcacacaaaattgcacgggaaaatccgctagtgtatacaagtgtattttgtatatatatataatataataaattatttgatgggcaatattttatagcatcatggttggttagttttaaggttccgctcggtgttttaggttctcattgcaaaaacatctctgtgggggattgaaaaattcttttcttttttacttttcagcagatttttgctgcatttgaacgaattttcagtgcatccaaacaagtttccttttttttaccagattcacttcatacaggatctacttgtaaaaatttcgaatcaaaatttcaaagtctggtcctactagggcatttatagtatagaagctcaataaactatatttccctgatttgtaaagaaagctcactgtgaagttactgcacattaaccctggtcccaccagggcatttatagtatataagctcaataaacatcattttttctgacttgtaaagaaaactctgtgaagttactgcacattaaccctggtcccactagggcatatattgagttaccataaatgttaatttccatacctgggttgctctttgcagctgaaaagaaaaactgattgcactcgtgcatttatcttgtaaccttcgtcagaatgatgtgctgtgttccccctcccaggatcgttatcctcgtcccgggaatatggggacaatcttatccctgccttgttaaaacctttcaaaagtagtgtcactcatgaacctgggagctttggtgacatgtaactacaaaggaaaaaagaaatgtaccaagaaaaatgcatttaatatggatctgtagcatcggacttgttcaaaagaatagctctttactttattctgtactgttgctcgtggactaacagttctgttacacaaaacataattgtggttattacaatgaagatgaactattcacagaagtgctttgttctacttgaattaaaaaagaagagaaaaatcacatgctgattacatttgacattcctattaaagttcttacgcagatgattaagtgaagaaattctcttagtaatcgctaatgtagaagttatacgtagaggtctcatcgtctaaatttcttctgggttctcatcaactgttcttcttcttttcctttttggagtgcgagcatcgcctgctgtgtttttttgcccaatgatcggtacattggaacctgctcatgaaaaaaaaaaactgaaatatagtctggtacatgcactgctgaccttggctatcatgggccacaaacacatgtggtaaggatagtgtggttattgcaagctatgagcagcgagagatgcaaatttcacatttcttgggtggatctaaaatggtagtttctggagttccatattgatgttgtaactgatttacatcaacttttttttttcaatatgtcaattgcagatttgtggttgaaaattttacgaattaggggtccctattgtaatgcataactactacaaatattagcttttcaaactaccaaacagtgttttttgcaaaaaatttctatatggaagttgttttaaaaatcatattaatccatttttcaaaaaacaaattagttaatacttaattaatcatgcagtagtacatatttcgttttgcgtgccggggaggaggggttctcctcctcctgaacgcagccttagtaaacaccggacattgaggaatgcaacgtttttagtagacagtcatgtgcatttcctaaccataagggtttgattttgcaggttcttgagagagagaaaataatgaagtctttccaggatattactgcaaggcttgaacaagccttaggtttaatctcatttgatgaacttgacatatcagatgaagtaagagaacaggtaggctaacatattcatgagtattttttttccatttagtaaaagaactattggagtgagatatttttagtattttttttattttgttttgttcaattttgcaaacttgttaacatgtgtgtggctattgtgcaggttgaattggtacatgctcagttcaaaagagctaaagaacgatctgatccatctgatgatgatctctttaatgatttggtgtccgtctacaactcaagcaccagtgctaatgttgacccagatattctccagaggttatctgacaagttgcagcttgccactatatcagacctcaatcaagaatcattgatcttgcacgagatggctagtggcggtgatcctggtgccgttgttgagaagatgtcaatgctgctaaaaagaatcaaggattttgtgcagagtcgagatcctgaaatgggaaccccagtaaatacgacagaactttcgggaaaagacaacatggcatctctgattgttccggatgatttccgttgccccatatcgctggatttaatgaaagatccagttattgttgccactggacaggtagttgattaacctatgtctactttcaatacgcatgcctcccatttgtatttggacttacaataattccttcaatatgcacatgcagacttatgagcgaggatgcatagagagatggttggaggctgggcatgacacctgtccaaagacacagcagaagcttcccaataaatctctaaccccaaattatgtcttacgcagccttatagctcaatggtgtgaagcaaatggtatggagccaccaaaacgtgctgctcaacatcataatgcaccagcatcatgtaccgctgctgaacatagcaacgtcgttgagcttcttcagaaattattgtcacaaaacctagaagaccagcgtgaggctgcaggtatgcttcgtcagcttgccaagcgcagtcctgaaaatcgtgcttgtataggagatgctggtgctattcctattcttgttagcctgctatctataactgatgttagcactcaagagcatgtagttactgctctcttgaatctttcgatatatgaagagaacaaggcaagaataatcacctctggagctgttcctggagtagttcatgtgttgaagaggggaagcatggaggctcgggagaattcagctgccacactgttcagtctttcactagtagatgagaacaaaataacaattggggcttctggggcaattccagctcttgtgcttctgttgagtaatggaagtcaacggggtaaaagggatgcagctacagccctatttaacctgtgtatctatcagggcaacaagggcaaagctgttagagctggattgatccctgtactattaggactagtcactgagactgaaagtggtatgatggatgaggcccttgctatattggcaattctctcgagccatcctgagggcaagactgcaattagttcagccaacgccattccaatgctagttggagtaatcagaaatggatcagcaaggaacaaggaaaatgctgctgctgttctggtgcatctctgcaatggtgaacagcagcaacagcatcttgctgaagcgcaggagcagggaattgtgaccctgttggaggaactagccaaaagtggcacagacagaggaaagaggaaagcaatccagcttcttgagcgaatgaatcggtttcttatgcagcaaagtcaagcccaagcccaagcagaggccatggcacaagctcatgcgcatgcacagtctcaagctcaggttcaggctcttaacgaagctcaatctcaggtagagatgcaggtggagcaattgttgcttccaactacttcacatctttctgatagacgagacggttgataagcaggatgttattcatagttagtgggtttcttttttattcatagtcagcggcttgtttttttggctgaggctagcagttggaagatcgcctgcaatgcctagcgtggaggtgtgtggtttttgttaagcaattagaatcaggaagtgccattagcgtgattctagggccatgagcttcttgacaattgagttttgaggtcgtggaactgttaacctgtgtgccgtttgtacaatgcacccagtgatgaatgttgggaccctcgagttttagggaggtgccattctacttgtacccggtgcctattacaggactggtctgtggcttccaaggttgataattttacttgcctgactcacagtttcagtgaattgtttgttcactttgttaagccaagatttccctacatagctatccataatctattgcatggctggagcatggagggcttttcatatggaatgctctttcttcagttggtttaagcttcaggtctgatctacatttctcagctatcatgtacaccctctattctcaaatataaatatttctagaagttttagcagaaattaagattaaggtcagaataattgtgattggttgggatgagaaaaaaaaatataacttatatattataatagaagtttaaaatcttagaaatgtttatattttaggcggcagtatttacgtttctcccacaccgctacgtatatgccaacacctcggactggagggcaacttcgtctgttcgattgtgcttgcaacaatcctccccgggaatactgtcgcctggccaggaatctacctgaacatca

SEQ ID NO: 66839 - DNA, 19194 bp, Oryza sativa
ggggggtttcgatgaacgcgtcgatcgtacgcgcgaacacggcgacgacaagctgcgccgaggacagcaagacgacgacgtcacatcgtgggcgcctggctgcgcggtgcacggagcgtgcaggcgcaggcaaggggcgcggcagcggcagaagcaggccctgacgacgacgacgacgccgatcgatcggtgtcacggccggccctgaccccgatctgggaggcatcgttcggtgagtttgccttagccagttaggccatgacactaccttctgtcgtctcaagacactctctggttagacacgcccatgcctcggtccgcatgcgtgttccttactctctccgtctcagaatatagcaatataatactagatgagatgagacatcacctagtatgatgtatatggacatggggtatgtctagatgcattgtactagatgatgtcccatctagttatagttataggttgctatattctgggacgaagggagtaccttttccatcgtcaacgtgagagagagagagagagcgagagtgtgttactgtgctaggacgtactactgctgctgatttgcttgcttgatcgagcctttatggtggagaaatctggttatggaggtgacgatcgatgctgccaaagagtcaaagcctgatgtgaccggatgagataaaaaggtggagtaataacaacgtttgttgccacaggcgggggcccaacataatgcaagcgccatgcgatgggccattccgtcatcgctagcaacagtgtatggcattgtaggctatcatccaaactagttgtattgcacaattgtttctcaagaaaatctcacatgtacaggagagtgatgtggaaaaattcaaaggataaaccatcatctcagttttcgagttatgatattaacggtaaagaagaaacacacaagtcgaggaattggctagtgattatccagctgatgagaatatgaataataaggggttattcagcttcctgctactaatttattttttcaattacatactactcctactttggaggtacttcctccgtcccataatataatcaattttgagttttttcttacactgtttgatcagtcgtcttattcaaaaaaattgtgcaaatataaaaaacgaaagttgtgcttaaagtaatttggataataaagtaagtcacaaaaacaataaataataattctaattttttttgaataagacgagtggtcaaacagtgcaagcaaaaactcaaaatctcttatattatgggacagagagagtatattattccatccgtcccaaaataagtgtacttttgcattattcacgttcaacgtttgaccgtttgttttatttgaaaattttttatgattagtatttttattgctactggatgataaaatatgaatagtactttatgtgtgactaaatatttttaattttttcacaaatttttcaaataagacgaatggtcaaacgttgagcacggatatgtacagctgcacttattttggggcggaggtagtatatagtagtctgaattgtttggtggacctgcattttttatggtggctagagccgacagaagatctctaaacaggcatcagctagcggccgtgtgcgtacgtgcctttccaacgggaacccaccagcggatgtcgctcgcgctctcgcaactctctcggctgcattatttgatgatccacgatggcacgactcacatcaggtcgcgtcgcattattgacacatcttgatcgcacaaggcgggccggctagcgacaaattaacctaccaaattaatagcggaatataagaatagccctgcaggttaatcatctgaaaaatcttgattaaagcaggtcatacatgctgagcagtgagctacagcaagcatgcggtgatctcatatgctgattgattagttaattagttagtacgatatgatccatggacgtacaatctagcgacaaatgatcactcagatgtcaggtcagaagcagcctacaaagagaaagccatcatgatctctgttgttatccgatttggcgtcgttaactactatcatgcattattgatgatttgtcatccagttggccacttgagctcggttggaatcgcttcaagagtagaaaatacgggccctacctttgacaatgctagcaatcttagagagagaacgagagaacgcgaagaaacacaccggaaagggtggaaaccgacgttaacgttacgacaaactagtgtaaacatcagacaactacaaatacagaggctaaattatcatcaacatcaacttactaattagattatcctaacaattacaaataaaattatcacaaaactacaactttattacaacttgtacgttactgacacattggacctatatgtaacttagagataattctcgacacggatgaaacattgccaacttagcacgcgtggaaagaaaaccaacaccttacggtccagctacacaccatcgcagcatagtatagctccagacaggggcggagctagagcgagatggaggggggtgccacttgtttaatttatctgctttatatcaagtttaagctaatgcgggtgtctaaatttgtattgaggtggtgcatacatagtgaaaataggtcaagtatagctacaaaattttcttgaccgggttcctgggcacccccctcaaacactctagctccgtccctggctccagagcaacttagtactagggttgaaactggttcggatagtttccgtccgtccggaccatttttcggatttggatagtttcggtcggaactatccgaaaattctcggattcggaaacgaattcggattttttttctcggaaacgatataaatgttggagatgttgaactaaaataataagcgatatctcttcctcgatcaagtaactcaatttgaggggttttttatataccggtaaatattcgctaccgtattcgttccgtctcgtattcgctccgtatctgtattcgataatattcgatttcatttccgtatccgagttttcgattccgattccgatttcgaaaaaaaaatgaaaacggatatgataaagctagtttccgatccgttttcatccctacttagtatgtcctgtcataactcataacccagtcaagtcggctgaggtgggcactgcacacattgtttccatccctttcccgctaattgatctgtaatacgaatcaaactgctaacaagattatcgttagattattttaaattttattatatttattagatgcctcataagtaatctaccttaccatatgatgtgaagaatatctgatattattctgcataggaagggaggggggaggtggttctaattggaggcaaaccatgcatgtcgatttcctcatctcgggtgatgagatgttaatcaacatggcatgctgtgagaccactacacaataaatgcgatgatgttgagtgttgatgtgtctcaccatttcagtgtgccaaaagacacatgtatgacatgtgggtctactgtatccgtaagttaagagttgtaaccgaattatagatttatgataattttttccgtaatggttgtaacaatctaaaatgtgtctctaatgttgtactaattaagttgatagtttagtcaataaaatggtagttctctcaaatttacttgaaagactaaggttgcagacttgcagttgcttcattagtttcacaatgaaatatcttagatccctatttagaataaacaattaatgtactaggtatgcagctagctagaactggttagacttagactgtgtttagttcacaccaaaattgaaagtttggttgaaattggaacgatgtgactcaaaaattggaagtttgtgtgtgtaggaaagttttgatgtgatagaaaagttggaagtttgaagaattattttggaactaaacacggcgttagccagtacaatttttctctgtttgccattcaatatatcttgacaaatctgagatcattattaatcaaccactagaaaattgaagtgctatatatgtatctaggttacaatcagcaacttcatgtcacgcgagcttaattttgcgcttttctttaaatgggacggtattccatttttatgtaaatgatgaattgaagtacaggagacagattgaccctatgaaagaacgcaaactagtgtgtgattaatgatgatgctacacaaacatggaagctgtcactaactcttcctagctccaaaaaatggtaaacagaagtacaagtgacacgacattactggtctggtagtatgagagtatcattttgctatacacctatgggagggaaaattgccaacatacatctcttcaaacaattacacacaataataatgtgcactactggaaaactgatctttgctcggtcgccccaaaaccacagtagtcccggttataaaaagaacccgatttaaaaccccatagccattctacgatctttagtcccgattggtaacaccaacctggacgaaagatgatctttagtcccggttcatcccctgtcagttcattgtcagaggggcggggatctttagtccggttggtgtcacaaaccgggactaaagatcaccactttagtcccggttggtattactaaccgggattaaagatctcctagatctttactcccagttggtattaccaaccgggactaaaatcacgcgtagtatataatccatattccctatcatctcccccacaaccggcctctactctcctcagatccatctccctcttctcctccccttcctcctcccatcccggccctctcctccccctcctcccttccgatccgatgcttagcgagcgtcgcctcctccccctcctcacttcccgcacgcgtcaggcggggccacacgcggtaggcggccggcggggccgcgcccggcgagtagcgagcggcggcaggcggcgctacccgcattcattctttttttctttttttttacaatttgtgattcactgagatgtataattttgtgatttgttgtatggatctgatatgtataatatgtgatgtatttggtttgtgtgtaatttttttaagatttgtgatatatttgatttttgtgtacaagtaacttaagatttgtgatgtgaatgttttaggatgttactttgatttggggtttgatttgggaatatgcatcccactcgatttgggagaaaatacagggattaaactctagctaaaaaataatgaaaaaaaaggagacataataggactgccgctaccctctgttaccaaccgggattaatctttagtcccgattatttcacccggactaaagatagcgatctttagtcccggattcatagttccggttagataaccggtactaaagagggggttacgaaccgggagtacagagggtttctccaccagtggtgcattcgtaaaaaactaatcaaatgtctactaatttgctactgataaaacaacaatgaatcatacatgtagtctagtattcactactacggaattattaaactaataaaaaataataattgcactggtttttgggtcaagcctgtctctcaacttgtattgaatcgatgatgtgaatacaaataagagcattatcaagagattatgaataatctttcctaaactgaagataggaagtaaagaaactgatctctctaagaaagcctaaattttatcctaaaaattaaaagtggaccattttgttaaattaccaatatttttttcctccaagcgcgtggtcctcctggcgtgcgagaaacagattgggagtaggaagggaacatacgttctcactcaaattgatggagtgagaaatacggagaagggaactccagttttgaaaataatataagtacttcatctatccctaaatataagaaattttggttagatatgacttatcctatgattctgtccagatttattggactaaaatatataatatctaaccaaaatcctttatatttaaagatggagtgagtagaacactgttggttgctgctctaagagagcaagttcaatagctaaagcaaattgaacgaagtcgtcgttgctcccctcacacatatgcatgtgcccttgccatgcacgcatgcatgccatcaaattaaaggcggctgcattctattgctatatgctaccacagggtacttactacttacgtaccccccgacacgatcattacggctttgattcgtttcgatcgatcgattagcaacaccggccgcggccggtagtctcgctcatactgtagtcatgtggtcaccattgcatgccgtccgatcgattgatcgatccatcgatgccgtgcatgtgacgtgctaacgcttgcgcagcccagcgcactcgatcataagagccatgcagctctgctgcttgctgcctgcatgcatgcatgggtgtaccaattactaattaaacgcagatgctctcgctttctggctgatctgatgcccactaaaataagctggctttgctgctttagagggcaaacagtgaacttgccatcctgataatgatgatgcatgtcatgtgatgagtgcctgagtcactactgaaaaactgatttttgctggatcatgcaaaatctatattagtcttggttcaactaggaaccggaactaaagaatatctttagtcccggtttaaaatgttacaatctttaccaaccggaactaaagatcatttttagtcccggttcaaaataggtcagacgtcccactatttttattcccggttggtaccaatcgggactaaagattgatgcaccatatataatccctcgcacttttcctcacctcctctccacaaactcctcctcctcatctgtaactacctttccttctcattatcctctctatcttatctctatcctctcatcctcttttttttttccagcatcctctccttttttttccagcggcgaggagccgcgctgggcggcggcggccaatgcggcgctaggcggggagcagcgccgggcggcggcgggctgcgcggatgcaaatttgtgaatttgtttcctgtgaattttttatttgtgatgtaaatctgtgatgtgaatttgttcatactatggatctgtgaatttgtgatgccaatttgagtatgtatattcgatctgtgaatttgtggatgattttgtgatgttttgtgaatggggatgattttgtggttgagatcggtttgaaatcaatataagtagcaaaaaaaattattaaaaataaaagaaaaaagactacagatgggaacttcagccacgtggcgctccggtctttagttctagttatttcaaccgggactaaagatacccatctttactctcggattcacggtcccggttatataatcgggactaaagggagttacaaaccgtaagtgaataccctttcttcaacattgagtggcagtgcaggagccatcggtcaaatggatgacgaacttagttggattttttttctccgtaaagtaacccactaatcaaccacccagatgtaagaataataagaatcttaatcccatttggtagatctcccgagcattattcttccgcgtgatttcaaaggtgtctttttctaaaccgacaccgatgattcatctctatcagcgtcgcttgtgtggtgctggggttgggaatccggcacatctacgtggagttcccaatcagcacccatgagaaatgtttttgtgctagtgtgtcaggattgaagacgtgtttagctagcagctaacgtgggttggctatatataaattggggggaaaccacggaaatcgatagcaatctctcgagaattaatggatcctcatataaccttaattttctcttaaatacaatgcaaatgatcctgaaatattcaggaaagcatttagaaattagtgcatcgagatatattgatcctctcaatcgattcttaggccgcgcgcgttcgagtgatggtttggagccatctcttcggaacgaaaacgaaatatctcattagcgcatgataaaataagtactaaattaaaataaattaaaataaatttttaaaataaacttttctatataaaatttttgaaaaaaaaagtttcgtttaaggattgggaaagcgtgtttacgagaaacgagagagtagaagatggaaataggtattttccgaacacaaacctaaaagagtttcgcaaatatatgagagtgggtgtacaatctcaaccggattttgtttctctctattttggttgtagctcaagagttgtgcatttagggccggtgtctgtagaaactctcattttttttttcatcttaatgcaacgaggttttgcgtttccaaggtaaaaagtactatgtaagaaatagtcttttcgttccaaaatattattagtatttctaacttattatatatctggacagggaagtaattaagtgagttcgatggagctttaggtatacaagggagctcaggaagtactcttaacaaacattggctaataagttgcagatatccctgactaataattactcctacttaattactatttcccagtattagaacaaatttcgtaccttgacagtacgtcgagccctccatgcttggttcgacgaccaaaggggatcggaaaagggaacaggaaacactcaaacacacgtaaaatggctgaaacaacatgtggcacggcacaccacagcggacgtgccatgcaacgagacacaggcaggccggccggggtacagatcgacagaatggcccgttttgcccgcgctctaacgaccgacgaccaactgatatatcaacggatcgaagtgcgcatcgatctactggggcgaagcgaagcgacaagcggcgaaggcgcgcgcgtggaaagctatagcagagcgcagagcggtgaactcgcggtgtcgccgggacgcgaaggcaccaccctccctgccaccacgcacggccctagctccatcgatcctcgatcgatcacgacgtgatccgccgtattatctcccgcagcggcaggcgccggccgcgctccgtgcaccatcgcggacaggccgggggcgggcctggaggtgcacggcgcatgtcggcatgcatgcctgacgcagctagctcccgcactaaactagctagctagggagagaacgaaagacgatggatatatagatccagggatggatatgtgtcgtcgcgcaccgaatctttcttaaggctgactgctggctgctggcgctggcgctggcgcgctgctgtgtttcaaggatgactgctgttcaccaattaatgttgctcgctgccgcaagcccggcgcgatgtccggcttctgtcccctctctcgtacgctagttgcatcagcatcaataccgccaggcgccagcatgtgggttccggttccgccaggcgtttgctgctgcacggataggtgtgggttaatttgtgattttgacccaccaggtaatatataggtcgagtttgataagatactaccctactgaaattttgttattagtgctaccaaaacatgccaatggttaatttgatacttattgttatatagttggatttagtcatacctcggtaattgatgatgagtaagcacgacttaaaaggtagggtttctcacctatcagaccggtcttttgggttgtataaacccataacctaaagtcgtggttttaattggatccgtggtggagcaggtccaccgtgaccttggtggttcatggttggtgccttggtggccggccgggctacgcactagtataaattttgtaaaagttgtcaaatatttgcgtcggttaccctacaaattatcagttgcatgaataaactcaattttgttaatgagatacaaaatcaacaaatcacaaagggaaaacactattctttttttatttctcctatgtttctcatttttatatctcacaaatgaagttgagtttatccttgcaactttacatggttgtctaatactacattagctatttgtgagattttttcccaatttttttaaaaacttttatatagttgtttgagatataaaattgagaaacagaagataaacttcctctatgatttgaaaaattctacatgactagctaccacataatttctaaaaaaatgttaaggccttgttacttcagttctaggcatatgattttcttggctccaccactgaaactatcacataaatttagggagagggtggcagtggggttattgagggaacatttgcggctgggattattattagatggaaatcttatcatccattcgtagttaacacaacatccctacaatcaatttccctaccaactaggaatccccctcttttcctatatgtcgccctttcttcctctacatgatcctaggcgcctctagctagatttgcccccagtggccttccccaccactaacctccgatgacgagctctattcaaattttatctgtagacctatccttcatttgacattgcacatgctttttcatgtgctgatgacacacatgttttcattgccaccatgaccgccccattggcatctacaaatcgtgattgtggcattaacatgtggcccctacatcacccatcctagtagttggttgcaacagctaaagccaatgcccctaatctagtttgactttgagtttttatatatacatttttttatggcacacggttccaacattatttggtaatacactctctgtcctacaataagtttatttatccttcctcctatttattccagaataaattcatttttgagtaatcgttgtatcaaagtttgtgaaagtatggaataaatgtattgcaagtagataaagtgaggaataatggcattgaaattcgataaagtcggggcattatagtctcttgggtttggtattggtatacatgagatgggtaaaataaacttattttgggatgacgggagtattagataagcgttttaccacaatgagaggtgcttgtattatgtgttgcagttattttccctagtaaattttaaaacttaatggagtactccctccaggttgaaaatacttatcgttttgaacaagggtgaggtcaaactttaaaatcattgaatataaatatgaataatttctaaaatatttgccgtagaagtatggagaccatatgtatagattagtcttaaaaagtacttcaaataaaccgtgtatttgttgattattttatttatactataatagaaaataacgatcaaaactgcttttaaaaaaccgtgtccttgtctaaaatattaggcaaaatttgctacagggcatcgaaaaaacgtgtaattagctcgtggacaccacaagaacgagaatttgctgatgggcatcacaaaaaatgtgtaattagctcttggacactcgaggccttattttattgtttcctgtggatttggatagagaaacactggtgagagtacgattttgcccctgccctcatatccagcaagtgattcttgcacggctcgccggcgatgtggcgccaccgccgccgccgtgatctgcagatcgcgtacacccacccgacgagcttctccatcctgcgacgcacacccaggacgtcggcgggccatgagtccatgccgccacggccggcgacgtcggcgttgtgcctttgcaggatctccctcgtatgcaacctgcagcggcagaagcgcatctgcgtgcgtgtgatccggacaacattccatcctgcagaagccgtcgcgtaaccccacccccctccaccggccattgctattgtttgccttctacgttcactgaccccgtacgcatggttcaccaactggaaaagaaaaaagaaagaatacaaagctctgcagacaagatgagaggaatgagagattgcaatggagaagaggacgagaattggtgcctgtttttttggttgatttgaatcgagatgaatcgatttgaaccatacatatacaaaattggaaatttgattaagaagagaaggagaagaatcgaatctcttcccggacatggcgcgcaccagcgcacacaccgccgcggcgccacccccggcgtccgcgatcaccgcgtcgtgcccgccctccgtccggcacagccgctccaccgcggccagcgcgctccggctcccctacgccgcctccctccgcgacgcgacgcgcgaacgccgccgcggctccggcggcgacagcgcgggggtggttctccttagcaaggcagagcatgaaaatgccacggatcccgatgcggatggcgcgggcgtgggccttctcctcgagaagcgtaacgaggccctcctgcccctccatgaccccctctgccgcgcccagcaccgccctagcatctgccccggacaccaccgccgcggcttaacgccagccaagccacccctacggtccccaaatttaagggcaaacttgtctttatttagtgtttctctctctaaatacacaagaaataataaaataaggccacgagtgtccaggagctaattacacgttttttgatgcccgacaacaaattcttgttcttgcagtgtccacgagctaattacacgttttttcgatttcctatagcaaattttgccaaaatgttaagtactatcaatccagagggagtattttgtatccgtgtgaatccatatttcacttgtcataactttaattgtacaaccttattggagtatgagagcataagtgtactcccttgcatgccccgaaagaaaaaaaaaatgtatagttgactctctagacatcactacacacaatggaaaaatcatagaaaaatttccatgctgattaccaggccatgcatgtcttgtgctcattgtagtcaaaatgcacgtcctacaactaaacattttgagggcgaaaaagaggaaacaaggaatcgagaaattattgctgctagttccaaggggtagaaaaaaaatcccaaaatatagtgtgaaagggtagtatcgataaaacacgcagaataaatatatatttaaacataaacttcataatgcatactactccatctatccatactaaaatataagaaatccttgatgtatccgaagttaaactattctaactttgaccaacattttagaaagagaattaatatccacctcaccaaacaagtaaattatgaaacaatattcgataatggatctaacaatgcacatttgacatcgtaaatatttttattcgtttctataattttggtaaaatttaaaacaaaatgatttaaaactaatattagataacttatttttaagagggatggattagtaattcatagtaacaatgataatatatatgcacagggccaccatattagcaggaatccgcactaccacagaacacgtgaatagtgccagttagaaaacccctttccgtgtcggttttcccaatcgacactatggaggcagcattgcagagtaaaccggcaccaatcccattttaaaaaccgtcacctttgataccactcgtgagccaaaaaaaaggctcgatgcatcggctcaaatcgagccgatgcatcaagctcatccaccccgcatcacggaactccaaatcaatcaaaatccccaatccccaatcaaacaacatcacagaacaagaaacattgaagaacatcacagaaatcatttcactaacattggaggcatcacggaaatcatcacagaaagccaccactgcctctcgtccagccgtcgcatctccctcccttccgccgctgccgggccgctcctccgtggccgccgctgggttgcccctcctcggatttggcgaagggcagggcacggtcgccactgccgcttccgccggctagccaccggccgtggacaacgagagagagtcgagaggggagggcgccactgccaggccgccgctgcctctcatcccgccgccgcatcccccctcccctccgccgccgcatgccgcctcccgctgttgccgccgatgggccggccctccccggatctagcggaggggagggcgtggccgccgccgccgcctccgctggccgggagaggagaaagagaagagaagagaagagagcggagagaacgagaggagacgagcggagagaacgatagagagactgataggagacgagcgctacggaccttatctcctcgaagcttcgtggtgaggcccgccggctcggctcaattcgtaagttctggtttattataggtgccggttttaaatattaaaggttctgatttttttaataacagacacaaaatagaataggtgtcggtttttatttataaccgatatctataattacttaaaggtgtcagtttttttgcgatttcaactcacggaggtgggaaaaggcctatagcaaccggttttagcactatcaaccatatttgctttggttttagcattttggagttgccatcaatactagctcttagatgcgacctagtttatctagatttttctccaatgaatgcaaattatcctaaatacccgcagtgaaaacttttcggtaggtacgatcttaattaatttatagctagtcgtcctacattcactgtaagcctgtaacgtacgtgcagtgaaaacttttcagtagggatcgacgacacatgaaccttaaccactgtagcttgaatccattggcccattggaactcggcacactcgcactcgctctgactagtatacgttgcatccgccggcgtggcgcgtgatcttggtagcaagccacgcctagctagccaagctcttgcatgtgtcgagccgtaacgtgccctgccccggcgtacgtactctcatgggccatggatcccgtatacaaacttaagctggtgaggctgaccacacacgcataaacagtcacgtatagctactctaggcggcagcttgtggtgcgcgcctttcccccttgccactgtgctcattatgtttgtgtacgactgagcttgcacagaaacatatgggcatcgatcccatttgatgtgcgtgcgtgctgcctttattattctctcctctcctctctctctgatcatctaccgcatccatccctagctatacttgcatcgatgagagagagagaggaagcaagctgcctcggtactcgggaaagaagggtctcttcttcagctaccactgcttgcaaggtgatcgaccgatcgatcatctatcgataggccagcatgcagcagcagcagtgcagcagtgtgtggcagcagctagccccctccacagattcccttggcaagcaatgacacaaaacctttgcaaagcggccgcggccagcgagccattgcgcgcacgcacactcacgcgcacacaatgacacaaaacctttgcaaaattacacgggaaatggtcctcgccgagagcttttggcatctcgcttcgctttacccgcgacgacgcagcctgtgccggccgagactcatgtcactcctatccctgtctttttcccgcgctgcttttgattgttgctagtgcatgcatatgcgctgctactactactacctcctcatcatgcatgcgtcgttggatttgttttttggcgcctatcaacgcatcacagttgtaaaggaccagggtatagagagatagctaagctagagaggcatgcaaaagctttagctaaacccatcagcgccgtgtacctggaccatgcaaagcatacaatagcttttcctaccactgttgtctccctctcccacacccccctgttggctatagctagctgttgtgtctgtgtcactcactcactgtgtggatcagcatgttgatgtgtatatactactactactacaactactactacgtaccagtccactgatgtggctagatgaattgcatttgccgacagatttgcgtgcgtggatttacgtttctttttagtacgtggtttgtgaatctggtaggattgattgcgccggaaatagacaattcatagcaaaggtagtagctttatttacaagtgagagcactgaccggcccatccctctttcagatcaatatggaggcaaaggatatataatgccatcgaacttcaatttgagtaatctgattggcatggaagaaataaataaagttagtcgcatatgcatatatgtcaaatcggtcgacatcgtggcttgttaacaaaagctagtaatccaggagaaaatggatattgttgtatatccataggtagagaactttacatgggcaatatattcaagaggggttattatagctccatctagtaaaaaaacatgttgttgcgtatgaattgtccgtgcaactataaattaaggggtacacttgctaaatgattattaaaaattccgacatatatgatcgatactggtacaaaaggatataaaacagtcctaataggacatgatcacctaattaagtaacatggcaaggcatcaaaacctactcagacaaagttattaagagatactagtgtataccagttttatgtatttcgtaccagttctatggaattttaggtaaatatagaaacactactacgaaacaagccatctttgccgccccattagtgtcggttagctaaaacccaacactgatatgtaggagttttcctatcccctactactagaaaaatcgttttccgggaggccaaaaatagtttttcctagacgggagaaaggaccgtctgtacgcaaaggcatgtgaaaatcatttttgcaggcggcatcttcatcttcacaggcggtagattcactcgcctgcgaaaatcatttcagcgaacaaagaaaagatccacaccacccctacccgccggcaacgccgccggcctccccctctggctggcggctcttctcctctgtccgctgccactgctcgaggggagcgtcccctctttcatccagatttgggaggggaggggccgacgctgtttgcagtagttgtcgtcgtcggctcctcctcttaagtggtccctgaaaaaattgatttttgcgagagaggttaaatttggaggctctttagctattattcacaaacgattaaaagggtttttttttgtccgcctggaaaaataaatggctaacatcggtaaaaatcgtttttctagcattgccctgaacccatgcgcaccatgagagagaaaaaacccgacactgatgtgtggtcatcagtgccggtaatttaaataaaccggcactgatgtatttacagtacattagtatcaggtttttttaataacccaacactaatataaggtcatttgtgctggttattcatgtaaccggtactgaaacaaccggccaagccgagctataagtgagtcagaaaataaaaacaacagataaaatcgaccatacgttctgagacgatcctacccatagagtctaaatcgatccaatccatccaccctcacgctccatccctcgcccgccggatccaagatgttcttgatttgtgatttgattgttctcatctttggcctgtggatgtggagttcttgttcctattctctaatagtggatgtgaatttgtggccaatatggatgtgatttggacatttggtggcgtgtgattcctctccgcctccttggagaagagtcgcaccctggtgcacggcagcggtggtggccaccgccctcctcaaggcgtcatagcggaggcggcctcctcacggtgcacggcagggcagtggcaccctcagccctcctcatggcgccatggttgcggcgccctcccgtcggtggcgccgccttcctcatgtacggtgcacaacggcagtgtcgctccctcccatcagcagtggcagcctccccatggcggcagtgctccccttctccaacctcttgtacacctctagcatccgttcaaccctcctatgatgtgcatcgcctgcatcatctcattgttggacggccagatctagccaccacaactcggggcagctagatccggtcgccatgagtaacggtatccctctgcctccgatgagaagtggcaccggcgtggccttgaagcactagctcgaatcgagcagatgcatcgagtcagctttttttcattcttgaacttcaaaggtgccggttcctaaaccaacacatttgattatcctcgttggtgccgtctaccgggcactggttgggaaatccggcactaatagagatttttgcagtagtgacaaccagcactgatgacatattttgtagtagtgaaagaccgtgaggttaggatgggccagatccttccatgttcctctataagctgatatcgaggagcttgtcgatcagacctcaaccctagagaaatcgtcaagagatgtactttagccgtagccagccataccctattcatccatgcatgtaccacataggtagtactgttcccgtacatatacgaatgcagacaaacccaatggaatcaccctagctaaagggatcttgaacttgtataaaatctctctatgtgtatatgaggatttacgaattcttgccgttacatacaaatgatcctaggtcgtatggtaaaaacactagctgcgaagataattgatgttcaaacactgtaatgtttggcatgaaacatctcatgactaaaatgatgttttccgtgatcgtccggaaggagcactgttgtctgatgcgggtgtgcaatttccttctatgccgtagggttccgtttaatttcctcaaatatggatatgatctattctggagtttggactgcactacagtcaacatccatgcatgtggctctaacattaggtgttttcgtcccatccttttaattttttgtattttgataaaagcagcttaattaattacaatattggctagtgctataattaaatcatacataactgggtcatagtactccaacagtagaatagccataaatgggtcatcagttgtaaagcaccgattctctctcctggcacaagagagtagctcaccttaactttaatttgatactgccatgccataagctgcatatataattgcccgtctgacaccgtacgtgtatcttcatatgcatgcatttagctttgtgtacctagcttgggctagaatcatatgcatatgtacacactagtacacgcagatgacacgcagaagcgcatgcagagctccaagtaccaagtaccaacctgcagtccaaggaacaaaactacgtggtgggcaaccagatgtataaattaaagatcaaaagcgagacgaaaaaggtaggatcataataatcaaacagtgcagatctctgtacaggcaattaaggttcatt

SEQ ID NO: 66840 - DNA, 10358 bp, Oryza sativa
  unsure (1)..(10358): unsure at all n locations
gtacatattttcgtttgcttcacagtatacagtccctgttagtcgttgtggataacgtcctaattaaccgagtcaaatataactagtcaacgactcgtagcaagcagccaatcagccagctggctcgcaatatctgcagaaactagtgcatcgacattgccatgtccgactcagcaatagttaagctcgtagtagtctccatatacgaccgtcaacatcaaccattgcatgcaaccaattaaagagtcaaaaaaaggctgcaatcacatcgctcctaacccatatccaactcatctttataagatccaaccattcctccccagtgaacccaagccccccacacacacttctaactagctaggtgtgatacacagcagtgacagtgagagtgagagtgagcttgagtgatcatagccatggcattcagtagcaaagcttgccgttgcttggtgctcatgtcatttgccttgctcccactgagcatggccatggactccattggcagctactgttcagggaacagcttggccggcaacagcaaggccgtggcaagcatcaactccgtcctcaccgacctcgtcgccaagggctccaccggcggcggcttcgccacgtcctccgccgggaaagccaacaacgtcatctacggtctcgcgcaatgccgcggcgacgtctccaccagcgactgccaggcctgcctcgcctccgccgccaaccagatcctcaccagctgcaactaccaatccgactcaagaatatggtatatatgccaagtgtgatgaccacaaacatacgaaaaaacaatgaattcaggcgactgataaacttcaaaactataattattctacgtgcaggtatgactactgcttcatgcggttcgagaacgagaacttcatcgggcagacggacacagatgccggggtgattcttgtgaacgtgcaggcgatggataacggcaaggcgttccagaaggcggtagggaaggttatgggcaaggcaacgtcgcaggcatcacaggctgggagtggtgggctgggtaggacgaaggatcagtacacgccgttcatcaacatctacgggctggcacagtgcacacaggacttgtcaccgctggcttgcgcacagtgtctgtcaacggcggtgtcaaggttcggtcaatactgcggcgcacaacagggatgtcagattaactacagtagctgcagggtgcgctacgagatctatcccttctacttcccgctcgccaccagcgcacgcagcgccaccactgacatgaccaagtacaccaagatcgttgtgcaccgctaagcatccatggttagttgcacgtacatggtgatgtgcgcatgcaaaagttgcaaacacatcacgtacgtacgtattaatgttcaacgtattatgtgtctgtggatgtttcagcgtgcagtggatgaataatcaaggctataaaatgtagccttagcatgttataactgggaataaagatgtgagtactagctaagcaatgtacgcgcacattcgtgtggagtaataatattagagtttttaaccattgcattatgtgtgacgtataaagtacagacaattaattatataccacgttataaaatataagagattttacccatttaatcttacttatatagataaaatcttctatattttataacggagataatatccgtgatcttccacttataaggacaagcttggaaggcatttttatagcttcgacttataagtcgcatgatcatgatatagcgcacaaaattaggttatcatttattttaattacgtgcatgggtgggaagagtaataatgtcccccggcgatactatggtgtatgatctgctatacatgatggccaagccaccaaggactcaacagcttataattgtgacgataaaatgaacgaccagatattctttctctaacgcaaagggacatttttttgaaggatttcaatgagaatatagaacctaaaccggatgaaaattctatgctgtcacgttaatatatcgtttacacatgcctccctatcatgccctatcttcactttagttcttttttaaaaaagatattcagaagacactctctacatttcttctctccctagtcttaatattttctttagaaaaaaaatacatgagagatgcacgcacaccctaaactataaatcgaactgtcgctaatccctgatctcataacgttatatataagaaatcgtttaatgatcagttgatcactactcgatcggttcttgcgctctccaactgaattgatttagcagattgaaaatggcgctctagctacatcttactgtgtgtgtcaccatctgatcgatcatgcccttttgcactatgtttttatttgctgaatagatgaatggttgagtgattttgtgattactattaaggtacaaatgaatgaactaagtaatacaaagttgaaaaatgaacacataatagttttttaaaaattcatatatatatatataagtgtttttaaaaaataacaccatttagaagcttagatagtgtgtcatattaatccaccatgtatctccttagttagtctccttacggagtaataataattagatatatggctgtacgttccacaacttctgccaaaattgaacggagcatgtacaggtcatgaaaactacgggggtgaactttaaatgtactttctccgtttcacaatgtaagttattctagcatttctcatattcatatttatgttaatgaatttagatagatatatatatttagattcattaacatcaatataaatgtgggaaatgctagacttacattgtgaaacggagggagtattataacgacttcggtctggtcaaatctttacaaactgtgccttggcggttcgctctggagtcacatataatgcctgctattggcgtgtgctgggatgctttgaagatagagtttgctgcttacgtacatagccccaaagtccaaacttagtgccagatatatcggcaggacgatgaactagttgcggaaacgacgtgacatacctaacaaaatttcggagttaggagcgatccaaccggatataccgcccaatcagcaccgatttctatagcacgattggccagttgcaacttgcaacgagccaacgacgtccactatcttgacctcatcccgtcgactccatgccaatatgccatggcactatggcagcatctatctagctaggtcagatgttcacccttgcagctgcagttgaggatgctgcggcccagttgagtgtttggcaaaaagtgaaaaagggcctggatattcggcctgctaaagaaaccgttctccgagcccatacgtgacaggccttacatgtgtgggccgtgcaacctgctgcttgctcggcccgaaccggccggagacatcctcaccgatgacgatgacgatgagcaatgagcagggaaagccagaggcaaacgtacgtggaggcaggaggagtggtcaccgcgtgcatgcgcgccacctccccggtctgccgactctggcggctgcgcccgcacgcacaaatgggagctcgtgggctccaggaaagaccgaacactgcactgcacaacacaagcgtcgtcttcaggccgtacgtgacaaacctcagcaggcgagtgtcatggcctccgaaggcgccgtgagcccggcgttcgcctacaccgtcgtctacgtcaaggacgtcgccaagtcggccgccttctactccgccgcgttcggctacaccgtccgccgcctcgaccaatcccacaagtaaaccatcctcggttaatattttttttccccgtcttaaatttttaactggctgcttgaaagtacttcctgatgcgtgtgacgtgtaatgaattataaggtgggcggagctggagagcgggacgacgacgatcgcgttcacgccgctgcaccagagggagacggacgcgctgacgggcgcggtgcagctgccggactcggccggcgagcgggggcccgtggagatctgcttcgactacgcggacgtcgacgcggcgtaccggcgggccgtggacagcggcgccgtgccggtgagcccgccggagcagaagagctggggccagaaggtcgggtacgtcagggacatcgacgggatcatcgtgcgcatgggcagccacgtccgcgcgtagcggccatgcgcctgctcggttgggggattttagccgtgtatgttcaataatgtgaactgttctccactgatctgttgatatatggaataaaactgtgatctcgttggttgtggtctgtactccaaagtccaaacgagaaaaaatggccatgtttgatgtatgatgtgttcaatcatgaatcacatgggtaaggataggaataagttcactttatccctcaatttgtcgtcagtatgattttcgttcctgaaccgtaaaattagatacaacttattttccaacttacaaaactcgttcctgaaccgtaaaattagatacaacttattttccaacttacaaaactaaaacgtattttctaacttacaaaactagtacggtttagatagcggttttggctgacatgacgtctacgtggctagtttaactagtttaactaggtcttcatcctatagcattgacatgacacttacatggcaattatatatcggaaaaataataaaagccatgggcccagatatcagctacacaacaaaataaatatggtgggtgggccccacatgtcatcctcttccctcttggctctccctcctcttcctcatcgcaccgcagcgccacctcacagccatcgccgccatcgttgtcgtcgtcatcccagtccccaccgtctctgatgacgacggcggccgaagcatgccggcggaacagcggcggcagaggtagccgaaggaggaggaagagaaggaggtcgccggcgagcgcggcaactgtggcgggttatctcctcaggccgccgctcgccgctagtagctcttgaacacgcgggaggacttcacaagcgcgtcccctccgcgctgcacatcgcgcacccatgcacgctagaggacttcacggggggtgtcctctccgcgaccgagagcgcaacacctgcctcgagctccacaaggcgtgtggccggcggcgacagagcagaggggcggcggcgagaagagggacggcagcagagagggcgtcggcctggatctgcacgaaagggaagggcgggtgggcggcgaggagaatgacggagcaggcgagcgaggcgggaggtggcggagcgaaccgacggtgggcggcaacctcggcaaggtggggaggaggcggaggggagcgcggagaggtcgacggtgacagccggcgggaagaaggcgagcgtgccggagattgagcagaggaactccgccagtgggtccgtcgtgaaagacgacgatgacgaggacatcggcagcttggagggccgcgtcggcggcgaggatgggcgccaccacggccaacctctcgcctgcggcgccggcgttgttgttgtcgtcctccgtcgccttgcccctcgtctgtgccgcggccgccgcctgctggagccgcgtggagcgccgccttgcccctcgcctgctccggccgacgccgctctgccggcctgctctagctgcggcctgccccgccctgtcccaccccgctcagccggtcagccgctccgccccagtcgtcgcctgctccggctcggagagagaggaattattttttgtgtagctgatatatggtcccacgatttttattattttttgggataaaattgccatgtaagcgatacgtggatgccacgtgggacgaagacatagtcaaaggagctacgtaggcgtctcatcggccaaaaccgcccttcataccaccgagggacctcgtttgcccggttttcgtaagttgggggatggatcgtattcggttttgtagttaagggacgaaaataggactgaccgacaaatagagagactaagggccagtttgttttgtgaccaatgtttttggtaaggccaacatgtgtttggattgaagccaaattaaactaatttggctattaaaatggcctatgttatataggcatgtcaaaaacatacacaattattgttaaggttgcaaaaaaatttgacaagcctaatttaggcctgccctaagtgacgatatgcatggtcccatggccatatgctaccgtgttccggcccatgaactacagctaagggcctacataggtgatgctgtcagcctgccacaggcacagcccaacggctaaccactgtcgagcctctgcacgaacaccggactggcccggcacgcatagcacctgcgcaaacagagggaattttttttccatttttcattttttattttttaatatttacagaaatattgtaccgacgaaaatatttacagaaatagaccctaccgccctctctgagagtggcagggtgacgcgagggacggacaagttgaaaaaaaaaactagaaaatatatttttggtagggcgaaaattgcatttactcccttgcagcctttgtagagggcggcaaaggacctaagtgcaaaatgcgcacaccttgcagccctccacttggacggcaggggccattgtgtaaatattttggatggtataatatttctataaatattaaaaaaattaaaattaaaaatgaaaaaaattcctcaaacaggctcgtacaaggctccttccatctaccatctctttctatacgttccaggtggcgaaacgtaagagaaaaaggaaaaaaaaaaaagcaaaagccgtctccaagaaggcacagacgctatacataactccagcgttttccacttggcgcgggaacccgctcgagcggtcgagccggacggaccaacctcccaaaggaaaccaaaagaagatctcacgtcgtcgcacccaacccaccaaccacccgccgcacgaaacctgcgagcgaaccgagagagatcaccatccccccgcaccgttctggagacgtcccgtgcgcgcgccacaacacccgaaccctccacaagccttaagcccggccccgagccgaaaccgcctccgcctattcgcgccacccacatcacgcccctactcgaacattcgtgaacgccgcgccgctctgctcctatataagcaaatcccctccctttgcctttctcccccaccaaagtcgagagatcgaagcgaaaaaaaacagagcaaaatcgtcccagcgcgagcgaatcagaagagcaacaacacaactcgatcgttcatcagcggagagcttgatttgatttgatcggaagagaagaaagatggcgggcaacaagggagagggccctgcgatcggcatcgacctcggcacgacctactcgtgcgtcggcgtgtggcagcatgacagggtggagatcatcgccaacgaccagggcaaccgcaccacgccgtcgtacgtggccttcaccgacaccgagaggctcatcggcgacgccgccaagaaccaggtcgccatgaaccccaccaacaccgtctttggtaagtgccccgctcctttgcttccgccttcaattatttgatttttggtgtcaaaattatggaattagtttctttttctaatcaaatcaaacttggtaaatttaattaaatttattaaaaaatagcaacatctaaaacacaaaattatcactacatctaacacctaacattaagacctctattctctaccgttacattacggcttgtttggtaactcgagggaaagagattgagagtttacacgagaaaattgatgatgagattaaaatgggaatttgatttttaatcctatatcttgtttggtagaggcgatggaaattgatagggagtttagttggagattagatcattaataaaaatggatggatgagatttgcttagacaaaataaaggggatctcttccaattacctgcccctacgcaggtattaaaaaggagggagttccttcctcaattccccatcccatcccaccaaaatttccatgtctctcaaccaaacaaaacacttaatagcctcatccttctgaactcccaatcccttctaaaaactccctccaaccaaacgtgccaatgagggcttcaggccctagttaaaaaaaataaaaatctaaatctaacatgcaatgtactaaatattaaaatatatttgttcacatctatttatattattaaagaaatagaaaaaggagcctccacgtccgctctcatggcctcgttcgttctcatggcctagaaattctcacattaattggagaaaaagaaaaagcagagtacatatagaaatacaatttagaaatagctgaaatttggaattaaaaaataaggaatattagaaaaggagactagagtccatatagaaatacaatttagaaatagttgaaattcagaattaaaaaataaagaatattagaagaggagactagagtccatatagaaatacaattaggaaataactgaaattcggaattaaaaataaggaatattagatgtagagtatagagtccatatagaaatacaattaagaaaaaatagaaattcggaattaaaaaataaggaatattagaagtagagtatagaatccatatagcaatttaaaactaactaaaattaagaataaacataataaaattaaaattagagttttgagtccgtataaaaatacaatttacaaataactgaaattcgaaattaagaaaaacatgggaagaagagtttaaagtcaatataggaatcaattttggaagtaattgaaatttgaaattaaaaattgaagaatattgagagatgagtttagagtccacctagagatacaattagaaataataaaaattcagagataaaaataaatatattggaagaagagcctagagcctatatagaaatacaatttacagaaaattcggaattaaaaaaagaaatattaaaagacgagtctagagtagatataggaatatatataatttacaaataactaaaatttgatattaaaaataattaataactaacacgtatataaaatacaatatgaatactacatatttgtagttttgtaaacttattgcaaaatttaaaattatgatgttattctaatatatttgaataatataatgagaaaacatatatgctattacatgagaaaatatactgatgctagccgcgcaatctgcgcgggccaccatgctagttcaaaatatagctgtgttttttctataaacctgatcatttttttaaaaaaataaaatatttgattaaaacaatcaaaacaacagataatatgaaactgggaagtattcatgagccgtaggagttacacttgcaacacatcttgctctgtttcctctgttttggcggcagatgatgaggatcactagcatgaacttgtaatttaaattcacttcgattgccgcaacctgattactgtaagatcatgtagttgcgcacacgggggaattgaaaaataactcaaaaatccagttagtacaattttatatgggtaacaaaattttatatgggtaacaaaaataactcacaaatccagttagtacaattttatatgagtaacaataatgttcaaatgtcgtaacacgctgtgtgtgtcttgcagatgcaaagcggctgatcgggcggcgcttctcggacccgtcggtgcaggcggacatgaagatgtggccgttcaaggtggtgcctggcccagccgacaagccgatgatcgtggtgacgtacaagggcgaggagaagaagttctcggcggaggagatctcgtccatggtgctcaccaagatgaaggagatcgccgaggccttcctcagcaccaccatcaagaacgccgtcatcaccgtcccggcctacttcaacgactcccaacgccaggccaccaaggacgccggcgtcatctccggactcaacgtcatgcgcatcatcaacgagcccaccgccgccgccatcgcctacggcctcgacaagaaggccgccagcaccggcgagaagaatgtcctcatcttcgacctcggcggcggcaccttcgacgtctccatcctcaccatcgaggagggcatcttcgaggtcaaggccaccgccggcgacacccacctgggaggcgaggacttcgacaaccggatggtgaaccacttcgtgcaggagttcaagaggaagcacaagaaggacatcaccggcaacccgagggcgctccggcgctgangactgcgtgcgagagggcgaaaaggacgctgtcctccaccgnccagaccaccatcgagatcgactcgctctacgagggcatcgacttatacgccaccataacccgcgcccgcttcgaggagctcaacatggacctcttccgc

SEQ ID NO: 66841 - DNA, 803 bp, Oryza sativa
cttaattaatcacgtgctaatggactgctccgtttttcgtgcggggagatgggttcccaaccttcaagtaacgaacgcctaagtatgtttaggatttgttctaaacaaaattgagttttagtctattatgatgtttatggagttaggtcaattatttagattctttgcctttttacttttgctaatgttttcacgggttcttcaatggagatcttgaaagacattgatcaggttgcagattatccaatcgacagtgtcggttttaggtgggtcactgatttgtttggtgatgccgttttagagatttgccaaatgatcaaagatggtggtcgatagaaagacttttgtgcggtccagagttgattagtgttatggctgtgcttgtgtacttgtatctcttgtggcattttaagatgtatgtagatcctctttgttctgtatcggtaccttatttctcatgtactagaactatcaaggttgtgatgatttcttatatttaatataaccaccattgtttccataaaaagaagtcaactggagtgataatccaaaagcagcctagctagttcctacaaatgagaggggaaacaaatgacacatcagaataaggaacatcgtcatcagacttaatcaagaacatgacaggttcagaatttatgtgatgcaagcctagcctagtttgctgatagatgcgagttagtaaattccatagaaatatatacatatccagggccccatccttttgtacatatcgatgtggtttaatagaaacccatacgatcgatgccgaaatcaagaggtag

SEQ ID NO: 66842 - DNA, 949 bp, Oryza sativa
tttatctatagccaacataatagtcaattcatacaatagttgcttactatattattaaatatatggtctctcacctgtcatacacacactgcgtcttgagtccgtgttgcagctggctacagatctaagtccgctattcttctctctcatcttttatctcattaaaatatgtttatagctggctaatagcctgctattgtacctgctctaagagcaagattagtataaccaactactagctccaaattatctatagttactttaatagccaatatatacaatagttacctataaacatatactacactattaatatatgatctcacttgtcatatacacattgcgtcttagagttcgtgctgcagctggctacaaatttaaaaggaaaaaaagaagaatgagaagaaaatggaaaataaaaagaaaaataaaagaagaaaaaaaagaaaaggacacatcatgtccatgtggcatgctacatcaacgccacgtaggatcctagaggtgatgtgtcaatttagaatctagatgatacactttgataagttacgtgactcagatatgtattttgagagtttagaggcctatataacacaaccctataagatgaaggaccgccaatgcactttactcaagttgaatggtagagctaactacttataaactcatattacaagtataagattggctataacatttgtcttcaccttttcttgcttatgtatttagtgcatgtaccttgaagcatatgactagagctttgtacttttcttgtcttccttctccatataaacttatagtttactattatccttgcttaaggtggttgcttcagcaacaccaaacacgagggcggcgaatgctatctagcgccagataatggtgtcattttcttccatatttttttttgctcgccatatcttcccgctcatgtcattctaccaacact

SEQ ID NO: 66843 - DNA, 858 bp, Oryza sativa
tgcaatttgttcgattaagagaatttaattttaccgatctcgtgaagtagtgtttctactaccaatagatactactgtaaaacggtatacctttttggtggtttctagttgcatcgatctaatatgttttgtttcttaaaacctttagctgatgagctttcctctgtccttccatgaatcattgcttaatccaccgggtgacatgttcacatcatgagctggagaattgaattccaatggatgatgcatggatgcaaccgacgatccatcgatcgagacggtactaaatggagaatattagtgcaatacgtggttagctgcaacgacgtgcatgcataatgcattgcatcctgggagggtacagctttgtgtacattgatcataagataatccaaatgtaatccaagtgtccaatagcctcacagtttcgatcgaaattgacaggttgaaaaatagcaagagcaactcatcactcgcatgatgaacgtgtagtgctatcgatcaacagtcggcacaaattggggcggttaatgtgtcaagttcagagatgaatctggcagcaacatgttacctacctggaaggacgtccgttgattatataattggtttatttagctttaaggttgatcctatcttacaggacaaaaatggacggttaaccgtttgagaaaatctataaaaagcaatcgattataccagaggttcagtttacggatgcatctgagaaaatctggacggttaacagttcattttccgatcagacggcataagttcttctgcctcagatggtcgaatcagaccagaggtataaaacaaatacactagaaaacaatgttattttcgaatagctctaataat

SEQ ID NO: 66844 - DNA, 2059 bp, Oryza sativa
  unsure (1)..(2059): unsure at all n locations
cgagggagacagggggccatgtgagccgtagcaagattcctcagttttgtgccagtgaatgagcagtttgcttaagtagggtagtagtgtccgacatgggcaatccgagctcgtgattgccattttatatggggggaacagtagtcgtcttgctccaacgactagctagacacccaaattatgccagattaatggcagatacgcccggttaggtgtgtggacttatgtttgtacctacgaatccaactgcacgcacgttcctccgttccctcaccggaactcaccccatgttcccccaactaaacacacatgtgagacagtgtcaaacgactacccccgagcagtggcgttttggcagtgtgcatcctactcctttcgttctgaaatataagagattttaaacggacgtctaaattcgtagcactaaaaagagtcacatccattcaaaatcgtttatgttttatgacggatggagtagatgatacagagaccaaagatgattaaactgatgagctatatatattttttgacatgtaggatttagcacggtgttcgagacgtgctgcgggtcaggcggcggcaagttcaactacaacaacaacgcgaggtgtgggatgtcaggcgcatcagcgtgctccaacccggcgtcgcatcttagctgggacggcatccacctcaccgaggcagcttacaagcagatcactgacggctggctcaacggcccgtactgtagcccggccatcctccacagctaaagcaaaatgactggaaagaacgagccattagttaatttattactttattattaaagctggtgtntattaattaagcgggaattaattaaaggggaatggtttgggttcttgatttttatttgggtggcatatatggtgggtggtgtgacggtgaaatggtttacttgcgttgccaanaaagcaaagaaagcgatggcatctgtagaataaatgttggttactgttgtaatttgataattgtttctctttcagaatcaaatgaatcatcaatggtattatactcagttattttttttcttttgcttttagaagagacttttttgccatgcagcttatgtttggatcttttgcctggccaggggcatgtggtctgtgctttagaaaaagcaactgcagaaaattcactctgatggtcatcctgtctgagacggtcttgtcattattagtcagagactctgaaagtgaaagtgacagtgtttttttctcattgcaaacttttagctaactaaccactaggttgatgaacaaattggacactcctactggggaaggaaaacctgagcaaatttatccaaggatagatagatatgcagcatatgctccaagtacaataatgcaaaaggaaagcaagctactcttgcatagtgatgcactcgctctcctactgctgaatctagctagttgcatcaaatcgacttgaatacatgagatggagtaatatgcagggcatgtgggtgacgcaagtgggatggcctgaattattcgtagctgttggaattaaatccaacggcgacccatccttggaaggaggagacgaatcttcgtatttgattgcctaacacatctattgattatgatagtgatgcacatttgcaaactaggacagggcacacaagcaagtacaagcatgaagcatcaatcagagcggctgatttatacttacataaacgcagtaaacaaaaaaaagaaataaaaacatggcatgcgtaggattgaaacacagaaccaagcctaccatagaggttgaaggatgttacgtatagcgaaggttaaaaaaatatattcaaaagtacgaagcatagaaactgtgtgttaatttgtgatgcattctactactatacaacaaaactgcttcacaagggcacatgatgagcattcctggcaagaatatactaccaagttctgaagtcataagcaaatgagaatgtgacaagaatgtggaacaagagctctgtgatcccgtgtatctgacgcctgaaatcggcggtgttggctgcctggacggcgcgccccaggcaatgatt

SEQ ID NO: 66845 - DNA, 5746 bp, Oryza sativa
gatcatgaacatttatgttattatatgtacatcattatctaaaaaaaatgttattatgtacatatgggtggcatgtgctttagtttttttttttactaaatcacgcgggaggggggagcttccccacctgaatttgtcattgcatttgggggagaaaacaatgttcattacattatattacatggaattgagagattgtagaggggaagagaaaattgctttccatacaggtattacatgtcgatcgtcaatcttgaaaggttttctgccgaaagggcagcctcagcagcacaccgttgtaggcaaaagcaactcggactcggacccgtcgtcgtgcgcgtggccgccaagcaccagctgcaccgccttggagtcggcgccctcccgctcccgcgcgcgtggcttccgcgaggcaaagcgccgaacaggtcgcgggcatggaggaggaggagcagcaactttgcagcgccatcccgccgacgacatggccgtcgagaagactagcgatgaactgatggctggtatttggaggtgaatccaattgaaatccatggactccatccattttagacccaaaacttatgacaaaaaccaatccaatccaatccacctccatcccacatccaagccgctccagtccattagctatctcaacccgtttacacccataccaagtgaatctaaattgaaaaccaatccattagatccattccaatccaactcattggcaggcttagctgcggcctttggtccttttcagctgttcttcgtcattgtatacgtgaaagactgtacatttgtaaagactcaaatagtatcgtgatacagctgcacggactgtacatttgtacaacactacagtcaacagtagactattgttggcacgccaacttgccaagtcatgttgttactaccttgtctctgaaaacaagtcccgatgattctacttgtaccagactgcccgcaccagtgcattctggttcgcttctgcatgcgtctcgtctcatctcctcatctctaatcttccatccaaaacttgaggtccttattaggccacaccttcactgacttattagaatggtttagctatgtgtaatgtgttggagggtcagggtggcgtctcgtttcggctgtcccttccatggttgcattatactagcatatcactacagaagcttcggcaccaaatatttagaattccatcatctaccacatctcacatgcaggctgttgttggagtcctctcctgcttttcgggtcaaaatggaaaatgcatcaagcgtacaaagacgtagcagcagcaggcagcagcaaaacaatgggcagaacatcatgcatcatatttacgtggaaaccattgacactgcaatatgattactcggtagctgaaagcctgaaaggcatttcacagaacaatttaatagggttaaagactgagggccccagataacaaaaaggcgagagtatattccatacaggttcttcagcaaagaaacactcgtcgttatatccaagtttgatagtactaataaatcggattaggccggttctcgtctttcccagtcttacttaaaaaaaaaatcttttccaaggacaatacatcagcaagccaaaaaattgggtagagtactaatatgacgacattgtatatagacgaaagtgaccgtaaccaatttctgctgcaaaaagatcctttttggttctaattggtactataatcgccccaaaaacaatctcatacggtacggtacagatccagcgaaagcaaaatgcagtccatgagaaaatgcaggcacgccgacatgtcaatggcagcaaagctgataaggcaccaagaacatttatggtgggctggtgaatgtccaaaccataccaaaccaaaccaagaatctttttgcaagtctaataaaaacttttctcttgctcctttctccggtcacgagttatagttgctcgcacacaaggataaccagataacacaagctggacccttaattgcttatccagttcagacagcaaccaaagaaacaccaactactcctattatttatagacactagtgatcctgggcctcctggaaatggccctgtgcaaaagcgagctagtataagcggcgcttccacgatctgaaaacccagcttatcacaagagagagtaggatgtgatcatcatcatcataagaccgaggtcagggccccgttccgtcggcgagagcgagacacccgcggcatcacgccaacttgcgctacgatacgcggagcggagagcgtcctttgggcgagcgaaaggccggcttatcgaaacggtgagacgcagatacgtgggcaacggccaacggggccaaggtgccgcttcgcaatcgctttcagatttcagatcctctactactactactactccccatctctctatctcttgcaggtcaacaaggatcgaattaacaagggttatccgcttgtaagcatcgtgtgatcgtgtttatatcggataggagtagatagcggtgatgaacatgaagatcctcgagtgggaacgtcatggaaagggagggcttaaaatgatgaaggcttggagccagaaatgacgatgcttgcaccgtgttttgatcccaattttttcttcaaaatctcaactttttccatcacatcatacttttttactcacataaactttcaacttttctatcatatcgttccaatttcaacaaaacttccaattttgacatttcaactaaaattttaattttgatgtgaactaaacacagtggtgcattatgctcgtgagatcaatcagctgagatggtatcacaagaggcaagagaaatccagggtggccagctgtatggtatagccaggagccagatgtgaagtattccaaacaattgtcactttcaggaaaagcattactacaaagccgatgggtcagctttcacccagacatttcgttagggtaaacaatttgcaatgtgcttgtctgaaacatggtacaccgataataatcaaacctatccaaacggcgtttcgacacataaatatcgtaaggaaggcgtgagattcagtcaaacgatctaatccatgcaaactgttacgcattcgagagaaatattcaggcagaaattttctgaggttgaaccgaacaaccatactgaatgatatcagatgaaaactgaagtactcgtaactgataggtgctgatcatttctataatgataacatatataggcacattggcaccatcaatcacttacacttgccttccagcgattaatggaaaacgttcacaagtgctaaaaagctcccactaattccaactaaacattggcaaatcctagaaagcactgataagtactccttttcctagtttccatcaaataaatgagatgaaatttccaagaatgctcacaagaacaagcttctcacctatctatggaatgcctatacagttcttcaggagtcaattttgtagaatcaaaccgctcgagacaataatgcacatacggaagcacatcgagcgggcaacaaactatgcatacacagaaattctaatgaaaacaaaagataatacataaggtattcccaaacaaatatactgaaacgaagatcgaattaatccagatatgttccttgtgatatgtagcatggtcctacaaatgtttcaaatgccaaataccagaatgcttcaatcaattacgattgtttccctttccctttccaattagcaaaaatgagagcaattttcttgtatgctatgtctctgaacgtctccttgcgagctgagggttagcagacagcaaaacatcagtcaacagaagttgacaataatcgatttctaccagctacaagggcatgcaccacacaccttgaacatgttaagactggcaccatgacgaggggggcctcatggacacatgaacttcatgttcttcaggaccaacacggtattttggaacaataatctctaggcctgttcctgattcatcacagtatgcttctaaagtagcatcttccgggatccgagtagggagtggaatttcccgaataaactctcctggtggacaatgctcaggtgtaggatcgactaacttgaaggtccggtcatgtctcttcaagaatggcatccggccaacactagtgcatgataccttaactatcccatttgtaagagtattcttccatgaaaccttcaccctttgtatatcagcaaacggtaggctaatgatgatcaagtaccccttgctatcttcatagattgtttttgctgcagtcactggaccagaagcatggcgcatcacaccagtgaagtcattcatccatgacggctcgaacgtgtggctcacttccatgtcctggaccttgtctgaatttgaattgctgcaatcttcttccatcgctgtgggggaggaatccttccggcgcttgttgcaaatatttgggatgtccagaccatccccagagctgtgattcgatggctgtgttgacaggttaaggccagaaccgttgagcaacttcttgtgatggccatgtgagctagtcttcgtggcagcagtagttgctggcctctcaagctcaaaatctgtgctaggaagatttctccatgactcataatcactcgcctcagcatcaatcgagaagttagcgtcccttccggtgagctctgtccacctcttcaaatcagcttcgggcacaccagccaagtttggtgcccggacgatctcgatcccgtgcaggcactgcgggttggacagcccccggtagtgcttgcgctgcatgcggtgtgagcgcacgaaccctttctccgcgctgaacgggaactgaggctccccaaggcgcgagtgcccgttcatgaagctccttagctgcatcttccccagggcattctctggccgctccttgaacacccacatgtacatgttctccatgtcgtgctgcactaggaaagcatccagcgtagcattattaccgttcccaccggcggtgggggccttcgccttgccgttcttgtcagccgacatgaccggcttgaagtagtgggtgaagaagaaccacgcgccccatatggtatcgttcctcttcacgcacttgcgggcagcgctggaattggagcccttggcatgtgatacggcgaccgtggtggtcgcggcggccggggcaggggacacgccggtggtggcagcaggtgagtccgagtcgtaaagctgcgggccgccgaggccgacatcaagcatgtcgacgttggggtcgtggagggcgccggactgcagagccggaggcggaggggaggggtcggcgtcgagggggaggttgatgtcagggggggcggcggccgcggcatggaggcagcggcggaacggccccggcggcggcgggaggaagaggtcgaagtcgtcgtgggaggcggtgtccatggagaggaacgtggaggggccctggtgcgggtggtgggccgtggtggtgtccatggagagcgcggtgagcagcgactcccccatgacggcgtcggccggcggcggaggcggagggggaggagcagccctcttcctgccctcgtcgcccgccggttgctcgtcgtccgtcgctgctgcgcttctcgccaactcgtcgccgcttccgcctccaccgcctcctcaccgcgcgctcctctcctccgaatctctccacgagcatcagcgactgggcttcacacctccctcgcgtccatcacacagccgtcgggttgatacgaaaaacgaaaatctctcctcctgcac

SEQ ID NO: 66846 - DNA, 9917 bp, Oryza sativa
gtgttaaaggcgaccacccacgggggggggcgcaggcgccctcccccagaagcgccctggacgagggggggtggggtggggggccgttacttgacggtgacgcccccctccccctgcgtcgtggtggtggtggtggtggattggcacggcccggatcgcccggccgcgcacgcggcggtagaggcagtgtgcacacgataaatctcgccgcgcggaggcggtggtagattgatggacggacggatctcctctcctcgggaggattctcgggaggattcgacctgtttggcagctccacagttcaaccacgtagtttcagtttcatctaaaatggaagcatgatcagatagagcgctctcataaataaattagagatgtggagctgggtttagacaactccacaaattcactcaagatctaactcttagggcgtgtttggataatgggttaggagaaatgggattgggaaatggaaatgaatggagggataggatgaaatggagtgagaagaatggatggctaggattgaaacttactctttgaggggtgggaaatcatatcccaaacccattatccaaacacttccttagagttaaattcaggagttttaagctctatcaaacaggtcctaaactctcgaggagatattccctcgttatttacatgctatcagaataattatgaaaaaaattaactagatatattaatatatgatagattactccgcaaacatataagttaaaataagttgtaaaaatacctaattaaattataactagttaatgtctattcacaatagttaaatttgtttttagttgcaacatgtagaagttaaatttaatcttgcatatttgtgaagtaatttataacatggttcatccgtttcatgttataagatattttgattttggtcaaaatcaagttgtttcaagttcaattaagtttatggacaaatatagtcatatttataatactaaattagtttcatcaaatcaatgattgaatatattttcataataaatttatctttggttgaaaatattactattttttttacaaacttaatcaaacttaaaagaagtttaactttgacaaagttaaaacgtctcataacattaaacggagggagtattaatctatcttattaagttttattaaaaaaaattataaccacttaaacaacgaaagcgtctcaccttcagagtttagaatagttatctgttctcctccctcccccggtcttgctctggccgcctccccctgcaactttcccctttttgttttgtttactcgctttgttttctctgtgtgccagcgagccatctctctgcttccgggtttctttgggagttggggataaaataagagggggtgattctcaactctgcatgggcagcagcaaagaagaattggttttgtgtgggggaattattatatcatcacaactgtcagtactagtaatacagtagagttttatcatataatactgctgttttggaaatgagagtacattaagtactcttacatgtaggccgtgtttagttttattttatttttttaagtatacaaacacatatttaaagtattaaatataaactaataacaaaacaaattatagatttcgcatgtaaactgcgagacaaatctattaagcctaatcaatctatcattagcaaatatttactgtagcaccatattatcagatcatgacgtaattaggctcaaaagattcatctcgcaatttacacgtaatttgtgcaattgattttttttatctatatttaatgctatgtgcatgtgttcaaatacttgatgtgatggaaaagttgaaagttttaagtgaactaaaacagccgtactcataataggagtaatagtagtacttaacccggggtatggtggttgtttgaccaaaaattcgtgactttcccatcacggctttgcaagtagcatgatgaaatgctactatcatattcagatttgcacgataacttatacaagtagtatagctggtttagcctctcgttcaggtttctgaggcctttaacaatatacaagtagtgccggaatatatcatatgcacacgatatttttcatgtatactatatgcataccaactatctaatatcacagaaacttttagaaaaaattaaacacatacttctaatagtattacacatacatatgtaattttatctttaaatccattatattttagctgtaaaaaaaacaaaattctgacagaattttacactttaaactgtcaattttttcgttttttattacggttaaaatataataaatttaaatatgagattttgcagatacgtgtaatactattaggagtaaatgtctatttttttttagattttttcgtgatttgctagttgatgtgtatgaagtgtgcataggaaactcgtatgtatacgatatattcccttacgccaccaaactaacggccccagcggcggattcaccctctggttagtatggataattgcccgggctctactgcatgatccatttaagtctactgatttcgttgtaaaagtccacccatttactaatttccaacaaagttaacatgctaaactcttaattagaagccttgaaacatccatgcttcactatgactaacgtgattgactttgagtaccaaaatcgtccatttttattataaatcattaggtttgaactgtgaaaattttgcatgcatgttaaactatgcttttactagaaaaactgttacgtgtttaatttggtatataaacgtttaataaatggataatggttttatacaatttatatggctgcgttcggagcatggtttgggaacccatccatacacgcaaaacaaagtgatcatgtaatttatgattaattaaatattagctaaaaaattttaaaacattgattaatataatttttaaagcaactctcgtatagaaaaattttataaaaacacaacttttattagtttaaaaagcgcacataaaaaaacaatggaggtgaggccatgtttagatcccaccgtaaaatttttcatcctatcacatcgaacgtttaaacacctgcataaagtattaaatataggctaaaaaaataaataattgcacagattgcgactaattcgcgagacgaatcttttaagcttaattgctccataataatgtggtgctatagtaaaatatttgctaatgacagattaattatgcttaataaattcgtctcacggtttacttacggattatgtaattagttatttttaagtgcccaaacaccccattggacaccatatataatacccgatatgacatgtcaaaactttacaccatggatataaacacccttgagttagaaaagttagggaaagaaatcagccttattaacttcttagggcccgtttagttcccaaaattttttttcccaaaaacatcacatcgaatctttgacacatgcatgaagcattaaatatagataaaaagaaaaactaattgcatagttatgggggaaatcgcgagacgaatcttttaagactaattagtccgtgattagtcataaatgctacagtaacccacatgtgctaatgacagcttaattagtctcaaaagattcgtctcgcggtttccaggcgagttctgaaattagttttttcattcgtatccgaaaaccccttccgacatccagtcaaacgttcgatgtgacacctaaaaatttcctttttcaccaactaaacacacccttattaacttgttcaggcttcacaaaatttctaacaccaccgcaccacgaccctactttgcatatcctgtaacggccacatgacgcgccctgccaacaccgcctgcacggaaaggaacatctcctccgccctgctgcactcaccccgtttttccgcccccaccccccccccccccccctgggccgtcacgtcgccccattcacgtgaatttatcctactaacgtgatacaccatgcgccctatcggtctcgcctcccccgttcctcactatcagccgcgctgatgccgcggtgttttccgcgtgatccagcgcccgcgggacgggaggctggccggtgacgcgaacgttgctggaaaaacccgcgcggtgcgccggtgtcgcggtcgcggccgaacgaacgaacgtgtggccgcgcgcgacgcagtgagagccagtcgtggcttctactcgcggtacacgaatacgaggagggatttctctcgcgtgtggcttggctggcagcgaggtgacagtcacacgggatgggaggagaaggagaggcgcgcgcgagcgatgggcctctgtttgtgtttatttacgcggagataaggtctcggtcctctcggatcgaacccaactcggggaggcgtatctgataggaggaggaggtgctaccttctcgcttcacgacagggacggataagagcaggtacaatagcatgctataagccaactataaacatattttaaggctacatatctgtagctagctgtagaacggactccaaaacgtaatgtgtgaatgatatatgggacaatgtattaatagtatagtaagcaactattatatgaattagctgttacattagctatagttgatttggagtcagtagtgggctacactattaaacttctctaataaacgcctcgtcaggcgtggctggaggtttaaaggcaggggagtaataaagtggatcaggttgctgacgccgcggaatataccgagaggacgctaagctctctctgtgtgtgggggtgattaggacgtgaggattgcccgtgatctttcgccgtaagctcggaacggctagttggccacgcatgtcagcatcgtatgattttatactgttttttttttctggttctattataaattggggatctgtggacttgtggatactccctgtctagacaagccggaacggtgttgcttctgccggatggatacgtcgatacatctacatggcgctcgtggtctcgtagaacataggggtgggttttatgatgatgattagtgacaggtcgttcgtttctgcagttgcacggctgagattgcaccaatcatggtttacttttccactaaccgaattccacggtgtcaattgtaccacactacccattaaataaaacaagaactgtaccacgctacattttcagctgttttgagtaggacttgtgagtttgagcgttgagactgctccgatcaacaggccaatgatatcgttttggcgacaaatcgccgtcatattataaattttctaacccaaaaggagcgcgatactgcaacgagcaagtttgacccggctaaaaaaaattaacgatcttgctatatttttgtcaataaatttaaattttgacagatgtaaatatagttcaatcacattataattatattataacttgtatgtaactgcaatataattttaaatcattcaatttgctttaaaatttgtgcgagggaggtaagaaaatacttaaacccacacacatgtgaggggattcgataccattataccttctttttggcaaaatagcatgttgtcatggttatggatatcacgtacctaatagtagttgactaaatctcggcaggacccaccacataccatgtcctatacggaaactgacttcagatatggaggaagttcaggataaggaaagacaaccagagttctacatggaaacgacaagaactactcggattgtatccatattggtttccttagttctacttggataaggggacacctatgggtataaatacaagcccccctaggaggagaggggggacacccaacatgagaccatggaagacacccatgacaatcaacacacacccaccagaagccacaacatacaagccaacatacgccaagacacgccgccggatatcgacttcaggataggcatggctattcccctacggatcctccggataccgtcaggagatacgaaagcgctatctctgatctcgccgggcacggatttgaggaggaagactaccctgttgtcgactacgagtcagaccttcagaccgccatgtcgacaacagttagataggctacccacatattgtactggtgtaattatggtgaataagagcaataccggtttcggccaacaggatgtagggttattaccttactactcaggggcccgaacctgtataaaaatccctgtctccatctcttttacctcagtctcgcgtatatcctagcaccaacgatcccatactgtccaaataccgtagtcgagacatcaaacgtcgacacatgtcacctaggatttttaaaaaaatacatacaaattatactatagttacatgcatcttacaatataattatatttcaattttactttatctgtttcacaatgtaagtcattctagcatttccaatattcatattaatgttaatgaatatagacataacatcaatatgaatgtggaaaatgttagaatgacttacattgtgaaacatagggagtactatatttacatttgctaaatctttttaagttaaaatttaacgataaatgtatagttagtcctaaaattaagcgagattagacggccagggtcactaaattagctcccattttctggcccaaaatagtctacacgaatcggccctggtaatgatgtggcccacggagcgagccggcccaccaccgcgcgcgagggagccggaggaccacgcgtcgcgcgcgccgcggcgccgcgcgcatcggcctcgacgacatcttcgcgggggaagcagcgagcgaccgatgcggcgatgcctctgcgctgcgcgcgcttgtcccgaccaccacctccatatataccggcgaggcgggaggcagggatcgaacgcccagcgagcggaggagaggagaggagatcagggggaggaagggtggccggcgcagcagatcggggcgggcggatttaggggaggagcgcgctagccgggagcggcggcgatggatgaggagtacgacgtgatcgtgctggggacggggctcaaggagtgcatcatcagcggcctcctctccgtcgatggcctcaaggtgaccgaatcccatctccaatctctcgaatgcaccctctgattgcaactcgacaatgcgttctactgctgctggtgcgtgcgtccgcattagtagatctcacggtgctgaaagtgagattttgtttcgtgctgctggaaaatttggatggttttacgcgtacgaatgtgaaatgtgtacctagactggatggcattgctgttgttcaggaacacaaatggcaagatcagagaaatattaggatttgctttctttctctttaaagaagaaaaactcgcacatatcttctacagattctcaacataaatctcgaccccagttaaaattataaaaaaaatggaatgatctcataagatcctactagtatattttagtggctgcccttttagacaaaaggaacaatgtacagttgtacactatcaagtcactgtttttgtctcgttcttgtgtatatacaggtccttcacatggacaggaacgattactatggaggagaatctacatcccttaatctcactaaggtgtgataacgtgatcatcttgccaacatttctttctctgtgcagtatataggaagaactgcaaagaccatgtaattttttcagcaaatctgatgttgtgttatctaatatttttctccgttcatatgatatgtatagctctggaagagattcaaaggcaacgagaccgctcctgaacatctgggtgtcagcaaggagtacaatgttgacatggttcccaaggtccgtcatcactggagcgttctctatcttccctgaatttttgcttacacgcaacttgctacaaattattcgtctgcagttcatgatggccaacggtgcactggtccgtgtactcatccacacgagtgtgacaaagtatctgaatttcaaggctgtcgacggcagcttcgtgtacaacaatggcaaggtgtggatctgatattcatatgttatgcaactgtcaaacattggtgcattttctgaattactgagtcacctttatttgtttggcgataccgacagatccacaaagttcctgcaactgatgtcgaggccttgaaatctaatctaatgggcctttttgaaaagcgccgtgctaggaaattcttcatatacgtgcaggattacgaagaggatgatccaaagtcacacgaaggcctggatctgcacaaggtcacgacgagagaagtcatctcgtaagttgactaagttgctgactgttaacaaacagaaaacaagttgtattttgccaccatttcttatgcaggcgttatgatgtttgcttgtcagcaagtatggcctcgaggatgacacagtggactttattgggcatgcattggcacttcatcgagatgataactatctcgatgaacctgcaattgacactgtgaaaaggatgaaggtactatatgccccctaactcaagaaaacatttgagtctgcgtatattctgctcactgttgaaaacaacgatgctttgatcaattctctatgcaccacaactatatagtcaaaaaaaatccgagtgttatgcacttatgctgttgatttagttaatggttagttgttcttaacctcgtggccagatgaagtgattgggtgcccttatgataatgttcagtctattttatggaataaaaaatatatgattccacatggcagatgattgcaaatatatcatcagcttatattgccgtgcatgtggaaggtggaattaacatccgatcctcacatttgtatctgtttcaatagctttacgcagaatcactcgctcgttttcaaggaggatcaccttatatctaccctctgtatgggctagcagagctccctcaggtatgctcagttcaaataatctggattctccacacagcttcagcttcattccagctgaaactctgcatattgtaataggcctttgctcgtttgagtgctgtttatggtggcacatacatgctaaacaaagcagaatgcaaggtaaccgaagcattgctcagatgctactttggtactttccaactatccagatgaatgcttataattctacggtcgttggcaggttgagtttgatgaaaatgggaaagcatacggtgtcacttccgagggggagactgcaaaatgcaagaaggttgtctgtgacccttcatacttgcctgacaaggtatttataccatttagactcattttgagatattcaggttcaatttatggtagtatatctacttaaattcctgtcaacaaatgaacaggtgaagaaggttggaagggtggcgcgtgcaatatgcataatgaagcatccgattcctgacaccaaggattctcattccgtgcagatcatcctcccaaagaaacagctgaagcgcaaatcagacatgtaagcaatttactcgtccctcagttcttgctgcaacgacagccatcaaagtctattgctccatttctgagaacttatagcgttcagatattgcataattcacactattgcatatgtttcatgtttggtttcaggtacgtgttctgttgctcatatgctcacaacgttgcaccaaaaggcaagttcatcgcctttgttctacggaagcagaggctgacaagcctgagatcgagctgaaacctgggatcgatctgctcggacctgtagaggaaacattttttgacatctatgaccgatacgaacctactaataccgctgacgaggacaactgcttcgtgacaaatgtaagttcagcaaatcagcaatttctctactcggccacactgcagtattgttgatgagcaccttcggttcttacagagttacgatgcaactactcattttgagacaacggtgaaggatgtgcttgcattgtacagcaagatcactggg

SEQ ID NO: 66847 - DNA, 25954 bp, Oryza sativa
gcttgaatggatctgatttgggggaagaaattggcgctagggttccggggagagagagacgagccggccggctggaggtggagacgcgcctgacaggcgggtcccacgtggggcgcgcgtgagggcgccgccgcgcgggggagcgcggcttgggccgggaggcggcccaggtgggatggggcggggagacttgggccggggcaggccgggaggagaagaggggcagtggccggcctggaaggagggaaaaggaggaaggaagaagagggagaggagtaggactttcggccgcgggccgaggggagagaggaagactttgggcccaaaggaaaggaagactaatttttagtttttctttttaataaactgtgacaattgtttttttttgcttaataaatattttcggtgctttgaaaattcatgtaaaatttgagggatccttttaaaccaaggagaatttaagaaaaatacgctggggcacattcaattttttttcttgtatgcattttaatgtttgccaattttttttttcaaattttaattaattatattattccttttggagaatgatttttaattcgggatgaatttatcaggacgtgacaaatcctcccccattacaagaatctcacccccgagattcgagaaggctacaataagataggtagggcggtcttctcttctttgtccggcttcttctgttgtatcttctttagcaaacttgtccagcaaaactacccaactctgaactgcttggtttggtctctcggtgcagacgaaatattctcttcgcctgatcttgaacctggttgcacctttagctgatctagactgggttgcggtacttgtagatgaggcaacctaatagttgtggcatagaagggtgctacctaaggtgatgtttgaatctcccgaagatgaagataaaaatgaagattaagtgtaacgaggtgataataacgtgtgattaattaagttttaattattacaaacttgaaaaataaattaatcttatattttagaacaactttcatatagaaagttttcgcacgaaacgtactgtttagcagtttaaaaagcgtgccactttaatctaaaattttatccacccatttcagtacattcgaacgggccccttaacacacttaaaaaactatttttttgaatactttctatctaaagtttatttaaaataaataaataaatctatttttttaagtttgcaatagtatagtgcatcgtcgagtccttaaacttgtacgatcgtgctatttaagtccctaaatactacaatatatattcaagtttgaacttatcaaagtatgccattctggttccaaaccaccatggcctctccgagatccaacctagcgacgacgtgacatcatcactactctacactcaagtagagcctcgatgtccacatgaagaagaggagaaaaggaaatgaaaaggaaaaaggataataacaaaatttctgaacagaccctacttgttagtcatcgtaacatcggtgaatatgccatgtcagcattcgtctaacgtgccatgataacgccatttaggatctcgaatagaccatgacaattttgagaccggaataacgtactttggcaagttctagacataaacatatatcttgagagtttaaacatctagattatacggttgtataaatttagggaccaatccaatactttactctctaattaattatgcgcaacctaggcatatattaacctctctaaaccgcgtaggatcgctgaaaatttagagcatcacatcagccattgttttgcaaaaaaaaatcctgtatctcaagttaattatgtatcgatcctcgctacccttcaccgatcctgggataggatcgatctgaccgtacaggtgtcctgttctacctagccatatattaaaacaaggagagcggttgagaacaagcacttccgaacgcagccttaaaatgattttcacttcaaaatgtaaatctttttttctgttacagttatgcaccacccggaattgtgaacgcgttgttgaacaactctggccatcacgtgccttgggcagaacaagtacgctcctgatgaagacccggagccccctctctcactctgatgaagacgaaggtccaaggccgcggataaagacaagaccggaagccgcggcaacccaccctctgcaaaatccccaaaatacccctacaaaaccccacaccgaaagcagcaaaacccacctgcccactgctcctccactcccaccaccaccgccaccgccggcgagatggccggagcgagacccttcttctcgccgcacgaagccttcgcccgagcctcgacggcctcctcacccgcggccgccgcgaccgtcgccgtcgcggcacctgctccggacccaagccccgccaccggccacgccgatgctgccgaggtcgccgtcttccgcctgctcctcccccaggccttctccgatgccgacgccatgcgcctctacgccgccatcgccccgctccgccgcctcttccccacgctgcaggtccgcgtcgagaccctcggagtcggagcctcgtccgatgatgccgacggcgacggcgacggcggaggtggtggtggtggtggtcgcgtcgccgtcgtcctcggccccgcctccccggcgcgccgcgtcgaggcctcctcgtcctccggggagcccctcgagctctcccccgcgcaggaggccctcgtcgccttgctcgacagcggctgggtcgtccacctcaacggcgaggcgtggggagcggagcggatgacgtgcctcgtcctggtcgaggccgggcgcctcgaggcggcctccgggaaggggatcctgtggacgatcgccaacgagtccggcgccgaggtgcgcgtcacgccgtggggtggtgagggcggggcggcgtacgcggcgcagccgcccgaggaggtcgtcgaggtataccactctcactgcgcgtaatgccccctgttgcttcgattgttatcatacactgttgcaaaattgaacctacgttggtttctgcggcaattgggcaagtagagattaaacaatgtgtgggcgtgcttgtttacgtcaagggcttagggggaatttggaagatagcgagtgcagcatgttctacaggtgccatttcagggtgaaaacgcaaaaggatgacacttttttaggggaggatgagcagctgcatactgtggagcctgaacaatcatgtggagacatgcatgatgatttatttgtgtaatgtttagggcactctcatgaatgcattctaagcaagagcttggcacacttagcaatgcttggcatgtgatgtgcatgttccttatgtgatatccccatctgtgaaaaagtatgttcgagtatttccctagtgcactgtttactgtcttgaactcaatccttttttgagttcttgtttcatgcgtatgctttggatttattgtgatataggacggtgaagtttgacaagagtccatttctgtttttgtttcaacagctgtatggaatatatgaaataattaacttattaaaggattgtgtgtggataggttatctacacaactgataaaccatatgcttcacaaacacgctcatccatgtctcatggtctcatctgtgaaccacttcagcagtgactttatctaagtggcttctgattccttatttgtgatctgactggtgaagtagagtataaaattattgatgtgcgttatcagtaagtccaaaatgaataataaggacctttttttattttatcatgttctaattaatatttactgaactgctgttaatggaagtcatgtaaatcattcgactaatttttttgatgagtgaactgcgtactggagacggttaagaagtaacaaacaaaaatgttgctagggattaactgtcttttccctgttctatgtattttaaaaaataggttatttttacctcctttgtgtactgacaaaattttatgttgtttatgttaatctacagttataattcattgcttcttgatgtaacttcagataacaggagatggaaccactgtaaggagagctcttgtttctgtgtctagctgtcttcaaggtgatgggccacttggcagctcaacttctgctcattcagtgaacccaattctcacacaaacatttccaaaagtgcctgagcctgaaatgggatctttgtattcagatatgtcaactgagcgtgcaaacaccagcattcctcatattgattgtccacagggtgctacaggaattgaacaaactgaatgtgtcatgcaattttcatttagactactctgccctgtaactcttgctggaggtttgataggaaagaatggcatggttatcaaagcaattgaagttaactctggtgcttctgttgatgtcggtggacctgttcatcggtgcatggaacgtgcgataacagtatcagccttggaggtttgaacatttccccataaatgtttttatgcaccatgtttcattgcgtgatgtacatagcataattttgcagcttttatgatggatgtttaatgtagaaactcttttgattttatattaattcttgtgagctttgttgtgcatttgattcattataactatggtttcttttcactcatgtagaaaccaggacagaaattctccatggtggagaatgcggtacttcgtatatttgacagaatgcaggtggtggaaagcaatatgcattcgagacccaataatccattgcattgctctgccagggttctaattctgaaaggccaatttggttatttagttggtccaggtggttcactaatcaagcatatgaataacacaacaagaacaaaaatgaaaattttagaagagactgctgttccagcttgtgcctcacaatacgaactagttctgcaggcaagcacttttctggtataatacaaaacagtttttgttgtacttgtttctgctttcatgctaagtagagatgtgagaagacggtgacagtatttagggttaacctgatgcatctaatcttaaccatctgatcctcttaatttttgttcaaagagtactcaatgcatagaggcatagactcagtagttcgcttcaatttttcacttctacttctcttaattcatgatcggttgatttctgatccttacactcttactatgttttgacagctcaatacttatttagtttggtattttcttttctctacagatcactggagagccaatgaatgttagagacgctttatctcttgtttgtgagaaactacgtaatcattgcttctcttctgagaaaacaacctacggcaatggtcatgttccctcatcggctattgatgaattaactacaagcagccaggttaatatctcttcaactggtcaatattcagctggcaatttgtcaagggttgatcacaggctttctcagaatgaaattgactcggtacaaaactctatcagcgccttcgacttgggatgtttgggctccccacaaattcaggttatgtattacataccttttccttgttatacatgctaaagtttctcttccttcctggatttgtgtacgatacatgcatattatgttctaaatgtttaaagagcaaaactaaatcagatgttgtacaagaaagttacatattactaacctatcaaaaactaatttgatattatgcatttggtaaagttgcaaggatcattgtagtggtctggaatgcctgtgtgaagtgtttctacttctgttgaattcttatattatcaaatttacataatttctatcttttgctgctgtgactgtgagcaacataagttgcagtaaagagatccctggctgtgttcttttggctgtgttgggaacaaatctcctgtgcacggaaaacaaagtgatccattagcgtgtgattaattaattatctattattttttttgaaaatggatcaatatgattttttaaagcaactaccgtacagaaaagttttgcaaaaaaacacaccatttagcagtttgaaaagcgcgtgcgcggaaaacgagagaggtgagttgggaaagttggggaaagaactcagccaaaactggatatttaagatatctgtcatttttttactgcaagtgcaaaccaagtcctagcctaggtgctaatcaaacttatcctctgctaatgttttgctcattataaaactgtcatatatttgagtcattcttttatagaggacgagtgtttggaaattttagtttcactcagagctcactgctaaatagatcgcatagagcactcatgcaaatatttgcaaagtgactagtaccttttattgctgaataggacacaatgaaatatttttgtccaattatgtatcctcctgtcactttgcagcctattataaattttgatgcacggtttttctgtggaagtactaaacaaatatttggatgcagaaacctaccattgggtgtggcactgagatcaacaacccaattaatgaggtggagaaaccagctaatggaaatggcactggaattaacaatttgaatactgggatgcagaatgaaaatggaattgacgtttcaaatcatggagctacatctctggaggaaaaaaaacttttgaggtaatagtcatatttgtttgtaacccatttctacccttgtccctttagaagtggtcattgcgtaagattattttataacagatcctgtctatggcacttcaatttttttcttgtatgtcaaatcacaaaaaccaatatcgtcttgggttcttattccattttagcataattgtcagctatttagtatcatagatctttctatttagagcccaagacgctactagcaccctgccatttacgtgagggatgcactttactgcttagaatgttgtatgtacagtcacaggaatgcatttagggttgctggatgcatgtactacttcatgggtaatgtgtttacagtctcaagcgcaggcctggattatcagcaaactcactgtttatccagaaattaatgcttagagcagcaccaaactgttgtattcaaatttggtcttatattaatagtttgtactattttattatgtcttgttcttcaagtcctgtacaggaaacatcccatggcaaacttcaaacagaatatctattttggtccaatggaaaacaatgaatagcaacaagtattgctgtgcacgattaatcttctgtgctctagcacccttgtagttgtgattgaactttagcaattcaatgtattatatatgcgtcacacaagtggttccaccagttatgtgcctaatactatatatttttataatattttgttcttgatgaagtaatgaatttgcaattggtactgtacatgttttgaatatagcatgcatgtcttagttaataactagaagggatcaacaaagggcaaataacatcagctgtataaacttccattcctatatgtcacattcctttggttattttacataatggtttgtgcatttattgatgctatgctttagtgacctgtaaatggcactaactacaattacaatgatttctgcttctggccacagaggaatcaagactgccaccataactaggatcacatatgaggttgctgtttgcggagataatggaaacgacttcactatgattagagaggtattaacggagaattatgtgatcgtgtatgcttattttgattgcctttgagaatttacttcaaataaatgctggtgtttctgagttttatttttttaaaaaaaattgattaaatgcttcctggattgggaaaaagaaactggttaagtcattacgttttgaactcagaactgaccttgctgatcatgtgtgttttcaaaatgctgtactggtctggtttagtaaagacacctagttcttcattctagaccatttaaatggtgtgcagctttaggtgttccttgatttggaaaatctgaagaaatttacatttccagcctctacatctatgatgcattgatgcatatgatgtacgtagccattaagtttgagattaaacaagggacagaacctcccaagagattaaataagcaaaacacgagattaaatttacactgttagggcctgtttgatatggatgaaaggcgctctaccatgatgattaaatattgtatattataaacctaacaaatactagcttaaaacaagtggtgtaaacaatgctgatgtagaaagtttttggagatatcatacttttggaagcataccacgaataattgcaaccattaatctaagcatgaagcctgttactagcttgttgtccaaagagggtgaataagcccctagaggatgacgatagactgttgtccaaagagggtgaataagcccctagaggatgacgatagactctaagagtgtggctgcgataagcataatatttttgttctctttgatactgcctcgaacaccatacacagagctagctgatattactaggaaagtatttacttcaattatcctttgtgtttttgccagttctatttttctgtgtttctatcccaactctttcattatatgtccgcgcaatcttttttctttttggaccagtaagttcaaaatttattgattgccttcgaagttacattgctgattttctactctgattggtattgaactttatggagctaatctaccattttttattttgtgaatactcagatgtctggtgcagacgttactgcccactacccgcttccagagacgagtgacggtatgatcgtgatatctggaacgccagatgaggcgcaatcggctctggccatgttccttgaccttgtcaaagaggggcagtgatcatcatcagatcttcatgcattagccctgattctgctaacatagatcactgttgggatggatctgctaacattttgctgacaccacgagatgttcttgaggttaactgacaacattttatgtgtaactatgtccagtaacgacaccacgagactagggttcatcacgggacaccacgaggcagacgcattcctctgtttgctgaatgtagcagcagagcaggcgcgtgatttatttatgtttctttttctttttacttaatccttttgtgctcttgctgctgggggaggccttaattgagatggatatctgcctatttttttgcatgccatttttcccttgttgacggtgttgagttttgtcgcgcccgtccaggctggggtattacagttggtaacttgatggtgagttatgtagtagcacacgggggtattacaaccttttgcctggatctttcggaagatcggagtaagggtaatatttggaggttggagcaatgagcaatccatcgatacatcgcaggctaaggggttcgggtcgattacctgcttagagaatcaaattacccctagctaagcggcatgaaaattattcagcctcttgtgctcgagcgtttgtcctgcaaacggtgagtgaaagatatcacgaaatctttcataattatatcatcgagtatttaattatggtgatatgtgatggtatcaccaaggtatcagggcacctcatgacatcccatggaatcatgaattcatgataacacaaaaaaaatatgatgggagaattctcctttgccactcattgcaattgtactctcttcctcatccaaatctttccttccgtttctttacctttattttgttagtgtgctcttttgttttgccatggctgttaggtcaatagtaattcgatctttaacttaattcttaaaagaccattatgtcctcctagtccttgtagatgttcagtagcacttgaattttagcaaacaccaagaaaaggccaagaaatccaaatatcggccactacaaaaagattattagaaaatatataaaaatgggcattacgacgtaattatttttatcctaaaatatagcaacctagtcctgtattgaacacaacctagttgacgagttgttctgtgtctgcctaccaccacgccatcatcgccatgggaacactggctgctgcccaaacgcccctctgcatgagggtgcccatgcacaccccctcactaccacataaactaccacataaacagatattattgtcggctcatcactgttggttttatgataagtggatgccagatcaaaagattaatttttggaaatgaactggaagtgatgctagtatccctaccaattcaactttcaatgtcagttcatcacattaatcggtagtgataagtgaccgttacatctaaattaaagggttaggattcactgctctaatttatataaattggacaaattgccagtctcactgttccatcctcctctctcccctctcatcactcctctcaccctcatatcccctcccgtcactcctctcccccctgatttggtcggcggcacccgccaactcccatcgtgccacccactgccatcccctctatcagagaaatgagaactagggttcccacttcctcggctgctcgaggtactgcggagtagttaacgttaaaatttggtacggttctttagtgaattcagttaaggaaagaagtccttaatcaagattgaagtagatggaaattaatcgagatcaagctgaattcaaagatgactcgtgaagaccacgacaagtcagtttcatatttagtatatctcttaataggcaggttaaattattttccttttcttgctaggagtcatatctcgtgtccgatcataacttgtatcaacccgagggtatactatgtacaaccagggtctttgtaaactatctccatagatcaatacaattacttttggcgcattgccaccttttactctcaacgagttcttagtttcgagttggactacatctgtttcgatctcctgcgatgaagtaagtttcgtcaaattcgcttgtatcggcatgtttagaactttttcggttaagtccgatattctattcaggttgacgcaagcgttgcctatatcatatattgattctatctttaattgtaccattgtttagagtcgtatcggcttagatagaactttctcagttaggttcgatattctgattaagttggtatttctctaaatcgtactactattttaaatacacttattatatcctttacatttgtgtggatctatcggctaaatagttttttcttattatcttcaatcttatactgtgtcagttagatccgatctattagattgctattaaaagtttatttctagtaagccgatatatttttatgcaatgttcaatgagttatcttgttactttctctaagtgttctattgtcttatactcaaatttgtatagtcactagttaaacatctctatatcaactttaatcttattctgtctcggttaggtccaatctatcaagattgtctttgataaagaataaattactaataattatgcattttttaattcaagccgatgataacatgaatctccatcgagcctatagccgattgatcaaaaccttgttgagctggccttgctacatcacattagcctattggccgatcggctcttggttcttatactgtcaatccatctatcttgttagttgcaggatcaaactaactagtatgtcttaaacccaattgattgaacctacactataaacccaattgattgaacctacactgaagctaaaaacatctctcgggctttcatgtgtggcgacgtaattgcatgtcaacaggagttcaccaacagccactacagacttttgtgggggcccaggaaaactgcgtcgagacaagcaaggtgactgaggacgtttcagctcgggcccgagtcgccatctgctcggggccatgacggctgcttcaactgctgcaagtgggccacattcctctttactgttgcatcaagattacatcttggcaacggattatggcctttggccgttgcagtattaccccgtctatacacccaaccagatatgtgtggtcatttaaattgggaacttagccctataaataatctaatctgaaattcactcttatgaagatttgcactcaggattttgagatactactaaggtcactgcaatcactagactacatgccctttcgcaaaattgtgatttacgcctggggtagtcatgcatgatcatttgatttatcagctctcttttttttacatggcccttttcccttgctgataatgtttattgagttgtcttgtgttgccatacagggggttttcccaaatttacatggatattattctttgagaaggtcagtttggtttcacttacataatagagagtccagctcagagtttggacgaatacatccaaaagatcactaacagagggtattttcaggaagtttaattagttgaggggatgcggttacttctcacacgcattgtccgctctcaacattgtgaaatgcatttcgaagctaacccacatgaaggatgaaaatgctttctattgtgtgggctatctaccaacacatcacatatatttaggaaaaattctatatacacccctaaatattagattgaagtccgtacacaggggcgaagctacattgatgagggggttcctaggcacctggttcagaaaaacttttaacctgtaattagcccacactcaccataagtgcacccacctcggaacaatagtgtgtaccctttcacaaaataatcagccaagcaagacaacaagcaagtagccaacacaagcgtatatgctcacagacgtagccataacaaatgtcgccgccaccgcatgtgttgatcaaatcacaggggggccatgcgtgatgcccagcagccaacctcatcaagcctataccttaattacctcatcaaatcttttttgtcactgaacatactaaccaatattatcatttgggttttccgttttggtaagcactttcatcgctagaattttatttcctacatcactcttcttgcttatgtgaaactatcgatgctaaaaaataatactgtgctggtattgttatagtgttgtatgttgtatatataataaaaacatacaccctccgtcccatacaaagcactggtttagttccaaaatttttcttgaaacttccaactttttcatcacatcaaaacttttctatacacacaaacttccaacttttccttcgcatcgttccaatttcaaccaaacttttaattttagcgtgaactaaacacacctaaaacaaagttctagccagtaagctagacataccctatatctaaattcgtagtcagaagttgatttttttaaagaataaagcaagtataccactaaaaatagtggtgcacccccctccattttgcgctggcttcaccactgtccgtacagtaccctaaactttaaaaccagagatttaaccccccaccccccaccccccccccccaaaaaaacattgcaatgccatttatattaccccattagatactttcggatgatggttttgtgcaattgaaagcttaaaagagcagttttaaatagctagtttatcgtattttacgtatcattgatcaccggtcatcaatttatattctcccatgatgtcatattaatattatatcgacatcgtttgtaaatgagagctaaaaatattaggtaaaaaaaaggtttaggtggagattttattatatatgtcaatacatatgtcatatcgataaactcatccgacgtatatgcaaattagataaaaaccactttttcctaagaatcgttaagccaaataagaaatgaagatagacatatcattcataatattcataatattgttgtttggtaccatggcatattccaggcgcacaaggtacgtaccaaagtttatggcaaatccttaaattagtccatcataataaaaattcctaacccgctatagaattcctaacaacaaagaaagcaagaagtccaacccctgacaaagagtacatcagtgcaaatttgcttgtgctgcgttctgaaacctaaagatcatcccattaacatggaatcgtcgcgccgtgtttggggtactgtacaagtaaagtctagctgatgcgctaggacaaatttgatttgctgttcaaaataaagaaaaaacgagttaattttagctttgccaaacactagttagatcgccgtcgagcccactcaatggccaataggatccgcattttggggagaccctcattcacatcctccttgtctatcacctgattctaaaatgaacttgtcacatcatttcgcttattcgcgagtaagcgaaacggtatatttgtaaacgaaaagtaatttatgaataaaacttttatatacgtgttcttagtgatctagcaacaaaggctgaaaaataaacttcgatgaaaaaacctcaaaatcacctccaaatttaaggttaaaaatttaatttttagctgataagcataatgatgagcgaaaagatgaggtccgattcttttagtgaaccagtttgctgacaatatgattgaatacaagataccaaatgaattttccaataaaagataacacagtagtgtatttgtttttcttgttacccggccgtgacatcagtatcgccactacgaggtaaaagcttaataaggtcatgttgacttcgaattaaatttagaaatatactgttcattcattttatttttagaaatattcggaatttaaaactttttaaaaaatataccgtcgatctcgcacaaccattacgcgaaagtgacgtggacgtgatatcatgggcggtatcacgctgggaaagagcgagaccgcgcggtctcgcgaaatggaagagcgagaccgttcggtctcgcttaaccaatcaacgataccggatttcaaaatggttgattagtgattaattaccataattaatgattaattaattattaattaatcgctaattattattagttaaataattaattaggtcgttagtcactaacctaatgcagtttaggacggtgtcgctctctgcttgagcgagaccgctcgtccttcccgcgctctcgccccgtcgccgcgcgagaccgtgcggtctcacgccctagcagcgcgagtccgcggggtcttacgctttctccgcgcgataccgtcctcaacgtcacctctgcgtcattttcgctcaacggtagagcgagatcgatggtatatttctacaataaaatttacatcccgaatatttttgaaaataaattgaataaataatatattttcaaatttaattatgttgacttcaaacttacctgggtatagacttcaaacttgtcctcttttaaggctgccttagttctggaaaaaaaaagaggctgccttctaattttgtgaagaacctgacgattctcaaattgatgaactcggcacaatgttttgaaaagttgaagcaaaaacagtcaaagtggaacaagccaaaccttcagataattctgtatcgaacagtttcgtaattttgaaaaaaaaaactaaaaatgaaaaagaagagaatatgtattttcgttgagttagattataatgaattgagatgcatatgtggttaaacctcacacgcttaaatgcatttcgaaactgacgcagctgaagaataaaaatgcatgctacctgccaacactccacatgcattatatatgtttactttttggatggttgcaaacatataaacttgttggtggcatgaaacagcaaagacaagaaaattaattctctgatgcgaggaaggttaggagtgcgtatcagatttaacaatagacatatatggttgattcagttcttacatacctaagattggtaacattcagagggtatagatagcagattgacattttctttagtgaagatttgttttgcaatgtgagttgaatggtaactgcacagaaaattatcacctaatcttagtaaatttggctaacaccccaaatagttacactataaaccaataaaaattacatccaattataacatgtaattttagtgacaacgggtttaatttgctcacactctcaatggaaattccatgagagcacacaaatcaagaagagaaaaagactggtgtctgcacatagtactgcagtttttattaagaagcaatcaattttccaccatgatgtgtatagcatgcatcttaaccgaataacttttttttaatttgaggcagttgaatagcaaactaaaaagcattcatttatgattaaagaaagcatatgataatatttatttatttattaattgaaataaatcttgtatgagagtacaaataaggtagacaaccctaccatttgagcaaagtgtagcaaataaacctaatagggagtgaggataaaaaagacatccatctacaaattaggtgttcactaactttaatttgttattggaaatacaatggtaataagaacaatagatacaagggtaaattgaatctataccattgcaaatttaccatattagataaatgctattaccattcgcgatatcggttgcgtgccactaaaattttgtaaaattttaatcataccactaccatccaattttgtatcatcgccatctatttctatccgttctctcctttctctatcgacattacggcgcacgttgtgcgccctatcgatgagcagatagcacaacgataaaaaaaagctctcagacaaaccaaatgatccgaggcaagttctatcgagattagataaatcgatgtaacgaagcaatgggagatagacataacctgcgattttctatcatagaatgataaaaacaaaagataatgagagggaaactcataaacaaattatcttatatttcactgaacaacattacacagggcacactggcaagatgaccagtaattatcaacagccaaatatacagagattgaaccgtcacactggatggcctcttttatttattcatcacttcatcccagataggcacgttggtgcttgctacagtcaataatctcttaacattagcagttgcaccggttgcacttgtagcaggagacatgggcaacatcataggagccagcagccacctccaacgctgcttcgccgtgcctgcaaaattaagcagacaaattcaggcctagaaaaaatgttatctgattcataagtttcttcagctcagtttctttttaagatgaaatatatgcgaattatcccttttcaggtgcaacaaaggaacatgttagctgaggtggttgtggtgttcttctccaccagatcagtgtactgtgtacatcttcctgaaccaataaaaaaagcatggcataaataaatgtaaagtaaccgatagtactgaataaaatgtcttttcatcttcatgcagctttatctgaagaaactttgaagcaaagggaattaacacacaacatatagtatatctttgaagcaatggaaataacattattttttatcatggaaaatatgaaatcacacatctctgaaagcttgtgtcagtttattttgacaaatcaatatctaaaaggcttacccgcagccattgccacagttgaacaaaaagatggatcagcagactactcactgaggtgattacagcaaagttataggcacacatatactacctgtgtagaagctggatcttcttgttctacctgcatagaatgaagcacatgcaagcacaggcgaggcaaatccactgcaggagagtgcaccccacattgtaaggcgagtgcttacccaatgtacatgcaacaataaaactaacggaaaattgcaacgtcgtaatcatagtttggttataaaaattaggcctttagctaaaatgctgaatgaatagcagaacacaaaacagcaaggttttgagaaatctaatgatatatatttattttgaacaaaggttttccttccctatgcatcactcttttccttcctgaaattaaactacattgctactatccactattcatcagctagcacaaaatcactacaatgtcacaggttgataagaactaatatttaggttctttatagtcgagcactcaggcaatggaagacaacttctattaaatgagtagcaagccagaacaaaagcttcaggaatattatcaataattcttatagcttatgaaatttggatccatattatgagaattttttaaaaaaagaggttatgtgtacacatagatcacagactacaggcttatattcatctactctgcaaaagaacagagttatcacaaaaagcaaagctctaaccaaaaactgcaaaactaacatagttataagccgacaaaataagctatgtttgtctttgctttatgcggatgtatctggcttctctatactggttttcttgcattatggagcattcagtgcggcaacaattcttgctccatctctgatatgacgccaccaccgctacagagcatgacaaagtgagcatagaggaggggaggaggagccaatgaatggcccaactgattctgacaatccagtataatatgagtaaggtagcaccattatactttgtcctaaactcctactaatttgagaagaggacctagcatgtgctaaattgcatcaaaccataaatccataaatttaaatggttgttatatgcctagtttacattattttagtccattgactgacaaacagacaactaaatctcacgtccaaaaagaacaacgcgtgtataataaaatgacagaaatgctaaccttgttcctactctaaaaacctacaatctttattagctcaagccatagacttaagtttcctcgctcttataaggcatatatccagatgttcagtattaataagctatcaaaaatctcccttcaaaaaaaaaagctatcaaaaatatacaccaattagccaagatcttgtgttgctcagatgaatctgatcccaagatcatgtggctcatccccagagagcatattgatgtgtactctcatccatagaatcctgagatcatactgatgcgtactttgatgtgatgcgaatttgcaacatacaaagaaaaacaaagacaaagcaactactctgccttgttccagcactgcaaccctggattgggcaccgaactgtcaaactcgaactccacgccactgcatcggttgtctttgctgctcaacttgctgcttacaatctgttctccctcctcccctcgtggctaggagaggagagaaacactaatctggccaagaaaaacatcatcctttatagttgggaactcgaagagccaaattcgaacaaattctctgtcgatagccaatgattcacatcggaaggggcagaacagattaaagggtcagacttgtgcaccaaattcaaccaatgggagcagctggaatagagaaccaacaccaaatccagccccgcaagaggaaagcatcacctggtagggaggaggagaaagatgcaccgccacttgaatggaatagcagtagtataccaggatgccacggtgcgccgacgctacgctgggctgccgcgcctgcacgcgttgcatccacgctgccattcgcccttgctctcgcacccagctgctgcgccgccgccaagcacccgcgtcctgctgcaagcctcaactcatctccaaccctagcctccgaatggatagtgatgctgctagccaccgctagatctgaaggtggctcgttctctgtcggggcagcgacgtactgggagaggggcaaggagatggaagaaggaaggtgagggcatgtgggagaggtcgtcgccggcggggaggcaaggtggcggccgtcgtgatggcaaaggagagagagcgagagcggggaatcgtgacggctagggttccgggaggtgagagttagggatacttttttgcaaaaagacaccctgcttttcatttttcagagcgcacttctattttctgaattttctctcctttgcataagatattgttggttatggagggcctttacgtgagaatacaaaactaaggaacccaagatgagggacctacaacaaattaagaataaaattaagggtgtttttgcaaaatagccagcttacgaaagtcccacgctccaagcgcgcgaggcgacgtggatagcgtgggaggcgagcacgcagcctcaaatcgctgtgggagcagcaactcagggcaggttttaatataaccgatgctgtcgcgcgcgcgctctctctctcttgtcctctgcttccaatccagcgccggcgagatgggccagtaggtagcgacacggacggccacctctcacattggccatgtacatgtattgcctgttataattgatcgaaggcgagtagtactctattgaaaatttggtcataattcggcgtattttaattcaaaaaaacaagataataaacatgatatttacaatgggatttgatctagtgatagtggtgaatgtaatcaacatgagcatgcttaacgtagaataagcatcaacaatcacataataacgcaatgttgacattgcgatgaacattaatagtaaaatttctaattgaaataatgtaagaaggttataccccaggaatggtcctccgctggagtttgagacagtattgcctccgttggtgttgacggaagcctccttctccttgtctctagtgttgccgttgtctccagtgtttgacatgttggtgaagacgaagtagacgttgacgaacagtgagtagtcgtgccttgcgctccccaaaaacctgatcgtccgcccgtccgtgcaaacgtcgcagcagtgcgtggtttcggaggcctactctcccaacgcgtgtacacacactcatcgggatgggattactgtagcagcaacagccttggaaatggatgaaagtgtgtctatcttctccttagggagatcaaatccattctcattttatatgaggaatggaagatgaagagtaagagtcatggaataagaagaggaatagagtaactaattctcatcaattagccatgaaccatcctccactgtacaaccatcaaccaaccatcaattaggagtaattgctgtaggttatcaatggaataggaagaggaatagagcaactaattatcatcaactagccatgaaccatcctccactatacaaccatcaaccatccatcaattaggagtaattgatataagttaccaattccctaatcaaattgattaattctcaaaactcctcatcccattgatatcccataagagaatgaatacacatgaattcctagtataatgagccttgaaatttatttgacttaattgatttaaatggatcaattacccaattaaatctaacactctcaccttcaatctttcatcaacaatcgatccggcgggcaaggcaggcaggacagggaatggctaactcgatcgatcagatcagtactgattgaaagcagcaaacgcaaacgtgtcatccctgcagttttccgctagccgctcgatgtcgtcagtggagccgcaggggagcgcccaaagcccgcccatggcgccggcgtaggcgtgccccatctcggagaggaccaccaccgccatcttccggaggactgaccatggagctccgcagcacgaacggcaccgaacacctgcagggcgagcttctccgctagcaagaggtgttgaataaaccccggcgtgttctagttaggatagttagttgagtttccttgttttcagctgagcccgagttttgggcgcgtcttgtacagaggctcgacgtgtgcacgttcacgcgggagtctggtagtcgtgagcgagtctcgcggcacgctcgagctgtgggatggcgcagttcgtgaagagcgtggcgtgcggtgcgcgcgtcatggccggcatggccatatgttttttttctcctataaatagcaagagctacagaaaacgcggtgattttttttggccgcaccaattccctgtccacgttcgtgtgtgttctgtgttgtgttgcagctcccggcgttgtcttcctcaactccggcgaccgctccgactccggcgagggtcggaacaagaggcgagtcgaacgggttcatggacaccaagaatccgctgccgcgcatttgcaccgtcgtcccagggcccggccccgagtctggcacaactggcaccgatgtcttcttctccgacttgcttctcgatcgccgtcatggcctgcttcagcttccctacgtacccttgtcgttgtctacctcaagcttccatagaaactccactgtcaccatccccttcaaccgcgtcgaggcactactgcagaagcatcttctttggtgagctcgagtgggagccagggtttgaaatttcagttcgaaatttccgaaatttcggtaatttcgcccgtcaccggcatactcaaatctcgcccgaaatttttggctttttacaatttttttgtgaatttggttaaattttattcaaattcattcaaattaagtcaaattttcaaataatttcagccagaaatttccgaaattaccaaaatttcagaaatttcgcccccccccctctcccacctgcataaaatctaatttcgaaattgaaaaccctagtgggagcagcgcttccctcgctaacgccctccttgccatccactgcatttggctcaacaaggtggagagagatgagaggaggggaggatgaaggaagaaaatagaactgacatgttggtcccatatctagggttattttggtatatatgataacagaaaatgatttgatcataactactattgatataaccgttactcacatcattgttcaactagaagacatcaaagatcaaacagcagaaactgtggaatccaattcggtgacctgcaacaatattgacttcaaatggccgccaaatgtgcatacgatctccattttttgcccatgagtacttgatggaaaactttctgagtcctcttttcaacggatccagcttcatcttcaaattccatctcagtcggccacaatcacataaataagatgttgcgttagctataatatgcctatgggcttgtaactttatctgggaccccggcccaagtggggcccatgtgggatgcgccccaactaagtggaacacgaccctagtgacccctatattgttctcccacctccttaaatagctaggtaccccttcagggtttctctgattttgtttagattaaagtttagccattactatttgcttgcagcgcgcatgtcggctagaccgcccatctgtttgtcttcgaaaccccaacttatcatttgtatttaattcctgttcgcaattcagattgtttttatcttattcttgtctgtttctttgatttgcttacaggaacaaggttgatctacaccagctagttcaacaacccacggagaggtgtatcaatcgctaaggcgcaacacaacaacgtcttgtactgttgtagtgggattgtcaatgtttctttgaaatcgtagttatcccaactcaccgaaagatcgggccaatcaaagccgtgagcgtatcgactggagctaagagtttatcagaaaacatgatggcaatggcatgatttcaatttgtacatattcaaatggcatggatacgaatatacgaataataatagcatttatctaaaatgatacattcgtagtggatgaatctaattaaccctaaatataaaaatataaaaggtttctgttgaattggtacaacataaatccaattaagaaagagacaaatattttcatttagataaatttaactgaaagttctttctttttctttaaagaattccatcttccttaaaatatcataaagtcttgaagcatccacctccttgttgtatgcacgggaaaatgtgtagtgcaaatcttggattgaaaaatagacatacgaggttcgttcacgtcattaaatgtaaaaattttactaataggtttactcataagtaaattttttactcatggtgacgtggacgaatctcagacgtttatttttcaatctaacggtagttttcaagtttgcactgcatatatatatatatatatatatatatatatatatatatatatatatatatatatatagttttcaccgtatggttttcctgaatgcactgctgaccgagcatcatctgaaggcacttcccttgctcctctttacatccttattattttcaaaaattgctatacggcaataatgttctgttgacgttatgtcgaagagtagaggcagagctagctgatattattacgtatgtactgtattacttaaaaatttaattatcattttgtgttattaccaattgtatttttctgtgtttctatccagctactgcactataggttcgcagttttttttgttctttaaccgagtaagttcatggtttcttgattctgttttcgaagcgacgatgatgatttttctggtctatatttggtttgattaccaaaacattaatcacaggtcatagccgctggtgtcgtgttaacaaaataaccgtgatctacttaagagttttttcccgcgcagataatcattaagccaaatagaacatgaaggtaaacatatcatattgttgtttggtaccatttacatgttccaggcgcacaaggtaccaaagattatggcaatttcttgaattagttcatcataatcaaattcctaatccatgctatccagtccctaacaacaaagaaagcaagaagtcaaaccacctgacaaagagtacatcagtgcaaatttgcttgtgctgccttctgaaacctaaagatcatcccattaacacggaatcgtcgctgccgtgtttggggtactgtacaactaaagtctagctacaagcgctggggcaagctttgatatgctgttcacaacaatgttctgttccccgtgaaaaggcaaaaacgatttaattttagctttgccaaacatcagtcagatagccatcgagcccattcaatggccacttgggtccacatcttggagagaccctcatcacatcctcattatctgtcacctgattctgaaacaaaaatttaaggatcatcaattatctcaatctcaacattattaagctggtatcagcagcatgaatatgactttaatggattctcatgcctgtttgtttggctattccgttctgactgttctctggaacatccttcacggcagaagattctggaagatcagaagatggctttgttccttctgctgaggttgaagcatccaccgccttgtctgtcccaggtatgcactgctgctcgagcatcatctgaaggcacttcccttgctcctcaattctcagctgcaaacttctttggatctgcagagcaaataagcattgaaccaaaagggttaatttcagaaagttcaacaccctgcagtcaacagcttggggaaatgagaagttcactttgatgttggtctagcttccttcataatccatgttaatcaactaggtaaggaatttggttacttcacttttaacgcatctcatagacaaaaacatctaaagcagacttagcagattttcaatgccctggcccctgttatggcagacctagctaatccatgaaactagtttttctaggaatgtctagtaaaaaggagcagagacaatgttcaacaacaggtttagccgactgttgatatgaaaggataagaaaaacagatgaaaacaatacaaatatggcaaaaaagtactagaaattaacagctaagttcatattttcctaatgagctgtgatgccctctattgcaagaacctacatgtacggaaaaaaaactaaaccctgaacaaaataataactgcatccatatgctaattttaacggttggtcttggtttgaaatacttttggattttttttcctaaggcatcctttttcacctaatactccaatcaatttgcttaccacatatgatgttaatggtcggttatataattcacaatagaaagaactccataaagcgctaattcgttctttgctttatatgcatggagctcaaacaagtcagcttacactagtactatatgatagcttgaagcttgcctactttattctgaacttcataccaaagcccttcccc

SEQ ID NO: 66848 - DNA, 682 bp, Oryza sativa
tgaagctccagcatctttacttccgggtggcatagccctggatgatgatagatttgggaacatgttagcatgcgtcagctagactgaaagatcttaggcattagtgtccttgagaaaaacaatgctttgcaagtttcagaaccagcttctgcacaagcacatccctcacttttattcatcttcctaacaagagtttggttttttagtactatgcaatacttgtgcaggttaatgttaactttattgattctcagcttcacagacctatatgggctacggcctttgtgatgttgaagttgatcaaaaggaaagtgtgatgtgataatactttaagggccacgcaaatatatagataaggaaaaaagataattcaccaagcacttccacttcaaatgacatcaatataagagtcaagaaagtaaataacctgaacattttggaatatcccaaacagcaattgaagactctgtgcactcaggtgaacaaagtgcatgtgtgttctcatggttgacgttcatagcaagcatccaggatccaatagtaacatcctcattgctgaacatacggaaactggagaaacatatgtgagaatccattaaacaaacatataacgtgactcgatcgtggatgaagtttaacagtgatgcaaaatgaagggtaccgagctcgaattcgcctatag

SEQ ID NO: 66849 - DNA, 7855 bp, Oryza sativa
aatcgcagcacacacacgcagttgcaatgctgtagctgcttttaggtgcaaccaggtaggtaaaccggttcatatatggccataggcagctgtcatgacaaaaaaaaattggcatttcttcgctctagacacaattcctgtgttccaaataagccctaacaatcgagaatttagccatttctaacaagtctccgagagttggaaactacagtgcatagaatgtgaattctgaacacgtgtttttataacaatattaatcattttcttttttcaaacacaactctgtgtatatatatatttaataagaacacaaaaaaaaagaggaaaatggaaccataatgaatccagattggatgtgtggggcttatggcacggcatgatgagatgctggctgtgatgtgagagcctctttaattctgttttttggtagtactgtgctgtaataataatccttgcgagttaatgcgggcattggttggctgatgccttgtcctgcgacgtcgtgcatggcgtggcgtggcgtggcgtggcgtgacatggcaggaagggtacatcgtgccgcgctcgccggcggtggaggcggtgcccatggacaagctgccgcggccggtgatcttccacgacggccgcctcgcgcggcggccgactccgctggcggcgctgctcgccgtgctctggttccccgtggggttcgcgctggcgtgcgtccgcatcgcggcgggcgcgctgctgccgatgccgtgggtgtactacgcgttctgggcgctgggcgtgcgcgtcgtggtgcgcggcgcgccgccgccgcgcgcggagcgcgccgcggggcgccgcggggtgctcttcgcctgctcccaccgtacgctgctcgacccgatcttcctctcggcggcgctcggccgccccgtggccgccgtcacctactcgctgtcgcggctgtcggagttcctgtcgccgatcaggacggtgcggctgacgcgggaccgcgccgccgacgccgccatgatcggcgagctcctcgacgagggcgacctggcgatctgccccgaggggacgacgtgccgggagccgttcctgctgcggttctcggcgctgttcgcggagctcaccgacgaggtggtgccggtggcgatggagagccggatgggcatgttccacggcacaacggcgagggggtggaaggggatggaccccttctacttcgtcatgaaccccagcccggcgtacagtcgtcacgttcctcggcaagctgccgccggagcacaccttcggcgccggcggcaggtccagccacgaggtggccaactacatccagaggctcattgccgccacgctctcccacgagtgcaccagcctcaccaggaaggacaagtacagggcgctcgccggcaaagacggcgtcgtcgacaacgccaccggcaagctgccatcgccggcgacggcgacggcgaacaacagcaaggacaaagcttgctaggagaagggaaaaaaaagggggaagtggatgttctagtagtgtaaaactataatgttattaatttttacctgtgtcgatttgcatggggcggtaaatttcctctttcttttggttatttgtactgtgtatgcacttgcaatgtaccaacggggagttgaatgcaatttgcataagtaaaagcaatgggccaggacaagcaaactattcttgtgagtcagaaactcagaagcatgcatctttctgcaggcaacagctaagaacataaaagcaaatttatttggtttggtagattgggtatcacacattacacataggccagggcataggtgttccattcgattcggcaactgaacaacaacccaacaagtaaaacgacaccagacattattgatatatacatactacgagtctacttatcaaatctggtccagatcaattgagttgtctctcgtttttgtaaattgcaagcaaccagtttcaccagaagaataactttcctttccaagaagaaaagcaatcgattgccacagaaagtgaagcaaagaagagtgtacaatccgtggtcgtagattccattgcttcagctaaaatgagtaactagcctcgagcttgaacaatgaacagaaacaagagtctggctataatttttctaggtgcatataggcgaaatggatcttagtacatcttaactccttccaggttacacatgctatgctcagtcctatatacacccggtaccgcggcaacaattatcgagggcgtgctgctatgtatcacaagggtggatcagtaacttactgtgcacacacattgcagcttttccggcagaagccaggtgcttcattggtacccaccatgtagttcggattcttggcacactcccctactgcagcccactgggggcagaggacgttctcatcctcgcacccgtcagtggaagctccctgcttgacagagatgtcgaaggacctcacatggatccatttagttgcggaccacttctgaccttcaatgaccgggcagctcccgtgcaggctgtcagagtctgttgttgcatcggggtggagactgaagaacagaagggcatcaccctttaccggttttactgaagaggagaaccaacagttaaacagctgattaaataatgatcataatggaaggtataactcatatatgcacggctaagacaacatgctgagtgctaagcccacagaatttatcagctgacaaggaacatacatagttctgcattatttaatatctggttttagaagcaaagtaacttaaaattctattacaggcaattcactatacctgcatatccatttttagcacagtcagaccatgtatcatccttgggttgtaataacttcccctaaaaaaaatagtcgagttactgcaagggaaatccaagtggctaacactgtagaaagttaaagaggacaggtaaactacctctgcttctggaaagatggtctctccccccttcccaacgtctgaaaggtacatgagcacagtggcgatccgatgtcctccaagagcttgattatttttgtcatggaagtaatcatagtgtggctcatacttctcgccattctgataatgtaatatttgaatggattcgccattatctaaacatgggcaagataatgataataccattaatgattacaaaaaatgaggtagagaaattttaacctagaatggttaggcatttcggatacctggtggaaggaacgtccaagctgcaatcctctcctctatcctagctacaacttcgtcctgccaaatgaatagttcagttcaacttagttgttacatgtggtactctgtaccagacacaatcagctaaaggcacggtagattattaatctgactcatctgaaagcaaaggtagctttaacagtctctatggtacagaatggaaactgaactacaggtggttgtgtgcagatatgtttgcaatagtgaacacatggggcaatatcccaactggtctgccctcaggttcaaatagtaagttcagatcatcacaattacgagcttgagaactggcctgttactcagtattgacgtccatatggcaaatatgactacgtggttcagtgctataagacaacagcatagacagtaagacagatgcaaagaaaaaatgagcaaggtggaaaacaatataaagcatgagaggcagttacaacccataagacaatgcacacagctcggatttgaagtccatttaaaacagtatacatgcaatggtacgagtcaagaggagagaaattggtgaagcgaatccagcagaggaaacatgacatgtaaaactaacatcaaaggtcaatcacccagatattggtattaatcattaatgccataaagtaactaagtatggctgatattaaagagttgcgatgtattttgagcaaccaattacatgggcactaaataaagtatacaagaagcatctacctaccaattaatcagaactgaatttttgtcatacattttcacatagcctcataaacaaatcacttactcaaatcaacacaactgctgggaggaacaaacataataacatttcactagtgagtacaaatttcagagaaggtaaaagcaacaaataatgaagataagaaatagttcaagtttattgtggttatatcaagaaaaggaaaaaaaaaactttttctagtagcaaatggatgaatttcagcatatgatatataaggacttcctacagactctggtgtgttccctacaagctaaagctagcaatatgaacagaacaaatgactgtagagtactttattacagtacagtctgcatgtcacaactgacaactattgagatgagttgtaagaaaagctgaaaacaggtaaaaatataaggaatagaaatatacatgaatttcaaatagtagcatacctttgcaaacaatactaatgtaaataggaaataattgatcgaatttcatctctcgcaaactacaaaagaaaactacctaggaaaaaaaataagcaccccagattccaataaatatgaagacaaaaaaaacatggagaagtattagtacattgagcgaacatgataaaaagatatgaacccccaacgatgaaacttcagccaaaaaaaaacattggtttcaaacatgtgttgcagataccaaatcaccaaagttgcgtattaccaaatagaagcttagccatatatcccctcttttaatttggccatgctaaaaaagtatccccaagcattttagatgaaatgttatctccaaattgagaggaaacaacaagttcaccaaatcacaagaagaactatagtagccaagttctgatccagcatttagtgtactgattgtgataaccaacaaaaagctgtaaaagactgcatctgccacaggctatttaatccaagcacattaaattcaaattctgaactgcttctgctataaaatcctaaattggtacaagcacatagattaatctcccttggcagtttaatactacctaaacatgcacgaacaccaactataaagacctggtatggcagtggcatggtagcgcatcaagaatcattacctacaaggactaccacccaaaatacaaaaatctgctattttagatttccaacacatatccaatctaaaaatacaaactataccgcagcaattccaccaattcccctttccatgtcgaaattacagtcgacacagaggcattctccttcctagatctctactattaacagcgagctgagccagtgaggcctataaccaggtcgggaccaatccaacacctcaaaacattatcgaaagaacagaacggaatcaggcggtgcggtggctggctgctgacctgcttcttctcgaggaacatgccggagctggtccgcacctcgctcatgacgctcttcccggactcgttgtccgccaccatcgacttctccagcttgtccttcgcctacaaatcgaatcaatccactattacccaaaaggttccccgaatgcggcgagatcgagcgggatgccacagtgtacactcaccagcgagatcaggtgctcgcactccgcgtccgtcaggaaccccttgtgcaggaacgccctagaacgaagcggcgggtcaggatatcgcacgaaccctaattcgcggcgggatggccatgggggagagagagagagagatcgtctcgtcagtcgtcacactcacctggggcgccacgagagctgcacgacgcgggatgggtcaaatgcgccgcggccgctccccgccgcggcggcggaggaggccactccggcgagcaccaggagggccacggcgaggaggcggaggctgccatggcggcggcgcgagctgagagcggccatggcgcggcgccgagatgcgcggaggaggaggaaaagcttcgaagggggagggggagagagaggcgcgatgtagtagtagtcgcgtagagtgagtgacaggtgggcccgacgactcgtggggcccggctgccagtgagagatggaggcgctagtttgttgggttccttctggaagcttccggggttcgcggggggtgatggactttgacttttacgtgttgctcgcacggaggcgtacttcttatctgcttgtacttttggtgaagcatttgtgagatcgtccggtgtgtgagggggagaaaaatcaagccaattccgtgtgctatgagaaatgcgtgtctgttgagattcaaacctcatttgaaacacatgaatcccagaaagaaattctgcgatgagttttcattaggttaacttttacatttgaatctctcgtcatctccgcggctaccacatgaccttttaaaccgattggtatcggacagcaatattgtgactgctcaagttttcagtcgtcagaccatcaaacttcagggaaatcagatgtgcatagctttactcccatttccatagctccagcaggtagtggcatccagagtcagagtcaggaggaccaactcacgaataggcagtaaattcaatttcatactatgcctcatatgcgagtaatttcagtttttttttctgttgttgtttggaaaacagagtaatttatgttcaacagcattggcatttagaacggtaaaaacctgtcaagacaaattggactataattcctatttcagacattttttatatgtagttacagaatagtccagttcagtatattgacagccgtgttatcttttgctaacaaatccagacgtgcagtgcaggcacagaatcaagtcaaacaacaaacaagatctgatgtttgttcgtttccagcttcttaaaaatagcagcagagtagaaacactcaaagcgaaaaaaggtagaagtatcctaaaaataaaacaggaatcctgatacagagaggtttcagagttttacagctcaaaaggaaaaacccattttatttcaggagaactaggtctgataagagtaactgcattttcgttcacaaagaaaacggagtaactgaatgatggtgcagatgaagtcatgaaactatgcagggggaacgcattggtgcttaaaaacagcaatacaacctatcatggtaacctaaacagcaaggcaacatataatggtaaccaagcatcatggaagtgtccattcttgtttttctctcaaaacaaacattggccatccaaggtgcagaaacaaaatgtcacaccagatgagcaaatcaagcactattattacgtataccctgattcctgataattcagttgatcagtacaggagtgaagcataacatttgccggaatgaccgaaggaggtcatttaatgtaattaagataagaagggagtgaagcataacataaggtggcctgcataatctagcagtccacatgaacaaaacaaatacctcacacaaattcatttgaagtcataatggagcaattcatgcatagatcactaagaaatgtgtattctaaaaaataaaacatatggctgagcggaccaaactttcaatcattttgttgtactgaacagcataacatctgcttattacagtgaatgaatttataaatctcactagcagaaaacaacaataatggtgtaataccaaaaggtacctcttctatctctcgatttaacaaggtatgattcatatgcagcaaatagtgcatatggtattgaactattgacatttggaatgacaaaataccaaatgtcctcaaaatttgtctcctaaaatacaaggagctctcctggatcccaattccattctaacaacttattattgcctgatgataaattacaaatggagatcacatacacctccaagaacacaacaaaaaatttgcatgcgcagctaagttctcatgatcaaactctcctcgtaaccaaagcacaaggcacgggctgcag

SEQ ID NO: 66850 - DNA, 15064 bp, Oryza sativa
ccacgttcatattgtttgaattagattgtatcatatttaagataccggtaggtgcacacatatttctctcttcttctactacttgttttcttttttggtacctctggtgaattgtgttcatgagttgcatcatgcgtgtcatgcaacgggggctatatatggtgagctcttgtgacttggtttatggtgctacgctcccactacgtttggagggcgaaatggtcgatctaagcataagaatcttgtgaaattggtaagcacactgaattgaaatttttgagttttcatttttcgaattttcagtgtagctagcagatgccttcgtttccatttcggcgcgagttaggattactttgaaactatatgctgttcttatccctgtatttaattggtaagctcaccgccgtgtaactttcaggttgcgtgcgatttttttttcaacaacaaaataaaaaaccgatgagttagagagacagagagcagtcttcagagcaaggtttgaataagacggttctcaggtctttaggttctgaataaatataatcttcaggttttgaataaatatactccatgaaggtctagcagtaaataattaagatggtttgaactgagcatctgtagttaggcaaccttctagttagtgaaagttgccatttatccactatacgtgatagtgacctctagctatattactcattttcaaaggtgatgccaacggctaatttcgaaagtccaagcttcatgaaaactactcgctccgtttcaaaatatttgacaccgttgactttttagtacgcatttaaccattcgtcttattcaaaaaatttaagtaattatttattcttttcatatcatttgattcattattaaatatactttcatgtacacatatagttttatatattttacaaaaaattttgaataagacgaacggtcaaacatgtgctaaaaagtcaacggtgtcaaatattttgaaacggtgggagtatttaatattatactcggcactaccatcagtatcaggcttcagagaacttggcaacaggtagcattgtaaaactgagctgaattctgaaacaaaccgggccaacggccaaccaaccgaagcaaatattcctgctttctcagtcccaaagtaagttcttttttatcccttccgtttatcccaaaataaattcattttgcagcaatcattgcaccggagtttatgaaagtaaggaataaatatattatgagtaggtaaaatgtggaataattatattgagatttaataaagtagatgtattctcgtattttgttttttaatgatatgtgtggatagctgaaaagaattattttgggacagattgagcggtgcactgttccatttcagttgaccggtgctgatcaaaggctcaaagtctcaaatagattaggcatcttgaaaagctaaaacaagtatccttgcgaaaagccaggtgtcacccaagtcagaccctttatagatgcgactaaaacttttaagtccttatcacatcaaatgtttagacactaattataaatattaaacgtagactattaataaaacccatttataatcttggactaattcgcaagacgaatctattgagcctaattaatccataattagcatatatgatactacagtaaacattctctaattatgggttaattaggcttaaaaaatttatctcgtgaattagttttcatttatgtaattagttttgtaagtagtatatatttaatactctaaattaatgtctaaatataaggactaaagttaaatccctctatctaaagaccacctcactcattcgtgcatggtcattgcaatcgcaaagaggcttttgtaatggcaagagctgtacatgtactacttctactgttgctgctcatcagttgcaactgtgatgagcaggcagcatgcaagagtgcagcgcatgtgctgatctgatgtgcattttttgcgaggtgacgaactgcatctgctttttttcccttgctgtgaatctgtttttctgatgagtagagcagtggtcatctttttttggagggcctttacgcctgtcagatcctgtcaggaccgaaagtgtccaacgaaaccattaaccatagagaatcctatgcaaagacggggtcagtccccacctcggttcttggttgtcccagctggtcttcagtcttcacctcggcctctgtggacatgttgcagtcttgcagatcaagtgcatatagcagcagtagatgaaaagagaagtcaaaaaaatgaatagagaagatcgtactaggagtgtacatggtagtagtaactgctgagtatatgtacatgtatgtagtatgggagtagaactacacggtgaactcgcaggtggcttcgggctcaccactacgagaggatcacggtcactcactcactctgcagtatctgcagtagcagtagctaacaggtggattcggtatcatatatcagcagcaactactgtatttatagtactacagacaatccctattattagaaaatatgttgtcatgcaggggagggagagagagagcgcgcgcataaagaagagtggtctatcatgatgatcatgtattctgcgagaaacggtggaatattaactggaagaagcggtgccaacgtcttagggttcgtgttgggagaacgcttcgttctgccacacaatgtgataccccttttatggtcagatgtagagagtgaaggtttggaggagtagcggctagagaacagggaccggatagatggagctaagggaggaagacgaggggacgatgtggctagatctagagggtgggatggtcgtagctagggggcatgatgggaggacattgccatcaccgaccagggagacgacgagtagatctagatggcggcgtcactatgtgagtatgtgaacatatttggatggcgacgacctctatactcgacgatggcttgcatagagcgtgcagaaaagagctcccattgattcaaccaccagcatggagaagtggtgcgatgcggcttctaacgacgagaaggaaggaacgtgtgtcgttggtactcaagatcaaggaggagtgggcttgatcttgagagcggcacaatgattcagcgacggaaggagaacactatatagtgtctagtgacagaagaagtaaaggccgcggcaacaaggttttgccttcgcttggaactcatcgagagtcagaagtaagcgcatgttcactttgatgccattttcaaccataccaattttttttagcaaaattgccaaaaaatggttatgtttaatttgttgccaaatttaatcaatatataataaattctgccaaaattttggcaatattgtaatcttgctaaaattttggcattgacaaaacttggtaaggtttattttggctacaatctgaacaaaccctatgagggaaagagaaccaaggggggcaagggtttaaatgtgatagaattttctcatttgagatttgttttgtaagctaaaaacgaattagaaaactatataagaacttgaattaaaaaaatagaggtattataagaacttgtaagctacaaattttgaacttgaactatataagaacttaataaaaattgtgtatttactttcaatactattatattttaactgtaacaaaaaatacaaaattatgacaattttaagacaattaatttattagaattttttatttttttcgctctttatgtagaatgaatgtgaagatgtggctttacatgtatatgaaatattattgaaattacatgtacaattatttctaaaatttttaataatatttgttagttagtgtgtacggtgtgtatacgtgaaggcttgtgtgtatatgatatgttcacaaacaaatgtggggtgattgaggataagattaggtaaataaaaaattaaatgagtggtgctttggtaagggaagtagttttcaaaagtacttatatttatgtttagattttaaatggtagaaaaagtttatatttattaggaaatagagaaaagtacgaggcttccattttgttcgcccctgcgaattactacaaagaagggaagcacctgccaaaaaatagcgcctgtatatgtctctctcgatgctgtttacaaagaattttcaaatacagaagatttgagtcaccgaaaaataacatactagcagctattatgaggatatgctacgcaaatgcgatgttgtgttagggcctccaaggaggctttggcatcgtcagagcagacgagtagagaaaacatgcagccctatcgtttggcttgtcggtggaataagccaaacaacatatttgtaaacgaaaagtaatttgttaataaaatttttatgtataagttcttagtaatttaaaagcaaaatctgaaaaagcccaaaaataacttcaaatttaaggttaaaaatttaaatttgggttgataagtataaacataggaaaaatatgaggccgatcgactttctgggtttgatttaggcccattcgtttcatccagacacagctgcagcggcggcggccgtggttaactgggccgaaatatcaggcctttcccaaccaagcccatcatttggttcccaaacacttgatttccagaatgtcaattgcagagcagcaaacttagctacagttttgagttgatgagttcaactgttttatcaagaaagcagcattgctgcaagggacagtaataaacattaagcaacaaccacaaaacagcacagcacaaaacacgtaaaacgaacttattttgtccaagaaattaaaacatgtgacctgtttgatctaaggaaaaaaaatgatcaagttgagacatcatatgttggatcatcccatcgtcatttctcttcttgcgcggatcttggtcgcccccatcgtcgtttggccaaatatagataatacgtcattcagtgtattagtaaaataataataatttataagtaagacttttatatatgagttcttagcaacttaaatatcaatgtaaaaaataaagttaaaattttaaaaatcaacttcaaaatcagattttaaaattcaaattttgaccgtggctgatgctgtatggaggagatgacggggcctccgtcacccggaagtactcgccggtatccgtcctccagtaggtgtagcctgtgccatcacgttttggcctcctacttgatttcattataactagcgattagaatctgctgcttgtatttgagtatttcaaagcttgcgactactccttactgagataaacggtaaggattcagaatctggattgcacatcttcaataccaaaccactggcactcaagatagagatttcagaatctgtgacggcactcaatatttgtgaagacacaagtacacaacaggaagtgctcccaaaaggatcataccaacatttaaacgcatccaaaaactgtaccacacatctttactgacagtctaaaactacttctggtgatgagtatcattttcataattttgaagcctacacaccacagacactgcaatatgtaaccaccaggcatgaacatcaagtggaattatactacactacacacaaacatacacaaacaagcctacacacacaatctgtagttctgtactatcaagcatgaacatagaactgtactactgtttaaacactgaattttcagaatgtcattgcagaagcaaagattttgcagcaattgagtctgaaagtttcatttctttcctttttttttctttcagcaagttgcactgcaagggacaatatggttacagtagcagcagcaaaaagctagtacaaaacataaaactttgcaactacagagcacactcaatcgatcatcaaaagggctgttcagagacagatatgatcataccaggaccaggaacccaactgaatgaatgaatgaacagaaccaaaaggctgaaagaaacctacagttgtacacacaccaatcttctctaaggatgtgttcgcagttggttgttcccaaccgggaacagtactcacggaaaacggagcaattcattagcacgtgattaattaagtattagctattttttttcaaaaatagattaatttgatttttttaagcaactttcgtatataaaccttttgcaaaaaacacaccgtttagcagtttgaaaagtgtgagctcctccacgcgactgcacacctcgccggcgtcgagctcggcgatgccgggtcccctgagaagggcgacgcggccaaggaagtccggcgagaggcagaacagcgggaggaggtcccgcgtcaccacgccatggccgccggcgccgtccgcgaccaaggggaagagccccgaatcgtagaggccgaggtggaaggcgaccagctcggcggacctgctgccgcatcgctccatgtccctggactcgtcgaacaccaccatggcctccctgctcggggattttgaactatttgccatcttctttaatggcgcactctcaaatgccatcttcttcaataatgttgattatttgccatccgactctttatattctttctattttaccattcttccctgccaactcagcaaacttgtgtgacaaatgaccttactgtccctcatctcctttcccatctgcagttcgcagactgtgccatcaccggcctcgtcaagtgaagaagctattgctttgcttgtttgcttggtcgattggtaatttggtatatatgcaagtaattaatctggagggttgaatgagtgccactgttgattgctttacttaatgcagcgctcgatcgaaagcttggtctttttttctttagtgtgttttcttctctttatcttcgatgcttcatgttggctctacccgaatatgcaacacgaaagcgctctctgccatcatgggaactttgtcgctctgctagcttgacagttcgatttacctgataactgatgagaattgctcgtccgagcggttgcccgcgaatcggataaaagccaaggtagcggtcaccggtcacgggcagtacgcccttccgtgtaggcagtcgccaactcgccatcgccgtcggatcaagaagtggcgaggtccgcttgaagacggcaccgtcgcaagaagaatgcggaggaagaaccgaaaagacgggggtagtgaagtcatttgtcacacaggcttgctgagttggcaagcaagagtggctaaatagaaacaatatagcaggtcagatggcaaatagttaaagtcatttgagaagatggcatttgaaaatacaccattcaaaagaatggcaaatagtccaaaatccctcctgctcgagtagtaagccaccaccgcgcacgctctgccggtcgctgccaacgctgacctcgcgacgccgtacagatctccgggcgtagccgtgctccttgcccccatcctcagcagcaggcacctcaagttgatgtcctcctgggcgtctgctttcagatatcgccagggaaccattcgacggaatgcctcggcggtggagcaccgctggctctgctggtcggctgcatccttcacaaggtttaccgaattatgcagaatctcgtcatcaacctacaagaacaacagattcagagcatcagaagtggaatgaagcaagagaaacatgaagattcaccctgcagcagcaaccgattcagagaatcaaagaaacgaacaatacgggaaagggagaaacatgaacaggcacctgcagcaaccaattcaaagaatttgaccatgaacaaagcgggagaaaacatgaacattcacctgcagagactaattcagaaccggaacagaaagaattaggacatgaacaaagcgggagaagcatgaacattcatccgcagaagccaattcagaaatcagaaccaaaaatacggagaattttgacatgaagtcccggcgaagaatctggacatgaacaaagcgcagagaccgattcagaaccagaacagagaatcgaacatgaataaatcgggagaactcaaatttcacggtccaaaactcccaagaaccaagaatttgggcaatcattgaaccaagaacaccgccgcgatcaacatctcgcacccaagaaatgcctcaacaacaacggatggggaagaaaagcagagaagcggtggttgtaccctggaaatcatcaggtatgcgcctggacgagccgcctccatctccgccgcatacaagcaatcgctctctgcggagaacaccagcatgccaacgcgctcgcatctggtagcatctcgtagcaggacggtcgctatgacaactccatagcgggtgaagaacgactccaggtgtaccggcgatatgatggaggctacacctccgaacaccagcgctcgacgcaagaaagtggagtcctcgccgagaatcggttgacgctccaagagcgcctcgatgaggtggcgcaagatcgcgctgtccatagaggcggacgcgaagaaggaaagggagggagaaagaatcgctcggtcaggctggaggaggttcttcgtgatcttggtggagaggctactggttcttgatttcttggggagagaagcactgaagcagaggggagggcgagcgagttgggagttgctggagggagtttcagcccgtatttgcgaattgggcgaatacgggctgaaacttcgtggtctaggccgtaaccgttttgcagattaatgtgccgattgcagtcagtatggagcaggaaagcacatattcaggaataaggtaaacacttcttttaggggtgaataagttcgctttacgtccctcaatttgttgccgagtctgaaatttatctgaaaaccgtaataccatgtatagcacattactcaactcgcaaaaccagtacaaataagctcccaaggcggtttggatgacgatttcagctaacgtggcgttgatgtggcatttaaagtcagaaaaaatcatgggacccacaactcaatgagtatttggttaaaaataaaaaaattatagtgggacccatatcatcaccctctctttttcctatcttctctcccttcctcatctctttccctttccttgttgtcgtcggcgcatgccgccgctgtgctcgaccttgccgagtgtttcgctcatttcactctgggtggacgaggtgcacatggaccatggtgcccagtcgtgatgggtgctcagagaagatggcgcgggctcctgccgtgctagggcgccacagggaatagtcgagggaatcgagggtgggaaagggaggaggaagtggtgggcaaacccgtcggagctcgagctcacccgaccgtcgtgtgagggagtgggatggcgtcattgaggagcaactgtgcgacaggggcagtgtgcgcgcggacgaggtgtgtgtgaaccatagtggccagcgggggcaggtggccaagggaggtgaaggtgagaaagggaggggtaggcaactagcgaacccgtttgaggtcgagcttgcctggcctccatgcaagggaggtggagatgggtgagggagggagatggctcggttgaggagtgaccatatgacggggggacggcgtgccggcgtgcgtgtggaccgcgggggtggtggttggaggctagggcattagcaaggcacgggctgccgccattctggaccaccatttgggggggagaggggtcccatacgagattgagcattcattgcgccccgtgccatccctattgccaccgcacatcttcccgcaaccattccacctgtgctacaatggatatctcaacaagactagcacgaatctcaacaaatatatttttcaacggtacaaaaggactcaacattaggggtggattctaaattctcaaggagataccttctctattttttttcatcttactcaaatagttataaaaaattttgaaaaaaaaagagaatatctattaacatgtgatataccactccataaaaatgcaagttaaaattgaatttttacaagttgcaaaaaaaatacaactagtaaacgtatattgacagttaaatatatatttttctgttacaatgtgtagaaattaaatttgaccttacatgtttgtgaagtaatctatcacatactaataatctatcttgttgaatttttttaattttttataaccatttaagagacatataaaacaacgatgagacgtcccttcagaggttttgaatactttcccccctcgacattatcaaagcgacacatatcaaacagccaatctctactagtatattacagtacgtctaatgagttcgagtcggtttttaatttcgttcacttttagaaatacatatgtttatttgattcggtttaatttgttcgcttttagaaatacagaagaagtcgtttaagaaatctctttataaaaaaaaactcgcatgctaacatgagacgatcggactcctaactgaagcttatgattttctaaaaatatatataacgaagtgaattcccacagtgaataataagattaaaatagccttcaccaattgcaacacacgaacatttttttcgaagtagtaaataaataaataaaaccacactcggtagatagagtttgacagtgaaacgggttgtttgataatctttcaaatgctcactcgtcggacaacttgatcttcttggtcgacggcgagtcgccctcgtcgtcgtcggtgtcgacgccgacatggcctctgcgcttcggctcccacgcggcgtcgagccgccgctcttccaggaatcgctccatgaaccccatgacatcctcgaactcccccgcgtcatccgacgccaggtcgaacaccttgctcgacagctccttcatctcctccaccctctccagctttgcttcgagattccgccggtgccgccgcggcatgaagcagtccgccatccgcgacacgccgcggtgggtgatcacgcggaggatgtggcggcacgggaggcgatcgctctccatcttccggcagctgcacgtcacggccatcttcccgtcgtccatgtcgtcggtgccgagcgcgccgccgcggtcgcaccattgcaccacgaagggttcgccggcggcggcttcctgcttgggcgcgagcaggtagatctttacgtcggggctggacatggtgggcagcgtgtcgacgacgacgaagccgtccatcttctcgatctcctcgcggacgaggtggaagttggccggggtgaagcgccgcgcggcgtgcgcctcgaggaactggtgattggtggtcagcggcagccgggacatggaggccgcgtcgtcggcgcgcaggcgccaggtccagtagtcggcgtggcgcaccaggtcgtgcagcgacatgtcgtcggcgaggcccgtgtggaggcccgtggcgagttactccgtccgctggtcgctcgccatgccgaggaagagcttgtggcgggtgaacgcggcggcccagagctccctcgtcgcgtgcatcgtctccagccagccctcgttctcggctgtccggtgtccgccatgaacacgctccaccgctgtcgaacgccgcgggcgagcacgcgtcgcgcgccagcgacaagaagtcgtcccgcgccgggccatcgacgaggtgctccccggcccaccgctccacgtgccacgctcacacgcggtggttggactccgggcacacggccttgatgtcggcgacctccgcgtcgccgccgtcggtgatgacggacttgggcacatccccctggatcgactcctgaacgcgcgcagcagccagacgcacgagtcgacggagccgtccgcgacgacgccgcagccgaacacggcggggcggcggtggcggctcatcccgaggaacgggacgaacgccgcgccgcacctgttcgtccggaacgtggtgtcgaagacgacgacctcgccgtagtagacgtagtcccagcccagcccggagctcgcccagaagatcccctccatccggccatcggcggcggcgaccttgtggtcgtagaatccctcggggtcgtccttgtctttctcgcgcagcgccgcgagaatctcgtgggtttcctcgctctccatcagcggcatctcatggagcatgcgccaccacaggttagtcgagtgaattgaggcatgacatgagatggatcggggataaggagaccgcaacctctcgatggtcgacgacggcgtggaggtggaagaaggcgacgacgccatgggcggcggcgacgggaggaggaagagatggagacgaagcggtttaacggggatatataacggaatatcgagggtattcgaaacgacaagtctaaaatcatgggagtagttaacacttaacatatggagtggtactcaccatttcccattgcatatgtgttcctttccaaggagaaaaccatcccatttttagcggcacgcttgctaggattttcggagcaacattctagataggaatttctttaaaaatttgttttaaatccgcttttggagtagtagccattcattagtattcactctattccaaaatataaggcacaaacactcttaacacaaagaccaagaaataattattataatctttttcaaaatataaggcacaaccactcttaacacaaagaccaagaaataattattataatcttgtagattgaatcatcctaataaatataatgtatgcatccaatagagttagcgaatgtgggagtgaaggatttaaaaaagtagtaatataatgaagaatgtcatacttaatggcatgcatgcattcataccttatactccctccgtccaaaaaaaaggcaaaccctgagtttccttgtccaactttgactgttcgtcttatatgaaatttttttataattcgtattttcattgttgttagatgataaaatatgattaatattttatgcgtgacttgtctttttaatttttttcatatttttttcaaataagacggacggtcaaacattggacacggaaaccagagtttatctttttttgggacggagagagtattatggaacattaaaaaaaagtgtttgtgccttatattatagaatggagggagtatttacctctgcttttggagtatcgcgaaatcagtcagcgactctcaccattcagcatgacacaaacatggtacaacgctttattatatgacaggtataccagagtctcagaacaatacttgcagccaaaatgtttgcattgctcaattatttttatgacagatttctgtaagttcaagcgacagaaaacgagcgctgaaatatatttagagccggttgtacagtccaagcaattccttcagcttcgccgcttcagggctgaggctgtcgaagctgacagagctcggcatcctccatctccagttccctttctgtggatgtaaaaaaaaatgatgtttttagaattactgctttagcagtatatgtgaattatacaaggtgattggatgcagctgttaacctgtgtagctggagtattcattctagcagaactgtcgaggccaagaatgtcctgcatggttaccatggatgtccttgcaactgaagagagggcagcagtgatcagtgcccatgagatttcagtcctattagcctcaggcagatacttgaacacctgaaacaagaaggcgtgaatatgacaatatggttgaaggtagtgtaatatgcctatttaagaaagttgggagacactaacagtctgcttctcttcctctggtaaagtttgccaccaaccaataacctgaggaatacatggttgaagagcgtcagcattctttgtatgcttgtgtcgctagcagcccttgacaagatattgaaaatagacagctttggaataatttagaaactaaccgtgtcattgtcgtgtgttccggtgtatactacttgatcaaattcatggttatggggcaagtgtggattgtcagaaccaccgccaaaagctgaccacataaaagtgggagtacgaacatttagacatcgaatctatatattcaagtatgctcacaatgccttctcaaaagagaatatacacataatctggctttggaacattaccaaactgaagaactgccattccaggagcctcaatagacttccttaggtcaacaacatcttctgttatcaccccctacaaatagtatgagatgatcagataaagcataagcatgtcagaattaaatgtttcaagttttgagtagaaccattctcgactatattaacccgtgattattatgaggaattctcagttaaatcacatttttgacaatctacagctaatgctgagtagcttatgaatgtctggttgcagataaaacttgtgtagctgactcaaataagacttgtcttatggagaaattatgtgaatttctacttccatattggtccacaaaagaaaaaccaatcatggttttattagataaatgtaaaaaaaaaagaatgcttaccaggtcttctgctattatgtttattctaccgacagctttgaataatgcatcaaaaaatgcattcctcggtccagcctactgccaaagaaaaacagaaaagcgtacatcagcaacaaatatttctgaaaaaaataagggggatagcatgtacatcaagtcaatgctcaccctccagcttccaaccagcgctacttttgactctacatgcaccggtaacaaattagaaatttgaatctatttacccaaaaatatgtactcctattatgtagacaggctagctggatgtatttggtttaccagaaggaactgcccaaaaacctgcaagcccccggaaatggtctatacggaactcatcatacaaatcaagggcacgattaatcctttttatccaccattcaaatccacctgcttccatagctttccagtcgtacaatggactgtaaagttgcaagtttcacaaaggaaatgctgttaattgtattcaacttttttcctgatcacattgacagggagcaaaggattacctgttccaaagctgaccagtttcactaaatgcatcaggtggaacaccactaacaaaagtcggaaaaccattcttgtcctttacaccagaaaaaacaatcaagaaacagaatgtatagcattttaagaatccgatgacacatgactatgagggaaaattattgaggtgta

SEQ ID NO: 66851 - DNA, 27459 bp, Oryza sativa
agtacagaggacggaactcttgttttagctgatgcatctggtatccaggcttcaacggaacaaaatgttgatgaaggtccttctgaggttgctgcaaagaatgaaggccttgtctctgttacagaagctagtaaagatagtgcaattgctactacagaagttagtcaggaagcagttgttgccgctgcagaggttagtccggaggctctagttgctgttacagaggtcagtgaggcccctctagttgatgtggccggaactaatgaaaattctctaggtgatgcagaagcaactaaagaaggtgatccagaatctgttccaagtgacagtaatgtggtgaaggaagtatgttcacatgctgaaattcattgtgaggtcattgcagagaagactccagacaatggcagcagcaagaaaatgactgttgatgacatatcatctgatgataccagtactaataccaagttggaggaatcatctgctaaaggtgaaccatgtgtcagtataggctgtgagattctagaacaggaaacgaaatcatcacatcttgatgttattttgtcacatgctgacgctgttgcaagtgcagaggaaatgattacagagagcctgattcttaagaaagattccaatgagaatgatttaatgtatgagaaggaccaaaaggattctgaccacataagcactgactgcaaacccgagcagtctggaccaaaggatcaggtatctgaagtcaaccaagatctagagtctcaaattaagtgtgtgtcaatttctcctgatgatatactagtcaataaaaacgacaatgtagaaggcaacatgaacgctgacaattttgatttaggactagagtctaagcaggatattgtcaagccatcatccagcaatccctcctccgttggtgatgatttgcagacaccagatgatgacaaagagatatctctgatcgacatgtctctgcaagatactgatatgagcttgaaaaagaaagaaggcagtcctgatagtatttatcctgaaaaactaaatttggataggagttcaggagatgaatcaatggaggaggatgcgatggaaactaagcacatggattccaaaacaatacctgattatctcgaaggaaagagtgaggtcaccttagagcatgtgagttcaggagatgaatcaatggaggaggatgtgatggaaactaagcacgtggattccaatacaaaagttgaacatgtgagttcaggagatgaatcaatggaggaggatgtgatggaaactaagcacgtggattccaatacaaaacctgattatctcgaaggaaagaatgatgtcaccttagagcatgtggtaaaagaggtgatcctccttgatactgtcactgagggttcatctgtagatcaaaaggaagctataagtcaagagaagccagtaatgccgactgaaaagaggaaagctgaaggtctgtcttcatccccttacagtgttcagtcatttttgcagtgttatgatgacacctttctgcttttgtttcatttgtttttttctatgctttgatgcacattatctgagatctgtaagtgtccggagtgaagtgcattatatctactgtttgatactagtatgttctatggaacaattgtaccctttttatgctcttttacattttctgtgtatacacttttttaaaattacttaagtaagatttctcatcataatttcacatgcttcagtcctcaagttgataataattgatataaggttgaaatggtctctattttttgttttaactcactgttgaatgcacagatcaagaagttgttgcaaataatgagccaatcaaacgtcagcgcctatggaatgtggatgatgtcaaacctgagcaagcaacttccaaactaagtggttctgatgcttctaaagttgtacacccgcctgctcgaagacgttcttttggcaggtctgattcaacagcacgtggaaattctccgaaggagaggatgggtgaggtttctcttcctttttagtaaagtatatacttcaccattgttaccaaattcatctcttgcctattcatatttcagtaccaccgcctcagaaacctgcaacaacttccttgagaatcgatcgatttgtgcgcccgttcactttgaaagctgtgcaagagcttcttggtaaaactggatctgtttgtagcttttggatggatcctatcaagactcattgctatgtcacagtatgtccttaacttgcaaatatattatgttacatctgcagaatattatcaaaagtgcattcatgcttataaattactatggcatttccacactgcattctttttcagtatattacttcaggcttcaaagcatttcatcatattgctgtctgtactctttgtaatttgcaacggtataattgtattgatttgtcttcttgtccacactgattttcagttctcttcggtggaggaagctctggctaccaggaatgctgtttacaatctccaatggcctccaaacaatggcagttccttagttgctgaattcgttgatccacatgaggtgaaggccaaacttgaaccccctcccccacctccagcacctatcaaccccacagcagctacagcaccttcccaccaatccaaggccaaccaaatcatgcctcctcatgctgctgatacatcaagggggctattacccacaccaccagcacttgctaggcttccaaccttcaacaacgcaccagcgagggagatgcttccgcccgctccaaagaacccagaaccacctgtggtggtgactcttgatgatctctttaggaagacacaggcctctccgaggatctactacatgcctgtttcagaagaggtggtatctgccaagcttgcagcacgcggcaaagggaagaaggcagcgtagggtggctcaaatttgctgctgctgctgctgccatgagtggtacaatttgacacttgaagaggcttttgcaagggttaggtcttgagagccgagaaggtcattttggttgtacatacaactaggtgtagttttctgcatctccgaaactgttagctgttgctcgcccatgccgatctggattgtatgttaattgtgcaccttttgatcgatggagacgatgcttaccttcaatgttgatgaactgggggaatgcatatgtgctaagtcgcagcatttcccccctaaactcgtcgcgcaaactattggttccgtttgtgaacctggcaatgttttgtaatccgttcttctgaactgggtggatggctgcatgctgcttcatcacaaaagaagataaaaactaggtggttctatttgtgttttgttctaataaatcacggcgtgattttgaatgaaaatgcacacaaaaactgtaaaaatgagcctctaaatttgttctcgcaaaaactaaagtaaaaaacatctgcataaattctttgcaagtttgcaaggcttaagataggcttcacaaagaactcgtccatgggccacggcccatgtacttttaccggtttatcggcccaattcgaaccgtaaagaggaacgggtctccgactcctcgtagttttctctctcttttttcctaactcgagtctttttcttctctctacgccagaattatctttctcatctcctccctcacgcaagcgactttgcagtaacaaaccaaccaaccctcctcgccgcggccgccgccaccgcgaagtcggcgacccgtattacgctgccggcagcggaagccctccctaacccctcccctctcctcctgccccgtcgaattgggcgcggggcctcgagatgatggcgtcccggcggggcagcggcggcaacaccagcagctgctgcgcgctctgcgagggatccaacctcccgtcctgctgctcggcctgcgtgaactccaagtaggatgttctacttgtgcccccctgattcgatcagaggttgattgatggcctccgtgtttggattgatcctaactctgtatggtgctgttggattttggggtttgtgcaggctggcggaataccacgcgaagctgcggatgatgaagaatctccgcgactccctcaacgcccgtatagccacgcgcctcgatgccaaggttggtggtgccctgaattctcccccattcccccgagactgtaacaaattaggtctcgtttggtggttagtttccacgtatgatgcctcagtttggactctatgagactatgacctgggtttagttataagttctgcatgtgtaaaatatcttgttgggtcgagaggcgtagtgtgtatctgaaactaggatggcaatggttgtatcgattgtgtctgaatagctgtatgctgtaaagttttggtgtttggttagaccattatcctgaaagactgcatctttgacttgtttatagaggaaaggggacgagcagagaaactggagggtgagcaaggcacacgatatcaaggagctgagggatcatctcgctgaactgaaaaggcgaaatgcgataggttaacaccgtgtactcatcatatgtgttaagatgccaataagtgatactgagttctgattattgaattgatgttcttgcagagaagaagaaagctgagcaggcatcacgtgatctcagagagagaacggcattgttgaatttggcttttgtcacggtatgaggctgtctttcttagtgtttccctttgattaaaaaataaaaccctgacaggttacttatctttcatatatcttgtttctcattgccagctgaaaaagaagcgaaatgattcatcggtgatgcacaccaatgccatgaaagcagcacagatgggtcttgtgagtcatatttgcttctgcttctttacttgtttgattggtgtagtaagacctcatttgttatccattatctatctggcctattttccctgttactgaaggactttatattttgttggcagatggcaactacctcagagcatttaaaaatgcagtcaaaagctatgaagcaactttgcagattgttcccattgcgacgagtaagttttatattgtttttaacagcatgtagcttctactgaaatttacattttccactgtctaaattcacatgtttgtggtattatgctgttatttgccctcttcgtcatgttcaattattaaattttgttacctaaaaaaaatccttttgataatattgtttaaatattctctggagttccattaataaggatttgtatgtattcatttcaatctgtaggttattaaggatggcgaacagaatgatggctacaatggtccatatgatgtaatatgcaacgctcgtctacctcgtggtctcgacccacattcagttccatccgaagaattatcagcttctttggggtacagctgcgcataataataatatattgaaatatactagtatgtgtatttggttctcaattctgtggaacttaacatttatttctttttgttccaggtacatgttacagctcctcagtattgtagttcctatcctagccgcacctgtcctccacatatctggctttggggtaagatgaaattcagtgtcatgactatcaacccttggctttagcatgctacattgggagattcagtatatttgtcctgtagctgtagatgtggatgcatttacaatctgtctgagactagttaggatcatggcatttttatgcaaattcatgcaaatatattctgcatgcgatgcttgtttagatttttatatgcatatgctctcaatcgattattcagttggttgtatggctgatatattcaatttctttataatgtattattaggcttcgtgttcacgtgtatggcagcgtagttcctactggagcacacgacagtcccaaaggtagtatatatgggaaagtgcagcacatctctttctctgcaacacacaaacattctgatgtgataatgttttcttcttttcagcaaagtctacccactttttatacctaggaaaaataattgctctgttggtgaggataattcatggacggaaagtggttcgggtaactttggtgttcaatctgttgattcagacaacaaatcggttcttgactccaagagaagcaatagctttaacttctctattgcatcttctcactccatggagaggcaccaagatttgcaaagaggaatatcattactaaagacaagtgttactgccattactacctattactataactcattgggtatggatgtgccatccaatctttctacttttgaagcatttgcaaagttgctccatatgctatcatcattaaaggtccttcgcacaactcttcaatcgaacgttgcttcaaggtataattaacatgttattggattacaatgcataaatgtatctatgattgcatattcttggttatcaaaaataaaacagaagttcaattctctgttctgcatgcaggtcagagaagcaaggacagcaactaaatagatctatatggaaagcgagctccgctatctcatctaacagcagcctgatggacagtgtgaacacagctataatggtaatctactagtagcctttctttttgctttttatacattgtgtatactttcaatgtggttacatcacaactgataggatctctgctttaatcagcctagttctctggacaacctcctgctgaactcaacacgagcttcctgtatagcggtaaaccgacgaagcatggtggagttccagacaacattttagaaggctgggatatggtagagcgcgacgtcctaccaccaccaccgtcgcgggttgaagacgttgcgcaatgggaaagagcccacaccttcaatcgcactggctccaaaaagaagtgatggttaggcgctcatgtattctctgaagccaggctgttaatttaggacactgcaagcctctgcataggctttcagctgatcataaggtttttggttgatgtacagaactgaccataacctgtgacaatgaatatgcagagaagagggtgtaattgatcagctggcatctgtaaagcaccttcaatttgtaaatatacatgtaattgtacagtacttcctatccaataaaaaaatatagttgaaatgtgcctgctcattcatatgctcattctccacacctgcaactacaaaatgagcaaaatgaagaacatcatacttgtacttggcttgaaaaatttgctgtatgtgtgttcttttgcagcaagagtgaaatacacgctgtaatcagaaaggaaatggtataaatcgcacctacattttttttaatttgaattttagagaagagaagtgatccacgtgtcaccatcgcgaggcgttccctccatttcaccacaaaaaggaaaaaaaaaagacggaaaaactgcgcctccaagctccgacctctctcccctcctccgcgccctaaccctaggccctccgcgtcgccggcgatgagcggcctccgagccatctccaccctactccacacctgcgccgccgccgccgcgggaggctccagtcggcgggtcgctctcgcgccgccgctcggtcggagcttccgcgtcccgtggagggcgccctccgcgttcgtcttcgacgaggtcgcgagggccgcggggggcgagcggaggagggtgtctacgcgcgcagcgagctgggattcggagaaatcaccgtacgagacgctcggtatgatgacactattgcccccccctgctggtgagagctagtggatatgcagttggaatcaggattggtacctggggattttgttgtgtggaagtgtggaacattatcgattttgttatcactgccttcgatacgatggagcttcaatggtgatcagtattggggattggttgccagaatctgatcgtttgatctagctgtttgatgccaaaattgtggattggttgctagtttcttatcgtttcagtgtgccctagtttattttagtttgatatgtactgtgtagtgtggacatggaattagccgtgaaacttatgggtgcgtctttttggtgcggtgtatggttcgaagagctggacagggatgcagatgaggagacaataaagacggcatacaggcgattggccaagttctatcaccctgatggtatgctctttacagttatttctacttttcctatcaagcaatcttctgttcctgtttattgctatcttgccaagttttggttgtaagcctgtaaaaaatccgatctcttgcctggcatactttgcgcagcataaagctatttctgcatgtgtaagtgtgcatatatctagcatgagattttagtggaatggacaattatacaaaattatggtagtgtagagttgcagaatatgtactctaacattatgattcatccattcataagcatcaaaattaagtggtcctcttcaagcctattaaaaagccaaaagggaatatgcaccgataaataaattcaagactaaccaaagtatgtctagcaaagcctggcaaaaaaaaatatgtctagcaaagagaagtgataggttggtagtttacctgctgataaataagtgaagtgtgcaataaactggtgcatggcaatacaggagggcactttttagttgattagtgctatttggtattcatggccaattaatgttatttggtatgcatggcccaatagtttttttttttctgttcattccatctgattattttgtcctcttagtttatgatggtaagggaacccttgaggaaggggaaactgccgaagcccgcttcatcaaaatccaagcagcatatgagctactgattgatgaccaaaggagaaagtcatatgacagagagcatcatgtgaatccaatgaaggtctgggtttctttggccacttattgattattgtgtcaaatttctatatcattttgataatttgaaattgcgagtgttgaaatgtattgcagagaaattttagtcaatagaggcttttctgttctgaaagcttctttttgtccattcgtcaggcttctcaggcatggatggagtgggtgatgaaaaagcgaaaagcttttgatcaacgtggtgacatggcagtagctgcttgggctgagcaacagcatcgggaaatgacattacgtgctcgccgtctctcacgatcaaaggtaatattagaacatttctttgtcattgttatcttcatgctttttatatctaggtctgattttataagcactggatccagattgatcctgaggaggagaggaaactgtttgccaaggaaaagaaggcatccatggaattctacagcaccactctaaagaggcatacccttgtcctgcggaagagggatattatgcgcaaaaggcagaggaagacaagaagaaagagatcagtagacttctagctcttgaggggcttgagctagatacagatgaagacgacaacataaatttcctaaagtaactacgcaaatgttctttcacaaattccatccacctctcccagcatatactagaaggtttcgccaaagttccatttagtgaatatatattgacgcaagaaaaaatgagctcaagggaaacattggatcataactgttggaaatccagaattctcccatggagcagaaagatgtggccaacggcgaaatccatctgggccaactgctgcaacctgcagcccagtgattcaatcaaagttctttatgcagatcctctattcattgtttccagcagatggactgtattgcaagggatatgactatcagatatgtatacttgttacatgcgaaattgtaattatgctagggtaattttgtaaccttcttgtttgtccgagcaaaacaaagtgcattctctgtgtggtgcctctagctctgacactttgtaaatactacagaaaacatccaaagctattgtttactgggcatgaataatgttgtttcaaatcatccatactcccttcgtactcgtaaagaaagtcgtttaggacaatgtttaagtcaaaccttaggaatataaatcatgaatgactctcaagttgttgagtttgaaaatgtaaaatttatatgaatagatttgtcttgaaaaaatacttttataaaagtatacatatatcacttttcaataaatatttttatagaaacaagaagtcaaagttgtgtttttggagaccgtgtcgctgtccaaaacgattttcttccaaacctctgaaaatcccacatgcagaagatggaaaatatgatgatgatggcatggttctaattttataaaatttaaatgacatcgttacaaatatacgaattataatggtatatctgaataagtatatttgcaatggcacatatcaaattaacccaaatttgtttcactggcctttgctggtagagcctccagcttcagcatcgcagtcatggcgtttgcagtagcttacgaattcgtaaattgccaatgaaaaatccaagtttcctctacctgactacctctcgacggcgtaacaaatcttgaggagaagcctgctattttgtacaaatggggggttttatatgcaaaagctccatccatcggccaatctgggacgctgaggtccgatccaacggtcatgaatggcccagtgctggaccgcgccatctcactgacatctggggtcaggcagtcaacggcgccacgtgacgtcactcgccctccccgtcgccggggatagacggttcggcgccgcaccatcatctccggcgagcttggcctcctcgagctcgtgagcgcaggcaagcctccacgatcgcagcaactagtgccacttccctatcccagctgttgttggaatatgaagtaaattgcttctcttttcttattagttactccctccgtttaaaaaaacttaacctaatattgatgagacataatttagtataacgaatttgaataggagtgaccagattcgaaatacgattatgtccaattccatactaggttatgtttttttttttttggattaacctctcacactggccattcatggctggtccaattaccagcctcgtcatgacgtcatccggccgccatggcggcgtggggcagctttcatcaaggcaacgacgccattgggctcactcctggagaattaaatcgatttaattcttcatttctcagctccgacacaatttcaattagccaaagctacgccatcagattggcaatctatttacagcggattcagcagcgtggtcggatgaatgctgaagaaaaatccagcttcagaacctgctcttggatgcgcagaatggtacattggagaagctgatctgtttttcttttaactgtttgcattcattcatggaggccagtatcactgatgctgacgacgatggctgcctcgccattcatttcgtctcgctgcgacgaaccagggacacattcagaacagcttgcttagccatcaagagctagtagcccctagtctactactagtccattggctgggacctactatgagatcttggaacttctgcaaacactaaccaggcaaccagcatgagaagatttggattcagggtgtgtttagttccacgctaaaattgaaggtttgaagaaattggaacgatgtgatggaaaagttaaaagtttatgtgtgtaggaaagttcgatgtgacggaaaagttagaagtttgaagaaaaaagttggaatgtaaacagggcctcagtttggactaggcctcctttggattggaggatgttcaaatccttaggatagcgccctttggattgaaggaatgcaattttgaaactcttatcctgaattcctttgagaagtcaaatgcactctctacattctctcttaacctgacaaacttcctccaaaactcatactacgttttatttcttatgaaccatccatgggcattatttcttatattcattcatctgttttgaaatcctatttaaattgatgcgattttcatgttcccacgtcttgagcgctttcaaaagaaaaaaaataaaaggtttggtttagcgaaattcggaatggtgagatgatgggtggtgactacggacaggagaagctgtacactcatgtgatgacagatgtgtcgatacagaaaactgcttcagacaaggaccacagtgagtgagtgaggcgaaaaaatcataatggctccatgacccatatgttctctgctcctgcaaccaaacgactgcccccagatgcttgtctggtaaccaaacctgggaccctcaccaacgtgctcacatctctccctgccaggtgggcccgacccggcctgggcccagccgccagtcgcagcgagccgttgccgcgatcgccgccgtccacctggctcggcatctgatacaatgccaatcaacggccaagatgggggggtggaggaagcagcttgaggttgggggatcatggccaatgcctgtctctccacagcaaacattgaaggctacagcaaaatggaccggctcaatgaacgcctcctcctgggggtgttcattcattcaataaatcctgagccatgctgcaatgcaaagcagctgctccagaagatcagaaactgcatgtgccctgttgtaaaagccagcaatggccaggccaaatcggagtaacttcagaattgcatgttacagctacagtatttttccaaatttcgacaaggaagcacagctgagaacagttcagaacagggaaatttttgatgagttggaacctcttgaactcatgaagaaagatggcaatggtatcaatcaatcaatgggatggatgggatcaaatcctctttacactactcgagttaccaaccaaacaaaccctggctacaaggctctggaaaacccacagaaaaaattgggatgaacgaaaaatcggttacatgtacacgggaaattaaaacgaaactcacacggttatggaacacagatcgtcacagaccgtcttcatgttaggcctctcatttacaggaagaatacacctaagagagatcgcaagcagctcgtccatcacccttggagattcttccaagcccgtgatgtctcgatcgaaacaatcagttccccgtccttccctgttgcacatttgaacccagtcggtcagatcaacggccccagattgacccgaaattatgtccccggcactcttccgcgtcaacatctccataacaatcaccccaaacgcgtaaacgtcagctttaaatgatggcattggcttggctgtgtttgccagttctggggctctgtaccccaatgcccctaagttaagtatttgctcagcagtgccacttggagtcatgaaccgatgcaggccataatcgactagcttcggggagagatcaggacccgtcaagaatatattggttggctttaggttgccatgaggcagacccttctcatggtgcaagaactggaggcagcgtgccaggtcgatggcaattttgagccgttgagaaactgacaagcgggagtatcttcttggagttgactctgcagcacatgcgaggagatcaaaatttcagcaatggaagaaacaaatgttgacatgaatgacccagcaaatatatggaacaaataagatagtaataatcaagcagacaatgtaaatataggtattccattgtaaattaggaatgcatgtcaaccaaacaaggaaaaaatccattgccgattcaagtgagcatgggatagttaccataaagataaagagccaagctgtcgccattgacgtagtcagaaataatgagtctttcttgctccttaggaccccagtagaaagctctccacgaaattatatttggatgcctgatggtcccaatcctctttatctccttagtgaagtcctttttatgctttacgaggccaacacgcagccacttcactgtcaggacatggccgctttgtagtgcagctttgtatgtcgtgccatgactgctccttccaagaacctctgctggtgctcgggacaggtcttcagctgtgaaaaccaaagtgctgtctaggaaaatcaattctccgaccaaccgatcgggtgagtacacttcaaatgccacaggttcctcatggaatctactatcaataaaatgtggtgatgttggtagcacaacccgtggagagggctccatagcagggactgcagcagaggtctcagccatacctgaactcgagggttcagtgacttcttttggatcagcatagccgtactcaacagcagcttcagctaatagctctttctgagcagacattgatctagctgcagctgttaagagatggtcatttgagaaacttgttttagttggtataacattatctttcggaggcttgaaaagatttggtcggcttaacctccccagttttagatctctaatagtaatctgacctctaaatccatttcttccgcaaagctcttgagacctgaccacatagattgccaatgctatgaagatcacaagcaatgcagctccaatgcagccaacaataagagcaactcgaacgccagccttatgtccatgagacgattgactctgagcgactccagtatcatcataatttccagcaggaaggccatctggaaaaactaataggtcatttccaggtctaaagcaggttatggggaatttttcaacacttttaggaacagttccttgtagatcattgtaggacacattgaatatcttcaaactagcctggggcatatcaggaattctgccagtaaagtgattatgtgatagatcaagatactccaatccttgaagtttgcttatctcacttggaatctccccagacaactcattcattgcgagagtaaggaactcaactctttgcaagttagaaatatctggtggcaacggaccggacaaagaattacttgacagatcaacgatcctgagaacaggctgaattagtgcaatcgactctgttgaatgtgtgctctgaaatggaatagtcccagtgaagttgtttccggaaagatttaacactgcaaagtgggcgacagaaagaagaaaggcaaaacaggtccgccaagagcatttagactgagatcgaggaattgtaacttctgataggttcccaacacggaaggaatagatcctgataacaaattgttccgcagcttcagggagactaagttctgaaactgtgaagcatcatttgggtagcttccctccagtttgtttgaactcaagtcaatcgtctccacggtaccatcccaagcacgcaatatagctagctccccagaaagctggttcccactcagatcaactgagctacacttgccaacagtggatggtaaggaacctgagaacgtatttgaagagagattcagcagcttcaaagtcgtcgagttcacaactggaaccgatcctgcaaaattacaagcgtgcacgaatcatttagagctgtagacaaatgaaaatgacatttatgaataactgtacaagaagagagtagacatagcaaggcagcaaactataaacagatacatatatttttcaatagtagatctcatgccatagcatattagcataggaatagtttgttacagtcttaattgaataatttctgtgtaaaagtcatgttagatggcaaggatccatcagcaagttctatggtagaagaaatatgtggcaacatgacagctggttcagaataaaaggtttatttgactgagtttatcaatgagcaccaaaaatgttaactacttaagactatgtttaggtctataaataaataactatcgtttatacaaactattacagaagcaacaaacatgaattacaaagaaagatgctaaaatcagttataagccaacaatgcagcttcaccacgagtcacaagagacaactatgcaagaagagtcaattgttccatatgctcatcaaatcctcaatgcaaatgaactcaaccagattcaagatgcattgaatatatttttgccaacgaagtctagaaatattcgtgtcgcaaatgttacgaatctcatttgattcgcaggttgtaatttaggcatcgccgctccacattatcgcccgtatccaagccgtcgcccatcgatcacaagaacaaaatcgaccacttcagcttacgctggggggttcctagtgacagatcaaggcatttttgacaaagatagcagaaccatttgactagcaaaaggaagatatatacctgagaagccattcctgctgagatcaacctcgacaagccgcatcgagttctgcagcatcgcctccggcatcacaccggaaagcgcattgccggcgaccctgaaaaccgccagagagaaccacgcgtcgatctgcggcaccatcccagcaatcccactgttgctcaaatcaagaacctccaggttcttgaaggcccccaccgtctcgttccggaagaacccgccctgcagcttgttgtggctgaggttgaggtacttgacggtgttcccgatgctggacaagctctcgagctccaaatcgacggcgccggtgaagaggttgtcgctgaggtcaatgtactcggcgttgcggagctcggcgagcagatcgccggcattgccccagaaggagttgctgcggaggtcgatgcggcggaggttctgcagctgccggatcccgtcggtggggaagcccgaggagaagttgttgtgggagaggttgaggtggacgaggccggagaggtcggcgaggcggccggggatggggccgtagaagcggttcccggagaggtcgaggtggcggagcgaggagaggtagccgatgccgggggggaggcggccggagaacgcgttcccggcgagggacaggttctggagcgcgcgcatgccggagagcgtcaccagcttgagctccccggcgaggccgagcccgtcgagcgcgacgccgaccaccgcgccgccgtcgcacacgacccctctccacccagacgggcacccgccgcctcccccgccggcgtcgggcgtcgccggcggcgaccaggatcccagcacggggtccctccccctgtccgaaatccccttcttgaactccagcagcgccgccacgtcgtcgcccgccgcgccgccgcctcccaacaccaccaaaaccaccagcacgaggagcgcggccatggatgcgggtgcgggggtggccacagctaggtttcggcgtgggagcaggtggtggcggcggcggcggcggctgccattggaggggggtgagaagcttagctgagagagagagaaggggaagagatgtgtgagagaaagaaatgcaaatttttggaaatgcgaggggtggagtgtaataatagcaagcaccagctggggaagagagagagagagagagagagagtagtgtatgccagtacagactggaaagttacaagtggttgtcttgtgctgtagaagttgtagattggtgtgctgttaagcttagcttaactgtggctctgtgactttggacgtgtttagatcgtagccaaaataaacattactaaattttgggggtgcgtttagtttctgaaaaaaagttgaaagtttgaagaaagttaaaagtttggaaaaaaagttggaagtttatatgtgtaggaaagttttagatgtgatgtgatatgatggaaagttggaagtttgggggtagttggtggtgaactaaacacggccttagtattaccaaaattttagtaatattatcaatttttggcaggatttcttatttatttatcagagtttggtaagaaactaaatggatgcacatatttttcaactttgccaaaaaaattgtatggtttgaaatgtcatcaatctgaagaagccctttatttacttccatgagtgttactgtgttactccatcgttccataaaaaaccaacctaatattagatgttacacatattagaactatgaatatggacatacctatgtacagatttattatactagaatgtgtcacgtataattttagattcgtttttttaaacagagggagttctgttttgtgtcattgtgtgagtacttgggttatggagcatattgtgtgacaatgtgagagtaaaaacaatgttgtctttagggtggttatacttatacctttttcatggtttcatgtacctggtcttggaagtttgcttttgtttattggttggtttgtgcttttgttatattgtagatatgttttgggaaaggttgtttgtgcaaaagaaaattatgtaactcttaccaaggctaacgtagcatgttgcgggtaaatctagatttcctgtaactcctagctagtaaaatcaaacagtcgagagttttgtatttaagagtttttgtaagttttccatagttgagtgtgagcaatttggtaagcgcaagaaatgaccgcttagaatgcaagttgaatctttcaccattgtagatctttttttccctttgtactgtagatgtgttctagtgtagtactagtagcgttttgttgctcatcctaaagtgctttataactatattctttaaaaaaaagaagaagaaaaaacatgttactcacgttattcctgaaaagacaaactcaatttaactacggaaatatttaatgtcaaaatatttattgttacagcaacttcttgacatctcaaggtcaaggaagagaattagggaacatgcaataaaaaataacaaaagctaccattcatttatacattagttagattattagagtgccacccattggggacaatcagtaattcaaaataaataaataaacctctcaaatgtgtgcagacactgggcactggtagaaaagcaagagcccccacatgacccaaggctgtttcaggctttgacccctttcctccagctcagttgagctgcctgccctcttgctttccattctttcctcccttttccttacctccaatgctctctttcttcatgccactcaacaacacattagactataattttttttagaaaaaaatccaaacagaactggaaaaaaatcgacagtttataaagtatacaatttttgtcatggacaagtgtcatgaggtgatattcttctagtttgtgcaaggttgatgtgatgtagtggtagtagtaaatggagtgtagtatttatttcagtagctcacagaggtttagagagacatgaagaccttagattcaggagcctgtcacatgtccaattatatatttctggtaccaggtagatcaggagaaaatttctacctctccagataatttcagtgcttcatattgacagtttacaagatattttatattgtgatcttcctctgttcatccaattattcgatttctgtcaaaattggcgttagtcctttcatgaatttggctgatccaggatctgtgcagtttttgcttctgaatcttgccaacatttcaacatgccatttctgaagtttaaggttaaggatgtgatgactgaaaggacggtaaaacagtcggtgcatagtggaattagaggatatatattcatatcctaatccagatgcttgctgttaggaggaaatataggctctgaaaatgacatggtgtagaggagtactaatcaatcggagagattgatgggctctggagtttggagtttcttgacatcaaaatccagagttgtctgtgatagagacggtagtgctaacaagaattaactagcaggataagttgaaaagtgtgtcatgtttggatgacacttaattaaggttgccatatttttagattaagaggggccaagcatgattggagttccataagtcaaatattcttccatttctttcctctcgtttggatgtgtatgagggtgacagtgtgtgtcctgactggtcctgagctggatgtaattcctgcacgaaatgcctaattggtgcaacaaacgggtttaaattacagtcaatatccagccatgtgttagaagcagatgttttctgattactttaattaaggccatgatcacactataaaccatatgcggaaactcgaaagattgtaattaagttctactagcaattagacagactattatatatgagtcgtatacaattttttttagataatgatatgaatcatatgtacaattacaatttatatatcttttatggataattgcaacagatgtccttttgcagtcgttatgaagtgattaggaagtttcttaacttgattaggtgcgggattatcagtactgcataatcatgccgtgtttgctctgaattgcggtttcttggggaaatgcaaatgctaatcagtaactggatcagaacatgctgcaggtactaatttattcagggaattaagtaatgtttcacaccgaagactcaaatagcaccgagtagattagttgaggctaccaaaccctgagctgtaaccgagtagaagaaccttgacgtcttaaaacacactaaaaaaaatagaagaagaagaagaagaaagtgtccatgtcgaatgctgtttttttttttctgaacctcccaacactctttcaacaaccaacctgaagaaattccaaaaggaatactggattttggatttttcatttacatgcttcataaactggtgcattttgtgtaaaaaaaattctatatgcttttttcgaaaaacttttctaaaccattttttcaactttatagtagttaatttatttattcatacccttaaatagctataaaaatcatattatccattaattcatcagtttaaactatctcaaacagggaaacaattttcagtggtacttttttttaaaaaatactacagtggtactggatgggagaattattgttgctgattgcaggaaaaggactgcaaagaaagatatgggcagtacaaaaggtgaggattaaccaggacactttcactgtaaaagagagtaaccaaaagactatcagtgtggcagttaaagctgctcagttggctagttgtcccggggctttgcttgaatttgaaaccatctgaagaaaaaaaatgttgccgctgctgctccatgagatgatgtttttttcatgcgtcttttgcagctaaacctgggacctgagctaggttaactccactgtcatgcatcatggattcacagtgcaatggtacacgtttgtagtactgattaagggtaaactaaagcaatcaatctggaggcttgagaaccaagcttaacctgaataatgattagtattggtaatcatacttaaactgaagaacatttttcagactggcacagtagtagtattggtaatactggtacggttttgccattgagcgatctttgttggtgggccccagtgactaacagtccgttctgtccgtgaaaggctgtatggacccgtgctgtcagaaggataagggttagattgactggactggctaaagactcgtctttcagaaagtcttctatgcacatatacagagacaaacagatctctaaacaaaacaagaggctggcagacagacagagtgagtaagtggatgattttaatctaagtaaaagtggttagtagcattattagttaaagaaagcatggaggagcatcaccagcaggacacaatagaatatgtggaagtgagcaaaggcgaggacgaagtacgaagaccaccgccctagagctcatgctcaccgaactgtttccgagctaaaaaccggtgataattggttttttaattcggttttcatggaaaccgttgaatcccgataaaatccgatcaaattttgttgaacttgaaaataaaccgagtggaaaatccggttttcgcgaacatcgatcggttttcgtcggttttgtgaatctggccacctgggaaatgcaatgtgcatgcaccaggcaggtagcgtgctgggtggtgttgtgttccatgcttccattacatggcgccatatgctttacaggagtaatcctcgcggattacagcgcatgcgatgcatcttcttgtcgttccatccatcgtcgccgcgacgccgcccgtcacatccccaccaccatcaccaccaccactagtcgctctagtgctaattaattctgattaagctggtgtaattgatagtgtcatgaatataatctggtcgaagttgagtagtaggcgaaatgtgatgttttttttagataatgaggcgaaatgtgatgtgtatcccctcacgtgtttagaacagggtcatatctgctggtcaaagatctagcgccctcacagttcaccggttacggctgattggcggatttcagattgtgatagatgatggtagatcagaacatgagaatcagcaagtagtgcttggcgaaaattcttcagccatgatagaggacttaactgaactaactgaaatcgaattgcacggtcataatcatgatgtgtagggatagttaatcaggcggaccaaaccaaactgaactgaagattagagaggacataattacgaaaataggcaattgcacgagcgacagggaggagcgagagcagaggtcgacgatggggtggaagaagaaagaagaagaagccgtgcatgtcaacatgcgtacatgcaggcatgtctgctacgacaagtctacaatactgtactacgtactacttctgaaaaaaaaaattataacatatgctctttcttttcttatgaagatatagattttatctcggtttttgttagcacgttttctaaattactaaacagtaatgttccgcgtaaaaaactttttatatgaaagttgctttaaaaatatcaaatatatccatttgttaagtttgtaataactagaaaaaatacacgtgcgtcgcaacgggtgatactattttaatattattattattatacggttcagttaggatgaaattcactgtgagaattcgcttggatatatttttagaaaatcatgagctgtaattagaagtctgactttcatattaagttagcaagttttaaaaaagaaaattcttatacgacttcttttgtatccaaaagcaaatgaacttaaaatccgattcaaacacggatatgtatttcaaaaaacaaatttaaaaaccgactcaaatacgaataacatatcaaaataccaacgaaaacattttcaatttttataatagcagagattaaaacttaattaatcatattctaatagcttttttgttttacgtgtgctaactttaattttatgcattaacttaacttaaaatatgagaatatatttttatctaaacaataaatttttttatattttgggacgaggtcggtatatcaatcctgagcgtgtccatgtgcgaccaggatgccatttaagacaacgaactgtaggaaggacacatatatatacggccccgcgcgccgtcgggggggccccttgtttgatcgatctttcatttcggtgtgtccatgcatgcatgatgcgtccacgcatgtgtccatgtgatcgccgaagcaaaaacagagtggaccatctcccttgtctcctcccgctgctactgctcgtgcaagtgatcgagcttccgtccatgtatacgtgcgaggtgatggtcgagattatccggtataagagacagggcaatagtacagatacctgttaagctgtaaaatcttccatcttagaccgagtttagttataaactttttctttaaacttctaacttttccattacacttctaacttttccgtcatatcgtttcaattttaactaaacttttaattttggtgtgaactaaatacacccttagtaaaatagaagataatatgtacgatagtgagctgtaagtagttcaatgtattgtcctctagcgcatatatatactatttattcgtttaatctaacaagtacctagtgtgtcgtcactgtaaactctctagagtgagcagcgtcgcatggaagcatatgaggtcgtgttgcagccggcgcttttatctctctttaccatcgtttttctttcagctcagctcatatctgacgtatttggtgttggagccggttaagttaacctactctatttgttctatactgtggtaaagttatacgtttatatccatatccatcgtctagaacaagtatgaaatattctctctataaaaaaagttaaataggaatgtggcataacctagtataacgaaacatttaaaaagacctaatctagcgaatttaggtttcgttgtacagtactaagtattaagtcgtatcacatcttcatttgtattgaacttttttataacaaataaagtactaatgaaatactacatctatcccaaatagagacgagaaaggagaaaggagtaagcaaagtaagcccttgtttagttccaaacttgtttctttaaacttttaactttttcatcatatcaaaacttttatatacacaaactttcaatttttcaatacatcgatacaattttaaccaaaattttaattttagcgtgaaaacatacctaaaataaaatcatggcgccgccgtggcgtgggggcgcgtggcggtggcgtgcgtgccaccggacaaccggagagcggagaccaattgcagttagcgtaggcaacatcacctgtgtgcacgatgattagctagggccggccgggctgtgtgtgggctgtggctggcacggtgggaaaagaaaagcggcgtgacggaggagagcatcggaattcgcgtaaagcgagaggggcacgccgtggcgtggcgtggcgtggagccgtggaagtgtggagcaccggcaccaatcatgcgccgcctcggtgtccgcgtacggcgcgccatccgccccccacccccaatgcttgttgcttcccctcccaaaccaccccttttttcttttcttttcgccctttttgttgggaaacaaacagtaacacgcgtccgtgtcgcatcgcagctcgatcggattccgttgaattctaccaatttctgtcatattgtttcgcaccgcacccccatttcgacatgttctcccagcaagcgtccctgcctggttgtttaattaacgtcaattccattccccctcatatgagtacgtacgtactcatggcaacagataccgactctcggtatggagcaaaagcacgcaagcaaagccatacagtagcagcatcccagcggcgtttgcttctgtacgccccatcatccgctgggaccggaccgggacggccatgccatgctgcaggagcaggaaggagaggcaactctgatcgtgattgcagatgcaggagatagcaggagtagtagatctcacacatctcatatcaaatgtgagtctcgtctcttgcaatcctaatccccagccgcatcatgtgtcgccttcctccccgtccccttgctatttgccactaccaccactaaccacagtttgtctccccccctcgcacttgaacgtgcctcccctgccccacccatatgggcgtacaggtgtacccagtgcaagcaaagcaatgctgctgctactgccaaatgtacaactacgtactactagtacagacaggctctcccttcgaagggagtgaagagtgcccgagtggctgccctggaatctggataggatctgcttgcctccggtgagagagatgagagatcagatcagcacacacattcacagctgaatgaataatgagacgaggaagacgagtcccggttttgctgctggtttcgttgtcttcctcttcgtgtaaatcggagtggaaaagaggcaacaatagatgttcagatatatacatgtgtccaggagcaaaatgtagggaagcgagagctattgtttctttcatggattactgcaacacaaataacaatgtcgatgtttacaacactacagttacggtacacaagtgagggagaaagagagggggagatcctaagtgggaaatgtacaggattgagctggtcagattttctttttatctaattcgttttgcacgagagcttagcttagccttgttccttgtagggtgtccagatcagcttgctaacgtcgacctcgaggccaccccggccggcggccttgaggtggcggtcgagaaccttggggtcagcgcagatgacgtgctgacctttccggtactggatcaggtccagactctgaagcgtgctcaagatgtcgtccgcttttattgccgtcatatcgctaagctcctgcattcaagcgcgacaacctgttaggaacagtttagggctgcgtaattggataatgcaaatcgaagctaattgatgatagaaaatgatggatctgtggtggagttatgggctatggattcagctacagaggaactcaatgtgtgtgtttcttcatgatttgaaaaaaaaaattagtatggaaagtaaaattatacagtagttagtacaacacagcctattgacttttcctacagatctgtttgcaccagtgactgtactagtgcatcagggagcaaggatgcaggaacaattatctttcagaatccaattgttcttgtgtgtcgtcaaaaggtttgatttgcatacatccaaaagttttagagggccggggcaagatgaacaggaaggcacaggctgacaagccagagaacacatggatatatgtccttccgtagaggaagtttctgcagattacactagttgcatgtgatcctgtctacatatatttgagttcaaaagaaaaggatatacacctcttcttcagaatggtttaaggatataatgcagcttggagaatctaattgttgatttattctttcatgcaatctttaagagctagaacaatggttctaatgccagaagtaagttgagtgaagatttttattagttattatagctgtccatgaaactgcagtgggctatatctacatgaatgattatttagatgtggacaaatattgactgatgacacatgaatttcagcttggtttgttggatttaatattttattgtaatttgtaagaagtaaactgggtgtaagaatctacagcctcccttcagactactgaactgcacatatctactgtatccatgaaaagtagcacattagatttgagttggtaatcaagatctcatggatatccacaaacatccaaactgtgaagtgtagcatcaaatggtctgtttcacataatccaaaagttttcaggccccagggcaaacgaacaggaagatgtaaggtgaaaagcctattaatatgcaaaccaatgtccttgtgtgggcaagcatgatcttactgttcactcaactggctactcctgacctgaccattttagcctatattaatctgaccatttacacactagaaattaacctgatgacactttatcctacatatgattgtaagtaatagattggctgagatcatcaatgaacaggatcagatagggataaaaaaaagtagtatttgatgcaatgccaaaaaagaaaatgacgcctgtttttatcatgatttattcaaatgataaaatggagagagaaaaaaactatagtgttagatagaggagaaggaatgtggtgattaccttaatggatatgttgctcttatgtttctttaaaatctctagaagcactctagtccaataacctctataactgagcagaccaagatcagaaagagggcgctccggtgtccctactttaccttccttcttagaaagctcatagg

SEQ ID NO: 66852 - DNA, 16172 bp, Oryza sativa
caccatccaaatgttgtggccttctatggtgttgtgaaagatggccctggtggtaccttggcaaccgtaactgagttcatggttaatggttctcttcggcatgtcttgcagcgcaaggacaagtaactgcttcctgtgcttttttttaaaagaaaattaatttgctcgttttgggtgagtaacagtgtgctttgttttcttactgagcaggtaccttgatcgtcgtaagcggcttatcatagcaatggatgcagcatttgggctggagtatttgcactcgaaaaatatcgtgcactttgatctgaagtgtgataacttgctggtgaatcttaaagatcaatctcgtcctatatgtaaagtgagccacacttcatttctagtgttatagcactgttttataccatttattaaatagttgctttgctttttgatcactcagtggatttatcatctcgatttctgttcactgttcaggttggttgattttggcctatccaaaataaaaaggaacaccctggtttcaggtggtgtgagggggactctcccatggcatggcacccgaattactcaatggtagcagcaataaggtgtctgaaaaggtaaaaacatttttcttggttttcttttttcttcaattctttctagccatgttcttaatgttccttatgggtaatgaatcctctatcatcaatatgtgctagcacttaaaacaattccaggttgcagatttatatgcaattaattcaactatagcaatatttttagagttatgtttagggtactcagtcatatatttgtctacaggttgatgtattttcctttggcattgttatgtgggaaatacttactggagaagaaccctatgccaatatgcattatggcgcaattattggtatgcaattcatccctcattttctaggaattgtttgttctaatatgagaatatttcatgtgtttttctttccttactgagaaaactaaatattcgcctcctcctgtgaatcattgaacctaccccatgcttgtgcaaatttatattttttccttgaggtttgattcacctatgctactatctattcatagctgttcacggctccattctgacatatctacaagcttatggctcctgtcaccttatgtacaacaaagaagacaattttcccccatcttttgcaaactgtattagcttttctagtgtgggctaaatagtacacaaactatttaagtattaaaaaaacttcttccttttctgggcaataaagttaatcagaaaatagtgtatgatactagtattctataaaacaatcaattttgcatgcttcctttgctaattaggcagtcctgaaccctgctgtcttaaattccaagtcacaccagtattgtgctctggtactcaacaattcaacatgactaaataagtcttttgcggagcattgtacttccttgaattcagtcctttttgatgaccctagaactccccgttcttgaaatgttctcttcgtccagcaacttataatacgacatcttgaaactccggttgcagggggaattgtaaacaacacattgaggccacctgtgccagcgtcatgtgatccagagtggagaaggcttatggagcagtgctgggccccagatccatcacaacgcccagcattcacagagatagctggacgactccgtgccatgtcagttgcggcaaatcaggcaaaggcggcatccaaataaacggcgcaggtgggaatacttatgggttccagtttgtatattattatttttggttgagaatgtaatacatacatgtatttggttggaaagtaatacatacatgtgtgccctatagagagtggtttgaaagttaattgcttctcatgggcaaggctgcatccagttatataccgttttatttggggggttttatgatgtacaaagccttatttggatttggagaaacgttatcattgaaagctcctcgctcatatactgaaagctgtgctatagtgtactcaaatgtgaataagaaaaactatacaggacatttaaattctgttagcctcttccttttttatgaagatatatgcgagtttttgtgttctcattatcctttttaggtggttaactaagcgctcacatcatgtactttcaattgtttggcatttcattctcactgcagggtaactgggtaaggtggcctttccccagttttgagaagtacctctaattgtcgtcagctgttggttttcaatgtgtgatcttcacccaccttatttgacgccaaaaaggaaactacgaaatgagattcaatctgacagttgccattagtttgagactgagtgaatgagctgaccttggtgtcttcccaagaatagtgtattgagattggatttgcatcagtgcaattttttatttcgtctatgaaagtcaacattttaaggtactcctactccgttttttttcaagagattgaccagtgctattcgcaaaccgagatgatcaagtgactaatcttgttctgcccaaaaagaaaaaaaaaactaactagagcatgtgcccaatttattagaggcttatctcttccttttctcttttcatgtaaattgaatcatgaaatgagcctcgctaataattgggcacatgcttgcctaacaggctaacactaccaagttgcactgtccgagttcatcttgtagagtagaggcttatccacgcaaaaagagccaaagaagactcctagggttccaatctgtgcatctagccagactgcaacaaatggtgtaaggctcctgttttcactggtttccaccgaaattaggcagatgaaacaagcaaccaatatgtgatggcgatcatactagcggatctttaaattatcacatgccggcgtaaaacagtttttagtcgcatgtttggaaaggtggaaatgccacattgccagtattggaggacactttgctaccgatcgatatgttacagtaaattttgcccgtgctctttgtagatttactacctttggacttgacctagagatagaagtttatttacccttcagcgaaaagtaactttaattattctaatttactactctctttatttcaaaatataattttatatgattcaaaatttatacagcaaaataagtctttctccatctatacttctttatctcaataaattacaacaatttctcgtctcaaccttagtttctattaaaactctcagaaatgctcatatttttattgaaacagaggaagtaatttatattgcataccaaaaatgtaaacaaaatacccatcgacatagagggttgaagctgagatggacaagtctgtaatataatttaatctagaatttaataaaatggatttataggccatacacatatttcactccactccattcatatctagtactctactacgataaggacagtactacagacatagttaatgacagcatacccattcttattcgttgttataattaatctagtcaaggccataagctcactcaaatcttcaaaagacgaaaagaagttcactactctgattccgtattttccatgggtggtagcacactagtactactttttaaaactgatagccacataaaaacaaataccaaacaattggcgccatattttggagtgagcatatcaacctctctctgtgctatataagcaaccatcgcttccctcatcctccttcccgccacaagcaaccaagaaatcaagaaaccgtttcagacaacccactgcgctgcccgccgccgccgtctccggccgaggataccaacgacaacgatgaatcacccgtcctccgccgcgaccgccaccgtactcctcctcctcgccctcctcggcgtcgccgctggcggcggcgaggacggccagaagcgcgccgccggcgtgtacatcgtcatcgtgcagcccccggccgacggcgccgacaccgtcgcctaccacacgtgcatcctcgccgccgcgctcggcaggtagcctagcttagctagctgcgagcaccaaatcacccccaagataacggaaagacaaaaattgcaaaaaaaaaaaaaatcgcatcaccgatcgatgtgcatgctctgtttcaactttcaccgagtgattttaattaccctgtttttctcttaatttctctgcaattgcaaaagcgaggagagggcgaaggaggcgttgctgtacagctaccgggcggtcgccagcgggttcgccgccaagctcacgccgccggagctctccgccctgcagagtgagttaattagtttttgctgctttccgtataatccatcctgtattcctgttcctcccaactatgatgaactgatcagtaaactttatgtcggctgcagtagaatcttctccatctctcgctagtagtaaaatcttcccgatggtcttcacatgttcatcatattatactacacacgtaattaagcgcagttgttaatagttaattgcggcgaggtttttctgggattagtggactaatttttttgtcagaggaaagggccaaggcccaaggggatcctcttggcaattccgaggtcaatgttaggcttggttcagtagtggctctggctcacagctttgctgatgatgcactgcactcttccgagtgtttgaccttacctagaaggccgagaaaggtataacttcgttgagggtgtaatcgtgtaaattttcccggttttatcttttaactgaggttagggatcatgctcaccaatgcaaagaataaagtgcatgcaaaccaaactttgtggtctcttttcatgtttcctccttttcttttgctctttgcttgttatcccgttcctaaataaactttttgtgtgctactcattagcccaagtggataaaattattctttcctttgctgcatgtatatgctattaaaatccttggaaccttacaagattcactctttcattttattctatttcttttgttcagagcatcctgcagttcttcaggtgcgccctgatcagatgtatcatgctgtggacaacctcaactgaaagcttcttccctttgtgagagagagagagagagagagagagagagagagaggatgatacaaagtatagtgcaatactgaaatgttcttcatgcttctccgatgttggtgattatgctaatcgacaatctaattaggcagtaaagaaggctataggctctgttgtgaaagagtttcatgttattctttattgatcttctctactatacatacatcgaaatatatacagccaatgtattactaattgagggaataacaattacttacaatgttgttgtaattcctactttacaatgttgttgtaattcctacacatctagtgatatacaatctgtatgttagaacctataatggaatataatcttatgatggattgggtcttatttggcaacttaatccacaatattgacctgtggaatgatttgcacactagattactcatgatgtggcaattgtggctaatgcaacgagaggtgataagttgataacatttaagaacataatatacaaaagtaatgcagagtattcaattcacttgtttttattctccttgcaagaaagatgcatacactaagtttgtttttcttgttacaagcacgagttatccgtagagcaaaagaaaacatctttggaaaccatacgcacacaacaccacatgtataccatatgaaaacattcacctccacatgcattgttctctagcttgagaatcatgcatgatatcgttgatcgtctggacctttaacttctaccaaacctagtcccaatccatcatcggctatactcccatggactcaagaaacacctgcatatgaacaacaaagaaattttatatccgagtataaatttgcaccaacttgtctcacatcatcacacaatagtatcacataagaatagaaaaccatctagaagtcgtaaacatgaagcaatctagaaattctacgaaaacaatatgaaactgactccctcccggaatctgccggtttgaccgtcgagctacccggtctgaccgcccggatactttcggtctgaccggcatgcaccacccagtctaaccggtcacctagcgccaacctacactgctcatcgtctgaaaacactatgcaccatgttttccaaaatactcacctttgacaatttgttcatcacatggattgaatcatcacatgattctagaatcagacacatctgaacattcaattagatgatagggaaaattttgtgaacatcttaaattcttgttataatacactctcatgcgtaaatagaaatcatgattgcatctactagtatttttaacgagcattttgaatatgtacacgtttcgatgacatgacttgaacataataaatgatccaatattaacacagttcttctcgcaacgaagaagaagaagaagaagaagaagaagaagaagaagaagaagaagaagaagaagaagaagaagaagaagaagaagaagaataggtcaatcacacaagggaacttgataaattgtgtatcatttcaaattgagcatcaatctacaactaattgtattataaacaacatgggtgcagtgcatctattatctattatattattattaaaggaatagaaaaaggagcctccacgtcgctctcatggcctagaaattctcacattaatcggagaaaaaaaaagcagagtccatatagaaatacaatttagaaatagctgaaattcggaattaaaaaataagaaatattagaagaggagactagagtccatatagaaatacaattaggaaataactgaaattcggaattaaaaataaggaatattagaagtagagtatagagtccatatagaaatacaattagaaaataatagaaatttggaattaaaaataaggaatattaaaagtagagtatagagtctatatagaaatacaattaagaaaaaaatagaaattcggaattaaaaaaataagaaatattagaagtagagtatagagttcatataggaatttaaaactaactaaaattcggaataaacataataaaattaaaagtagagtttagagtctgtataaaaatacaatttacaaatgactaaaattcgaaattaagaaaaacatgggaagaagagtttaaagtcaatatagtaatacaatttagaagtatctgaaattttaaattaaaaattaaagaatattgaaagatgagtttatatagaaatacaatttagaaatagctgaaaatcggaatttaaaaattaggaatattaggagagtagattagagtccatatagaaatacaatttagaaatagtagaaattcggaatttaaaaataaggaatattagaagagcatattagagtctatatagaaatacaattaggaaataactgaaatttagaattaaaaataaggaatattggaagtaaagtatagagtccatatagaaaaacaattaggaaataatagaaattcggaattaaaaataagaaatattagaagtatagtatagagtccatatagaaatacaattaagaaaaaaatagaaatttagaattaaaaaataaggaatattagaagtagtgtatagagtccatactaaaattcagaataaacatactaaaattaaaggtagtgtttagagtcagtataaaaatacaattcacaaataactaaaattcgaaaataagaaaaacatgggaagaagagtttaaagtcaatatatgaatacaatttaaaagtaactgaaatttgaaattaaaaattaaagaatattgaaagatgagtttagagtccacatagaaatacaattagaaataataaaaattcagaattaaaaaaaaaattaaaagacggatctagagtccatataggagtatatataatttagaaataattaaaatctgatattaaaaataattaataactaacacgtatataaaatacaatatgaatattatacattagtagtttcgtaaatttattacaaaatttaaaattatgctatcattatttgaataatacaatgagaaaacacatatgctattatatgagagaaaatataataatactagccgcgcaatctgcgcgggtcaccatgctttatatataattatccaaataatatgtggagcggtgggcctaataacaaaagaatataaatatttaccatgaatatgtttcccttggggggaagtatcaggtgcaatagcacaatttagtgtaatcgtgcaacttccatctttcaccgttggatctagcagactagcatgaacgtgcaagatcaatcccctcctccctcaccgtgcattttgcagaaaaccgcccaccaccaaagaaagttttgcattttagtccctctggcaatctggcttcctcaccctctctccttaccatcttcatccgagttgggaatttgtgagcgaaaaaataactcagtgtcaaatttgagaataaaaaaattactgcaattaatgaattcgagtaaagaaattacattgagcacaaaaaaatgaaaggtaaaaagaaatgtgcacgatgggatatctattcacagccggcgaggggaggttggcggcaccgagcagatctgacgcccatgacgagtgcgagcatggccccgtcgtccccgatcggcaggagcgaggagagagggaggacgacgccggcagttgcgaggagaaagagggggaagaaaggggaccggtcgagattcacgcgcgctgctcgtcgtcgaccccggaccggctgctccctcccgttgtcgtcgcctccttcgctgtgtctgctcgcgctcctgcccgtcgttgtgctgccgcatccctccgcctctatccccgacctcgccgcatcgggacatacgccgcagccgcccctttgccgtcgccacttttcctttttttttctttttttgctgtataattttttttactctttaattcatggataaatattggttgtaatttttttactgataggatacaacatttgtaatatttttaccttcaaaatccacaaagagtgatttttttactcttggttttaagcatgagtaaaattttcactcccaactttaaacgtgagtaaatttttttactttgattatagatatgagtaaatctttggttttaagcatgagtaaaattttcactcccgactttaagcgtgattatttttttactcccgtttataggtgtgtaaatcttttactcggtgaggtgaggaaagtggaacgatataaagagaaaggaagatgagttcaaggaccaaaataaaaaaaatataacgagagataggtgttttttctttttttgcaaaatgtgcgatagggatgagattgtacacaaaggaggttgcatgattacactgaattgtgctattgcacttgatacttctccatttcccttgtggaccctgttgggccaacataaattcacctatgtctgtccaagtgtctacgtggtttccagtttccaccatccagctatggtcgccactagtcaagagaagggctaaggtagtaagtgcaaatgaaataaaatggataacgttcttatttatagggataaatttgtatgttataaatctcataaataacttagaagaagtcatctaaaaagtacaatagggaaaaagagtttttaataaatcgtattttaaaatacattgagcaagtaatccatgataataaactaatgaccctcatgtgagcgctcagggcgactgtggataccttaagatcataaaattattatcttttatccgagcaagtgaagttgccatacaaaacaaaaataaatttgacacaaatctaaaacgaaaatgaatgtgacacggatactattatagcaatgtgatgtctatagggaccagtggtagtgacttgccactcctaccatcatcaatttcacgatgagatggatgaaataggatagatgttattagtacggccgggtttacttctcaactttttcttttaacttttaacttttccatcacatcaaaactttcctacacacataaatttttaacttttttcttcaaactttcaattttagtcaaacttccaattttagcgtggaactaaacatattattacttacatttatatttaggacatgtttagatcccctagcaaaatttttcatcctgtcacatcgaatgtttggacacatgcatgaagtattaaatataaacgaaaaaaatatctaattacacagattgcatgtaaattgcgagaagaatcttttaagcctaattgccccatgatttaacaatgtggtgctacagtaaacatttgctaatgacggattaattaggcttcataaatttatctcgcagtttacatgtgaaatctgtaatttattttgttattagtctacgtttagtactttaaatgtgtgtctgtatatccgatgtaacacgccaaaactttttacccctgatctaaacacaaccaattgcatttgagtgacatcgcgacggaactacggaagagctgaggtccatgctgaggcatttggaggtgaattggatattgtatatgggaacgtatcgtatacacataaattcttcatgtgtacatggactttcaatagtattgtattcacgtgtagaaattagaaaaaaaaatgtacatggacttttcaaattcatcatgcataaaagagtgaaaagaaaagataaagatctgatagacttgtagtttaaaattttcagaacttttttttcacggctaaaatataatgaatttgggttaagattttacatgtagttataatatacctttttctatatttttgtgacattttttaattattgtgcatgcaaaacttgtgtgcatagaatatggtctcatcttaccctacgtcctaccgacccctagcttctatgctcctattatttggcatatatctaaggtctgtttagatcccacctcaaaatttttcaccctgtcacatcgaacatttaaacacctacatgaaatattaaatatatgttaaaaaaataactaattatatagatagcgactaatttgtgagacaaatcttttaagcctaattgcttcatgatttgataatgtggtgctacagtaaatatttgctaatgacggactaattaggcttaatgaattcgtctcgcaatttacagacggattatgtaatttgttttgttattaggctatgttaaatacttgaaatgtgtatccgtatatccaatgtgacacggtaaaaaaatttacccctgatctaaatacagactgattatatgttgtgatggataatctgtgagtaaaacgtatttacaccacactatttgaaaattcaataaaaaataaactacgatggaaaaatgtttaaaaccaactccaaagttaaatttctaaaaatacaaattttgacagctgcttataagctgaaagtaaaaaaatcagctccaaaataaaattccaaaatttcaaattcagattcgcacattgattatcattccccttgggttcgttctagcgtgtcttggctggcgaccgttacagtcagccagtcaccgaccgaccgcgacgacgcctcctcctcctcctcgtgtcgtgtcgtgtcgtgcggtgcggtccagccaaacttttcttatgcctattatgtgaaaccaaaaaccaaaccaaaccacatttcgccttcgcctctttccctctccgctgcatcgccaccaccacgcaaagccaccgcctccgccgcggccgccaagagcagcagccgcctccgccgccgccaccgccgccgcgcggtcgacgcaagggtaagggtaagggtaagggtagggcagagcggaccgcggcggcgatgctcgcttggaaggagaaggtggcggacaggctcgcccgcctcctcgccgactcccccgcctccccctcctccgccgccgccgccgccgctgccgttgagccgcaggtgagatccgcgtccctccctcccttcccgcgcgggcacgctgtgccggatccacattttccatttctctttttttttaacctcgcacaagaatttggtggcggttggtgtggggtcgcctcgcattcgcatccaacccggtggttctggaaggcagagaagcgggatcctcggagggtgacccatgtcgaatcggaatcgaagaattgtttctcttcctttgtagaacgtgtaattcttcgatgtagaaaattgcattgcggcgtagatatgtatgtgttcctcgtgttcatttggatctgggggctgatttgaaaggcgccgccatgtaggggaggtgagtcacacgaggagagttctttgaggaacgctggcctcgtttgctcattgcctgtcccttctctgtgatcaatttgatatattagtatgtatatagttactttgtcgctgtgaaagctcaggtgcagattggtgcttaataagttgatgttgtgttgtctaatgattttgtcttctcccaaggcattgatgttctttctacatgtgaattttctcacatttgatagttgagagttgacgctttagccaggagagactattcttcggttttcaggataaaaaggttgtgttttggcaacaaacctgagtgccggtaactgcctaacccattaacgatggaggcaatgttgcaacgtatataggtgtacagaaaaaaaatactaagtttgagctgactcaatactgatgtagtgcctatttgtgatgcacagtcttagtctttgaaacattaatgacttgtttagttcatagaaagaaacattttaaatattttcatggcttgtgtcagcttaagcagcagtacctcataatttttacaagtttaagctgtggtacgtcataactttttgttactatagttttactagttcaaagatgttgctttcttgcatatatcatgttttgtttgtttgctgtacttctgtattaatacttaatagcaatgtgtttattcaggcaacgccttttccagtggagcattttacttcccctaagaaaggatcattatcttcttacgtgatgtcccttctaccaacctcaaatccgggacatgaaaggacttcaccgagttcacagcatatgaaaccactgcctcctgaatcgcttcctaaacgatggagggggaatgatttcttgtggcatgatccgcccctggcattaagtgaggaatctggatctgaaagtgagagagacgaaaggaatggaaattctaataacgagcagatcctgcagtcacacaggcccatcgataactcaaatggaaatgaagaaacatcaacatcagactgcacagactctctttattatttaactgaaaagtctacatttatatctccaaaattgtttggattctttcaatcttctctccctgggaccttaaagggttgtcactgggttttgctatataggtaagcagtaaatcaacatgccatggttgaaatttttatttaatcatgccttgtgtagtattaccttttgatttcttcattctttgttgttttggcaaatgaagtgcagcacttggaagcatggaacatcgctaagaacacttttccgtaggagtgaaaatctccagggtccatgcctattggtatgtccaactatgatttatttaccattttgaggtgttatgtgtcattacaattcaacttgtttctagaagctgggtttcaacggacaatatttctcacctttctcatgttagattgtcggagacatgcggggggctgtgtttggtggcttgttaaatggtcctctcaggcctacagagaaaagaaaataccaggtcagccattagatagcttttcgtgctacttatgcttatgaagtcatgctatgagggcatgagccctagttcaccaaggcactagaaactagtcaggtggcaagccagtgcctagggcctaatttgtaattaggcttgcctaggcaggagaatgcccttcagtgcctagtattgccttagcaggctaggttactgccttttagaccatcctttattaggtttttccctagtttgtgtaatgattgtatttatattcctgatgaagcagggaactaatcagacatttgtattcacaacgatttatggtgaacctaggcttttcagaccaaccggtaagcattttattttggtatacctttttggcgtcggagaacaattttttgttttggcacattcttcataaattacacatcttctgccattatagttttgaacttctacagttgtcacatcaaactggttgatgtgacaagaaaatttggttccacttctcttgatgattggtcaggaatattgcaatgcattttcatgaaagtagccagaatgatatggtgatggattgtgattttatggtgaaaattccaaatgatcgcataactttataatttacatgttaatgttgtatgtaatattcaccttttgcattttgcataatgccacttttgttgatccattggtcaggaaaattgcaatgcattttaatgaaagtagccaggatgatatgctgatggatgtaatttgtggtgaaagttataaatgaatgcataaatctataatctaccatgttaatgttctatgtaatattcaagaaatataaaatgaaatttatgtaccgcttgattcattttaatagtagtacaaatgttctgtatcaacatagagaatatactgttaaaattgaagttgtacttgtcggaacaaaaatattcaggtgccaacaggtactactacttatgcttgaatgatgctttggcatttggaggaggtgggagtttcgcgttgtgcctcgatgaagatttgtaagttgctattgtggcatacaatttcctcgatttgcggaaaacaatcatagttagtattatatcttgatttatggagtaggttacatggaaccagtggatcatgtcagacatttgggaactcatgcttggctcatagtccagattttgaactgaagaatgttgaggtaagatgatgtttttttacattcaagtctaaagacttctttggactttaagtcatattatctcacaagttagtagaatgctcaagtactctagtgtgatcatgatgaaaaatgtgcaccatgctgggccacgactagcataatctcgacatttataaattttaacttctgttacttttgggacagtatttgatcatttgtttgctacatggaatatgcacgggaattttttaagtataatattatttttaccataatatttctaatattatcaacaccagatcctttttacaaatagtttgatatctctataaaatgaaagtagctagtagtaggtggtgtttgaatctcctgaagatgaagataaagataaagattaagtgtttcacgcaaaacgaggtggtataacgtgtgattaattgagttttaattattacaaacttgaaaaaggattaatcttatattttagaacaactttcatatagaaagttttcgtacaaaacgtgcagtttagaagtttgaaaagcgtgccgcgagtatccaaaattcaatccaacttttgttggagaaaagaacagggtcaggtggttggtggttgtgagtataccccatcccacaactgacccctcgagttgtgggatcttccaagaatgaggatatgcatttgtccgtatggcttctaggcaatgttcgatcgtgctgaagagactgggattattgatttattgcggcatggaaaacatggcagatcattaattaagaaaaatgttttaaaatttgaaaaatgggtttatttgatttttaaaaaaatctgcacagaaacttttcttaaaaaaaatgttttgcagcttgggaggcgtgcctgcgataatctactaaccagtagctgaatcaaacagggctttttgtggcaacattatttgcggattgatgtttgattgcggattttgtatgttttctcctaaaaatgatgcaactttactagtttgaaaagtatgatatacttctatttgaagtctgttgcaatgcatggttacttggctagtcaggaaagatataaccagtcataaatgatcacagatcaaagataggaagttcatatgcacttctcccaatgacatgttatttgcatctgaaatactactactacttttagattgccttctatgatggagttaatccgcatatgtttccgct

SEQ ID NO: 66853 - DNA, 10155 bp, Oryza sativa
aagtgtcttgtgatcaagaaatagtttggtcaagataacaaaggttctgcccataaactttgttcttcttgccatcaacctgcaattatgcaaacatttttcttattaaaatattaagataactaaatgaaaaggagaagttgcatgatttccattctgcttttcttaaaactttttaaggcattatgccaacagcagagaactggtttcagaaacttgatcaacatagcatgcaagctgccattacaggaagctaaaatggatatcgaactaacctcaaacatagacagggttccacttctgtatatttcatcaccagggggatgtttaagatcacattttttctgtatagtaaagagaatggaattaatcattgattatgacttatgataatttaacatggaatatcagaacgctataaatgaaacatgtgcacaacaaacaagatataaaatgcattcaaagatgatcatagatcaagtgatcaactcaggaacggaatatgctgcacatgcagcgaggttgatctgatttatggtatttgtaatgtcaataagtaccagccatgacttgaggacatttaaggagatttttctgagatgccagaaacataagtagtggggcagaggggttgcattttacttatgaagttcgttgtactaattattaaatggctggcgacacacaacagttgcaatcaattcagagctagggaccactagaatggcaaaacaggcattttttagaacccacaaaattcacagtaaacagtataattactgcagctttatgaggaaattcctgcaatacaaacagggccttttaaaaaaataaagattaagagaacatgtttggcacctaatggtacaatgaacaaaaagttaagatagatgggccgaaaaagcacaggaggagctaaacaagtgcaggcagatttgagctcatactcccaaatttgcattagcagagcctggctgaaaagatagtaaccctccatatgggaacaaataactaaatctcaccatgtgcctctgaagctgttccttgcgcttcatgaagttgaggcaaaactcacagaagaacagctttggagagtcattatactccggtgggaaaggagagaaataccatgtatctatctcatatctcccaagttctatcttcgctatatttttcacctttgtgaactcttcatgttcccgcaaactagcagcatcaagctcctcatgaccttgctataatggaaatggacacaaagctagattagtttcaggatactaattcaaaagggaaaccacaattacagtacaacgtgaagaaggaaccaacatgtgtttcatcaatttttgtagccattgcatagcaaactaacatccttacagataataaatcttcaagaacaaatgataatcaaattatccacagtgatacaatctattccatacctccacatgggtttcatcaattttacgcttctggtgccgtgtcatcttcaagcttgttgcctgagtacatattaaaatggagttgtatgagtattcttttgaaataacagagggctatttatgtcttaggatgatcatctcaggttttcaaccgtcacctggacagtatagcggccaatataaggaaaaagcaaattctactggtatgattgacaattgaacaacatgaatttatgttaccttatcttctaccttctcatcaacatcggtctcaacagtctcaagatcaagttgttcaagtttaacccactcatcgagcctcctattgactgcaagttcattacatttaaatacgattggtaagcataaatatgtcaacatgacagaactccacaaacccacaacagaatacgctgcagctgttatgaagcactaactcctatttcagctaacgaaatcgggtaaaagtttgtgattgtactgaaactattgagacacgagactagaacggccatttccggccccagcgaaaagcaatcctatattcccatatacaaattcatcactatatcacctcgaatttcataacccctaaactaattgaccatttaagccccagattccctcaatctgaagcaccctaaacctaaccctagaaacgaagcatcctgttgggggcgaggtcgcttacactcggtgtagtggacgtagtactcgtaatcggcgggggaggaggaggtggaggacttccggcgctcgatgaccttgacgggatggagcttctggtcgcgccaccggcacatcacgcgcgtgcccacctccagcggcagatgcgacgcccacgacgcggacgcggcggaggacctcagcctcctctctaccccgccgccgttcgaggcggcggcggcgccgccgccgccgcccgcgccgttgcacgccgtcgaggccgcggccgccgcggcggcggcggtgccgttctccggcgcggtggacgcctccatcgagcccatctcgtcgtcggagttggatcggaagttgtgcggttttggggctgggcctcttgccccggatttgggctttgggttagatctttatcatctccgtcgtgtggtccggttgggacgcatggtttattccgtggggcccacatgtaagtgacagaatgataccgtctcggttgtatttggtctgtttgatcctccccaaatttgaattgggtcaacggatttgaaggcccagctctgttttaactttaaactaatttagttttattgccgaattttttttaaaaaaatactccctctattttattttataagttgctttaattttttactagtcaaattttttttgagtttgatcaaatttatcaaaaaatttagcaacatctaaaccaccaaattagttccattaaattagtttataattttatagtttttaaaaagttctatcaaaacatagaatgaaacggcctacttttccaatttggtgtttgggctaacacactgacttaccaatttgtgaagcagatcaataactattttcaaatccaaacgatgttctcattcctaatgatgttctatttcttcattgggatttacaatttgaaaagagtaaagaaatttacaaaaattttaacgatgtaccttgttggatcgaaaccatttaggaataagttcactttgggtctctctatttgtcgtccagtctgattttcgtccctcgatcgcaaaaccgggtacaacaggtcctctaacttacgaaaccgtttaaataagttccctcagcagtatttgaccccggttttagctgaggtggcgcctacgtggctaatttgactcggttttcatctgacgtggcattgacgtggcacttacgtggcaattcgatccgaaaaataaaaaccctatgggacccacatgtcagtttcacacacataattaaaaaaaatggtgggccccacgtggaccccacctgtcatcctcgctaccccttctctcatcccctctctctatcctctctctccatcttctctctatctctctctctcccgtgagaatggcgggcgcgccataggggcggcggcgaggcggcggttggagcactgtcgccggagccggggataccgccgccgcaacttccgcgtcggccaccacgttgctcccatccacctcgcggagatggagcatgcgccgctccttgaccccgtcgagctgctccggggaacgcctagcggtcgctcccccacgtcttcagcgacgggaacgacgggaggagcgtggcctggtggcgagcgctcgacgccgctgcctccaccgcggcggcgccatccgcgacgggatccggggtcgaggcgggggcggctcggcggagatcaccatggccgcgggaaaagccgcgatgatgaacacgcgcgtggaggccgccgtcacctagacctccaccgactccgactccggtggcggcggcggcgggagagtcggccgagcgatgagggtcagcgcgcggcggccggccgaggagggccggccatgcgtgctctaatcacaatttttttgatggttaatttgctagtatttatcagtcgcctgattgatttttaatgtgctgtgtttaatttgatggttaatttgctagtatcgaggctgcgtgccccggcgtcatctcctgcgcggacattgtcgcgttcactggccacgacgcatcgaggtacatgagcaacggcggcgtcaaattcaatgtcccggtcggccgcctcgacggcattgtctcgtcctccgaggtcgcccaaaatatgctccctgactccaaggccgacttggacaagctcacagcgccaacttcgcggcgaagggattcaccccggaggagctggtgatcctctctggcgcgtactccataggcaaggcgcactgcttctccttcaacgaccgcctcaccgagccgaactccgagatcaatgccaactaccacgacaacgtcctgaacaagacctgctacgccgccccgaacgagacgacgttggcgaacaacatccgcgacatcgacgtggcgacgctggggccccggcgccagcgctccacccgccgctccacccgcggcctgctgcctcacagctccgtcgccgcccctctgcgccgcccgccgctgctcgccattctcaggggagatagagagaggggatagagaggagagagagaaggggtaatgaggatgacaggtggggtccacgtgggccccaccattttattattattgtgtgtgaaactgacatgtggatcccatagattttattatttttcggatcgaattgccacataagcgtcacgtcaacgctacgttagatgaagaccaagtcaaactagccacgtaggcgccacctcagccaaaaccggggtcaaatactgccgaggtaccttatttaaacggtttcgtaagttgagggacatgtcttacctggttttgcgatcaatgggcgaaaatcagactggcgacaaatacaggaacccaaagtgaacttattccaaccatttacaaatggaaggcctaaaataaacaaggcccatatggcccactcagctcaaatcaggctaaggataatcccctgtccttagccagagcttcggccgctctcctcccggacaccagcgcgccgtcgaacgtcgcgtagcaccagtggtcgccgcacatgtacagcccgtcgccgaccctcgggtcgcgccccgccggcgaagtcggcggcgtctggtccggctgcgcgaagccgatgcggtacgtcctcaggtgcgtccacgacgcgacctccccggcgccgaaccacccggcgagctcggtgaccacctcgccggcgaggtcggcgtcggaccgcccggcgaaggagccgacgagggatacggacaccagcgacctccccggcggcgcgtacgacggcgccacgttggtggcgaagaacatgttgttgacgatccctttgcctgagccgttgaggagcaggatggggtcttggaccgccgccttgtcggcggcgaagtagaggcagacggtgctccgctcggagttcttcttgggtttcgccggaatcgttggtagctgcggtaggagcttctcggcctccggctgctcgacggcgacgatgacgccgagctcgccggagacggtctcgccggtgtcgagcgtcacgctggactggccgatggccgcggcgcgggagttgaggcggacggagcccgccggcaggcggtccgcgagctgcgacgcgatggcgccgatgccggcctccggcagcgcgttgtccccgagggcgaggcgcttgaacacgagctcgaagaggcgcgacgacgtgtcgagcgccgggtcgaagaatatcccagccaggaacggccgcaggaaccgctccacgatggacggcgagaacccgagcttctccaggtgcgccgccgtggtcgtctccggcgacgagaggatgacgtcgtccggggtggacgccgcgcggagccgggcgaggccgacgaggagcttatcagcgagcgttccgacgggggagaacacggcggagagggaacgcagaggaagccggaacgggtcagacaacaggtagaacggctcgccggcgccgaggaagacgagcgctccaggataaaacggccggagccgcaacgccgggaagtcaaggagacgccggcactccgggtaggcggtgaggaagatctggaaccccctatccaaccgatacccatcgacctcgtcggtggcgacacggccgccgaggcggtccgacgcctcgagcagcgtgaacggcaccgacatggacgccaggtggttcgccgcggcgaggcccgctagcccgccaccgacaatgacggccttattaccaccgccgccgccgccggtggcgtcgctccccggcgcggcggcgcgggtgacggtgaggcggagggcggcggcatggtggcggcggagcttgggtggcgtggcggggaggacggggcgcgcggcgtggacgtgcatgggcgtcgcggcgggcgacagcgagtggcgggaagcgcgcgcgcgcgagggagggagaagacgagtttggggtttgggtggtgttcctgatttgtccatggaccggctgtggatatggtggtttcggtgcatggacccggcgtttggatggggagctatgggttgacgagactgcgtggtggggttgggtgtaggtgttctgtgtggacgtccgtagactgggttcagggaagattcgtcatggagcaaagcgttatcctctctctctgaactctgatttatgagatgaagaacagaagaggaacgctctgatagaataatggttcaatcctggaatgctattttctcgaaccctcttttacctcaacatttgtaatggtttgcctccggcaatgcccgctccctgtaaccccaagatctttctcttaaatgcaatggaagattcaagtggggaacatatcctctccggtgattattaaaaaaaagaagaagaagataaacagggtaaggctagtttttctcatccgaacacatagtatatagacaattacgtacccacgcacatttgtatgggcgcatgtacacatgtagctagccaaaatttaagattgatgaaattaccccaaatccctaaatgtcgcgtcgctaataagtgtcgcctaccactaaaatcatgattagctatggatataaacatctgttgtcgactgatatctaggtgggtagatgttaataagtgtcgccttccactaaaatcatgattagctatgaatataaacatctgttgttgacttatatctaggtgggtagattctactgcaggtaacctaaactggctatcttaggctcacagtttgtttaggttggttccagtggtaccgaaattaaacttgtgaatctcagacaaaatttgttaaaaacaatagatttttgtaaacttggttgttccacgtgatcaataccatttgccacgtaagcaatacttttgccacatcatcattcacgtaagaaaatcattttggtcatttgtagcatttcttatactttaggtttgtgtttggtttggagatgagatgagatgggttaggtttatttgtattttggggatatgatggacctagtttctatttggttctaggaatagaacggacctagttttctgtttggtttgagggatatgatgagttggaatgatcctatctcttgtgttggttggagggatgtagatggattgcttagatatagttacctcttcacattagttggtgaggtcatacacaacacaaaatattgaacatgaagaccacatcatttgaaaaaaaaaatacattcatatgactatatttggaaataaaatacaatcatatcatatagccaaccaaaaaccaaagcaaaataccgataattagcatacatcaatccttatatcaatgtaagcataggaagttcaagccacacataataaggagttccttactttggctatagaggatgatggaggatgcgaggagcagtagcagacgagagagaggatggcactaggacgctgtagtaggttcccgcaatcggtttttgcttctcgccaccaccaccaccgtcttcccttcctgccgtcgccgccaactatgagatgaggagggggagtggcgagagagagatgggaggaaggaggacagagaagggaggatggcacgggcgccactggccccatcgcatgacaccggcgttgccggctgttgcgcgcgatggcgccgccatcaccctctttttttctctcaatctagatggtgatacggtgaagggggagaaaaaagagatagggttaccctatcccacacatgtgtaacacatgtgatgcgcgactccggaggtgagatggagtgatccgctactttttttcaagggccaaacgaccccgaatgtagggagaatattcctttttgacccaactcaactcatgaagtccttcaactaaacaccagtaaatataggatggtcccagtccaactcaccaaaaccttgcagctaaacacatgctaagagtgtaattaattcagggctaaactatgtcattcatgcatagggttataatatgaaaacttcaaacctaatagagggttctaatataatttaatgtcttgttctaataaatccttataaataaatacgtgacggaaggaaagtaaattggacttatgttagcaattaacaacggcagtcacacactcgcacacactttgaattgacgaagatgaataataagttggcgcacgtaaaacgagaaagctactagcacataattaattaaatttaattattacgacttaacaatttgatatatttgatattttaaaataacttctagtctctccggtttcaaaattattgacatttcgaacatgatctcacataccaagcagtgatttattaagatatcaatttactattttacccatattaaatatagtattgtgctctattatcttatatatatatatatatatatatatatatatatatattcttgtgctaatggtaatcactaccgttggtttgaaccaatcacctgcatcggtgcgaggtaaagatccaattccctagcttttttacttggtttttatttgcatgcatgcagggcaaagcagtccaatataacatactaatacaaaaggcgtcaacaattatcaatcactgtttagcccgaaatttttgggctgatacgacttatcgttttagataatagtgagatcaaaatttagaatatttaattataaattatttttaaaatatttgtctttcaaatatgatgactatatgtatagattagtcttaaaaagtactttaataaaatcaaatatttattaacactttatacatattataatgaaaaataacggttaaagttattttttagagatcgtggtcttattcaaaacaataagtattattaatctgaaaagataccagactaattttttgattgaaggaagtatataaaaagttttagcacgaaattcacatctagtaatttgaaaaatgtgggcacaggaaaagaacaggacatccgcagcacacgaacccgcccgccgcggcgcgcacgcgtgtcggtctttccgcgcgccacacgcgcgttgctctgctattacacggttacaccccgccgaacgtcgcggtctctcctctaatcatggacaagcgaaacgttaagcaacaacacgcatcacggattaacgggccctaaaacaaaaatcaaacgaaacaagagggctcatcatcaaaactaaaaggaagaaaataaaaggtgaagaggaaatttcttgaaaaggttttcgttgcacgacgatcatcagtaaagtaatagagtatctcgtccgtttatggtgatggacgagaatatcgtacaggttggctacgtgcctactacgtcgcgtagacgtctccagagcatctttcctttctttcatcctccagaatatgattctgctcaaaactttctacgatcatttcgttttgaagcatccaacaccactgttttttttatatatattttgcatttttgtactcgtggctattcatatccatgagcacaaggcttgttttttatattctttttcttatcttccttttgatcggttggtattggtaatgattgtacatcatttttgcggttttacatggagacccatctatctgttctgatttg

SEQ ID NO: 66854 - DNA, 2580 bp, Oryza sativa
atgccagaaactatgtcatatcttagaacaattagatattagaattaaattaaattcatattacagagagcagaaattggtactagaattgttatgttgttagcattattatgttactctatattacagattgtttctgcattttctcagcactcaagtggaaaataagttggaaattcatgcatcgttttgtaattttaataaatttctaaactaataaataacccatggagatctttctcatacattgtagtgctgtcgaaactcaagtatggttgaattggtaccatgattaatcgtagcttcatgcactttcttttattttggcaatggtctctttgcgtactcttctattcatgcaatgacatgagcattgaattctgaaactgaactggcattattttgaagaaataaaaaaaaacccaatcatgttatcttattaggcaacaagatcagtgatcatgctcaagttgataaggaaccatattattaaatgtttaattttgattattttcctggtactgaagtactgtctaatttgacctctttgaagtacttgacatttgaattttttctaactttgccatgaagattttgtaaggttgctttttattatacctgtacagttagatgcagtatttaaccaatctaagtaggcgtttttgtgtattcttttaatatataatttttttcttttcaaaaatgcggaagaaacacaaattggaattgcaaaatttaacgctgacaaagcatccattcaaggcattccttttttttttagagaatctcttatatgccactagaaattggctagttctcttatatgccactcaaaattggcttctcccttatacaccactagttcaagtttttccacccttttattctactcccagcactatagcatttgttgatggttagtcaaatgttagttttttcataaatgaccaatatgccctctcaactaaaaaaaatgtgtaaacttcaaaaaaatcataactaatttattttaaatcctttttgagtgaacaaagttttgtcagaaccggtggaaaatgctctttgtattaaaaatatgggtaatttggaaccatgccattataattttgcaaagtttgagatatgtcatcggtatctcaatgacatgtaggacccacatgagtcaatgacatgtgggtcaggatggcatatctcaaattttacaaaattataatggcatggtttcaattttccctaaaagtattgttggaaagctgcatgtttcatacttatattgaaagtttatttgtgatggtgatgtctaaaattgcatgtgattgaaaaaaaatcaattttcatatgttgtatccagtagatatattagtacgaaaatacctatcattggttgtataccaactctcaatggtaaatgcgtctttttactatgaagttaacgatcaattgacggtggagtgacagcaatggcataaaagggaggacaaacttgaaccggtggcatagaaaggaggagccaatttgaaagggcatataagggaaccggttaatttggagtggcatataagggattctctctctttttttcatgttagcaatggtgtaattaatactcacctgccaaatacataaattccatgccaatggttctactgagtcctttttcttgctcttgttcaagaacaatttatgttcctcttctgatcttaagtcccaacgtctattaatttatttctttaggtttctggttcaatgttttaagaaaaaggaaaaagtacgaaatacccccccgaactatagcggtcgtctgaaatacgcccctaaaaacgaaaaccggatataattcaccctcaactatcaaaaccggttacttaaccccctaaggcagaattatgggcggttttgaccggtcttcgtacacgtggcagtacagtgtggcaaggggacggcacgtcagcacggggtcactatataacagcggagcgttctctctctctctctctttctctctctctctcgcaaaatttcccctttctccccgaaaccctagaatgggcggcgattccggtgactccggcgaggctggctgcggcggggctgggcggcgctctaggcgggcgggggtggcgcgctccaaggtggccacggcgacgaggccggcgagctccactgcgaccacggtggcgcattgcaaggcggctgggatcaactaggctggaagaaaccgggcatttgaggtatgtgatttagctcgatttgaagtgtggattttttggtgaagtagttgtagtgtgggatggattgatatttttttgagcagttcttgctagatattagtcagatgcgttgggattgttattatagtgcagaaaggtggagtaagtgggaatatgggggaggttgattttcgtgttgggattgtaggtgcatgcatagggattgattttgttcattttatagtaaaggtggaagtatggtggttgttttttaactgtcatcttaggggacatatgcattgggattgattttttagtcttaactttttttaggacaattttaccatcactgcaatggatcctctagagt

SEQ ID NO: 66855 - DNA, 503 bp, Oryza sativa
tctcagaaatcctatgcgcattgcgcgccttggtgaatggctccgaacagcaagaacacagctgcctggatttcgatctccttgtgtcaaccacatcattcgttgctacagtgcatcttttgcagagatcatcacattgtgcaagattgttgtggctactgcagtatgccagagatgatatctccgacctatgcgcggcgcagaccaaatccgaagagaaccatggcttcccatgaagggcatgatccatccttgtgcacaggatgcatggcatcttgagcttgtggatgcgcgccaacctcgtcgccaggtaggatgctcctgcggccacatggagcaggatgatcaagcaaagctcgctgcaagcataagacagcatggaccagaatctcctccagaagtcctgggatctcgcatggtttttcgcagccatggatgatcaatgtgcatcaaaaaaatcacatgaaaggttcctcaatgcagcttcaaggcaaccaaaatca

SEQ ID NO: 66856 - DNA, 568 bp, Oryza sativa
gtggttgcatttttaccaatttttttgcggtgaaaacggtcgatcgccatgggaatttggccctcacgaaggtcatatcactggccgactttgggtcatggaccgtgatggaccaacacttttaggctgggcaattatccaaatacctaatttaaagttttttttctcctctaagatggtggttttcttaactatttgtcacttttatctatgtggcatgccaacatgacaagcaaggatagaaaataatgtgggacccagtagttagcctcacatccctttcatttcccctccagcccatagatggagacggtgagcaccttggcgccggggttgtggtcctggcgtatcacgttttcacggtgtctccaagctaataacacttttttgagtgtcatgtagcaaattttaccaattcacttagacgcatgttatttacacgtgtgtttagttccttgagtgtaaagtttttcaagtatatacacgcacatttgaagtattaaacgtacactaataataaatcaaattacagattccgcctgtaacctgcgagacgcatttataaagc

SEQ ID NO: 66857 - DNA, 2606 bp, Oryza sativa
gagcaacagtctcccacatgcgtgcactgtcagtctcaatgctcatcgttgggtcggagatgtcaaccagggtgatgctcatgttgttgcggacgatgcaaagcttcccatttaatgtaaccaacgctgcagcttcaaaggcgcgcgagctgcccaggtggtgcttgctgtccatgaattttgcccatgttcctgtgtttggatcatacaccctaagcttgcagccatctcgacaatcagatgaatagagctttccgttgaaggtaatgcttgggttccgccagccggtaaccatttcatcatcaatggttgaccataaattggatgatggtaggtagacttcactcgtcacttggcgatgggaatcaagccctttcaggaaccacttgccatcatatacaactccaatgaaaggtaccatcccattgttcatttcagcaacgcaggcccatctgttcctatttggatcataaacttcagcagacgggagtgtcctttgtattccttcacactccccaccagcaacatacaagcaattgtttatgacacaagaaccaaaaaagtgtcgtttccgtaacatatctggagctcggtgccatttgtttgtccgagcattgtaaaatacaacacgcctcatagagcccctcagaggatccttaccgccaaataagtacagatagcaaccactcagaacagcacagccaaagcctaatgcttctgaatattctgctggaactggtggaagtgacttccatagctggtgcagtgggtcaaaggcatgccaggatatctttccttcacggtcccttttaaagacataaacccattcttccgccatcccgtttctcttgcgcaaggaataatagtaattcccagataagagacggttccatcttttgcaaactatccgaagattgggatgttccactcgaggaacccgtatgagacaagcaatagcaaggtcatcaggaagaccaggcaaaagtggtgcttgagttcggctcctctccttacgagagccccttgatttgcacttgttgggtttgacatcaggttgcatacacatctttgctccaggaacaaactttctagcatcaacaacagttttcagaccagtatctaatctgcagtagcatgagacagactctacctgagaaatgcaaccatacaacatataaattagcaatcaatgtactagaaggggaaaaactgcaacgcatgaaaaccacagctcatattcactcagaatgtgcctacttgtccaccaacacatgcaacatataattttatccaccacaaaaatatcatgcagatcaaatttgctctgaaacagcaacaattttcaaatccaccacaaccctattttattatgcgagatatgacatggagaaaaatagacactaccactctaatagtccaggttacactaggttatcagatagatcaaaatatatggatacatggccctgagtaaaattaatcactaaaaaactctggagagattgtcgaacttgttttacaaagatcaacactgcaacatgatgttgttgatttataaccattttttttattttcaaaagctaatttctgtttaaatacccaaacagaagctaatgtggattagcgacatcataagatttaactgttagcacatatgggtaaaaaaaggttgcaggatagcctccataatttacaggcatgtagcagacaaaatcaacaaagcaagactatgagtggtagttgcacatcaaaagctgagatttttcttaactgcgaagtttaagattaaaaccatggtacagactaagcttaagaaaatcacaagtcaggacaaaccagctcatgacaaacaaagcattacacaaaagaaaaaattaagcacaataagcatgttaagtttgtcaagaaatggtaatggaaatgcgaagctgggttcatgatgtcagtgcccagaaaccagttgaaagctaaagatactaactaatctacctacctaagttagcagatatctgtgtgaacacttgaaacggtatggacgagcttagtgtaacagttaaagacctgaccagaacaattgcaactttccaacccaaattatcaattggccaaattcaaggccaaaatggacgcccaagctatacaactacattatggttagaaacaacaaaattctccagactcacagatactcgccgatcatttgttcatctcattacttgagcagaatacattcccaaaaaaaaatgaagaaacttaactaatcgattgcacacatacagggagcttttagagcatagcagaagcccatctgctcatgcaaactttccatatgcataaccagggataccgaaatgcggttgcgaggaacatatatgatgtccggcagaatcttatcctaacatgttgtaccagccacagattagtgctctaagatcactaccaccaccaccacaagtacctaaccccgagtagcacctgataccgcgatgaaattccacaccagcaaatctactacttgcctatgatttccgactcattttcaccgatttcccccacattccaacaacacggtaacccttccaagaaggcacacccccccccccccc

SEQ ID NO: 66858 - DNA, 511 bp, Oryza sativa
cagatgtccgtgtacgtcctctccgctatcaaacatattctcgttcttgcaatctgcacatggacaacacatgtaatcactgtttcttcttatccgatcctcctccgcggcattcataaaatttattacgccctttcggtacttcgtagaatgacgtttcaaatttttggcatacatccaacttcgatcaattgctacaaaaaaaaaacaaattagaggcacatattataagatcagtattgcaaaagtaagacatgatgaaattgctcaattaatgatttatattactcacttgattgatccattttgatcacttttgggaatttaatttctgttttccttggaaaaaggacaaaaaatcggcccctacagcctcccaccaaaatagtgaacagtgggatacagttacactaggtggtggggggtatttatactgcgcaacaaaaatctgtaacgggccttaaacaatcaaccgtgacgagcatacaaagaaatctctatcgggccttaa

SEQ ID NO: 66859 - DNA, 9405 bp, Oryza sativa
cagcagtccatcacttgtgataacaacctttaaatgctccggttttatggcccttattgcaattgcaagaaacacggtgagcaagacatgacagtcgtgtgaattataaccagataccgagaaatctttcatggaaactagtcgactgttgtttgatgagaaacctatgggcactctgacatcacggagtgacttgcaaaatgacttcttctcctcagatgtcagtgtgaaacaggctggtggaagatatactttgccattcttctctccttcttgagggtgtaactcttcctgattcccatctcgactaggtgatggggctagagaattaatggtttgaatcaccgagtttttttttttttgagaagatgcatctcacactcaattaatcttgattgtaattcttacagccacaattgaagtaatactccgtacaatcttgagcaactgaaagccaggtagaaaaactactcaaagacattcctgcctgagctaatctatgagcaattttattcactgatctcctaacccgaacgacactaaagctattgaaaggactcagcttcaatttcagatcttgtaccagatccataaatcgatctactaacttccttctgagcaaccatcctcgttacttccaaagaaccagtctcaataattagtttagatactcccaactaatgcaagatcagccatcctgctacaagctagtaattccaaggtggtagcgtcctgaatacttgggatgatactgtgctactgccgccataaaacctccactgtcatttcgcatgaccacctccactgctctaaacttgtgtgccatcacaaaagcccaatcagtatttgccttcacccagctgatcggtggtcttcgccaagtttgtgctgaattgtgaacagggccattgttcctggatggcaagttccatggccaaaccattctggatcaatctccagcaatgtaccttcattttatttggaacacttcattttattctggagtctcttgttacggtgagtctggtgaaggcttgtcgggacggctcgatgtgagcggcaaaaaaggatcaactcaagtcttggtacacgaaggttcgagcaagtaacagattcggattggcgtggcatattcgccaaggtggagtttgttagagtttgtgtcgaatatatgtacgtagtcggttacagtttaggacttggagttgtactaggtgtaggactagagtatgagtcggactctatcctaggatctcttataaatagaggtgcgtgtctgttgtaaccgcatggcgacataccatagcgagagtgagcggctgccggcggcgaccggccgtatgtcgttgtaactctgatacgctgtatatgctggatcggggaggagcacccgtaatcagtgccctggagatgtaggcctcggctgaactccgttatcaaatatcgtgcctcggtgtcgtcatcatatttggatctcctatggcgttttcttccgcgtttagctaccgatgtcgatttcggggctggtttttataacaagtggtatcagagcctgcgggagatccaagatagaggtacgaaagaggtgctccacaccgcgacgactacacaggatatccacggacggacatggacgcaaggtggagcacggtggcgatcaacggaatttgatcaatggaatcggacacttcagacagcggtctgaactgttcgatggctgtaatcaacaaggagatgaccagacgtggtgctcgggttgatggcggccgaagcgattggcgatccaattggtgggtcggacacttcgagcgggtggctcggactttctggtgagctactctcaacagggagacgtggggccccacgctcgggttgattgaagctggaggtgatcggcgttctcagtcggtgggtcgaacactctgggcggggtggcccgggcctttcgatgagctgcgttcaacagggagatggctagacatagcactcgggtcgtttggcggctaggaagacggcatgtgatttgtcggcttcggctcacgactagattgatgggtgatcaatcggaagtcggggcgggttgcgggctcgaggtggagcagcaacagtggcgacgaacttcgggcggcaggaacacggcttggtgtagtcgtcgtataggtgccgacgagattcgacgcggaccggctccggtgtttggagggggcaatgacggcaactgctacagaaggaccggcgctcagggagaagcgtgcggtatggctgcggcagcaaagtcgtgaggctcgacacgcacaatagcagggcgcacaacagaccaagctgggtagcagagtctaacagggacttgggtttggcttggttttcttcaacacaagaagcaaggtgcataggaagtatcgtgtagctggctgcatgtacatgggaacttgagccaaaattggagagacggtcaacatgcatagattattggaggaaagcatgcatgttgcatgcatgcaggatcaaatcaagcatgtgttggtgttgcaatccaaaagggagctcaggagtccggataggatgcagggacacggtacgtgtatgcatggataccgaaaaaattagcaggttgagaggaggagtccgtggtagagttgtattcgtaattgaactttggcggctcatgacatctcaacggctggaggctcggtgaagcttgaggttgaagggaggcgcgggtgctatatatgtgtaggaagactggttgatatatataatcagggtaaatcaatttccccggcaacagcgggtgaaaatcgttgagggcgtcaacgggttgtctggcagtacaggatatatccaggatctgcgggaattgcatgatagggatatatgaaatctgcgtcactgaaggagaagagtaaacgctatagtggtaatttcttcagatgattcaaagcaacggtgattttctcaaactattaggaattcagtctacggatgcgggaaagcgtggatgttggatttattagctcggttcataagaggacaaggaagaaaaggttctcttcaagtttggtgagtttgatttatctatttggtgatgacatcggttatctggccatggattagatcaagtcaaatttaaaacggtagatggaggtgaacatggtcttcgggaagtctatgatgtgacagctaggaaggatccaatttcacttggcaagacgactgtggtgatatgagagaaggtggagcactgttgcaggtggagtcaagaggaagaaattacagggatagcgggagtctcttgttacggtgagtctggtgaagacttatcggggcggctcggcgtgagcggtaaaaaaggatcaactcaagtcttggtacacgaaggttcgagcaagtaacatattcggattggcgtggcatattcgccaaggtggagtttgttagagtttgtgtcgaatatgtgtacgtagtcggttacagtttaggatttggagttgtactatgtgtaggactagagtatgagtcggactcaatcctaggatctctcataaatagaggagcgtgcctgttgtaaccgcatggcgacatagcatagcgagagtgagcggctgccggcggcgaccggccgtgagtcgttgtaactctgatacgctgtatatgctggattggggaggagcacccgtaatcagtgccctggagatgtaggcctcggctgaactccgttatcaaatatcgtgcctcggtgtcgtcatcatatttggatctcctatggcgttttcttccgcgtttagctaccgatgtcgatttcggagctggtttttataacagttgattacaggttgacgcctactggcctactgcgattgcgctctgctgcatatgacaggagcatttcaccaaaaacacccaagactttgtgaattgctaggcaacaaaatcttctccatcatgttcaggtaacggtatattaagcacatcggtggtgtcacactcaaacgaaaaaacagaaactctatcattgtcccattgttttgtgcttgatataaatagttttgatactgtctggtcgcccaccggctccttaaaacctagcggtctctaggagcccacccatgggatcaaattatctcttttaattttgattgatttaccatcggtaatatgccataacaggcccttgctcagcagctctctaccaaaaataatgcttctccacatatacaaagccttccttggacatgtagcttccagaaaggagcaatttttaaaatagagagcctttaatactttggaacacagacactctggacatgtcaaaatcctccacccctgcctagcaagcattgcttgattaaaaatcttgaaatcccgaaaccctatgcctccactctttgatttacataatctttgccaagaaatctatttagtcttcttcttccctgctgtcgcccccactagaaattcctgacaatggtggttaataatttggagcacaaaccttttggcaatctctcatggagtaggttggaactgctaataggactgattttttttacacatcttttcctgcattcgataaaccctgccctttaaaacctgaaacttttgtccacatcctctctctgctattcttgaaggcacccaatttgctgatctcatggtggaccatctgatggctcagcaataagaagacccaggtcttctttagatatagcataaacaaaaaaggggcgtctaaggaatttattttgacaaacagtcaatcacagcttgtctatgaagcattcggtgacatggtaatatttgacagtatatgttgtgtgaactggtacaatattccatttgtaccttttgttgaagctaaccatcattgcaacacaattatttttgggtgtggtattttgtcaaatgagacaatttcttcatatgtttggctgtggcaaactcttttggaggcaatgcaccaaaaacatcgaaagtcattgatcactgacggggatgcatcaacggcgaaggcaattatgaaggttatgcccaatactgataatagattgtgtagttggcacattgaggagaatatgaaacgtcaccttcgttggcaaaagcttgcatacttcaagaaattcctttatgataatatagatgctgatgagtttgacagaagttggattgagtataaagacaagtatagattcactgaaaatgacttatgagctgcatgacatacgaattaaggaagaagtagtccgtagcatatatgaaaaggaaacacttccttggaatgcggagcaaccaacaaagcgagtctttaaactcaaggctgcataggcatcttgatcgaaagatgtcgctagtccatttggttgagaactatgaattttgcttatcacgtatccgtaggaatgaagccaagctggatgcgagagcctcacagtctgtcccattcactagtctacaatatgtgctaacccattagagaaaagtgtggtacacatttacacaccgaccatgttcaagaaggtttgggctgagataaggaagctatataagtgggaaattgtcaatgtgacatgacaagatggagctggtgtgtttactgttgcatcaaaaaacaataatgctctacaggttcatgtggtgtgtaattttgaagagcaatcgacgagtagtgccaattgccattaccaaaagatggagtatgacattatcccgtgctcacgtatttttaccagttcttaaatttcttggtttcagtactgttccccgttattgtgttatgatcaggtacacaatggaagggaaagaaacatttgagtcaaatagaagtatcaacactcgtgtgtggtctgagcaaatggattgctacagtggcctgaaaaacataagtagacttgctttatttatagcctctagatcaactgagcatgcataaaaggtaagagagtttttttcggagtattatggatgaagattcagtgaaccctgataaagagtggccgtttggtcctttgccagcgcacttttctacttttcagctagtaactaaccatacaggaagagagtcctttatcctgaagtgattacatctaaaggtgctccctcatagaagatattgaggccaatcagtgattgcagacaggataaatacatggtttatgttttcataataaattttgccacaatagaagatacttggttccttttgagattaccaacgaagttatctgtaaaattatgggataagttttggtaaaaaagaaagaatggttgacgatgatggcttgaggatacgccatagggaaagctgattatgttattaacctcaggcgatccttccaaatttcaggtgaggccaaccgctgtaataaaaataaagataatgttgtttctccgtgagtgctagggtgggatcatgtttggcttggggctgtttggttcccagccacactttaccattacttgccaacaaaagttgccacaccttgcctaaggtgaggtgatcaaattgttagccacaacttactaagcctaagggaatcttgccacacttttttgagccattgacacgtgggacccaatttgttggaggggaatcttgccacaactgtggctacaaccaaacacctgtcaaatttgcctaaccttaggcgtggcaaactgtggcaaagtgtggcttgcaaccaaacacacccaatcccttgttgttggcacttccttcctcagccagacagacctcatgcttgaaaatcaaacactcaaatggggtcttactagtgttcctccctattttatccctggttgttcttatccatcattgaaatgattagccactgctaaaaattgaactcccaatgcctctctctcctattgtattgctatttccagagtggttatttccatgatctcttggccgatcggtttgtttcttctcctagagttttgtgaattgcgttcctttcgtaacatggaattgaagactcctgctatttattgatagtgtagtcgtggagtggcgggtatgctggcattaactgacaatctgtgtgagacaccaactcatatatgaaatgcagtagattagaatttgtttggtgcattacctaaaattctagaaaacataccaaagtcttctccagagtttttttgggtctctaggaaggtgtgtaaatactggattttatctatgccagtgtaaaaatcacctacatttcttggcaatttttttctataacaatcttttcttttaaaaacatcgtcttaccataaatctggttttacatattgtaatctcgcgcatcgcaacaatcttgtggtggcaggtttgcattcctcgtgcctcctcttcctactgaacggctcctacatggagagtgaaaatctgccgattctcattggcctggctcctcttcctactgaacgtacggttcctacatcgagagtgaaaacatatcactgtactaagtttggatgtgtgcattcgttgtgtggatgtagaggccgggttttaatccatcatcttaaaagaaatgtgagaaaaaccagagtttggaggttaagttaaagcttagtacattggactggagttgaatttccatgtgcaaggagatgcacttgctaggagtatattacagtggcgtctggctttgcatgtagacgtagatatccccatggttccatcatgatctctcagcagttcaaaaacattcagttgaagtgtccaagatgacacgcggtgctctttcctattttatgacgagtggaacatgtttaacggtaaatgcagaacaaataatttaaaaaatataagggtgctagtgaaataacactatagaccaagactaaataatacattaagagtatagatggttcatatatgttttatcatggtgtcattacgagatcaaaactaccggtatgagcttattggtttttccatatcgtcgtgcattaagttcaacttgtttacatgggaaaaaatgttgggtataattgccatttcttgcaaatcaacgaatagataattttggaagctatattagtacaatggtgtagaactaaaaatccacaagcaatcaagctagtgtacatgtaattggcatttggcatacatgaggcctgctaatgggaaggaatccaatccgaatccaacccaccccatctcttttatgcacagctgaccaaaccaacccaatccatttcaccacttcaaactccaacccccacaagatttgggaccaaaccaacccaatccattctcctgaaatgggtcttaatccatttccaatccagggctcaaaccaaagcgcgtgcagtgcaggcttcatctcaagccacagaggtgtttgcgtccatggacatggccacagcgccctcctcgaggcataagaacgaacgggggagaggatgaaggtggagacgtctgtttttctgaactgagttggatgttggctattgactggagtagaatccaattgaatccttggactcaatccattcttgccccaccgttttagttttgcatccaaaaccaaaccgctccaaaccaattagtctatgcactaatcaatcactagtccattgcccccaatccaaagctaaccaaactaaaatccaatccattttatccatttcaatccaatctattggcaggcctaaatgatagcttttattagctaattgggaatccctcctatcactctctaggtgtttacactactacgtaacacattttcccggacgggaatatccatttttccgtgcggtcatttggcccgcctgcacacccctgtctgtgaaaatcagtattttcgcgtgcgggcggaaggaccgcatgggataatcgattatcccgtgcggtcatactgaaccaccgcacggaataaaaaataccaaaaaaaaaaaagaaaaatcgccgtccgcccgctggccgccgcaactcgtcgtcgacatcgtcgtgcccaccgccgcccctcaccgccacgggggacggccgccgccgccggatccgggcgcgtgggggctggttgctgtcggccctcgccgccgcgcccgctcgccaccgccgcctcgccgtgaccgcccagtcgtcgcctcgcgaaagtagggagaggagagccctccctcctcatcgtcgtcatcgtcctcgagcggggaagccctccctcctcgtcgttgttgttgtggtcgccaccgccgctcccgcctcgtcgtcatcgtcgtcgtcgccctcgagcggggaagggtgggagagggacgctgccgccggatccgggcggggacggccgctgctgccggatccgtgcggggacggccgcgagccacccgtcgttgcctgcccgcccgcccgccggatccggcggctacgtgctcccgtcgcccccggggaggggaggggaggggaggggacacctt

SEQ ID NO: 66860 - DNA, 7170 bp, Oryza sativa
aatcgttgattgtacactaataactatttcctccgtttcatattataagactttctagcattgtccacattcatatgcatgttaatgaatctagacgacatatatgtgtgcctagatttactaacatcaatatgaatgtgagtaatgctagaaagttttataatctgaaatggaggtaatacagtttgacagatcaaggatatgtcttgatgtcataatgttagtattgatttattgtcgatgtgcatcccttgcatctaattttgctcaatcaacaactttggttttaactcgcacaatgcttgattcaagaaagagattaacaaatagaaaatgcttttgtaaaaggttaatgctagcatcctctatttaccaggaggagtatcactagaggtgctatatttaattgaaatgaacaagtcagccatactatcatgcgaatcaagttgaagttgactcctccaaaaattattccattagataaaggaagaattaatccatcaaaacaaattgcatgccgtacaagaaaaggtcaattgaaagaggtcattttaatcaatccatttgtcctctttccatgttcaatggccatccccgattcccctctttaactaatgtttgaataatttcttatttacacttttacataaaataatattccattttctctattattataattctaaaaatacctccaacaacacaagtaatcagaattacatacatcgtcccttaactcaacgggagacgataaaaagatcaacaataacaagagaagatgtttactgcaatgcttacagtcagcgttggatttaaattttagaatctaatatcgaagaaaagttactagataaactattaacccataacctcatcgatatttactctcttattatacagtaataatacaatcttaattcatcataccgagttatccaaaaaaaaatcatcatacggtagaagatcatcatcattttataattcttaaaagacacacacagacaaaaaaaaaaaaaggataaacagagaaagtaaaagttgtccaaactcgacagggaaaatttgcaaataggtcccacaacttttttcaaaatttcctcgtgcgcgaaaacaacctcaccagacacaaaaaatactccctcgctccatttccagcactacggcactacccatttctattcctcttcacctcgcggcggcggcgcggcgagcaatcggcgcctctcctctcggtctactctcctccggccatccccgttcatctctactcttcactccatcctcctccactccaccgtactgccctggggtgcagatcaatcgagacttggggctgatttctcgagttggtgacgaaccctaatttcgtttggattgttgcaagaggtttgtcccgccctctctcttagctgcgagcgatcaaattggcatcgttatcactgggatgagcgcaccgatccatcgagttcgtcgcggatttgattggttcgcggcggagcacgagtagcagttcatttcccccacgttatgtccagccctggaaggagtgggttctcccctgggttggcgcagttgttatcatctagagatgaagcgaaggttagttcccagaagtcgcacttggtatcgtaccatgacgagattgggcaccaggatattgagaggacgctagagcatatatttgatctccctcacaagtcggtggtccggcctccgggtccgattgatgtgggatttgtgcgctcggtattgcggaatcaggcaaggaagtttgatcttggcgggaaagatagccgtaaatacgatgatggtgttctgattgtggataaaggtgctgggcaaactaaggttgttcttgatgattcgagcatttgtggcaagttcaagagcatttggggacctttgcttgttgagagctcggcatcattcagcagcgctagggctaacacctgcgtgtggaatggcaagtggatgtatgaggttaccctggagacgtccggagtgcagcagcttggatgggctactctctcgtgccccttcactgatcagaaaggagttggtgattctgatgattcatatgcatttgatggccggcgggtgaccaaatggaacaatgatccagaacaatatgggcagatgtgggcagtaggagatgtgattggttgctgcatcaacttggatgctggggagatcagtttctacaggaatgggaattttcttggtgttgcctttgatgggattcgcaaagtgggacctaggaaaggctactatcctgcaatttctctctcagaaggtgagcgttgccatctgaacttcggctcacatccattcaggtatcctgtagatgggttcaatccaattgaggcaccgccacatttttgtatgtttgcggcatatcttcttagatgtttgttccgtctactagaagttcaaaatctggaaaaatctgaatctgcatacttcgagaaactaaggagggtcaagaaatttgcacctttacgtgaactatttcgaccaatttcggaagggatatgtgcagaatttttcggtgccgctgaaggaagccaagggtgttctgaatatatcacctggggatctttcatcacccttcttacagatgttttcagggtacgggagccgcatgatttcttatgccttgaccaggttcttgaactttttctacagttcccggggtgcagttcattactgcaggagctcattgtggctctttcttgtatgtgcaaagctgctccacttgtgttgacagaatgcccattttctggaccatatccatttttagcgctggcttgccacattcttaggcataaagatgtaatgcatctatggtggaagtcagaagattttgcattctcatttgaaggatttcttacgatgaagattccaaacaagcaggacttgcagtaccttgtaccttctgtttggtggcctgggtcttctgaagatgaggttagcatgacattatcgatgacaacactctccgatgcaattaagaaggtgaactttctctctcttccttagtcgcgcagagaaattctactaatagatgatatcttgaattaattatgccactgttataacttattctagcatatgcaattttctgctattttatgttgttggcttggatttttattattcttctcaactcttggatgtgcatgctatgctatttggtgattaaaatttgtattaccctgtaactagcccagtttgaaatccagactgccttttcctttagttttctcagcgtgttgcttccttgcttttgtgcacttgtgtactacctattattctccttacttatatgttcaattcatccaaagtttatgctctgttctattagagattaatgttttaaaattttaactacaaacatgatcgcttgcaaatagataaaactctctccctccatttctaactcttaaatctttgtttgtttgttatggtttgcactgtttttcttctacagattgaggataagcaccgtgagctttgcagcttggtgatatgctttgttccaccaacgtctccccctctgcttcctggatctgtgtttcggtcatttgtacaaagttcaatactaaaggttagaggtggagatcataggatggcttccagtgggactttcaatgacacggtgcttgtctcactgtacactgtaatcctccatttgttgtctgaaggattttctatggattcttctggacctgcatcatcctctagaataaattatggaactggtgttggatttctccacaaaggtggaaagcggaggtttcctacacagttattattgaggaatgatgcctattacaatgtaattcctagactcggtggatcactaaatcacctgttgatgtttcaccaaattgatgccaatgaagatgaggtgcagtgggatgaaggttgcatgaatgatgaagaaacacggataacacacactacagcacaaaaaccttgctgctgttcaatcacagatgtcactgttggcctgagatttaaagaaaatgccaagtacataccatcaacttcgaaaggcccatgcaagtccatgcatgaaaaatctgcacatattgcctctgaatgcagtgtgagaagtcttagtaatgagattgaagacaaacctatcacaagtgctcaatcagaaattgaatatggctatcaagcactacatcatttagaaagcatgtcgatgacaaaccaattttcatcagaagcactaagagaagaagagttgcttgattttatgctgctgttatatcatctgggtgtctcaccaaattttaggcaggcaagtgatattatttaattttttcttgaattaggtgaacaaatacaatgctgcagcaaggatccaccactttgcttacatagagatcctcaggatccgtaaacattacgtcatgtactgttcttaattcataatctatagggagttgtccttaatttatgcccttgcacatgtacccaagagtttagacaccatgtgctttccttatgtatgtgagctgcatggccagtatgtgtagccattttctagataatggcatcactttctgcaatactatttagggtgatttgaggattagccactccctgatcatgaaagccactattggggagtggcaaaccattagtcatctatactgtttaagaacaggtccagatgtgctaagtacttcggttgttcattagcttatttaactctcttagaaaaaaaatgaagcacgccaacctggccagtccatgagggtatattccaatgccacttatccattgatgcctgccagtgcactaggatacttaatactttcatattctgctttacattatggttctgattaagtttgttctgttcaggcattctattttgtgtcccagcaatcacaatccatttctttactagaagaaactgataggcagataagagaaaaatcatgcatggagcaagtaagacgcttgaaggaagcccgcaatagttatcatgaggagttggtggattgtgtcaggcattgtgtttggtatgatttctgaaaggacaaattattatgtcttcacatattgcatgacaatatgaaaacactacacttctgccgtatacaatataatttagatcatattttcttctgaatgattatacgaacatattcacaaacatattcctgttcagtaatttattatgtcgaaatggataaaaatatccttgaagctggagcttcttggaaatatatttaccttgcataatttaggagccaccttctaactcttataggtgtttataatgcttgttcttttgctttccttggtgtgagtaagattttcccacaggataatttgtacagactaaagttgatgaaaccattttgcagactagagagctaatttgttgactcgatatatggtacatgcaggtatcgtgccactgttttttcttcatggaagcaaaggggaatgtatgcaacttgcatgtgggttgtggagcttcttttggtgctcagtgattcttcttccattttccactatattcctgaattctatgtggaatcattggtaggtttgaagcgcccatttacagccaacttggttatttgcattgaaacaatatactgaagcctgcacttctgttgtttgtacaggtagactgtttccatgccctgcggcggagtgatcctccttttgtctctcctgcagtatttcttaagcatgggctagcttcatttgtatgtacagaagcgtcttaatgatttttgactcattaattatgtccattctttcttgataaggcacctaaccacacccatcattcagaacctttaaatcctgcattactaatgttcttgctggtttactttagtagcaaaaattgtgaggttgaatgcgtataacaggaagtttgatggattcagtgtttttatgtttattttatttcacaataagcaacaccctattgcacagaacaaaataaaactagctcactggtagctggccaaattgtgggcaagtttcttgtttatgtttagcattattcagtgttgcagtatcaactaagagctctattttcttatcattaggtcactcttgttgtcaaacactttgatgatccaaggatagtgagtccagacttgaaagatcatcttcttcaaacaatatcgattcttgtacagtataaagaattcatgtttgtatttgagaacaatcgggaggctataaacagaatgccaagatcacttctgtcagcttttgataatagatcatggatacctgttaccaacatacttttccaactctgcaaaggttttggctttgcttcatctaagaatgttgaaccttcatcatctgcaattttccaggtttattttaatattacaatcacttctgttattatattcagtcttctatttctgctgtgcatatcttactgtgtgattgtgtgagaactatctatttgatcttacattgtttttctttatgaaggtcctactcagggagacatgtattcatgaagaagaactgtttttatcctttctcaatcgacttttcaacacattaagttggactatgaccgagtcctctatgtccatccgtgagatgcaagagaagcgccaggtggattttgttttgtttttttattcccctttgtgcagaacttcaactctttgctgattgatgctttagtgtcgggtttcattttcagttcagtaacaccaagctcttttctcatgtgtcaaaatgcattaaaaaactgaaatatatctagatctgcgatgaaggtgtacactaataggatctcttgacaacaatcagttccagtcattaggtttccagttaattgctttttaaatattttatgccaagggggggggggaatctgtgtcattcctgtggtataaccatgcatgtggagctaaataatggtaatcaatgtcctatttttcaggttgcagatttgcagcaaagaaagtgcagtgttatttttgacatatcatgtagtcttgcaaggattttggaattcttcaccagagagattcctcatgcattcctgatggggccagatatgaatctgcggaggttggctgaattagttgtctttattctgaaccacatcatattagcagccgatgcagagttctttgacatgtaagtccacat

SEQ ID NO: 66861 - DNA, 21027 bp, Oryza sativa
gggtatgtcttagcattggaacgtgacagaatatccttgcctgaggttaattgggtatctaaaagatcactgcgaagtgctccctggtatgcttttgcgctggctttttcctgggaaagaactggcagatggggctgagggtgttggttgagtgacaaggtctgtggctatatgtcgaagtgtgttgtggatggaggaggtggctgagatatgtgtagaggcagtagtgggaggggagtccaatgagtctggtagcagtgatgacagtgactttgaagatgaattggaggacatgtctcctgctgatgatgaatgggatgatttaaatgatgatgctgtgtttgaattacctactgcgaagcctattcttcttattcagtcaacaccagagaagacaaaaagtgatttagatagattgagagcttggagtaccccaagcccaaaggataaggggaaagctgtggtactatgtgaagagagggtgaagagtgcagacttgtctggttctcacagtgattacgttggtggggactcttgttcatcaggagaagatcaagaggttgaggaaattaggaaggcatacaaggagtttaagaagaagctaaaggatggtgaggtaggaaatttagatgatgtgatctatatggggtcttcaagacagattaatgatggagtcttggttcagattcagggtgaggaagataatagcccatatgagaacagcagtgcagatggtgattcatatgaagaggatagtgatggatagtttgtcagaaagaagtccaaataccccagatttaatgccaaccagccccatgttaggcttgctcttaggatgaaatttgatgggaaaaaagagtttaaggaggtagtggtccagctagccttgcagaacaaaagattcataaggttccccaaagatgaaggttgcaggacaagggcaaagtgtgactgggcaacctatccatggagttttttgctatcaaggaacagcaggacaaatagctggcaaatagcaagtcttgttaatgagcacaattgtcctccaaggaaggataacaacctggtcacatacaagagaattgctcagaaatatgagaagataatcacagataacccaacttggagtattcagagcatgcagtcaactgtctctgagcaaatgtttgcaaatgtcagtgcatctcagtgcaagagagcaaaagcatatgtcctgaagaagatatatgagtctagaagggatgaatactccagaatttttgactatcaattggaattgttgaggagtaatcctgggagtacagttgttgtcaagcttgatactgaccagccaagcccagtgttcaaaaggatatatgtttgcctagctgcttgtaagaatgggttcttattgggatgtagaaaggttgttggtttggatggctgctttttcaaaggttcaaacaatggggagctattatgtgctgttggcagagatgccaacaactccatgtacccaattgcatgggctgtggtggaaaaggaaacaaatgactcatgggattggttctgtgatttgctatgcaaggacttgggagttggtgaaggtgatggttgggtgtttatttcagactagcagaaggtatactcttctaacatattttgttcagtgttatttactgtatttcttgatgtgttgttgttattaaatggcttctatgtggttgattgcagggaattgtaaatgcagttcagcactgggctccaagtgctgagcacagaaattgtgcaaggcatatttatgctaactggaagaagaaattcagcaagaaggagtggcagaagaagttttggaggtgtgccaaagctccaaatgtcatgctattcaacctagcaaagccaagactggcacaagagactgttgaaggtgcaagggctatcatgaacacagatcctagccactggagcagggcttggttcaggtttggctcaaactgtgattctgtagacaataatatttgtgagacattcaacaagtggatagttcaggctaggttcctacccattattagcatgttggaagctattagaaggaaggtgatggttaggatacatgagaaaagaaccttgatggacaagtggctagaatcaatttgtccaaacatacataagaaacttaatgcatacatcatcgattaaggaaactgtcatgcaatctgcaatgggatggacaagtttgaagttaagcatcagaatcataggtttactgttgatcttgagaggaaaacttgttcatgcagatattgggagttggctgggttgctatgttgccatgctatagcctgcattcactttaaaaccaactgccttgacagttatattgcaccttgctactctatttattccttcaaaaagacctaaagctgttgtttggaacctgttgagggaatggaaagctggcctacatctgataggccaaggccaaaggctccaggttatgttagaatgctaggaaggccttccaagaaggaaaggagaagagagccacatgaaaagcccaaagcaacaagggtgtcaagggtagggtcagtgatgacttgaaggttgtgcaaactccctgggcacaacaaggcttcatgtcacaagaggagacagcaatagcagggcaatgtgcaggtactaacttgttcatgcagattttgcttcaatttattactagcacagcatcataactgatattttctctcaaccttacaggctcaaggatctcagccaagctctacacaggattaggcacatgttgcagccaaggtaataatggcttgcttcctgtttgcacttgcttcagtcatatgtctaactgctaccacttgctgttgaaagcttcatcatctcgaaagaggcagctaaaagcttcaacatctgcaagggcagctggaatggttggggttgagcagccaagaaagaagttggaagttaggagatctcctcggctaaacagaggatgaataggatattaggttcataatacttttggacatgcttactggattagcaataggcagaagatcaccaccttttgtagagtaacatgtggtatgaaacttctgtaatatgatatctgtggcatctaataggccatcttttgtgtagtaactgaaggaattacagtgctctaaagtttgaagcaacctgtgacatttactgccaccactcttgtttacttgctgatgtaatcagatacaatgggttccagatgtggcaatatatgtcattattcatcatcacttttgctgtttccattatctccaattgccataacatgcattgattcccagtcacccaatatggctggtccatttgccagtacaggtcatcaaatcagctgatttttaactgtcatctcaaacaaaaccacaattttgcattcattccaatttgcaattacagattctagtagaacagctgacaacacaacaattccattcattccagtacccattacagattataatagaacacctgacattttcttaactccacactgaccacctaaaccctaactttcatcacaacctacaattttagatacatagttccaaccaagagaacaacaacagctactaaaacatacaccaacatcatgatacatgtctgttgtttgttaatcctatcaactaaaacacaatttgcagcttccatcttctctacagcagctcttagaccctgaacctcattgctttctttcttgggggtagactgcaagttgtgctgggctactgtcctgtcccaaagtgcagcctccaggccattcacctgctcacgtgcagaccacacagcattcctcaaatcaagcaacagttgcttcatatatggttttgcctcaacagttgcttcatatatggttctgcctcatcatcacaccactcccaaaatccgcagcccccagacttcacaaaaaaaggggaagtgaaagagtcaatcccttgaaaacaaatctaaaatgcaaaatcaatttaaaaggcacaaaatttaactcacacgcgcattgtagcatgtaaaatatctcctcccggggttatggggactccaagaaatccaccgagctgccttcactttacaatcacagaacacgggaagctcataatcaagaagcccctgcctgtatggcaccggcggctgacgccttcctcgctcaccacctccatcccaagaagacaatggcgagccacgcgatgtacctgagctcggcatgcccacattcatatagatgttaatgaatctagacatatgtgtacctagattcattaacatatatatgaatatgggcaatcttttttaaaaataaccaatttaatcggtatatatgatagaaaaatgtttaagtatttataataataatataatagcccgtgaaacgtacgggatgatgactagtagtcataattcatgatattttaatccagatatatagcataattctgagaggtactaatcccataacattaattgtgggcccatggaatttactagcattaagaaaatattgtgatagacaatcatccatgtttagcaatgttagtaaaatacataagataagattatccacttactaattaacacaattcatttaacacaaacttagacagacatttaagataagccttaatttatttgtcacagaatggccagacatttcatacaagatttaaggttgtaagctattatttcgtgctaaaattatacatgagagatggagtattggtttaaaatagcaagtatttggtacctaacgaaaaagattagtatagatagccagacgttcgggataagtcttatgtttggatgccattaatttcacaaaaatacaaatgtttgtgagatatatatatatatatatagcttcatacagcataaccaaatgggcaagcagatgaggtcccgtagcctactcttggttctgttcgtggttcatcttgctatgcctgcacgcatatatggtaatttgctaactgatattcattctcaaagggacttccaatattttcgttcatttaagtgttattttattcttctagagtagtcaggatgcactaagagaacatatcttataggttccattttgtttttttttttgtcttgttctccctattcacctatccgtgcatcacatttgttttatttttatttctttgtttcattctaaaagtgttcgttttgtttgtaaggtaaaaacatggtttacactgctagcgaaaccaggaacgaaggaaggtacaaagtcggtatcaatggtttggaccagtgaaatgcaccatttcccaagatggatactgctgttatgaccaaaaatcaaaagcttacaagacgtgctaccctaacgcatcagaatgctggagcaattgccataaacttgaggctcgtgtttgatcggctgacaatgcttgtaattctaaggaatttataataatactgtcgcaaacctacgtgatgcatgggttattattgtaaatattactccctccatctcatcttagcacatagaccaaggataagtaatcctacttatcatccatttaaatatgctactagtcattcctcgtaaacaagtgattcattaatatttacatttctcaatgcccatatagccaatcatgtgtggaagaatggagagtcatgtattaaaatccgagaaagtcattaagatgatatgttgttggattgaaatatgcctatcaaaaataaattttttagatttggaaatatgactatcaaaagtagatggagcgagtacttaataaagatgcattagttgttttctaaaattgcagtgatttagagtcctttgtcaattacaatatgctaattataattctggatttcaaaacataatacaatttcatatgtattaattaattccaaagttaaaataaaaaaaccaaagtatcgaacgatagtatgatagtataaactaaaggctcatcggccttggccctccccttatggtcctggcgggggtaccatattggtcctcacttacgcatgggccctacgagagaattagaaatctaacatcttttcataggcagacaaatgaggccctcgctgggctttcccaagaaagcgacttgaacttgaattcactaattcgatgtccatctagttggaaataaattttgactactctgtgccctgggactagtatatacgttcagagttgttctggttttagaaaggggcaccttagtggagtacaagaattgttggtttgaactttatttcgtcaagacaagatgccgactactataaatcctccgactagtctcttttactcggaccaattgctctaatctcctatacaaattgggcactttctacgagctttgtcgtaaaccaaaaaatatgaccatttattatgttattcgaacaatcatgaccttagattaatagatcttacattacaggcatagtacgtacatatatcaatccatgtgcagcatagtacgtacgcaacaaccaaaacctctcagatatatctcctaatctcgatcagccacagtacataacaaaaaagtctgtcaaatagatctccatatcaatctgatattacgacttccacgacttcaatctgatattacgacttccacgacttccactagtatgactatgccaggagcagctcttggaatagagacaacagggtacatcatgcatatgacgtccataattctccagtgtagggcatgacgggatttttttcagttccaattatactttattaactagaaaggtctggttaaaacttagaagcatgttgcaaccatgatacctctcttttcaatgaaagatccaaatagaattttataattttaattatgttgtttaattaaacgtttcctatctgaaaataggtcgaccaagtttcagatcctatctgatgcacgatgcaaagcacattgatacatgcctacatggtactacaaagaaatttcagtccattagtctcacaggaacaactttcgagatttcttcagttggacagcatcgtccagttgacaatgacgagaaaaaaattacaagttttcttaaacgttagcaacgttcctaaatcagaacatgcggagtccattaaacatagcaaaactggggacctatatgaattttcaagcattgatgtttttttccaagagaataaatagcaaaacatacttatcaggtaagatgttgtttgctagactatttcctgccagcaaaattaattacttcagttgcttcatattaactccatgtttttgtttttagatgtcattggcttcgcaccatatgtagtaggacatatggaagaaatatgataagtcatggaataaggaaactcagtgacactatactctgaattttgtgagttaaattaaaaccagttatagctgcaatttttttactctcaacatatgtagtgattaattagagatcaatgaaaaggatatgatgcaactctctttgaaaaaatatgcttcagaaaacactattgtaagcgaataaggagagttgttaaaagctgggaacgattgaagagttgatgctatattggcaagaacacaagaagtatatgtgagttttatgtttcttattattggttccttatgcttaactttttttactgaagaagtttcctaattatgttgccgtaatccagaacaatagtatagagtgtagtagtctaacgtaaaattttagtaattaagaaattggataaaaattaaaatatactcaaccttgcctacaacagttttggtactaaaatttgtcccagtgttaactgatgtaatatttaatagttatttttattatttaaattctagaaaatatatgtagtcatttgaatagatcatttttaaaaataaccaatttaatcagcatatatgatagaaaaatgtttaagtatttataatattaatataatagcccgtgaaatgcacagattgacgactagtagtcacaattcagcatattttaatccagatatataggataatactgagaggtactaatcccttaacaataattgtgggcccatggaatttactagcattaagaggatgttgtgatagacaatcatccatgtttagcaatatcaataaaatacagaagattatccacttactaattaacatcagacatttaacacaaacttagacagacgtttaggataagtcttaatttatttgtcatagaatggccagaagtatcatacaagatttaaggttgcacggtattatttcatgctaaaattatacatgagagacggagtattggtttaaaacagcaagtatttggtacctaacgtaaaagattagtatagatagccagacatccgggagaagtcttatgtttggatgccattatatatatatatatatatatatatatatatatatatatatatatatatatattatagtaaatttgtttggtgctccatggtgcccgggcaccattgttgaaattgagtatatacccaattcaaatgagtatgaatctttttcaattacttaggtattaatattaaccactttactaactagttcaaagcaagtttgaactgaatttgaacttgtttttgttagattttgattctaggtatatagcatccatacatataattagttaggtatgtaatcatggattgtgaaataaagttaaatttgagttgttttgttgataggtatatgtatgaatcgaattattataactagatatatactcacaatttgaaaattttgaaaaatttgagtgattttgtgcatttgataccatggtgcccgggcaccatggtgccccatatgagtgtcatatatatatatatatatatatatatatatatatatatatatatttataatcatggagcaacaaaaaaggtacacaatccatagcttcatacagcataaccaaatgggcaagcagatgaggtcccgtagcctactcttggttctgttcgtggttcttcttgctatgcctgcacgcatatatggtaatttgctaactgatattcattctcatagggacttccaatcttttcgttcatttaagtgttattttattcttctagagtaatcaggatgcactaagagaacatatcttataggttccattttgttttttttggtcttgttctccctatttaccaatccgtgcaccacaaaacaaccatacacatatcacacacatgcacattcttgatcaaagagtatgacttgctatctccttgggtctggtattttggctttgcaaaatatgtgatgcaggtatgccccaattgatccctatcgagctccacctatacagcctaatagaatagggacaattcggcaaacatgccttggtgaggatccacaaatcaaaccacatgagtgatctaagagaaggtcatttgaggagtaaagctactttgcgaaaatatatgaaaaccccaagaaattcataggaggaacaagaaagacttgagttatgactgttccattcatcaattacccaagatggtaagttagacactgcaaaagtgcaaaagttcacaggtacaggtatggcttggaataatttgtgtacttgtatagtatcttagaaaaatttattccacattaatccttaacctttactcgggacgagtaaagagctaagtgtgggggggggggtttgttgacgactattaagtaccaaaataacaccatcaatacctgcataaaaccataaatgtgaaacatccaacatagtgacaggatttatttctaacaatttccacgattgttggtgtatatttgtatgcaagtgatcaaccacaaaagttgggagagaataggcataaagaatggaaatatatcttgcgttgatggacttgcttggttttgagatacaacatataaaatgtgcaatcattcggagccaaaacatggagtaggataaagtagggcatacatgtcagcatcctgaagaaagatgtgagccaggggagcaaaccagggttcggtcgaacccccagctggcctaaccaggcccatcttttaccaggcaatagttattcttatcccaataacggttgtgagcgttgtacctgaagaaaccgtcatggacacatgacaagaggagatgaaatatgctctttggatgcttgagtatgccacttgtcatgaggagagcaaagatgctcataagatgcttggagcatctccactctcccaaggcacctctccacctataaatacccctctcctccctcattcttacacacaccaaagcatgagctgaattacaagaggctctagtgtactttattgtatattagaatagggagagagtaaggtggaaggaatcggaggaatcccggagttgtcggtaatctcctcttactattgtatcttgttaattactctacttttaataaaaatatcattctgagtaattaaggtttgcttagtgagaattacttcttggttagttcctaattagcatacgggatcattgttcactatagtccatttatctatagtgattgtgttagtgtttgatcggcactagagtagttattaattgcgcagacgcggtgtttgggtaattaatttccagtggttgctgcgtttcccacagtacatttgaggtgggtgtagaggtggtgacagccctcaagagcacttaagtcctccctgtccgggtatgtagtagagcaacatcttggaatagcgggttgctagtgcatgaagtattgcattaggattaaagttaagctttctctagacactgtttctcattagaaatcatctctgccctctgcacatattagctttgtgtccttgcatgaacctgatgaggagataatcacacacgttcccttggattcgatacccttggaatactctgtaggggaagtgctacatcagtatatccgtgcgcttgcggattctatctgtgagtgtaagaaataccaacactactcgtagcacaaaattgggggacatatactagatagatgaaaagtatggattttaaaaactttttgtaacagttgatgtgttgatgcatcgccttgagatgggcgatattcatatcgcccttagacaaaaccaaatacaaacaacaagtgttgcaaaagtattatcggcttgatggccgatacagatacatatttatatataggatgtttttgttacaggagttaagtatgaagccaagattgttcatgtctatctattacatcaacccaggaaggtatggattgcctctattgcacggagatgaagactatcgatctcttctattatctttttgtcttcggcgtcagttccttgccattgctgcaagattgaggaagactaatagagagcaggggagaacgccgccggaagactggatcgccggagatgaaggggtttttgcaacaagaaggcttgtgaaggatttaaccggagaaaggagattttgaaggagtgggcctctgcttataagcttaacagtgaaggcagaaatacttagtttttcgcgggttcgaatagagcaaattccaccgcattatataatacagcggaagtggggggcatgtgttaacaacggaattttgcatcaggttcagagaagaaggaagaagatcgaagtggatttgatttcggatcgagttggatttggagtcgggctgcgcatcggctggatgtcatatcggctaaaatagagtgtgagttgatcaaggttgatgaggatggtagccgatatagccgatatgggacagctttggttcggtttgggcctaaatcatgataaccatcattgccaattggaggtagagctcaattaaggcaattgtatctattaattaggttagtttaagtcgattttgttagatttggtaagagaccgccgtatgttgtcttgtttgtatcttatctttaggaaggtttgagtcatgtccataatggactaagtctgtatttggggtacaaatatgaaccccctaccactgtaatatgggagacaatccaatacaacttcgacgcatcgccacccttttttgttcttattttcagcgagttctctcgacaagaggtaacccgtctcgatggcttgtgctatcggggctatcatgttgttttagatgtttaagtccttttctcatgaccatctgtcatcatatgtcctagttaatctagccttagtatcacaatttagccttatcggctggttctcgctttagggttcccgccggcatcagctacattgccatactatagattagttaacgcatccgccatcttgaaaagtggttaattccttgattgtttagattttaggtttttttacttactttgagatgcatcaccccgagtcttgtctagaacactaaaaactaacctggaattaatcataattagagatagcatcggagtttcagccgatcttacctaatatacatgctttttactagttttatgtatatttgccacttatatagacagatcatcccatataatcatatcaagttagatcagtatcggctgggtatttgaattactaactgattgtcacgaccgaaaaaatgcctttttccaatcgctagtgcattgatccccatcctaggaaaagccggggtacacattaacaatcatgatacaaaagacatgtctttattgcatcgataatatttacattattacaaaggtgcttaaggcctgacaaataaaaataaacaacaatgggctagcaggcatatggctccatcttcataggcgctcagctggagtataagccaagactccacctaggactttttcaccaaagctttctcttactaaagggagaaagattgagcaagaatgagtacaaccacaatactcagcaagtcacaccagaagatgcatgattaatgcaaggggtacaaggagtaataatataaggggttaagttttgcagcaaacaagcatttcaaaccacttagttgctcaaagctatttgctaaattcgatcctgagtctacacaatattattaatcaaggccgtgaacccacacgaccctgccttagcccaaggcctacgatgagtcagaccaaattggcaaccctgacccggatcccagctcgtcccaagccaacccaggccaaccattccaggttttagttggttaaccaaattttagggctatagggctgcttcaggatgcaaagataacagttcgctaaggtacaagcttctgatggttgggtattgcatgggtcggcttgctatcaactgggtttctcagtttggggcacttgtcggtgtaatgacctagttcttgacaattgaaacaacatatatctttccgaactcaggatttgtttttcccatctcgattcttctgtcctggcactgggttaggagaaaactgttgtcttggtggggaatcgcgttgccttcatgcttctctccattggagctggtgggttagttgccatcttcttcatcagcagaaaactgaattgacaatcttttggtacatgatcagttccttcgcacaagaaacaagtgatcttccttgtaggacattcgcctagtggatgctcttatccacaataagggcagtgagcaacacacgtgttagcaatatgtccaatttcaccacagcgagagcatgccttgagttcccttccacacgtggaagtacggtagtgctttgcaataggcaatagaggcccaaagaccggtccttatggtggccgatgtgcttctatcaaaacaatgcaacttgagcccagcttaaaaccattttgggggttttgaatagagggggaggtgtatgtccaattccaacataagccaaccattccataatgtccaagtgaaatgatataattcccaaagtctaagattatgaaaccacctagggttgcctagttaaccagcaaagtatctacctaaattcatactagtggaaccatggatagagtacccgctagttggggttttattttcctagggtgagcaaggtgataataacaatagcaatgataaggctataacaaggaataataggaaagctaaatataacagtgataacgcgggagtttaaataaagcggtaatccaataatttaaaataaaataattttataaactggaattcaatatactcaatgtaacaccctaaaaaaaaggcaagcaggcgtgcaggccctgggccttggcctacccatgcatgcggcccagcagcagcacagcacgcagagcaacgagtagtagcaactgggtactgtagctggaatgatcccacctcgctagttgagagtgatcaacactagcttataaggatgtttgcctgggtagtgttaactccgattccggaatttttgtgttaaagcgaggacgaaaagctaagagaagacgtgttcctggtcatttgggaaagcacgtacggtcgtacactaagagaagacgtgttcctggtcatttgggaaagcacaggtatagattagttcgatggggacgtcgaacctttgagggtgggtgtatgtaaaaccctataagaaaaaaagggcaagcaggcgtgcaggccatgggccttggcctacccatgcatgcggcctagcagcagcacagcacgcagagcaacgagtagtagcagctgggtactgtagctggaatgatcccacctcgctagttgagagtgatcaacaccagcttataaggatatttgcctgggtagtgttaactccgattccggaatttttacgttaaagtgaggacgaaaaacacagagagttgcaatgttaggtgtggttttcggccctgggctatcacaaggatgatgcgacttgcctctctcagagagaatggtgtggacccccgtttttataacaggaatcaatcgtgtaaacagtactatttccctggatcaagtagtctggtacacacgaattcatagctgaaataccaagtgcacatacacgagtgtctagtacggcttattacatcataagcccgcaggcatagttcttaaatcatcgaaccgagcggtccggaatacattccaaaagcagaaatagataaggcagcggaatttaggcagcggcacgccattgccacaggcaacgaccgtaactaagacctactgggcgccttcgtcttcatcaccctcctggtagtacgcgtaaggatcctccaaagcttcatctccaacctctgattaagtttgtatattgcaagggtgagtaccaaccgtactcagcaaaccaccacagcaataatgcacatgacaggggaatccaaaggatggctatggttcttttgcgcaaagcaagttttgtaattcttttcacaagcctaagacctagcatagactgatcaagttttaataccagtgttcacattaaacaacgacggttctgtccactatctattgtgatcccaaggatagcttcccgccattgagtcgtcatggttttctgagaacgtccatattcccgcctctcaggaagtggctccatcagcatagaaatcatcatgcaatatcccatctgtcggtgtcatggggccgggggtatcgtgactagaggcttgggtagccgcggtcacccacgtggcctgaccccctcgggggggggggtcgggcccgagggtgacgtggccacccctccctctgtctccccgaggggtcgggccgctcccgtgtcggccccgagggatcgggcgcccccgtttcggccccgagggctggggcgccccgaccccctatggttttggcgccacgtgtgtgggttaggtgagcacagcggggctcacctaaccgcatttataacaggttggacgagcgcgccacgccgcatttaatgcggcgcagcgcacgctcgttcggtccgtgaccggtcgcggtgtgtgaccggtcacagaccggtcagatcgcgggttaggtggcaacaggcggcctgtcacacgcctcgccccgtcccgtcggaatgatgagagcttcctggctctcgtccctagccagagccggcgtgctaactcctggagttggtatgtcagtcccggtcagatccattccaggcttcagcacaagcatggcaaggaagtcgctggccattgaatgaaggttgaaatgggcgtccaccgggaaagctggcgagcggggcaggaggcgtgtgctctgcttgtcagaggtcacttccggctgtagactagccctcattgtaaaaagcatgtttcctttcttaggcagctagaggcccctgtggtgacccctgaccagataaaaaggaggcccaggcctaggagagagagggaggaaaaaaaagaagaagaggggtgctagagcctgaactctctctggctctgcggctctctgtattccttcacatacagatccaccagaacacaggagtagggtgttacgcttctcagcggcccgaacctgtccaagtgtaatacatgtcccggtgctcaataaccgcgagcacggctattcgaatagatttggtttactcacactacagtggatgtacactttacccgcactccgtgactgcccaacacatgagcctcgtcctaacacataagacgcgtcacggcaaagcctttcgataaccttgcattggcagtacccgctccatgaactttagccctcatgcactctaggcgtcatacgcttctagcagtgagaggagttctggcgctcccgggaagggaaaaacacacacattcctacgttgcttcttgtcgttgaacccagtccatcatgattgttctcttatgggtattctcatgtagtattgccaagccagcctctgaccatccggaacgggcatccgccatccacctggccatccaaaccgggcatccgccagcagactacttgccgcatcacacacctaaaagaagaccactacgcatggatactgcctccgctcagctatctactccgctaggtctatacccatacgagaagtgcggttgtacgggggtcgtttcatgcttaacttcatggctcggtccttaactgaccagggacggcactagccttttccggacaccacccaaatcctccagccgccccagtcgaaaacagttgtttcactttattttcctttcacaaatcatgtcatcaatatcatggcaatgtggcgctcatgtctccacatgccgcatctcaattaccttcccaaaggtaattgcccaagcatataacatttgataaatatgagtatgcatgattctagaatagcatttctaagcaaaggtcatagttgactagggactcatacgtaatcatggttacaaagatttaagggtaaacaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttgaccttcgcttggatccgcaactccctcgggctctatagctacgtgctaaaattgatttgaattcggttagaattcaaatagaaatccaaataaatccaaatgaaagtcgaatgcgaaagtcgatttctttatattaactttactattcgcgaactaaggcaaacccaatttcgattcaaactattttgcgggtataaatattttgttgtcataagtttttaatttaatctacccgagcattatatccatataataggttagaaatttctatcgcgagctaaatatcggacgaaatcctagaaatattatacgaattaatttagtctatgactaaatgattaaatataatacacgggtaaaatccctagtaattaaatccgaatttcaaccgtgaatcgattacttacagggattacccaaaataataatctataagaatctataagaattcatctatttgtttagttattaactacatctaaattattaccgcgaattgatctcttatagaaattgccaagaataatccataatttatattaaattttgcaattctacgactataattaatccataattaaattctaatcattttaaattttctaaacttccctaatcttcctctaatttctatttatttttttcttttctttttctctcttcttttctctcttttcttttctttttctgtctttttctctcttttctctcctcccagctcctttctttctttttccttctcttcctctcttctcttttcttcttcctccctaccggcctctcctttcctctctctctctcggctcttgtccacccgagcagcggcggtagtggacgcgagggggggaaagacggctcaccggcggcggcggcggcgacgacggcggcagcgcggcggtggcgactatggcggcgcaaggcgacggcgacacccggcgcggcacacgatgtggcgcggcggcaccgagggcagcggcgcggcggcacgaggacggcggcgcggtggagggagagaggggaggaagaggaaaatggagtgggggaaatggagtgggggagtatttataaggaagagggggagaaggagagggggaggggcggcggcctgatgcgacggcggcgcggggctcggggcggcgcgcggggctcggcgcacggtgatgggacggcgatggaacgcgcgcggcgacgggacgggcggtgacggggcggcagcggtggcgcgcggcgcgaggcgggacgcgacggcgacggcgacagcgcggcagcggcggcacagggcgcaaggcgacgcgacgggcggtgacggggcggtagcggtggtgcgcggcgcgaggcgggacgcgacggcaacggcgacggcgacgcggcagcgacggcgacggcgtgcggcggtacgaggcgcgaggcgcgacggcgacggccgagcggcgcgcggcggcaggcgacagcggcacggcggcaggcggcgatggcgatggctcggggcgcgaggcgcgcatggcaggggaggggaagaggctaggtaacctcgtcgaacacctagagtgcaatgaacagtgtctttttcctatttatcccgattttagtttatttcccatataaatttgattctataatttctaaatcttgcataaatgaagtttactcaatatttgtgttatctcaactaatgaattcaccctagattattattactcataatttatttgaatttttaattagggttaattcttgttccattgcatttaaatctaattaatacaaatatggccgcgatgatattttatttattcctatccttacataatctttattttaaattataatttatttatttctttaaccaaatctaatttcagggttaattcctaattaattttcccctatttgtgatcgatgaattccgaaatcaaaatccaataaaatcatcgaataaaattggcatgatgcaatttatttaaaaagtttttgaaggcccatatttttagagtttagatttttgtcggtcgaattttcagggtgttacaaatggccttccaaacttccaaaccttcggcgatgacagcgaaccatgcttcgggaacctccggaacaagaggagctacgcgaaagcacactagcaaacctaaaaccctagaaagaagtaataacaatacataaaaagaaaggcacggggttctttagattataacaaaagttctttagattataaaaaaaattaagaaacttggacgggtcaattcggagtttgtataacaagatatggttatccaaagtttaatgctgttatatggagatttacggttgttgtgattaattttgcaactataaaacatgtgtaagtgcaagcctggaaaagaaaggatggttgcaccgttgacatgcagcgtgcacatgtcaacctaagggaccatggtggaccgggtgcacagagacaatccacgggtcgacagaagcgcaccccgtgtgtcaaccgagacgagtggccgacaaacggactccactagacaccacgtgggttacgcacatggaaactacacggctaccgagtgggcatactaacacggtcaccacacgtgcacacgaacaaccgccgacaccggtacacgggtaccggggttgacaacggcacgacgtgcacagtgacaaacaccgagaggacgaggagggggaagcgaggggaggggtcctcaccacaaataggacgagaagcagaacgacgacgatgaacgggcacggcggagacggctcggggtacaccggcggcgacaaacaacgacacttcagtggcgaccctaggacgaaggcgagacgaggccggcgcaacgcttgatgacgcgaagctgaggacgaagacgacgatggggcagcagcacacttgacgaaacgcagacggcgaacgagcgcggcttgacagagggacaaacaccatgatgaggaggaagacggccgggaacaatgatagaacaacgatgacgaccggtggcagcagcacggaggcgaggacagcgtggaactagggatgcaagtgagtagtcctgctacccgcataaaaacccgcttgctagttcattttccacatggtagtataaattttagaaaaaaatgaactagaaatgagataagtggactaaaaaaacccgcttacctgtcccgcttgcatccctacgtggaacacgctgctgcgatgctgacggcggtggcggtatagcgagacgacgagccaacgtagaggaacggccaaacgaaggggacgctgacaaggatgaacagtgacgacggcgatgaacaccggcggggttcggccgaaagggaggcgaggctgaggacgaccttgcccatgcaatgcctgaggtggtggtggttcggccgagcggcgcacgggcgaggaggaagggccgaccaaaagaactccggcgaggcggatgaagaggccggtgcggttgcctccgggcaaaggcgggcagcggccagagtggagagcgatgctgcggtgtcggaggaggagacggcgacgtcagccggtgctatggcgccgcggcgggggcggctggaggcggtgcagtggcggcaacgccactggttgccggtgggggcg

SEQ ID NO: 66862 - DNA, 1053 bp, Oryza sativa
tctggctggcccatggccggatccggtgctcctcgcgacggatcttgccgcagtggcacgaaagcgacgatgtcagtgtttgaagcgggaggccggcgtcggtggctggatggcaatgtcactacagtgggtagcgacgagaaggccgtgggcgatggcggtcactgacggccgccggcggacggcaggctagcagggatagagccagtggtcgccggtggatgggaggctggcacgaaggagctggtggtcgtcggtggacgggaggcccgcgcggtggacacgggcagcaacacgagggtggtgcggttggtgtcagtggtgagcctgccttggtccgagcacggcacgacttggcggtgtggcggtgaggctaacgcggtgggaggacggaggcgacggcgaggtgaccaggcggcccgttgtgaacacgagcaaggtgggtgttgaaggctgcggcaagctcctctccaggcatcaatccttttgcgacgatggcttgccgcaacaagatagccatgttggatggacttgtgcggcggagaggagatccattcttctctctcaccctctccctctccaacccacccacgtagatggatttggagcgctccggaggtcgagatcctgctttgatggctggccagcggcgaggcgtcagcgcggtacctacgcgttgaaggggattagctggtggttattgctgaatctgacatgcactcaatgacgtgggagagtatgaaactacgggtgaaagcctagtgttcgggctggcaacggtgacgcttgcgggcgcctctttcctcctggggcgttgttgcatttttctctattctcccaatggtttcttcaagtgaaaaccacgttcttgttctctaggaagggcggcggcggtgctcttggcgtcatttcctccttggaggcgtcatttagaagaaccattccgggtgttgagtgcatgtttttgtttttcagcagcaggatcagacgtagacacgtggtgtgactgtctttttctttttccgactatagtctgccaggactatagacttg

SEQ ID NO: 66863 - DNA, 3258 bp, Oryza sativa
  unsure (1)..(3258): unsure at all n locations
aacacttgcatatggagctttggaaatgtcctccatgcttgaacacatgtcacccctgacttcctccaaaagtggaccgaaaaatgatgtcatgtactgctccatgctgctgaatgtttctgggatcttagccacctgcgacgacacatacattccatgaatccacagcctctttttatggcaataggcaaaatgagttcacagaggagttaagcaacataagagcagtcatgctaattccttagttccattcttagtgtagttaacattttgatttatggcatttcaactgcaatcattctactctggctaaaaagggggtgtaggttgtctccatagcactacacaagcagaaggtaaatctgaaatctactccagccatctaggtaagtacaattcagatactaccagacaaagcataaacagtgaatcacttggcacagattcaaaaaaaaagggctagtgcttctagtgtgctctaccagaaactggaaagcacaaactccaaagcgcaccagtggtacgatttgcagcgccacccattatttcactaataataagcacaataaacttcaacaagcgcatcagtggtacgattgcagatttgcagccacccaatacttcgcttattacgcgcaattaccggttctacacaaaattaaccactcattcgcgatgcgtgaacccaaaaatggccccatcacaagagagggaaaaaaaaaacggccccaagtcccacccaatcgatgacgcgaaattgacacgcatttcgtcagatccacgccgctcaatggccactcacgcgagtgccaccggtgcgaattcgagaggaagaggaggaggaggaggaggctgcggatgtcgcgagccagcggaggtggtggcgtcaccttgtcgcggagcaggtccttgttgaggatttggtccaccgaccacgagagcaccacctcggacagcccctggctccgccactgccacagcgagtcccccgacgacgacgacgacgacgaccccttccccgcccccgccttcatcgccgcctggtgccacccgccgccgccgtcatcgtcgtcgccgtccctgccgccgtcgaacgcgtgggaggaggagggctccgcgggatccgcctcgcgcccccagtctccgccgccgcggcgccgcatttcgccggcgaccgggagaggaaggaatcgccgcctcgcgattggtgggtcagatttgggggctaaattggagtaggttttagtggatttttttttgtttggtggatttttttatcctattggagtataataaagtatggatcgatctgtccccctgcacggctgcatccaacggttgggcggccgtgattcggacaggctagctagctccagtgacgcgtagtaccggcacaagctcagctcagctcagctcagccggtttggtcggctactcggctgagttcgttccttgcagttgggaaataacctaccgtacaagaagcacctaattaatcaagtattaactttcttttaacagtttaactatttaaaaaacgagaaacgcccagaggtcttccagctagctcaataagatggtgggctagacgacctgggtttgaagtctcaccccttataattttttaatattagatccttccctgatattcgtgttttactatttgaaaaacatgcatgtaaaaaaaaagatgagctgggaaactcagctgccaaacacagacttgaattgagatcacaaacacatggcagtataaatgcaacttttgcattcatataggagcaagtgtaataggattattacatcagtcgatgatagcaattgccaagttagatttttgtcgagatggaagagagagaacttaagaagagagatgtgtgggtgactaagagcaaaaataataacgagctataaactgactataaatttatacgaaatagtgaaacaaccaaaaataaaaggtgttggctctaatgcaaaatctagctaacacgtgcttcaggacaaatactttaaatacagtaggtgagagagatagtgagaagaaaatatagaaacaataatatagttaatttattatatatatattggttttaagatggactaatagcgggtagtgaactctactactccaacgcattcaacgcagcaatgtgggcccaacgaataggaacaaggaagaaagcataggagagagattaacatgagtaaaataaaaattttgatcgtgctattgcagttagctattatagtagtaccttagagacggtaaattatctctatctgatgcggatgaaaattatagcctgctgcttacttcattattaatcttgctctaaccatcattagattgaataacaaagattcagatcgcacaagagtattgttcatcatattaccgtatgtacatgttgaataggggtagcagcgccggggggtctccaatctggcagtggatcccacatgccaatatctaccttcttcttcccttctctttctccacagtccacatctttccccttccccatccccacccacccgacggccctcttcccaaccagtgcatgaggaggcggcggctcaaggctagggggcgagtggatggggagccggcggcgccactgctgtttcacgcgacgatggccgacgctagacgactacgagcacatgaggcgatgacgggatcaactccttgctagcctccctcaccgtcgcgccctccctcccttgccgtcgatggtgcacaccggctccgtcgccctccttgtcgagttgcgccgatggccgacgttgaagaaggaaggcgacagcggccagcagaggtggcggcggctggcaggggaggcgatggccggcagggccagcaaacagcagcgagccaccgagccggcgggcagcaatgaacgacgacggatacgaggagtgagactgtgaanaaagcagnatgtggcgcccgttccgtcgtggcgcctggcgggaggactattcttaaaaaccctatttgcgaaagctgtttctttgcttgtggtctagtgtccgtgccatctcagatctcaaatccccgatctatcatcgaattcaatcccgaatccaaatccttccaaattaatccctccgcaaaagtctatttcgcctcccccgggttcgatgggccgaatccctctcggcccatctcccttcccgtctctctctctctctctccctcgctctgcccgcgcgtgcccgaaccacgccgagcgcctcctccctcccgtcgct

SEQ ID NO: 66864 - DNA, 3471 bp, Oryza sativa
gcttatttaggtgcttatgatcttttttgttaggcatatatgtagctggtattagacagaatattgaggctttaggtctggactttagcagcaatagagaggtttttgggctgcaattatttatagttgaaagagaaacatatataacatttttttattctaccgaactttcatgtgacagcggtgactatcgagcagattggcaccaacgtgatgtacaagttcaaggattagacaagagttggatggatcccacccctacaccgtccatttttggtgtggatgatctgtgtacaatttttgctgctaaccttgattgccagatggttaaatcccggtctagagtgcctcctcgtgaagagcttcgtagaatcagtgatgagcgggactacaatagtcttcgtattgcattgaaggcatacatcagtcgaagcagtgaaaaggtatataaatgtgcatgaattgttaacttatgctttgatttaaaacgacttctgacatgttgtgtcctatgtatcagactccagaactacgggttgttagtgtacttgagcggaaccttatcgtggagcatggtcaaggatttctgcacttcaatttcttggtgcaaccggttgatttagaatcttcaacactcaagatgttctttgcagaagttcacctggactgcaaaggagacgaagatgtgtatgtttgctgccctttgcatgtccacgacaatggtatatcttttgcttatcttgcttctgtttcgtgcatattgttttgagaatggagttttagtacccagacatagatctttattcacaagtttatagttagatcctttagcatctcctaaactatacttcatccgtcctaaactgtaatacattcttattttaaaaaagtcaacatttacaacttttaactagctagtaattaaatctccaatatgtgtttagtttcaggcatatgacatcattaaatttgtatttgaaagtactcaattattatgggagaaattaattatcaaagttctacattggagaccatataaaaaaactcgcacgccttataatttgggatggagggagtatttaacaatgtgcaatttgctatacagactgaaaatgtaacacattgattggtgtgatttcaggccactgtttcggatgcagtgttcgagctaagtttcttaggcaccccagtagtcatgtttttcttggtggccacaaagatgtagatttcccatttaccgactcatcctcaaatgaccattccaatggaactgaagatagccttcgggatgaagaaagtgagaattcaaagatcgaaacagatgataaagattcaaacagtgatacagaagaggagacagaaagcaaggatgattgatagataaaaggtatgaagattgtagggatgaggataggccctcttttcttggcatagcagtgctacaaaactgtaggttagtttcgcacttgaaggtatgcttaattacacttgggcagtcagttaactgtattacatatcttgttgatttgctttgcattagaaggtatgcttgaccggttgactgtattacatatttgctcagtaattcagtagcatcttaattagcagtctgtctcagcccacgatatcatcttttacatcacatatttgaccagagtgccaaggaaatttaaaaatagtacatatgagtgcagtcactgctacaacccattttgtgaattgtgatgcctgtcttagttacatgatcatggtatctacataaaaactaatgacgcagcccctgctatatatatctattttgtgtatattttgcaacatatggacacagaattacataaaatatggtgagacttttccatatcttctgcagacatctcacatctgcatggtgctcttctcaatataatcaaggcagagctcctgccgttctattcaaaagatctcttctgatggtttttttgacagaatgtgatgcattacaaagagtgtgccactgctgatatattcacttgttgctctagcattgactcccaaggtcaagagttcaaagcgttggtctttgagtttatgccccattggtagttcggatagttggtttcaccagaaaattgccaaaacctgatccaagcaattaccctcggcctagctcagagattgcacattgttgttgatggcgcggacacatcttcaccactactgtcaatcaccaatcatccactgcgatttcaagcagaatgcagaaaacatgagtacacacatggggattttggcgtatcaaagattatttctatctgaacatactagcagaagtgcagtaaatacatccagctccatcagaattagaggttccatcggttactttgctccagctgtcagcctgtcatatacatacgcaagccctgttttcttcacacgttattttgtgttattccctgttttcttcacatgctattttgtgttattcttgcctataaatgaacgcatcatatcatactgaaataatttcccctgctattgcagagaaatggtccggaaagtttgtgcagtctcatctacctgtgacgtttacagttttgacatgctcttatgtacttgcttaatgataaacatctcaattttgtgtactacaaactgtgagtatttgtttggctatcatcttaggagtacatatatgccaacgatttttgtgtttcccatacaatctgattattttctaattgcatactctctaaattcgctcccaaaatcagtctattattaatctttaaatccattgtatatgctttgcaatttagattgcccaattcatagtgttatagttgattgacatcatttgaaggtttttggagtaaatattattgtattcacaaatacatttacataacttattgtgttttcacgttatttaagacccgttgcaacgcacgggcataagactagtttatttataaatcgttactaaggtttttgaaagcgtattcgacgcccaacgcaataacgcgactccaaccataaccacctcaacaaaatttacaaatttaatatcaggatcagggagataaaataacaggacatgaaaatcacacgctttcacgggcccagtccggttttttcggttcaaccggtggcccggtccggtattttcgtccggttttttccactcaccagtcaccaccccatttgtgggccccactgccagtgactcttctgtccactgcacacgccgttttgaaatttcaaatagccccatgttcattgtttgccgcaccacagcgtagtctcgcctcgccttccggaagcttcgagaagcagagccgcctcctcgcctcgcctagcctcccggaagcttcgagaagcccccgcgcggcccgagccatggagaagcagaagccggcaggccacgacgcccgcctcctcctcgcgctgcgctgctccagggcgtcgctgctcctctcctcgctccgccatccc

SEQ ID NO: 66865 - DNA, 7846 bp, Oryza sativa
gccctcctcgagtcgcagggtggtagcgtgctccgggacgccggcctcctccgcgcggagctcgctgcggcgcggcgcgaggccacgatgcacgcggcgaactccggggcggaggttctcctcgtcctctccctggtccccgtcctcctgctcctcctcgggttcctcgcggcagcggcggtggcggcgtagtagggagggggttcggagcgcggcgccggcttgagatcgacggaatcggaagggttcggagccagcttcaccgttcttgtgctccgtgagtttcttcctctgttgcggggcgacgcgttgttgtgcggatgagcaggtctagctcacggcacgattgtgtagtgatatcgtacatatggcatcggattttggtcgtcccgttttagcgtttgctaggtgttcgatggaatgcccatagaaagtgtagcttcgatttcattgcttctcgttgacagagtaaaataatgcagaaccgagaagatgatgctttcatttgtctgacctttgatttttgtgaatttctctagaacatattctaaactgtgaaagctttacttattgctctcgattagacatggatattgcaacgggaaccaataccaatcatagcttcttgtttgtccagtccagtagtgtacatttttgtaagacatgggtgttgtgtcttaaaaaggttctcatatgcctcttacaaagctaaaatgcagtgctgaaaaatgtgttaatgctagaattgaattgttgatgatttggtagtactgaaaaatgactgaatgcttgatcaattgaagatatcttttctcaagttgtcactggtatgcagtctgcaggctatcaccggtaactagagaagttagctgctaatagattacttttactgactgtggctacatacgaattgtggaattgctcgcttgtccatggcaaatcataataaactgaactcatttggttccgagcacggcactggcttgagatcgacagaatctgaagggttcagagttgcttatcttgttctggtgttccgtgattttcttcctctgtttcggtaacgtgttgctgtgcagatttgcaaattacatggcctcagattttggtcgtcttttagcatttgttaagtgttcaatgaaatgcccatatgtgttcagggacctatagaaagtatagtttttgattgcattgcttctcgttgacagatgaaaacaattcacaatggaagagatgagacgcatgttgattatcggatgtagtatttctgattggtgtggcttgaatgctagattcagcctaccttgctttcatttgtctcgttgtctgaactttgatttttgtgaatttctctagaacatattgccacgtttttgtgattttttttttaaaattttacatattgctttcgagtagattgtgggtagcagtgtgaaccaatatcatgcattgcttcttgtttgtccagccagtccagtgaccggtagggtaagcagggttgtgttgtgtgataactagtttctcttatgcctctcacgatggaaagatcgtactgccttttgcaatgctagagatgaattgctgacgatttggcagtgctgaaaaatgtttgaatgcttgatcggttgaacatttgtgtattgactaaaactgtttgatgtctgtataatatctgtttgatgcttgaatattaacttttgtgaagatatgttatgcccaattcagtagcatgccgtctgctggtcttccccggtagtagccaatattgttttcgtctaaagtaataccagtaactagagaagttaactgctggagtaatggattgcattactgtatttgctgagtgcatccatgtaaagagtcctataatcgatcacttgtcattttgtcaaaggcaaattctagatttacttgtgattaatggttaaatttgagtgcacgtgcagcatcttaagaataacttgttgacagaaaaaaaattccttctgatttccctaggaagaattaatagcgattcagacttaattaagcacaacatcaggttgtagctttgctattaatcccagaacgatcacagcagggactctttttaccttcaatacgatcttttgtacgaatacattccatgtatatctggggttggcatacttatggatttctgccgataaaacgtgcctcattttccataaaccaatgcacttcccatgatctatgcgaggtcaggtaccctataaatacctgtgaactacgatactcaacgtagaccaacgatcaagtctgacaatatatcgttccacagacttctctttcatgtacatcttccccaatcttctgctgctaagtttgcggcaaaatgtctgtgctgttctttctgttggagtttaatccacttaattaatttgagtcttagcctaaacatgatcacctctgcttaatgcagaaattgaatttgattcactgaccttgatgtgaagccattgaagtcttttcttcttctattctgttcggctctcctgttcatggaaacaaaacgaacagagaaacctcacgaacccctttcagtgttaaaaatcgattgggtaattgatttagtgtttagggttagagagagggctcgacatgaccgctgcctcttctcctctttatgatatatagcgacactggtaaggcttgggggtttgtctccaattaaaattcgaatctattttgtaccgatcacacaaaacatattttatgtcttatttggttgataagaaaaccggtgggattttactcttatcctaactaaccggcattagtcgataaaatcaactaacattctcctcttgattttgagactaactaacgagtttactaaatataatagcttcccaaggcaatctgtcacaacaacattatgcgttactgagacaataagacttattgttcactatagtacccaaataaactcaagcttaacttagtgggtgttgattgaaaaattaagtccccctcatccaggatcttaataaggctaatttacacatgtactggccagaacatatcttaattaaacttaattttataagcctttaaagtatggatccatgagcaaatgctcagcttagggcctatttggttggagggactaaaactttagtcgcttcactttagtccctagagtcccaaacaggagggactaaaaagacttaaagtgcattagtccattggtccctaagggaggagcttattgggactaaagtagctcctttccacccactgccctcgcgcgtgccaaccctatccatttccttgcctcttctcttcctcgcctcgtctctctcttgctcctctcgaccccgcgtcgtcaccgccgcctccctgtgcaagcccccgcagttgcttcgcgcaagcaaatcctctaccctgcacttgcctcgccggtgtcatgcaagccaccgcgagttgcttagcagcaatggtagaggaagatcctcacgatttcttctcccaatcatacaatgatgctccggcggcccacatgaacggctccgagtacgatttctcgcaggggtcgttaggccatgctggatctagcgtcggcatccattttgggggggggggggggaggggatccaggggcctggatctgaactctcaggccgacgccttccctgatttcgcctcctaccagcagatccttcaaccgggtagccttgggttacctccgatccggccaggcagcagatccaccgtcgcaatgtcgcgccctcctttctgggggggacgcggcagaagttgtggagggagaggaggaggacgaggccgcgctaggtcgttgactattggcgcgggatccggcagggggatgcgtggatttgttcccctggctcagtgtccggcaatggaggtgtccgagctcgtgcgccctccatgtcgcatgacgggccccccttcttcgaatttggagtctttggaggaggtgggcgacttggtgcgtcattgtttcaagggacatcagtggctgaggacgacgccaatgatgaagacgaagaggacatcggtcccgatggtcagcccacggtaaaccccgatggctcaagattgctcttcaattttcttatttgcacttcattgccgtgagctcatcttattgaaactgctcttcaacattcttatttacaatgattgaaatgccattagttgttcatgtggttaatttagggttaaatcatgttttctttactagaatactcttgacaaggcatgctagacagaagaaaaaacttacacgttgtgtgaaatagcatgtgaggaattgagggatggacattgtccaaatggagcatggacaactagagggtaccagaatttgaaggagaaatatttacaaagggctaaactaaagcattcaaccaaacagataaagaatagataaataatttcactagatgcttggtggaaaaagaatcaaggtacgtagttgtgtcaaaaattgccgtagtttacacgcttttggagatttctgtgatgttgattcagtgtcaatacaggagaagggagacgccaggaaatttcgcaatggcaaccctgagtacttagattttcttatagagctgttccaaggtgttgcagttgatggatccacagcatatttccctggttttgatgaagacgaagaggaaggggaagaggaagcaggggaaacaagaagaggggaaacaacaacatgggatggttttgagaacagtcccatgagcaccaacagcaggaagagagggagcagcagctgtgatgtttccacagcttcaagtcctggaaaaaaaaagcaagagcccagtggtgaagctcatgaagggcctgctcaattctttctcctctgagaatgataagtcaactaccctcattactgaacttgttaacaacaagaagttaaaggactagaagaaagaagacatgattgaatcattgacgcattgtcaaaagttggcagttgagtgtggtgtagcagaagatagtgtggaatacttctgtgcaacatagctatttgctctcaaacacaagaaagtgatgtttgagaacattagcactaatgaagcaagattactgtggttgaagagatggtgtcatcagaagaatttgtattagaggaggtctttattagttaatcttagctgtaggtctttcttagctgcatttagttaatcttagctgcattagaggaggtttttttgtcgacccctggttttgtacactggaaacctcatgtgattacaataccattccctggatcagtagatggtatacacatgacaacattgtatatcacaagttgacatcgttatacaggctttacaatacatcaataatataagggttgcccgagtggcacccgaatagaccaagcatggtcatctacaaagaccaaaaatcctaagaagtagatatggtagcggaagcaaagcagcgacggtccatcttattcaacaggcagcgactggtgaacctaggtccctactccaccgtcttcgacatctcttcatcagcatggcacacgtacagatcgctccgacttctccttctaaaagatttaattaagcaagggtgagtaccaaccgtactcagcaagccaccgctacagaatgcatatagtgctcacaggaattcaaggatggcttggttcgtttgcataaagctagatttcacaaatcatttcacaaacctatgacttagcagttttaactgaaaaaaacaacgttattgttgaagttgttgttaattcgcaagggttcatccaccttccccaagcctcgcttggtccggtttaccctcacaaccagttttcccacattctccatcgctacgaccttcccattcatcgggcaaggtcacacctctttccctaatctaagcaaaattaaaaatctatgaggctagtcaagaatagtacaagtcccggtgctcattaaccgcgagcatgtctattcgaatatattagttttactcacactgcagtggatgtacgcttttaatcccgcactccatgacttgcccaacacatgagcctaatcccaacacatgagacttgtcacggcccggtttttcagtcaccctcgcattgcggcacctgctccaaggactatgaatccccattgcactcccgacatagcacaccccctcgagccggcagtgaggggtcctggcgctcccgagattctagggctataccatatctgatcatatacttaggtgtattttaggtttttgccgcggcattcaaacgatcgatccaattgatccatctcaaacgatcgatccaatcgatccatcacacttccgtcacaattgtcaccacttcagaatcatcatgactggggtgccgccccacaaggatttcttagtccgccgggtctatacccattcgagaaatgcggtcgtactcgtttcgtttcctgcatagcttcttgactcggtccttaattgaccggggtcggtgacttgccgtttctagaaccacccatattctattcatgtcaccccagtcgaaatcattttgttttatttggtttttgtaggctttctccgaaggagtattctttgtgggcccacctgtcagtggcttcaggctcttggggcacggtagactgagtctacggagcgcgcgacatggggaggtggtagggagggctcatggtccacgaaagttgcgtgtggggcccgatgatcagtgggatggttcacacgaacagggtgcatgtgaggtgagaggaccgtggtggaggaggtccacgggtccagcccctttggtggactgggtggtggggccaaccgatcagtggctccagggtggtggactgggcgcacggtcgactgggaagagcgggtcccacatgtaagtggttcaagggttaaaaggggattagatagaggtttaacctggtcgggcccacctctcagtgcgattagaagggtttacaaaggggattactatgcggattaggttaacaaaacgtggggcccacttgtcggtgtctcttctctcttcctattcttttcttctcctcggttcttcctcctctcattctctcttctttctctctctctctctctctctcgatacttcctcctctgctttctttctccaagtgcgcctgagggagagagaggggagggccggcgggcggcggtcaggtgaaggcggcgtagcgcggcggtgcggccgaggtgcgacgcggcttggcggcggccgggcgcggcggccaaggcgatgggcacacggcgttcgggccgcacggcgtcgagcacacccaaggtgctcgtccgtgtgtctcggactagcggcgttcgcaagatagcggcgattggaggggcggaagaggaggacgacggaggaggagcgatattcatagccattgcttaagagggaagggcaggacgccgatgcgagatgggcgaagagcggctggtgagcctggactataatggcgatgaaacaatgataaagtttttttatcagactaataatgtgagatcttattgtaaagatttgattacaatgaatataacggtataatcagatcataaattggattgatggttttgaaggaaaatcatttggaagaatcataatatgcatgctatcaacaagtaatcgagcgagcccacattcccatcctctctctcatgactctgttggtgagtaggattgggcctaatcagatttcatgtcgatgggcgtccgattgttcttgcgtctgacatgaagcattatcgaacttgcattgtcctccagttgccgccatataactcctaaagtatttcatggcaatggcggtctcctccagttgtcaaatggtgtagggctcat

SEQ ID NO: 66866 - DNA, 3017 bp, Oryza sativa
accgcgagccgtgaggctgcgtgtgggcccgccgcatccgcgtccaccgcgaaccacgcgcatgcaccgcgccccgctccacaccctagcgccgcgccgcgtgctccctccgcacggtgagccgagccgctgacaagcaggtcccaccccggaccacgcaagatggactcggtccaccggcggcctctctctcccctccccgcgccctattgggccgtgtcctcttgggccggccggcccatttaactcggccgagccgccccttttctctcgggccgcgccctagccgcccgagggaagtctacttcccctccctcttccttttctttttccaaaagggtttaattaaatcctttttcctttagaccaaaaatccaataatcttagaaattcaatatcttcccaactgtaaatccgtttgactccgttcaacttccaaaattcctcaaatctcgagatctatctaatggcacgcttagaggtcattaatagggctttattttcgccgtttgttgagttgtcccgttttgcgtgtagtttcggagcccgaagaccggcagtgcgaggatttcgaggatcaagctcaagatcttgagcaaggcaagccacctttgaacatcttgagcctatatttgaacttaattatgttgcttgaaaaatattatgcattgataggattgcacttagtctgtttgtcccgtctgcaaggcagattggcggacctacctaatttgttgcatttgatccttccattgttaattgttatatcatgttcccttgtaaccacctagttgcgcctcgatattcgtgcactctatgcgagtatcgacggtcgccttcaaacttaaaatctgagtaacttctcgggtaaaacttgggttttacaaaagacttggaaaacccgacacctgggtcggtgcttgcgaactaaatgaatttcaaacaccgcggaccggggaacgtaccgggtgtacggtttcccgctcttgcactaaggaccgtttccttggaatttcatccgaacataagacaagtactaccacatgggtggaatgggacacccctggctgagtaactagcttatcgggggagccttgatgccgagagacatgtggattcaacggggtggtgccggggaggacccctgggcttcctggcatatgatggctgggacctaacctgatgttggtctgggacccctcttattgacatatggtgaacctgtgtcggcttttaaaatgtctcggcatgaaagcctcaaggtctccagacgtggccgttctgtacgggctgggtgatccgggttagtaatgtcgtgtgggtaaagtgtaccccctctgcagaggttattaaactgttcgaacagccgtgcccacggtcatgggcagatgtgaggtgattcctagcgtagttttgtttgactactactttgtgaaattgctgttgtggaatgggatcgatgtttagaaaatctgcggctgatgggatcagctaggcccgggtggccatttgaaagctgttggccgggtgccaaccttgatcaattcaaagactgatacactgcacatactccgaccggacgagacgcactgtctcattcgtgtcgtttgagaagcactcgcttagttgtttcaaaaaggagtttaaataaaatcaattgcaaaaacaacagcctttcctttgaagcctgcattaaacacttaattcccatggcttgctgagtactcctatactcacccttgctctatataaataatacccccctccagttgctggagaagatggagtggatcccgctgatgaggagttcttccaggagtaagtcagctatgatgagttttagggtttcggtctattcccaagtcacgcatgtgatgattggtctaagtcttggcttccgctttcgcttttgtaatgcagttgtgagctcgggatctgtccgcagcccaacatgactgtactcctactctgtaataaagagacctctgttgctgtgatattctgtcttcctgtgataccagcactgtttcctaggactggtatcgattaacaggttaatttagagtgtcacgagctagttccgttcgggactagttcggggcgtgacacaataattgttggtcaaatacttttgtagttgaatcttgaaatatgtcacgccttatattatgggatagagagggtagaggcttatttttaaatttttattagaggaaggttcaatttttttaaaaaaatatagataccaatatcactgacgtttgaatggtacgttcgttcaccatggtgctgtttcgatggtttctgataatttcctacctggctagctccatgcatgaacagattcagtcttttttcttttggatggaaacgttaatgaatattgaaatggagatgatgactccatgaaggctcaaatggctcatatttacactgtcaacacctattgactttgattaaaaaaaacgcctatttgacattggtgatctgatcctggttttaaactttttatacaaaccatacatcgagagcctggagttgcatggattgtgttgtgtaatctcgaggaagaagataaccatggtcattaatccactcattaatccactcactaacagtagcataatcatgggaaggctggcgccaatgcaactgctcgtgctctgcttgatctccgtgacgacgtgcgccgccgcgcacggcctccggcgaggtctagaccagcaaggcatgcgcggccggatcctcgccgacgcgacggcggcgccgccaggaggcgcggtcgtgcccctgcactggtccggtgctcactacgtggcgaacttcaccatcggcacgccgccgcaggccgtgtcggggatcgtcgacctctccggcgagctcgtctggacgcagtgcgcggcgtgcaggagcagcgggtgcttcaagcaggaactccccgtgttcgacccgtccgcgtcgaacacctaccgggcggagcagtgcggctcccccgctctgcaagtccatcccgacgc

SEQ ID NO: 66867 - DNA, 15814 bp, Oryza sativa
aaaagtttgtagcagctactccaccaaccatctcaacactatttctctcatcgaagaaaagtagctataattagttgagtgattttagggcgtgtacagtaatgattaataggggctctttagctttgctaaagaggaatgtttgctgatatggaagagaaagaaagaggagagataaaatattgttgatgtgagtaacaatggctcaacatagaatgtttgctggcacggaagagagagaaaaaggagagataaaatatcgttactatgagtaacaatggctcaacatcgactcatagcctttataaaatggaaacatagttgcatgagggtgggaaaaaaagaagaataagaaaaaaataattttgagttaatgattaaaacctttatcgtcttaactattgtatagacacggtctctaaataatcttgtaacgtctaagataccatactagactcacattgatacttgttggtattagaggtaccaagatttacataagaaacatggtaccctctatatgactatcagagactataaaatttgtctaattaattgataggagtagaagaaatgcttcgatcaaagagttctaccagtgcatgtgcatgctattctacaacatcatgcgtgtgaaaaatacaccatggcttggttgacgagacctataattcccatcagccaaaaggacagaggaaccagcctgatgaattattcctgatgctgcctccatttcctattcaagtttgcacaacagcgatcatccatatgcatcccatcattcacgtctttttccctgccaatatgcaacttaatttattggacaaaatgaagttcaatgttgtgctcgctcataatgtggaaatgcacacacatataacttgatttgatttcaggtgcttgaaaaaacagcatcttaggtactaggagttaccaaaatttacgagagaagatttggtacctgcaaattcttattaaaaaacataaacatatagagagagagagagagtgtgtgtgtgttttgtagattgctatttttcactggaatgatgagcaaaggtaattaatttacagtttagtgtaacgacattggataaggacctattgagtttggaaccatggtttgatcccggcaaatgctccaacactagctaggctgaaattctttgtacatagaattccttgcactggtggagaaaccgtttgtagtcccggttggtaaccccctttagtcccggttgtccaaccgggactatgaatccgggactaaagatagctctatctttagtcccgggtgaaataaccgggactaaagatcgatctttagtcccagttcgtgttaccaaccgggactaaagatcggtcagtcacgtggccggctaaaccatttttagtcccggtttgtgttacaagtggaaatgaatagtcctggatgcagaatactccttctgattcttacacttattgcatggacaacaaataaaacccttttgcctgttagctttggccactctcaaaaaataatgcacgccgttagtaaactctttggaccgcaacagtcagcgtacatccattgccgatccatctacatgacatgaaaaaaaaatcgtacacaaataattattcgtgcaataatgacagtcatacaataattataaaataattacaaactctttcaacaatgacacaataatgacatatcattattcatacaaaaattatgaaatattacaccaaataattcttatttactatttataaagttttaaactaatattaatgtgttgtacttattttaatttttcattttagtttgttttctattattcaagattaactttcactatattttccttctcaactattttataaaaccttctttagcaaataaactaaatttctatatattctttcttccccacacaaattttctctctcatcaactaacaacaaaattttgaagacaaaaaagtgtgtaaaacatagctccaaatgtaatatgaccaaaaaaaaacattggaggatgaagttgctaaccttttaggcacctccgatttgtataaaatcaccaaaataaattcactagaaattttggcatgacctcccctcttttttgaagaaattttgaagcttgctcgggcagctggagtagaaagaaaacatatatataggggtgggactttagtcctggttggtgttatgaaccggggctaaagatcgctaaagtttagtcccggttggtattaccaaccgggactaaagatcaaatatgtccgttaccctttttaaccgggactaaagatcatctttagtcccattttttttgcaaccgggactattgtggaattaggccgaccgacgaaagatggtttctctaccagtgttggtaatactacaatgcaaccaggttaatatatatagctgcatatatatgtttagcatgcttgatcgagatcataaaaactctctctaaacaattaattatgctcgaatcgatatgctaagctgtaagggatgcctctcgcgatcggtatacttgctcgagcagctcacatggcgcgtctccccttgttcctcagatcagttcgctaatctggctagcagagcaatttgcacaaaagatataggccgtgtttagtttcaaaataattcttcaaactttcgacttttccatcacatcaaaactttcctacacacataaatttccaacttttccgtcacatcgttctaatttcaaccaaacttccaattctagtgtgaactaaacacagccgcaggaaccgtgggactgcgattcaatggtatcaagaggaattgccgcacgatgtgttgtggcctcttgtcatcaaagaattagcacattgcaggccgctagttcatcaagatttatgtgggtgagtgtaggatcgaatcacaagaactaagccaaccagaggggggtgaatggttgatatacccaaaaacccaaacttttagcggaaataaaagttaccctcaaattcgatgtagatcggtctaaccgaggttgatccgccggtctgaccgagctcgtgccgccggtctgaccggtgttgatccgccggtccaaccgcctgaagattgcctgccgcgtgtgaagtcgccgccggtctgaccgcctctcctccatcggtctgaccgccgcctgccgccggtctgaccgccggtatgtcgccggttagactgccgaaacccgatgaaacacaaatcgaagaactctcaaagtagataacaactttattacttctctctgtgtttacaaagtgcaccaacagcactccttacaaaaatctcgactaaactcgaaaccctaactaaactagcaactcaattgctctcaaaagcgataccgggaagcctcacgctccccctctatttatacatgaggtaggcagcctaaagccatgaactaaactcatactaagtgtcctaaacaccttaggaaaccctctagtacaagacacaaactttacataaccaattgtaccaaatttggactccttccaaattcgactccgcatcccatacgcacacaatacctccatcgtatgccatatggaatcttcaccaaccacgtgcatcaactctagccttagtatcccgcatgatatctgaccaccacggacattgtcttaccaccaagccgactcccggtccatcaccgcaaatactctcccgaggcatcgggtcacctacacatgaaataaacaaagaaaacatattctaagaccaagctatccccaacttgactcattgttagcaaacaacagtattacatacgtatagtatccatctagaagctataaccatgaaacaatcacagatatccaaagaaacaacccgaaaccgaaaccgacacagcgtcggccggtcagaccgcgggccggctggtctgaccgctcgatcaccaccggtctgaccggcatacaccacccggtcggaccggtcacataaaataacagtgaattcgatcatcacctgaaaattgattatctcaaaaccactttcgacgataatctccaaatatcaaaaccaataatcatagatgccaattgttcatcacagaataagaatcaaaacacactttaatcttacagtgagtaggcatcaaactcccgttgcctccctgtcctattggggatggttgtatgtacatctggaatgatatatatacttgttcaagttgagttgttgtcgctgtgctcttcctccggttggcaggctgattactgttcaacatgggagattatcattatatatccttgtcatgacaaagtataacactgaaaggtgcatgcaacacgctcacaggctctacccgttctgtttaacatgacacacctaagccatatatagcacatctaccacaatggttgtgaagatgtaatgaaattttcattaggaaggttgataccacctgctagtacctcgtcaagtaccatgaaatcacgctaatataatggtgtggtcttattaaatgttagaccatacaggaaacctgaataaagcgaagaaaacaaaaacaatagcatcaatcgagagcaattacatattttagtattgcctatcttttgaactccagttcttagtactggctgcttaataaggttgtaatttaggtgaaattttaagttaaatatctacatgtagtcataactatttttcttctcacaactattctcagaaaaattctaaaactttcgatgaagttcatgttcagattgttttaatatatatatatatatatacatgtggggccacaccaatagaggatgaagttgctagccttttacaattatgaagtactctttttttttctaaaattatgaagtactcttattttctctacaaatttattctctcctctttttccataacccttttgtaaaagaatgacatatagaccatacatcaatacaggatgaagttgctaaccttttatatccttttgatttgtgtaatatcaccaaaatactttcacaaaaaatttgagcagcaactctcttcctcctcctcctcttggcagcaatgtctcgggctggagaaggaagaaggcatataaaaaaatgaacaacaccaaccggtactaaagattatatgtactaaatatcaatataatctttagtaccagttggcgacatcaaccagtactaaagattgattttagtccctattcaacattgtcagaccgtgttgtactaaagattgtatagtaccgttggtgttatcgaccagtattaaagaacatctttagtaccgtttggtaatagatccgagaaatttgtgttttttgataccacgatgaaagatcagatctcaattagtgtggccttatgtgtctaacttgtgttatctagaaacaattggttgcaaaagtgtttttttggtccaatttgagactcttgtagtgcatccattttaattttcttcacacactaagaattccatgtcatttctacttgccacgaattgtatttagatgtatagagtcaaaatatggtataacagccctcttggctgctgcagttgttcttctccaagaaaaatcatggtcgccgcaaggaagagaataattacacttccacaaagaacatcacattgttatctcaccaagtgtatctagttcctcatggctctctgcaggttatctcgccaatctcaaagtgaattcatccgccatgaaggaagaatagccgatcagtattcctgatgtctccgattcctaccctaccctgagtttacacacgcgtacaacatgctctgattcgcctccttgtttgtctccctttttctcttttcacgctacttcatatatatgagaggacggaatttcatattggcctcgctcataatgtgcatacacaagtgggtgcaatttattgctgggtgtagatacgtaaataatgcactagcgcatggcctacaatataaataatccaccagctatctccaaacccttgctccatcagcaaagtgaattcatggctgaacatcacgtccaatataattggcatgcacaaaaaatgtaagcgtgattggcttgctaattaagttcacatgactgcctgtggcctccgttagtatgctttttttttcttacaaaaatacagagcatgcttcactgaaattataggtaagagaacttgaacacgtaaagatcaagagcaagaaaatgttagtccaatacacagctgagacaaatatgggtttgtccctgtcgtagtgcactgtttgttgtgaatttttgcatgtatatcattgccctattgcgtccattactacacatattcgatggtagacacacttgacttagatcaagattaatggttgtgtttcatattataatccacaaggatttcaaattttaaacttgatttttcagaataatcttagctaaatatcttttacttgtcaatcgtgaaaaaatatctaggcaaagagttatgaagaaaactaaaattattcttaaaataaaattttgaaatcttacgattatagcaaagactcaacaaatagatcatcttagcttgacagtcgacattacacccatggatgaatgttgcgatgttcttttatccatgggaacaccttgttcgaaaaagcaatgattgatatatctttgacatgtatacccctagtatctttcaagtaccataaaaaatccgagtattaaagagtattggcacacttaattctaattgtcttttttgcaaaaaaaaaaacatatcaaccaaaatcattatgtgcatcagtatgcttgtctatgtactcctcgaacgaatgcatcaccagtatctacattactgggtcgagtacaacacaaacaggttgatctggataatagacacacttgaactagatcatgtttgtttgaaaaaaaaagagtgaaaggtctagaggataggcacataaggaagaaaagtgcaaaaagaaaaaaaatgacaatagaatggtaggagaggaagttttacgagaccaaaaaggcattatgatcaacttagaaggataaataataagaaattatttcaaaactccacactcagttgtgctcaagtggatagtcgtaagctagacaagcatatccaggcgagatgtttctgcttggatagcagttctctcatcttagcagccataagatacatgagagccgtagaattaactccagcgggatggtagtaggaagaggtactgcacacgacgtgatgtagcttcttcacgttagagaattgttatcttgcacactgctaccacacttcacccatatttggcttcatggctacgaatggaacttccggtgcctccctctcctatcaggcatggatgtgtactacacatcgagaaagatactagcttgttatgttcatctttcctagagttcaacaggagagattgcctgactagtgtttgaggaactacaccacactgaaacggcgaacgctacatatgtatctgctcaattatatctacacttctcatcatgaaacataagctatggtactattggtacatctagtactccaacaggcccaccatcgtatctcaacaccttcaattttgatttttcgagtaaattagtttgctactcctaattgatagtaatcttgaatggcagtcatcttatacatattgcatgttagtccataaaggaaggcacatggggtgaaagaaataacattaaaaaaatggcatcaagtcaaagcaattgcatgtttgcatatagcatctagtctatatagactgaatttaaacgaattctagtacctagtacaagtctcacaatgtcataaggctggcatttttagttttgagaaatatagtacaagtgcaggcactcacaatgcgtgaacactcacccctatgaatgcacgcgtgtacaccctacccctatgagcatctttggaatactagaccgacatatcttgagattgacgaagtcaccacggctgtctcgttatcgacaggtacgtctcgcctaccagtgaaaaaataattagttgtaaatacgagcacccatatcaagtctagaacttgaacccagttgggttgtttccatcataaggaatcaaccagttgagcaacgctcacttcatcataagactgaaatttgaagttcaatatctagttcttttatgtaccttctcacaaccattctaaaaaattctaaacttcgacgaatgtttaagtttaaattatttataactatattcgtctttttccttcctagctagtgttctctagacaaaaaaaatgttaacaaaaaggccttcgctttcctatttcggggcctaacgcatctagggatgtcaaggggaccctgttccctggtccctggcagggataaggatgggcatgtttcaatcaccatttggctactaacgggaaattctctctcaatcggattagagactttgatgtgtttgggccatccaaataagaaacttacatattaaacatctctaccctccccattctattatttatacttttctgtagctgccaccaagtgacctagcatgagcatgcatggctgagtcgcggttgatcagagcaaaattcactatcagattgcttggtttgctagccgatcgacattgtcctggacggtatccgaaagtgtgatcttgtttggttaatttgctcctcgtgaagcgaaggggatggccgagtgccttatcagaaaataccgtgagtcatcgccatggactaggacgatatggtggaactccgaaccgtccacctccaagaagtgtgtcatcatcagcattaggatgaataaatgaggtggaagggacggtgacttccatagaatggcaggcaagagatacaatattagagcttgtacaatgattgttgatggtggtctcttagcgtagctaattaataatatttgtttatatgaaagagagagaaagaggaaagacaaaacatcgttgctaaagaatagtaataaaaggaatattttttatacaatggttagagtctttatcgtctcaactgttgcaaaaatatgatctctaaataaacttaaaatgtttaagagatcatacttgtctctaccattaatcatgcccttagttgtatatgataacatcttagatggaagtagtaagacaaactacacgccctgatacgactctttcacagcagacaatcattgtcctgctctggcttgtaacacgtccaaacagtcctaatgtcagtaacctcgaattgaattctggtgcctccctttcttatcgagaccagtacatatacatataagctagaatgattcttttatcattgccatctccctccaatccagctgatacttagaatatgattgtttcgaggactatatgtagcactgcaatagatatgctacatgctgagatgcctctatcctatcagctattcataaaactagtggatgttttttttgcgaaacaaccctcgtcttccccattttacaacccaatccctatccgcgattttttctctccgaacactgttcgtggggggcctatatctaattacaaaaaatcggagggctttttcacaaaatttaatctgacgtggcagcgcccagcgtccgccccaagcgccatcctttatagtctctaatgtactccaatggttcaaccgtctacaacaccatcaattaatttgattcgtggagtaaattttcttctcctagatcccaacaagaaggaaatcttgaatggcagtcttataaatgttagttcatattttcgaaacgacaaatatggaacaaaaaacatcaactaactgacattagctagctgagaacaattaaatatttttatatttcctagagtaatttggactttagtgctggagacgccgactggaggaggcaagagtggaggggctgattgtgatgggacttattggcttgagggtgtgtttagttcacgccaaaattgaaagtttgattaaaattaaaatgatgtgatgaaaaaattgaaagtttgaagaaaaatttagacactaaaccagacctgatttggaaccgactggttgttggaatacttctctttgtgttcgcctaggtgaaagtgatcgatcgatcagtagcagtgcctcagacaggggggattcctcgatgtgccatatgcactagagctgcgcatgtacttgtatataataccaatctcaccgggatcctcgatcgatctcgcaagctaattaattaaccgatcacactctcgctcaaacacaagattgacatgcaaccagatgaacacagtaacacatgcacgcaaggtgtttgatgatttgatgctgctgctaaccttgccgcagcttttctgcatgtacgtattcgttgcctgcagtccacgcacactacaagcacatgacccatctggattagcgtgtacacatatgtgccatcgatcccatatatactctttccgttcttaaaaaaaagtccaaccctagctagtatgcactactacagagataatattatggcgtgtgacccggacgtgctgacgctatcacaacgtgaacgtgcaggcctcggtgtgcagaaaatgctctggcacgctcagcaagggagcagccgagctcagctaaacaagctcgaaaatggctaactaagcttaacagacaggaaagcaaaactaacttaaccaacacacacgcccatagggctatcgacggactctgtactaactaagctcccggtgcttccttttcctggttgtttttgtatatcatgctactaggatgagtactgaggccaccactgtttgtcattctcatcttccatgagtctggctgttttgagggtaatatatactccatgcatcctataatataataatctagaattgtaggtatgagacatttcaaatacaactaatctggacggttgttatattatgtaacggagggagtatatatacagtactttctcggttatttttattataacatttgacaccattcatcattttgtgcaaacatgtaaaatataagtaatgcttaaaactcctttagtgataaatcaagaaaaaaaataaattttcttaatttttatttaataagatgaaagttcaaatataattaaaaatttgacgacgttatatattaaaaaatagaggtagtatataagaccggcaatatagcagcctagcaggtcatatatgctcacaagtatctgtgctgttttttttccagccttagcacatctactccaccaaccatctcaacactatatattcatcactggaggaaacttgctagtagtcaatatggaaacggttgaatagcaaattcttatcaattctagtatatagatcaagacagaagaagtatgaaaacaacatgcaagtagggaagagtgaggctaggtagatccatacctcgaggtatctaaactttatactagattttttaaaatttaggtatctctaagtaagtatatagagtacaaaattttacactagaaaatatagtacattattccggtacattcttaagaatagtaaaattattctttttagataatggaattcattcaggcctttacatcagataagttatacccaattattgcaaagactaattaacttgtgaattacaaaattacaacttgatcattcatacccgaccataagccaaaaggacagaagagaaccggcctgaattatttttggatgcctccatttcctactcgagtttagtttgcacagctagcagccacatcctatcattcacaacattttgtttccccacatgtatgcagtttaacttatattggcctcgctcatattgtggaaactcatatgcacatatgcttgcagcttgctatatatttatcactagaaagatgagcgggtataattaatttagattagagcttaattacttaaggtatggacaataagcaaaattgagtttctcgactagctaacataaccctgtcaaaagaaaaggattgctttatttggtcgctacataaaatggcaatttttcggtcaaattaatccatgtataatgcgatcatcaattccaatggaagaatccataagaggatcttatgggaggtaaaggtaccactaaaaatcaaagcatttatgtggtttcttcaaaaaaaaagtaattttgacgaaatataacctcataaagagaaaatagagggaaaacaagcaatgttgttttttaatacacaagaaaccatccaacatttttttctttgactgtcatgttgcatgttttgcttggcgatgtgtcttctttgccttcaatattccctctccccacaatgcaaaagatatttttggtaactggctaaggggagtgcctagacccacaaaaaaatgattttatttggagctagtgctctatgttggtcaatttggcgttgccgtaatgatatggtttttaaccataaaaaaatgcctaacatcatgcaggctatcttcatgtgttccaattggctccactcttggtgtatgatgctttcacaggaacaacaagatactatgtgcaatggtgctacacgcttggaattggtagccaaggaacttttactcaagtttggatggcgtagtacctacagaatttcgtgatagaatctacataattttaaaaaacattattttagtagatcatattatctgcagaagttgggagtttgtcccatctcgccttttttaagctcttttctattcacttctggactttttggctgtgtgcctacggacagaggccagatatgtaacccattttcattatctagacatggtttgatatcccgcaaatgcaatgcactagcttaaatggtttggcttaaaattcttttgtaatactacctgtcatacaatacaattaaacatgttaatatgttatatatagccgtcgttagttcattggtacgttcggttgcttggggcagtgaaaaactctacacagtttagctcaaatggatacgatcgataaatgtaagctagggatgcctctcctgcaggtagctttgatgctttcttgaacagatcgcgtggaaaaactctcgcactaattaacagaactagaacctacggcgcgcttcgcggtgcccttgctgtgtaaatgaggaaaataaataaggaggccctgaagagcctattcagtggattggctgtagcaccgctagctatagcattcaggttgtgaggaaaaccattgatggattaagtagacataaaatacatagaccgaatgttaacattgtttgtggagaacaatgcataatctagagtacattatacatcacagatacaaccattggaactaacatcgataaataggcaggaaattatggggtagattggtgagggccacgcctgcgaaattcgagaggaagacggcgtggaagcgtggctgggggaccaccctagaggtgtgaggcaaattctaagcagcagcgccggcgcagcatccacgatcccccctgcacacgcacacacattcagaacagtaggcagggagcataaatcagggcagcagattacctagtgttggccattgatgtaagagcgaaaaggggaaagatgagagaagagccaagaaaacaaccgaagcaacgcagctgtttgaatggcctcaatctctactaacgaatcaggtaagaggaacgataggaaaggctagggccatgccagatgcattaatgcctgcgcgcatgccggtacggctcgtgcgtaggacgatttgatgtggcctgacgaggcacgtcagacactgtagcacgcggcgcttagaaaaacatggcacgatagactcacagcctcttggatacgcataacacatggtatatgggacaacccacaaaaccgaccccacctgtcattggctctacaacgaataggtgcatgtccatcatttatccaatgtaataaccagtaggtaatttgcccaatcctttcgttgcactggatgaacgtgctcctagcgcacaaaacacaggcagagaggagcactcgtgtgaccagggattacggtggaccagacgttggtaggagaatcatgaagaaacgtgcctgcctcgcactgtcgcacatagtgacatcgcatagagaaacatgaggctatgctgggtaaacgtgggggtgcaccaaaagtcaaggctgtcaggcagggagagagctacataggccaagcgcagcatggaccaaggtgatttccaggtgggccatagagcgttaggaccgatggcacacacgcacccaaccacatgcccacggtgaaccgcacaaaggatccaaggcatcacaggatgaactataaacaccacctaattaaaccgacaaatcaaacgtgatatattcatcgtattaatcacataggtaatatgttctgtgtagcaacacgaaagacacatgctaaactttggtggcagcatgccacagaattactgggcaaattcctatcgccagcagaaaatgatgtgctattttttgttacagaaaactaatctgttattgcctctcttttttctggaaaatgaatctccatatcgaatctaccatgtgctctgagaagcaacataccatagtttttttaatggctatctaatttgaccatgcaaaaatctgcataattcaaggtaagaacagagagaacagataagagctgcagttacaacaggctgtgtatgtggaggaatgatataattcaaggtccaaatattagcaggatctcaaggtctaaatattagcaggatccaggatcactaagtagaaataaacacacacggagtttctgtttacagtggcgctataccagattctggataggaattttcctaccaatatatcacccctgtcctaagcacatatccagttatacatgcttgcttaataggaaactaatctggataggaattttcctaccaatatatcacctctgtcctaagcacatatccagttatacatgcttgcttaatagaaaactaatctgcatattgagtgttatttttttgctgtagtaaataaatctgcatattgaatttaccatctgttctgagaagcaacatgattcataggcacaaatggatggggatctaggacagaagccctgatgtacttgtctagaacactaacttctttcaaaaaccagtcagtattgtgattttttttatcaaacagtcaacatgcttgtatagaacactaagggtgtgtttggttcctggtcaagattggatgggatacggtggtccatattttgctggatatggcggtccatttttttgtttggttgtctgaatatggcgattcaattttttgtttggttgtagggacaaaggtggatttggtgatccaattttttgtttggttggaggaagtatggtggatttgtaggtgtggtcgcctctcacttgagatggtgaatataacccatcaaattaatacataatacacattccattataaatacacactccattataaatacacattccattataaatacacatagaaaaaagaaaaaagaaaaaagaaaaagaaaaaagaaaaaaaaaagcagcgccagatctgggctcgccgacgccgctggcagcctcctcccgccggcttcctcccgccgccggccgcctcctcccaccaccgaggctcgcctcctcccgccgccgccttcctctctcgtcacccgcgccagctgccgagctcgtcacctctctcgtcggccgccacgctcgtcgaccgcgccggccgccgagctggtcgcctctctcgccggccaccgcgctcgttgcccgcgccggccgcctcctcccaccaccgaggctcgcctcctcccgccgccg

SEQ ID NO: 66868 - DNA, 8066 bp, Oryza sativa
aaaaatagaagaagttcatttgtggttcttcatttttttcaaagcattataacaattatagtatttgaatatgtttaattcaaagcaaacttaaaagaaggtagtttcattcttttttaattaaataatttttaaatgatgtttgtattattaaaattagcaattaagctctgaaaattccaataaaattttaacgagtgtaactaatcatggagaatttaaaaaaattaaatttaaccatgtcattttatttctcacacttgctttacttgtaaatttatttaattatacacatacctacttaaaaataccaaatatttcagcgaatttgtattttaattaattgcatatttttctgatctgtacgcttcccgttgcaacgcacaggcacttttgctaaaccaaacaacactgggccgaagaaaaatagaagaagttcatttttggttcttcattttttcaaagcattataacaattatagttattgaatatgtttaattcgaagcaaacctaaaaggaagtagtttctttcttttttaattaaataattgttaaatgatgtttgtattattaaaattagcaattaagctttgaaaattccaataaaattttaaagagtgtaactaatcatggagaatttaaaaaaaataaatttaaccatgtcattttatttttcacacttgctttacttgtaaatttatttaattatacacatacatacttaaaaataccaaatatttcagcgaatttatattttaattacttgcttatttttctgatctgtatgcttcccgttgcaacgcacaggcacttttgctaaaccaaacaacacttttggtcaatatacacactccgtaatcacccggtgcaacgcacatgcacttttgctagtataactaaatgaatgtaggcaagaagacgccacatgcacatacgtatggtatttatcaagattctatggtatttatcaagattcacgaacacaactgtttacacccaaatttggcacgtaggttcaaattaagcaaaattaccaagatttgggaaaatcgccgatttcctccacagggctggtatgatcgctgtttgtgggctggtcagacagttacttgaaggccggtcagaccggcgtcatgtggtcggtcagaccagcagagtccgagactgagtctgttttcgtcgggtctcaggattccttactcggcaggctatgtttcgggtttcctttgctttctatcctgaattggacatggagatggaagcaaagtatttagttgtccgatcgtgcgtgtccacttgtcaaaaagttgtcaacataaacatcacaacataataattaaccactccaattaaaaagtagggctcagtagtaagcaccaccattttagtctgtttggttcaagaaattagagattattcatcaaattagttgagataactccatttcttatttcttcgggcagagtttgtgccggcccccacgtcaccataaggttcgggcgacatgggcagtgttctctcgccccgctgccacccccacctcgctgccaccagaacaagccatcaaaatccgcatagctacaaggacggcggtgacgggccttcccttccccctgagactttgaggtcgaagcccacggcccagatgcggggcggcgctagccgcaatggcgacaggtgggaggtggtgcacggtgccaacggcgacaaatgagggggtggtgatgagggttggtcggacggccgtggcaagaagggtccgacaacggtggcaagaaggatcggttaggtggggttgtggcagtgggaggtggacagtggtgaatctaaatgtaaattgaggtgtggttgtgtaaaagttatattatgactcaaataaactagaaatatatcgacgaaattagttttcaatgaaatccaaaaaccatatgatcggaagagaacacaattctttctccattatatataaataaataggtaataagtatggtccgcacagagtgatccacgaataaaatctatattgccttgtcttgctcaaaacaactattggtatggtctgctttagctagtgaggtagcttgccttgcctcaaaccagtttttcattgattaatggttaattatatgtgttaatggctaattaggtgcatgaattggaggtggggatggcgccctaaccagccccaacagtgaatccgccactggttcaggtggaggcggccagcagcctcgccacaccaattgcggggtcgacagcggcagccaacgacatcgacgagggatggattgcccggtgcggcggctcttgagcagtgggctttgtcgctggcctggcacggccggggtgcaggtggtgccatcgcgcaggggtcagaggctcgagcgtgtagatacagtactgatcactgaatactgtcagtgttaatactagaagggataccatcatctcaatcggacggtaaaccccatctcaattggacacggcgtccatcacaggctagaagtcacagatgtgaagagttatcttaatcgggcaaacggccgtcacggatgaatctatctcaatcgggccctaattaaacgccgtcaccgatagctttgacccagacgatcagtcaaactatagcccgtcacggatgacctatctcaatcgggccacaactagcgcccgtcacagatgacccttatctgtgacgggcattaactatagcccgtcacagatgagtcatctgtgatgggcattaaatatggcccgtcacagatgacactcatttcaatcgggcctaagttaatgctcgtcacagatgagtataatccaaaaaaactaaattttattttttggctagtcttaggcctcctaggccagtctttttttttgtcctcacttgaaattcaaacttcccgattggtcacccatcctaaaattgctccaaaccaagtagttgtaacttgttggtataagtattctattaatcttattaagccctaggccaggatgtcaaattggggttattaaatgatttcaaatggaaaagtcaccaaaaccaaagttgtagaactcatcgaggtgcaaaatttttattttgatcatttctccatatggctctatttaaacaatttgaaatttaaaattcaaagtttgaaaagttcaaatagaattttagatcagtctaaaaactgaaaaagtcataaacaacaaagttgtataactcatcaatatctgtaacttttattttggtcatttttctatataacattttttgaaccgtttgaatttgaatttgaaaatatgacaacttcaaacaatattttcaaatactaaacgatatcaactgaaaaagtcatcaacaacaaaattgaataactcatcaagatctaaaacttttattttagtcatttcttcatacgataaagtgatagtaacattgttcacaaaattgacatatctcttatctggttttataaattataacacatatatgtaaaatttgtgaataatattactaacattttgtcggatgaagaaataacaaaagtaaaagttttagatcttgatgagttattcaactttgttgttgatgactttttcaattgaaatcattcagtatttgaaaatgttgtttgaatttgttatattttcaaattcaaattcaaactattcaaaaaaaatattatatagaaaaatgaccaaactaaaagttgtaaatcttgataagttatacaactttattattgacattttttccatttgaaatcatttactacccgtaaaattattttgactcataaaatgaattattatactggacttaattattttgctatagttcaacttacaaatataaaaatttcatataaaaaatgaaaaatagtcatcggtgacgggttttagttaatgcccgatagagattaagtatatagcccgtcattgatgagtcatctgtgacggacctagttgctatctcaaacggggccctttaaaaggtttttgggggggtttttgggggcccccccaaacagtacggatgatggttatccgtgacgggccacaacttgaggcccgtttaagatatggaatgttatctcaatcaggcctaaagttggcgcccgtcacagatgatggtcatctgtgacgggccacatctttaggctcgtttgagatatggaatgttatctcaatcgggtctaaactatggcccgtcactgataggtgtcatccgtgacgggcttaagttttatgcccatctaatatgtctgtgcgaccatatttcaatcgggcattttttggcccgattgagatgacttccttgtgacggcccgctatttctaggcatattagagcccgtcacagatagaagaatctgtactagtgtgtaaggagttgcctgcagttacgcaatcgccacgattccttgcctcccactgtggggattgccgaagcacagagcatacgcatctttcaggctcctatctcgtagtggtttcttttcgcccagtactggcaggtagtatggattataaaacgctgcactagtcacttggacctgaattccacagatgcctccatttcatactggaattcgtcagataagagtcctattgactcccgcagtgacgggcacaggttgtgatcgatgcacagtgagatcgatgttgccactgctatttatcatgaccctcaatgtaattgcgctatgcactggttgagctcacagagtgaagtcaatatatatttagggaaccttatggtgtggaactacttcatgattgcattcatgcacatgtctatatttatgtgcttgactgtctgaaaggagatagcatgtcactatgtcagtttaatctgatgcgcaaaaacacatagttgctctccctagctggcggactctggtcattattaagcgccttttgattacagatgagaagttatagttaattgcagtagatgctcatttatttatttattttgtagagttctttttttgttttcttccattatcttaaaaaaatctcctggaattaaaagtcagaataagtcaggtattatatactagcatcaatgatggtggttttactttcatcggtaaaccatgcaaatagtcgaacaattacagcagtcaattgttcacctggatatcgacataactgaatacaagacgagactctaagccaggcttcctgtccatcaaatatctggacgaagcatgcgcggatgtttccaaccatatcatcgatgcttcaaggtcagcgccatggtcacggtaatcctagctcttgccgccggcaaaaatggatgaaaatgcttcaaggcgggctgtgcccaggcaccctttggtcttcctgctgcgttgcatatcaatcttctggtcggcttgcacttaatttgcctctgacatattgtttgagctacacatacatttgcaaccttgcatcgatcccctttctattggacgtgattgtccatctagctagcttgagagtacttgcagatgttggcccatcgtgatcctcctattacattacccattgtaagaatttgacgagagagagatatatggcgcagcttgtgtttatttgaggggttatatatatacactggtactgattctttttagagttatattggagtaaacttgctagttcgtatacggatgcatgaatggcagcgtcacacaaatatgttgtctatgcgcatgaattcacaaggagctcgcaagggtacgtagtcaatgttaaagggaacagatggactactgcaacgttgcattcttgcatatgtcactagaattatgtatctggcattctgagtgagagagcgtgtcgaattggcaatataaatctgatgcgtacaaagagaaaaaaaaacaattgctctggctggcggactctgtcgtcattaaccgtcttttgatagcagatgaaaggctatactaactgtagagtattgattttttttagtaaagtccatcgccggtccctaaacttgtaccgctgtctcatcccggtccctaaactcgcaaatcgaccgttcaggtccttaaacttgttcgactgtatcatcctggtccctaaacttgtagatcactcgtttagctcttctccaacttgttcagttgtgtcaccccggtctctaaacttggatttgaatatcatctgagtcaaataggacggtctaaagactttatatttaaaaataattcatgactttttcatgtgaactctaatgaagacaaactttgggcctgtttggggaagctttagattctgagaagcagttgtttggtagccagcttctgagaatctggaaaagctctaaaacctagcttctccagcttctagctttttagttcattttttagaatttataactacagattctcagaagctgtggactgtttatggcagcttttagcagaagcagcttttgggaaaagctgcagctgggataagctcccccaaacagggtctttatatcaaacttgtagccctcgacgtgatctacaactttgtagttgaatttttttattgtaagtcatcttttgtcccaaaatgttattttaaaattaaaattttaaaatctataaacatgcaacaatattttgggaccctaaacagttttaattcaaaaacttttcaactacaaagttgtaggtcgcatcgagggctacaattttgatataaagtttgtcttcattagagttcacatgaaaatattatgaattatttttaaatataaggtctttagaccatcctgtttagggaccggggtgacacaactgaacaagttggaggacctaaatgagtgatatgcaagtttagggaccgggatgagtcgaacaagtttgaggacctgaacggtcgatttgcgagtttagggatcggaatgacacagcagtataagtttagggaccggtgatggactttactctatttttttttgttctcaccaaatttgggctttatatctcggggggaaaaaagttgagaattaagtgaggtgagaaagtttatatcgcgctggtgatggtgatggttttgctttcaacatggtaaagcaaataaattgaacacttacaacatattcttacacatggctagtgcttaagttctttcacagtgcgtgtatgtggcgcgcggcccgagcgtagattccataccatgtacgcgagagtcgtagtcgctagcgaggaacgcggaacaaaaatgggacacccgttcttcagacgaaacacggctttgcagcatgggttgaggcatccggccgcactgtgaaggtcatgtcctatcgtaactaattgcctgcgtccaaggttcataaatcactgttgctacatagcactataagacctatgtccttttaggaacttgagcctagctggctagtgggatccaacagatgagaagctgtactgctacgtactgccctaacaggacgaagcacacacggctgcaaactgaaggaagcacatgcttgcttagaacagattgtgtcttcattaaactcccggtgcctccctttcctattggacacgattgtctatctagcttgagacttgcaaacattggcctatcaccaattcaccatatatcctcctcatatactgcatgccgtccaagaatttgatgagagagatggatgagaagcaagttgtgttctgttttgtgggactattatatatacatgaattcaaaggagtgagaagctggagcaatttggttcagtagaggaggacatagactgccatttacggctgtgttgaatggagccggctgatctggcatttcgaatatgtctcatcatgatctcttcgtttcttcctttcacgtctctgatttttctataatgcaatttaatttgtaagagccatcaacttggttcgtgatgagcccgtggttgtacaaggtcctcaacagccagaacaggagaaactgtgttgccatggacaagctctggtcagaaactctccaccacactcttccagtctgtgtcctttgttactggctatagctaccatagcagttgttcatgaatttagcaaatggctctgtaccaagatcccggt

SEQ ID NO: 66869 - DNA, 1513 bp, Oryza sativa
attcataatatattcttttcttcttgatacgtaggtcaaattaattaggactccaaagtttacgtgatggtatatatatacacacacctatcagagttgtcaaatagtattgtcacaatttccggctagctctgctaatccaatgggtcaaaaatgaactttgcaacacaacagtagaaagaagcatcgctttttctgaacgctttccctttccttgcccctgctactgttgtttttttaaaaaaggtaaaaaattttaaaaagcggcaacagaccgcgtcgctaagctggaaattacctctgaaaatcaccggcgtttccacacactgtgcaaggttccttgccccaaatcaaagcgtccataaagttgagaagaaagaaaagaaaaaaaaacaaggcttagctagctagctacttaaacaaagcccacaccacaactcaaagaatcgattcccccattgatcaatcaatcaatcgatgagctagctctctttatttaccacccacaaacatcttttaatcccctttgatcaacacatgatcgatcaccatctgtccctttttttctctgaatttgaatcgatcccttctctgttaatttctccttgccatacatggcttctgcctcttcttgctcagcttaaagttcagaaccctagaaagttgttattggcttagctatagctgcttgctctcccaccaagtctacactactgtcacacactgacattgtccgtcctccatgtacatggatgcacagcaaaaagccctagcttaattagctacgtataccttccttgtcgccgggttcaccgcggcgaggcgacgtcgacgccgacaccggcgtcgccgctttgcttgccggcgaggccacctcccggatgcccctccatggccgtgcagtgaccacgcatatgcctgctcatcactttctccttgtagagttctaggtataaatgtctcgcgccattgttaccgtctagtgaaatctcgatcttggaacatttaggtgagattattgatgccgagttatctgcgaattttcatggagttttccggtgttttaattcgatggtgtggtttggttgcaggtacaaggttgaagacgacggccggcaacgacggcgacgatgacgatgaccggagggcaccaccatgacgcgcaccacgaggacttccagctgaaggacacgaacccgctgctgggggagcaatggccgaagggcgcggcggggccggcgcggccggccgtcggcggcggcatcgccggttggctggggttggagaagccgtcgagcacctacgacctcgtcgagcagatgttcttcctgtacgtgcgcgtcgtcaaggcgaaggacctcccgcccaaccccatcaccgggtcccccatggatccgtacgtcgaggtcaagctcgggaactacaagggcacgacgaagcactacgaccggcgagccaacccggagtgggaccaggtgttcgccttctccaagtcgagggtgcagtccaacgt

SEQ ID NO: 66870 - DNA, 16069 bp, Oryza sativa
tttcaaatggatgtgaaaagtgcttttctgaatggagttattgaggaagaggtctatgtcaaacaacctcctggttttgaaaatctaaaatttccaaatcatgtgttcaaacttgataaagctctttatggtttaaaacaagctcccagagcctggtatgaaagattgaaaacctttttgcttcaaaatggttttgaaatgggggcagttgataaaactctttactcttcatagtggcattgattttcttcttgtcgagatatatgttgatgacatcatatttggtggctcctctcatgcacttgttgcccagttttctgatgtgatgagcagggaattcgaaatgagcatgatgggagagctgactttcttccttggacttcaaattaagcaaaccaaggaaggaatctttgtacatcagaccaagtactccaaagagctcctgaagaagttcgacatggccgactgcaagccaatcgccactcccatggcaactacttcatcgcttggtcctgatgaggacggtgaagaagttgaccagcgcgagtacagaagtatgattggctccctcctctacttgactgcgtcaaggccggacatccacttctctgtgtgcctgtgcgcgaggttccaggctttttcaagaacatcacatcgccaagcagtcaagcgcatctttcgctacatcaagtctacacttgagtacggtatttggtactcctgctcttctgcctttcagttcgagctttttcagatgctgaatttgctgggtgtaagattgatcgcaaaagtacttctggcacttgtcattttcttggcacttctttggtctcttggtcctctcgtaagcagtcttctgttgctcaatcaacagctgaggctgagtacgtagctgctgctagtgcatgtagtcaagttctttggatgatttcaactctgaaagattatggtctgtttttctctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttactttatgcattgttttatacactcttcaattgagctttgcttgttatctcttggtcatcactatgctatgcatgtatcactcttatgctagtttgatctcttgtctagctttcatttgcttaagtagcttgtgtgatcatgttatgctgttcaagcttgttgaaacctgcttaaattgactattcatttgaacttaatcaatgtgcaatgcttgctctagaagtttgtttaaattgaagtatccctctcatactcatgccatgtttacattctttttgcaataactgtcagtacatgcttatgaatgctcatgcttatgcgtccatactttgtatcaatcatgctttacaagctttatctctgtttttgtccgggctactgagtgcgtttacgcatgagtagtgccgaagatagcactgagacagcctgtaatctgaactctagctggaaaacttgattgaggtcagacggcagtgtttggcacaaccatcacttgctgactgataagatcaggtggaccgtcgtgattgtgctattgtctttaaagaaattaaaaaaaaatcttaaatataaaagtcatgagaaaagattaaaaactcatgttctatgctttgttatcatgttgatactctttatgaactgggcattagcacattagcatgggttcattgctttgattatgtaaatcttgcatgattatgagctggtttgcttccttttaagcttcttctagaaatagctttgcacactaaatcactaattcacttgaaaactttttgcttgctggcgatactaacttgatatccatgacatgtttcatacttcttatgcacatgcttagctaggcttgagcacatgcttgtatctgtgtgatccatgtctaccttttgatgcctttagataactctcaaagctctcaaaacactaaaatttgtaagtttcatctcatttttatcttgcatttttgtctcttttgatcttgatggcatcattgacaaagggggagagaaatttgcacttattaaaacttgctttagatcttggtgaaagggggagtttggcacatagggggagcattcttgcatttgcattcgcatcccttttcttcttgtcacttcacttggtcttgatttttcacgatttcaaaatgaccaaagttcgacgtttgcaaaatggtttactttgtgaatcaaaaatcaaattttcaaaatttttgcttgggattgtcaatgttcccatcaagggggagattgtgaaaccatgtgtggttatagttcttttgtgatgggaaattgacaagtactggaagtgcaagaagtgtgtgcgtggactaacattggtcagattgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacataaggttgcacacggtggacgaacaccgtgtgaggaggtcttcgcaacggacttcgcaaggtcaagtgcaagtgccgggttcgcgaacagaatggagaatggaagaggagcttgtatacatgcactggcatgtgcatatgcaagcatggacagtggtgcttcggttgtgcatgcgtgcacatggccgaatgccatgcacgggggcaagacatgcatgtgtgcatgaggagcttgctagcccattggtgcatgtgagctgtgattggttggcagggaggccaagccaatccagcccttcctcgtggctcaagatgatggatggatcagcaggcagggaggccaggccgagcaggcccaagacaagacgacggcccacggcattggcaccatgcgcgggcaagcgcgggagatcgcgcgaggcacgcgcgcgcagtggacacgcggcggcaaggaattcggcgctgtttcaagtggctcggaggcgggagttgtactgggacccacgcgcgatttcgcgagcatgcgcgggagcagctcggcgggacgcgtggaggctttggactggatgcgcgcaggtgagcgtgggatccacgcggtggagcgcgcgctctcgcgtgctgaggcgtgacgtggcggctcgtcactggtttggagagggagcacgcggatcagtgcggcgtggagagtttggatcaacgatgtggcaagcatccaggaggcttccttcggttctaaggaagaatgggtggaccagatccattctgagttagggtttcgccctaggggtatttgagacaatgtcttaggggtcttagcctataaatagagagatggatgcaagggtggaggttgcttctttggcaatccttttgagatgctcggtgagagagtttcagtgtgagtttggagtgagtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctcttcctcacctctcttctagtttcgggaattcattttctcttcctcctctagtttcgggaattccttctctcttctttttctctcttcttttctagatccggcttctctaatagccgcggttctagtaaggattttgagaaatccggcttgatgagtattttcgggggcaagatttgaattgctatattcagaatcctcaccggatttgctatgatcatgctccaattttttggttttatactcgaaggcatcaggctctcgagtgcttgtcctgtttgtttcttagacttgagttcctggtgcctccatttcctacaccgattagtactaaaataccctccatgtctttctactaccgttatatatatggccaagacctttttaagatactgcatcgcatctctatttatagggatagagttcttttacgatacaccatactagtttgtaaagacccaccatgcagggtcttatggccataaggtacagtagtatatgggaaatctagacgttcatttgtacaggtaaacccaccatgccgtccttccctgccgcacgttggtttgcgaagaacccttaagaattatgtagggattactggttgtatgtacatccctagttggtagattactcactaagaattatgcatggatgtatggtgtgttgcgtgagttgtgttttgggtactatttctgcacaaggtttgggaactacgtagttggtgtcccgtagcataatgtgtactacctccgtttcagcttataagacgctttgactttggtcaagtttgactaagtttataaaaaaatatattttcaacccaagataaatttattatgaaaatatattcaattattattgatttaatgaaactaatttggtattataaatattcttatatttgtttataaacttagtcaaacttaaagtggtttgactttgacctaagtcaaaacgtcttataacctgaaacagatggagtacttctcaagagaagcaatgttctctttctgtatagaaaaaacaaaataatacctattcaacatacaacagttttgggtgaaaagcttttaaaaataattatagtataattgaagtgtaatctgcatgcgaccccggctagcacaacataggtcaggagtttgaccctgcctcgcttgcgagctgtgtaaaaactattttccctctcgcatgaatcatgaggcaatccgacggtcacttataaaaaaaaaaagggaacattttttagcaattcccaaaaaagcacacatagagtgtttacaatctattagattaactatagataaattggagctagtagttggctatactattaaacttgctctaggaatcttgtggtggcaggtatgcatttccagtgcctcgtcttcctacaaacctactagtttattgtctagcttacatcgagagccaaacctacaacaaattctcatgcattggccagcctcttctagcaattcagctgacagcttcagttctctaacgatactaaaaggagctttttgttcctagctaattaggccaacaccatgcacaagcatgaagaccttgttatatagtatcacattgagtatttaagttagggccaggtatgtgcactacatacatgttcttgatctgatgacataagtatgcataatcaatacagcccaatgcatgtaagagtaaggctaataatacagccgacctgttggctataaggttctttgcagccttctcttagcctatctatataatagttagctctttataattaatacagggcccacttgtctctttcacagatttttttggttcttgtgtctaagccggctgtaagtttacagcccgtttctcctctctctcctctcttttctcctccacctcagcatttagccagcttatagcctactattatacttgctctaaggtggatagaattattacatggacatgctgctaccaatatccactcatcattcatgtctgttaatttaccacctgatagcatatagtatatagcaacccttttacatacgtaaagcattacaacgttagagatggggctagatactggtggagaaaggggctttactcctggttcgtaaccccccttagtcccgatttttaaaccgagactaccaatccgggactaaagatagaaaagatcactatctttagtcccgggtgaaaaaaccgggactaaagatagagataaggtcagtggaggaagaggtgaagagataaggttgcccgtctcctcctcctcgatctcgcagatggcagatgcctcgtactctccgccacgatcttttgttccggttggtattaccaaccgggacttttttgttcccggttggtaacactaactgggactaaaaatagatctttttttccggttggtgttaccaaccgggactaaaaatagatcaccaaccgggactaaagattaaaaagcagctctaaacttttgaaccgggactaaagataatctttaatcccggtttttattgcaaccgggactattgtggattttggctaaccgagcaaagatagtttctccaccagtgagataatggcttgaatcactgagttagggttgatggcttgatgcgtttcttatatttgatagattttggtcgatatgttctgatgctcaaaggtgttggcttgcggaaaatgtgagtacattaactagcgtttaactgaaccagcaaagcctgcttctggctcttctaacattttctggcacactgtgatgtgagtatatatatatttgcacatctgtatttctggatatttcgataaaaaaaaagacgagatttggagggagagacgtccctccaaatattatttaagaagaaattatgagcgtgttggggattgaacattggaccttgagattgaaatcacccacccgttgccactgcattatcaattacatctctttatgttttgctactgaacatagaactggtttctgtataaatttcagatccacggcagtatttgttttctgacatacacggtctagagttgaattcaattggatccatttatttgaaatcagtcctaagttttcctagaagtcttaacagctttaaaagatcatgtcaccaattttttcccctactattcttaacatttcttcatagcgccttggcgatacataattgttatcaaattcagagataccattaaatttgattcagagaaactattttatttgctgtagatatgtcaaagcgtgatgtgagacatcactcatccaattataagtcctccgtccgagcacaatgggagataccaaataacatatgaaaatgcagaaaactaaaccaccttgccgccttgttcattctcctctttaccttttctttgctcgtttgcactaaaatgtgtattgttgggaaaaacgtatttaagctcccctattgccttcactcgttgtaaaacacggacatttagctagcatataaaagaattgacatccactactacgaaacaaacttacgctggtagtcaaaattaatttttgcagacggccaaacaattggccagagaaaatatgcgatcttcataggcggagatttgacaaaaataaaattgattttcacatgcggctaggttgagctgaactcctatgcaaattgattttcttatgcggcaaggtttagccaaccactaaaaaagatgattttttggcaaaaaaaaaagaaaagaaaagaagaaacaaatcgccaaatcttcttttttgcctgcaatttttccaaaaccacaaatttcttaaactctggaccagggaaatcgccaactaaatttgaaaatgaacttccttaaaaaaaattgaaaatgaacatgaacatcatcagtggcaacagagcatcaacatcagcagatcactcagaacaagactgcaaacatcaacaggggtctcatcgttatggtagcactcattgctcctgttgtaaagatatttaattatttgccactcttacaagtggtagtttagaatttattagacctatatgccatagacatatgaagttccacatatcgtacactgcgagtgacaaaattttgattgtcacaaattaaaagtgataaatagttaaatgccctgttctaatagtaaccctagtcgcaggaagacgaatgaagctagcacaatgcggctgccaagggtggagacaacgtgggggcggggaggtctttagacccccctacctcctaatagatcattagagtccccataatacccccttagattaattctaatccatatatttatagatgagagactaatatagattttgtttgaggttgttagaaggcttaaaaggctaagaagtcccaataattcctaacccaaccctaaatctatcttagttgcttttagtcattttggtttagcctctgctataattttaacctgcctccgccactggcggctgctagagaaggaattaaatttgaaagtatactatttatttatttttttcataaatatccgagatgtaaaatttttagcataaatatatcgtcgtcgctgattgaaagagcgaaatcgaaacgatatcgctaacccgttaagcgaaaatgacgacaacgtgacactttgtcacggtctcgcagaatcatggcgcgattccgccggatccgccacggtatcgcaacagtaggtcgcgagaccggcggtctcgcttcatcaccttgcgagatggcctgatatgactcatgatcagtggacgattaacgggtgattaacgattaattaattactaataatgttagttaaaggagtaatagtaattaattaattgctaattacactaattaatttattgatagcgagagtacgcgggttaggtaagcgaagtcgcggtgcgagaccgagcggtttcacgcacacctcgcgcgacgtcgtgcatagtaacgcacgattttacgctttcatttcacgacaatggtatatttctgtaaatatttttctaaatgagcgtatttatacaaaaccaatgaaaaagaggtatattttcaaatttagcgaaaggacagatctgttagaggttacatgggattgcttttaccactattccacacagtcactgcaacttgggaactaatgcttccagttaagagaaacatggcaggtggcaatgtggcatgcagaaatctgtgcagtggacagtccacctcgataccgtgactccccatggtagaatcctcaccagatttgctataagcacgctccaaatttttggttttctattcgatggcactaggatttcgagtgcgcagcctgattgtttcttagacttgagttcctggtgcctccatttcttataggtacgctgattagtgctgaaatatatattctccatgtctttctaataccgttatatgatcgagaccttttaagatattccattgtatctctgtagtggtaacacctttgataaatcctagccattgattatttatgtgctttctaattaaaatacatgtggcccattcaaataataaatgacagcaaacacaaaaggaacaggaacagtgggcaacagcatgcggccggcaagtttggtgtacaatccattttatattttatatattaagttttttttactgtgcaacagcttggttgggtactaaatcaggtccgttcataggccacgatctaatgacggcaattgaccggtaccaccaggtaccgttaactctgttatgcggtaccaaccaaaggaaagaaggtgggaggataaaatcgtattttcgtgatgtaaatgagccattgtcatcttatgcactttcttttcagtcgaggattcgaaactcaaaccctagttttgtaatgtcaaatcgctgaggtgcccaaagccggaggtgagcaatcgatggctgcataggggtttgtgctcctggagacccttatagtggcagtggtggcggcgatggtgctcttggagcccctcgttgcaggaggagtggtgctccaggagttttccgtagagacggcgacggcactcccggagttgtccgcaacgatggcggttaccccatcgtcgacgtccgtggtagtggagagtttgggtagtagtcagcgatgcggtgagcgtgtgagggggaaaacgattgtggtggtgtcaaacttggggtgcgatggaggaatatcgcgcgttggggtagaagattgcatgagacttacttacttctcacccgattataccctcccagattccatgcccatattaagttcggtacctaggggtaaagacttcctcaaatgtacaaaattattgcccactatacttgggtttcatcattcttgtcatcttgtgggaaccatgcgcgcatgcattaaatggataaacttaaggacacttctttgaatgttacttatttatagtggatctaaagtctatgtgcaataaaaaatacctatgttgtttgtcacgagaacttaaaacaatggcgtttgcaattaacccatgatctgtcgtgcccgtttatgacaactgtaaatcttacctgaatattcatttcttaaaaaactatccgatgtgttcatctgtttttcttgttggatgaccgaattatagtaactatttttttatggaaattacagcgggtgttgacaccagcctaaacttttattaataatggtaaaagcatttacatgagaagggttacatgggaaaggggggggtgctgaaattatgggttaattacagagagattcagcgaccaagtatggagctgttgtttgcaatcaagagaccacaattcaatttggggttaataaatattaaactggacaacatgttcgattagaagtcatctagagaccacaattcaatttggaggacctcagttggagagtacatttgagcattaggtgaaactgcagctagggcactcagctcctccgcggcctaccatgagtgtgagttccgcatactgaaatcagctttccgctggaacgatacggcagacatcgccggcgatgcagccatcgtggagtttttggctttgtcttggaaggaatgagcacttggaaacctgatttctgtctagatttgagttcctggtgcctctcctttccctacaccaattaatagtgttataccatccatgttttgcacttttgctactaccgttgtagaacatgagcttgccgagatgtgttatttatccctaggatatatgtagcggagatatgcatttacgcgtatgctatattatggcattctaacatttcgtacaagaagatttggtatattgtctaatgctaacaccaactttttagggtggtttaaaaatgattggtaatgaatagaagttgattttgttttgcatttcaaatatatggtcctattcataaaaggtgggcaaactaatacgtccaagtagtgaaagtttgcgagagtgtcaatttagtaacttgtgatggtttcataatgagtgttaaagagatcattttctctagttttgcacacatactaaaatcatattcatgtgcatttggtgacatctggattcattgtattggaagcttttggagactgtgatttgaaaatttgtcgctagagatgccgtgagtaacacaactacacacaagcaagtgatcaggatgtggttcgctgtcttaggctctgagccacacattagtcacattgagtggccatctagacctcaccagccgcttcgccgtccaacattggccattgaaggctagccaaaagtagaacttgcaattcgctggtgcctaggttcgccatagttgcttccagtggtggaaggtttgcaacccaagtagtaagaaattaagcctcgtatgtcaggccggcatagtactgaaggtcacttgtccagcgccagatcagtcagatcctctttgctttggctgaggatcaccgcttcgactagcgaccagacatggagatattgagaaatccatcgtttagatatacggagtatcaagttacaacattaggtaatgtattgtttggttatcatacttgtgaaggagatgcatgaccatcttgccatgaggatcagcaatacttaaattttagttccctttgcctccctttcctattgcacttcatcagttcaccgtgaaatacaagacattggttatactagcagagctacaatgctcatgagctcaccctgctgctgtctttcccttgtactggacattttggcacacgttgtgcgccctaccagatagcaactgtgtgtaataattaaacccaaacaaatcaattcattttatttaatttgtgtgtcaaaataaaaatgtgtcgaaagtaactatacaaaattaatatcccataggcaaaaaaaataagtatcaagtatatagagcacaccagattgcttaaaatatttttgctagtcactaagcaaagaaaaactttaatctattggaagttccaatttccagataaatttgtaggggaagacattatttacttttaaagcattataacgagagcgggcagtgaagatacagattttacaaatggggacaatttcgttcgtgcccctacttttatcttcagtattgattctgctcccgttttttagggttttcgtttttaccctcgtttttttaaaaacgaaacgacatattgcccctactttggatggacaaattaatgatgatgagtatttgataaaaggacatttatacccttacttcatttcttgttgcacattcactagtacacaaaagatttttccgtgtggaggctccgctcgtctgcacccaggtgtctgcgaaaatctatattttcgtgtgctagcggcccaaccttacgggataatccatctttccgtgcggtcgggttaagtggatcacatgggataatcgaattaccctgtgcaatcaaattatactgctcgcacgcaaaaaaaaggaataaataaataaaatcgaaaaccctaaccctaaccatagaatcgcccgctgctgccgctcatggtcaccgtcgtcctcgcgtcgtcactgtggtcgcgccgccaccgctcccgtcgttgtcgtcgtggtcatgccatcaccactcccggctgccaccgctcatggtcgctgtcatcctcgtcgtcgccgacgtcgtgctgctgccgctccagtcgtcgtgccgccgccgctcccatcgtcgtcgccgtggtcgccaccgccgctcctgagcccgtcgctcttggctgctgccgctcctgagcccacctccgccgcgaccgtctgccgtcgccgctcttgggcgcctccttctcctcgtcgtcgtcggtgcgacacggatccggccggtcgcccgcgcgcgcctcttgctctgcgagccgggtgcctcccgtgccctgtgtgcttggtggggaggggaggagctagaggagaggagaggaaaggcagagagagagatgagtgattgagggagaataaaagggaaaaaggaagagagaagatgaaaaatgtgaagtgagtgagagggaaaagagggagtgctatttgttggcaactttttttggccagaagacaattacgatcgggacacctaaacgccttgtggtgataaggagtcgccattcacccgatctagccaaacggccaaatcaagatgggttttgtagaaaacgactaaacctactagcgaagccgatttagagattaaaatcagcctctaggctgatttagatcaatatgaggataactactcgtcttgtgggcaaacggaaggtttatgggacaaacctacaaagaggtaatcgcattctcgcagcgacggcggacgatttacggcgcaaactgacgaagatggactaaaactagaagaaagtagaaaacatggctaaaagtaaagataaaagaacaattcgattgtgttcgggggagagagagatctcaatcgaaccggacttgtcccttaaataggggttggtcttgcctcctacaagtcatcctccacgtccaactcgagatagaaaccaatagaaacccgaaacataccttcccaagcaaggaaacccgagacctgatgaaaacagactcaggctcgcactcttccagtctgaccagccacacaccaccggtcagaccggccatcaagcaacggtctaagcagccaacatacggcggtcaaacaggccttgtggaggaaaatgacgatttttccaaatattggcaataattccttaatttgaacctaggtgtcaaatttgggtgtaaacagtattttcgcgtgcggtactgcggtccacttaagaggcctgcacgcaaaaattaattttcgcgtgcgggcctcttaagagtccgcatgtgaaaataggagcccaatttttacagacgcacacgaaaacggcccttctgggaaaattggagctccttgtccaggaaaatattttgtgtactggtgatttctccctcattttgtacatatagcatggaacttgagtttttttttgaaggttcaaatataagaatttggaccgaatgtcaataatattgaataaatttggacagattcaaaatgaatcatgaggcaatccgatggtcacttatgaaaaaaaaaaccagggaacgttttctagcaattcggaaaaacgcacacatagagtgtttacattggggaattggttgcacatccaatctaaataaatcgataaaaaattccaaattaataacgccctcatgaatgacaaagaagcaacatctcgctcctggcacaatgtttcatgaatgtcggataaaaaacagatttgctgtcaaccacattgtagaaaacagcgccaaagttgtcgagaatatgtaagtagtcccaggaacaaacattggtgtacgacctcctctgcttcgacgttgcttcgtgtaatcttgcacattgtatgaatcctctggtggcaggtatgcattcctagtgcctcctcttcatacaaacctactactttattgtctaggttacatcaagagccaaacctacaactaattctcatcattggccagcctcttatagcaatttagctgatgctatagcttgttgtgcaaaggtcgggattctattccattacctaaaaaggagcaattcaactgacaacttcagttctctaatgatactaaaaggagctttttgttcctgactttaggccaacaccatgcacaagcatgacgaccttcttatatagtatcacattgagtatttaagtttgggccaggtatgtacactacatgttcttgatctgatgacatagtatgcataatcaattaaaagcacatgtaaagtggatagagttattacatggagatgctgctaccaatatacactcatcattcatgtccgttaatttaccaccttatagcataccaacccttagagcacccgtaatggtaaagtaatgtgctatctataaaacatgtacatctcagcaatagactagattaatagtataccacctcaatagtatatctacacatgggtatctatagctctctaatccattgcctcgtttttctctatagactatttccaggttagtagatagctttgctctctctcttcatttaatctctttcaagtaggaaaatatgctgacatgaatctcttgtagagagcctatagataactattgtgggtgcccttagcatacttaaagtagtactacagcgttggagatggggctagagaattaatggtttgaatcaccgagtttttttttttttgagaagatgcatctcacactcaattaatcttgattgtaattcttacagccacaattgaagtaatactccgtacaatcttgagcaactgaaagccaggtagaaaaactactcaaagacattcctgcctgagctaatctatgagcaattttattcactgatctcctaacccgaacgacactaaagctattgaaaggactcagcttcaatttcagatcttgtaccagatccataaatcgatctactaacttccttctgagcaaccatcctcgttacttccaaagaaccaggctcaataattaaggtagatactcccaactaatgcaagatcagccgatcctgctacaagctagtaattccaaggtggtagcggcctgaatacttgggatgatactgtgctactgccggcataaaacctcactgtcatttcgcatgaccacctcactgct

SEQ ID NO: 66871 - DNA, 34738 bp, Oryza sativa
atgtatacctaagatttttttttaaaaaataagcatatatactaagtatttggcatatgtattcagaacaacaaaaaagccacaaacagtccaataagcaatcaaactacctttttttgggcatgcttcatcctccctcctccattggcccattggcccaagttactaggcccaaattacccactcctctcatctctctctcactggccactcacccctttctctcccctcccctaaccagctaaccctagcaaagctgcgcgggcggcggccggcgagcggcgagggagtgaggtggcatggccacggcgcggcatgcggcagcagcgggcttctggctgtgggcgcacaacgggttggcgtgtggccgtggggcatggtcacggcttggcgtagccatgcggggcagcggtgcgacgacgtgggggcgggccgccggggcagtggcgacactggcatagggaccagcggcggcgctggtagtggcacaggttagggactaggtggactagggccttgggaagttgggggaaccaggaacctccaaggtgaggtttttatgcagtatttttcagtgcttgattgatcatttagttacattcattgaaaagaaatccgtattgcaagttaaggataaggacatcattactcatttttaaaacatcaagcatcgaaaagttgatatctaaattgtaatacttcttctaactgttataaaacatgccccaaaatcacatcggaaaccaaacgcggaagaaaatgccataggagatccaaacatgatgacgacaccgaggcatgatatttgataacagagttcagccgaggcctacatctccggggcactgattacgggtgctcctccccgatccagcatatacagcatatcagagttacaacgactcacggtcggtcgccgccggcagccgctccctctcgctatgctatgtcgccatgcggttataacaggcacgcccctctatttatgagagaacctaggacagagtccgactcttactctagtcctaatacctattacaactccaagtcctaaactgtaacctactacgtacacatatttgacacaaactctaacaaactccaccttggcaaatatgccacgccaacctgaatctgttacttgctcaaacctccatgtaccaggacttgagttggttccttttcgccgctcacgccaagttgccccgacaagccttcaccagactcaccgtaaacaagagactccgctatccctgtaatttcttcctcctgactccacctgcaacagtgctccaccttctctcctatcaccataatcgtcttgccaagcgaattgaattcttcctagctgtcacatcatagactctccgaagaccatgttcacctctatctaccgtcttaagtttgacttgatctaatccatggccagataaccgatgtcatcaccaaatagacaaaccaaactcaccagacatgaagagaaccctttcttccgtcttatgaaccgagctaataaatccaacatccacgcttctccgtatccgtagactgaattcctgataatctgagaaaattcactgttgccttgaatcatccgaagaaattactaccatagcgctcgctcttcctcttcagtgacgcagattccatatatccccatcatgcaaactccgcagattctggatatatcatgtactgcaaacagcctgttgatgccctcaacgattttcatccgcggttgctcgggaccttctagttttggtccactcgctgccttcgtttgagtcacgtcttgactgaacacgccaccttgccttgccacatgctaaatttttccatacaatagcatgaccacacaacttgaccaagttcctatgcataatcaattttaccgttcggtctccacgtgcaaaccagccaagcaaaaacatttgactgtgcatccaaaaagtccacatgggcccacagccaactagactcggtcaacaacagtcgcagcaactgaccagtcgcgtccagggaccagatcgaaacaaccgatcccctcgcccttctgctcgctcccctcagcctgagtgcgccgccgcccagcgcttgtcgcgcccctgccgcgccggccgctacttcctgcctcaccgtctcctccgcgccgccaccgaagacgctgcttcggttcccgacgccgccgcccgtccagaagatgctgccgcgcagaggagtttttttttgaaagattaacggcaggagctctgccggatatattaaaaagaagtaaaaggagtcagacaaaacgaaaaacatcaagcttaggacaccgccaatgacaacgctgccgatgctgccaccgtaggcttcccgccggtgaggatgctgacgaccacggtaacggcctccccgacacaggagcgtcgctgccgccccttcgccggtacttgccccgacgacaacaccaagccgtgctcctgccactcgacgctcgtcgtcccaaatcaccgccgccaagaggtcccaatccgacttttgcttggtgatttgttcgattgcaaaatctgcaatcccgtggattaattcctgttgctgagtcctgggaatttgatgtccgattttaagtccaaaccgaaacccacttccttttccctttcgtgtgtgtccagtccaactaggcctcctctcctggactacttgccacaaacgccgccgtgaccgaacactgtggctccgtcctgattggagtcctgtgcaaccatgactcctcccgagcctgcttcctcctggcgttgcttctatcaatgccgctagcctggtctcaacgtgcggtgcatgcacaccatcgcgacatggacttccaagccttcacgtatctcacggcttctgcaccttcccttctgcacttccggccaactccgctaatgacgcatgccatcagtttgtaaccaatgcatacgattgtgcaaagcctctcggttgaactgacgtttccacgatacagtcggcccaatttgccgatctggtcgtcctcagcccgatccgcacgtacgccgccctcgaagcaattctgttgcacaccttgttgaagacacatccaaaacagcctataggatccaccgttgcggctccacctcgagcccgcaacccgctctgacctccgattgaccacctgtcaatctagccgcgagccgaagccgacaaatcacatgccgtcttcccagccgctgaacgacccgagtgctacgtctagccatctccctgtcgaacgcaactcatcgaaaggcccgggacacccggcccagagtgttcgattccaccgatcgagaacgccgatcgcctccagcttcaatcaacccgagcgtgcggccgcacgtctccctgtcgagagtagctcactggaaagttcgagccacccgcccgaagtgtccaacccaccgattgattcgccaatcgcttccgccgccatcaacctgagcaccacgtctggtcatctccctgttgaagcagccatcgacggttccggccgccgccagaagtgtttgattccaccgatcaaattccgttgatcgccgccgtgctccaccttgcgtccatgtccgtctctggacaccccgtgtagtcgtcgcggcgtggagcacctccctcgtacctctaccatggatctgccgcacgctctgataccacttgttataaaacaggccccaaaatcacatcggaaaccaaacgcggaagaaaacgccatagaagatccaaacatgatgacgacaccgaggcacgatatttgataacggagttcagccgaggcctacatctccggggcactgattacgggcgctcctccccgatccagcatatcagagttacaacgactcacggccggtcgccgccggcagccgctcgctctcgctatgctatgtcgccatgcggttacaacaggcatgcccctctatttatgagagaacctaggacagagttcgactcttactctagtcctaatacctattacaactccaagtcctaaactgtaacctacaacgtacacatatttatgtatttcatcctccctcctccattggcccattggcccaagttactaggcccaaattacccactcctctcatctctctctcactggccactcacccctttctctcccctcccctaaccggctaaccctagcaaagctgcgcgggcggcggccggcgagcggcgagggagtgaggtggcatggccacggcacggcatgcggcagcagcgggcttctggctgtgggcgcacaacgggttggcgtgtggccgtggggcatggtcacggcttggcgtagccatgcggggcagcggtgcgacgacgtgggggcgggccgccggggcagtggcgacactggcatagggaccagcggcggcgccggtagtggcacaggttagggactaggtggactagggccttgggaagttgggggaaccaggaacctccaaggtgaggtttttatgcagtatttttcagtgcttgattgatcatttagttacattcattgaaaagaaatccgtattgcaagttaaggataaggacatcattactcatttttaaaacatcaagcatcgaaaagttgatatctaaattgtaatacttcttctaactattataaaacatgccccaaaatcacatcggaaaccaaacgcggaagaaaatgccataggagatccaaacatgatgacgacaccgaggcatgatatttgataacagagttcagccgaggcctacatctccggggcactgattacgggcgctcctccccgatccagcatatacagcatatcagagttacaacgactcacggtcggttgccgccggcagccgctccctctcgctatgctatgtcgccatgcggttataacaggcacgcccctctatttatgagagaacctaggacagagtccgactcttactctagtcctaatacctattacaactccaagtcctaaactgtaacctacaacgtacacatatttgacacaaactctaacagtaactttatcattttctatcatttatgtatttcatatgttagcactttgatatgtttactgattagtatttctatatcttagactatttcaagtgacaatcaattctatttgtgtgaacttatgctcaattttttgttatatacgttatatattatataattataagcgtgtgatactatacaagctaattattaggcttttaaatgtatgaataaaatttttctttaccccttcctatttcgaatacacaaatgaaaattctaggcccgccaagatggtgccaccatcactgtagtataaccattcgcaataccaatgagtgtatgatttattatagaaaaaggtacgaattaccccctaaactatcccatttgaccgaattaccactctaaacctgaaaaccagagagagaggggaagaacctgcattctaaaacaaaaaaaataggatatatgagggaaaactatagatttggccttttacagcttgaacttatcataaaaaaagatgcgacaaagaaagctaccataaaagataatacctcatcatctttaattaatgtagggtccctaccaactccataacgtctttggtttccgtcacatatatttcgcaggtaaacaaatccagcctgaaatataaatgttaattacggtctgagagcgaaaattcaattgtttggcacggtaaaaattcatgatgcttcatttactggttcaggtgcagatttatatcaaggcacattaacacaggtttctatatatccttcatttactggtagaaattttacctaatagtagcaccaaggttcattttcaatcacactatcaacactcaacagacacatagtgcagcattttagcaaaacctacaatattcagtaaatcctctacattgcattgcgcgtggaacaaaccatcctaacaaacataaccagaaattaacatcgcgggaaccagaaaagtgaaaataacatcgcaggaaccagaaaagtactccctccgtttcaaaatgtttgacacagttgactttttagcacatgtttgaccgttcgtcttattaaaaaaaatttgtgaaatatgtaaaactatatgtgtacatgaaagtatatttagcaatgaatcaaatgatatgaaaagaataaataattacttaaattttttgaataagacgaatggtcaaacacgtacttaaaaacatcacgtacttaaaacaatagacatccagctctgatgtaaagcgagtcagggtgcttcagcaagccgtgcatctgcttaaccgtgagcttcatggtgaagaacttgtagaggaggcagaagtcgctggaggggccacagcagttgcccggtcatccattgctcgacgtggtcaacctggttgtagatcacgttgatgacctcgtggtacgtcttaagcctgtacagctccttgaagtagtccgaggagaggatgttcactgacaggaccttctccaggagcacttcgggacttcaatgggcctcccagatgactgtatctccatcaccctctcggaaattaacaatcaatccatcaatccgtggaggagtctcctaaacctaattttaatctagagtataatctatggactaatttactattgaacatcttacatctccaagaatcagtatctcacggttcttagaaaagataaaattgtctaatcggaacaggatttcttaggaacaagggagagaaaagtgttcttcctttttagaatcaacatccaaactttcaccgtggaataggaagcttaccacttttttttctcgccaggatgcgaagcggcggccgggcgcacggagggacacggacggggctgccacttccatcgggcctggtgactggtgacaacggtgcttgagaaagaggagctagcgtttgaggtggtctggtccgatgggggccgcggacttcaagcgacagcgatcttggcggcgtcgaatcggacgatgcagcgcgaccgtgagagcgaggcgacggggttgcaagccttgcaggaggtttggcagagattcgcgtcgtgtgaggggatggggaggagactggggcggaggagaggtgcgcctctgctgccgtcggatgtaagtcattggataattttggatcgtttgatgtgtcacatgatggatgatgaatgagtaaaaccattcgttgaactataggatagaggtagatagactactacaactattaaaagcaccaaatttgaatttagaccaataactactttatttaaacccaatgattattcatatcaattaacaggcaattaagctacacgatttgtataggtgcttcaagatctttgcattatacattatagggtaacttctaagggcatgtacaaccaaccaacaaagctcgagtccaagctataaggagattccctgtgaaaacaatgaaaataatgtaataatcttaaatcataaggaaattgaagtgctaatctcaaatagaataaagaatgaaatccatataaaacaagttgtttgagaatccatcgtgtgttgcactgttgttttaacgcaacacaaacatattgaacagatgttgctgcaaacacttgttttgttttcagaagcaaatcaaacccaatggtctgttgcaatgctgctctactcttgttagatgtttttgttttcgatcaagttcatgtcttctgtaaacattcttgcatcctttgctacgtgtgtaattccagatcaatgcaacagtcatgtgttaacttccatttttggcggagagtcatgtgtttgctaccccttcccatatgttgtactcatgcacaagctaaggacgcgtttgatctgttgtggacaaaagagtgtcttacatacacatttttttttgagaattacacagtacaatacagacactcacagcgcacgcgcactcacccctatgaacgcacgcacgcaaaccctacccctatgagtatttttgtagactgggccggcaaatcctcgagaatgacaaagtcaccacaggcgtctcgctgtcgacgggcacgtcgcctaccactgaaagcacaacgccgttaaatcctggaaaattcgctcccatagggagtcgaacccaggacctcaggtgctattgaggcacttgtaacccctaggctacatgccctttcgcttagatacacatattttgaaactgttggactcatgcatttgctcatctatagaatggggatggaccaaatttgaatgaccaaaaataatttctaaggacggaagatactcatcaattgtgactgtaaaattagcaaaagcaactcattctaatgatacgaaattctcattcataatgcatgtttttttattgagaaaattcatagtgcgtgtcacaaatggttgcagaatcttatatataccacaatcaggcagggatgtgaagcataaaaaaacaaactatgctaccaatgtatacatttatcaattataggtcgtatgttttccggctgttaattacatgagataatggagtccaccaaattcaatcgtagtgtttacatcatggaaaggtagtcattgtcgagcacgttctggctactctagggataggcggcatggggcttctgcttgtccttgttgggcctgatagtgtcgccgttctggctgacaatgagttcagtgcgattaacatgggcgtcgatgacagcgaaccagacaatgagttcagtgcgattaacatgggcgtcgatgacagcggtggttcggacatcttcggctttgtacctgcttggcttgatggcatcatcgttcttatcgatgagatagcgtcggcagcggccgcgtaaggggcagcatgcttacactttgatgatgacagctattggtccgcattcgaattgcattcagaagctgcatgaggcggcagcatgacttttggttatgacgacagttagtagtccgcatcgaattgcattcatgagctgcatgaggcggcggcatgacatttggtttcaggaaggtgtcaaatagatttttctcttatgatcatggtcattgtactcagttgtgccagataaatctatattctattatataatgtcttaatcttttgaaaatttgatgccgctactacatcttactatgttctgtaaaaaaaattctgagaaaaaagcgaaacatcaccccttgatttcacttagtacagtagattcagtattttacaccactagatctattttctttatctttacatattataaaaattcaagatgtttttgcctgattttcgtacatcgttccgtgtcgccacctgcgcgtgacgatgggcctcatcggactttacttgggcttggagttacgtacatggattagattaggtttatttacagggacggaatacgggtgcaaattgttacagttgtagtatgatacagattatcgtatggagcaataacatgtttcatatatttcagcagtgggttgtgggagaggctgccggcagcaaggttaattttgaccgccttggtagcgagagagggttgcagctgccgacaaggatttgatagccgatgggctgaaaggagagctcagtccggtggaggaggtgggtgtcgatgctgtgctggggacaccgcccgacgcggggctgtggaggagcagctcacgggcgggagatgggggggcttagcctggcagtagaattaacgaagatggagagaagaaagagtcgatcgcgaggaggaagacaacagggaagtcgtccgatcgacatccgacggctgagattgccaaccgataataatctatctactactacttaaaaaataagaggtgcttccatcgtccgtcaaaaaaaccgggtgaaaaaaaaccgggcagaaaaaaccaagtttgtccgataaaaaaaccggacgaaaaaaaagtccgatccaaaaaaaagtgaaaaaaaaaccgggcgaaaaaaacacccgtccctggcaaaaaaacacccgatcccttaaaaagggaaaaaaaagtccgagagaaaaaccgtttaatgaataaaaaaagcgaaaaaaaaagagtccgattccctggagaaaaaaaatctgatttccctggaagagatccgatctgtatactactacttaaaaaataagaggtgcttccatcgtccgtcaaaaaaaccggatgaaaaaaaaccgggtagaaaaaaccaagtttataaaagaaaaggaaaaagctgaaaagaatctgactccatcgacgcggtaaaaaaaggcgaaaaaaaactttccgataaagaaaaaggaattatatgtgacgcggtaaaaaaaaataaaaaaaccaggcgaaaaaaaagataaaagtccgataaaaaaacggggcgaaaaaaaaacaaatctgtcctatccaaaaaaagccaaaaaggggaaaaatcaaaacgaatccgactccgtcgacgtggtgaaaacagggcgaaaaaattccaaagtaaagggagaaaaaaaatcaaaacgaccgtcgacgcggtaaaaaaagggcgaaaaaaatccaaagtaaaaggaattatatgtcacgcggtaaaaaaaatcgatcgggcgaaataaaccgggcaaaaaaaaatctgtccgatccaaaaaaaggggaaaaaatcaaaacgattccgactccgttgacgcgataaaaaagggcgaaaaaattgtctgtttctaaagaaaaaggaattatacgtgatgcggtaaaaaaaatcgaatcctattatatctagaaaggtttgacactatgtgaaagtggtgaaaaaaacccttcgtaaaagaaatgcacgagaaaaaaaattaaaaggacggaaaaaagcgcggaggaaaaaagtcaaatttatattcgtcgttttttagtccatttatatatcttctttatctctaatctaatctaatctaactataaaaaagagaagtttctacagtatattaaaaaaggaaaaaatgcgcgagaaaataaaaacggtttaaaaaaacacgtgagggaaaaatgtcagaaaaaagcacaaaagaaaacgcgctagaaaataaagtttcgtagttctaattttctgattgttatcgacatggttatgcatgaaaaacgtatattatcattacgttttttcacccgttgcaacgcacgggcatatttgctagttgaaaataaaaatagaaaagatccttcgtggcgtgacggccgggttcgctgcatcgggcacattcggcgccgcagcagcccgcgtgcggcatgcaggaatggatgtaacaacacctatactcgccgtcagggaagcacgcccctgcggccttgcggtggccggtgccaagccgcctacaagctgtttcacaccggcccgcgactcagacgccaagacgaacaaccccatggtgtgtccggttcacgctaaaattgaaagtttggctgaaattggaacgatgtgacggaaaatttagaagaaaaattgaaagtttgtgtgtgtaaaaaagttttgatgtgatggaaaagttggaagtttaaaaaaaaaatttgcaactaaacacggcctcagtaactgaacgaattaactagagtagttcaataaccttaccttgctgatgcgatcgtacatgccttttgtattgtcaggaagcgtggatctccgacttctgagagaagaggagcggcgtgcgggcatggttggctcgatgatgccagaagttttttttttttttgggggtggctatgtttcctttttgtttttttccgtatcattttcaaggggcatggagtttctttatcacggatgaggtattgagatacgagtgggtgcgtagctgacaatacagacgatatccagtggcatgggcacccacatggaagatgattgggtgggttgaacttaacttcagtcttgtgtatttgtgaccgtttggagctagcctcgcgttggtactcatgtttattttattaattaattagaattacatgtttgagatggttattttagttaatataaagggagggcccactttacatcgtgggaaatcaattttagactatctcttgaaaatattagttttctcactttctatattcagtttaggagatctgaaaaaatagttttgggaattgattattataccactaaaatcgccagaaaactgctgtgctgtttatattccatttcatgattggaataaaacgtttgatatgaacagaaatgatagccatcatgatcggaaatttccgtaccttttactaaattgtatcttattcactaataatattgtgttagtaatgtatagtagttaatttaattttttatccattcaccgttgtcgcaacaattctctcatttacaacccgttgcaataaacgggcattttgctagtaactgaaaaaaccgaaaccccatctccccaaaatccactccaactgccctccctcatgggtctcctctcctcctcacgcaccctccctctcgtatcctatctttttgtccttccatccatcttatatagttcatccttatttaggtagtgcttaaatgattaatctatgatccaaattatctttctcctttttttctctaattaagttatatcacatcaattgcttttagcctttatatgattaatctatagggaaaatattcctccttgattgcatctttcttgtcttgtgcaaaacggcggagtcattgtttgatgggtttagcgtcttctttaacatttaaggagtgctcaatcaactctataggaataccaggcatatcagatggtttccactcaaaaatatctttattagcttgaagaaaggtgatgagcgcgctttcctatttacaatctaactcagcgcctattacagcagttttggaaggatcagatggatcgagagtgattttcttggtcttggtgttgatttctccggtctttgatatcttgggcgcaggcacttctccttcggttgcggttgatgcagccagtcggatctcatcccgagcgagtgtaatctcacgcgtctgggccatctcacagctttccttgtcgcaggtgacagcttgcttgatgtcgctccgcaaagatatgactcctcgaggtcctggcatcttcatcatcacgtaggtatagtgtgggactgccatgaatttggctaacgtcgggcgtccgagtatggcgtggtacgccgtctcaaaattagcaactttgaagcaaatattctatgtgcaaaagttctcctgagtgccgaaggtgacgggcagagtgatctgaccgagtggagtagaagacaaccctgggatgactccatgaaagggtgcactactcggcttcagctccgtgcgagggatctgcatatcgtccagttttggcaaaaagaatattgagtgcactaccaccatcaatgagggattgtcggagcttgacgttgcgaatcactgggtctagtactaggggataccgccacgggtggaccactcggtcaagatgatccgagcggtcaaacttgattgttgtctctgaccactgaaggtattgaggcgtgtcgggctggacggcgttgatctcctggtcagttagcttttgcttccgctttgattcgtaggcttggggtcctccgaaaatatggttgagttccttgcgagagtctagaaagccagtcggtccgtcatcttcattatccttcttttttgaagtgctttgctccccgtcagccggcttccatgctttcttggcgtattgctctgtgaactgctggtagatgatgcaatctttgaccgcatggtttgaattcgggtgatgcgagcactgagcattcatgatcttgtcgaaagtattgatgcacggtcgctgtcgagaagaaggtgctgtagtggccacaaggtcctcgggcttacgcttgcgatccttatggttgtacttccactcccctctgctgctggcgcatctttcttgggcttccaattgctacccgactgcttggacacgatgacggcatcatcggctttggcatactcattggctttttgaaacatctgcttgaccgtcctgggatgcttgcgtctgaatttgccgactaagagttcatgacgaacgcccatagtgaaagctgctatgatgatgttgtcggtaatgtcagagatcttattgcgttgttcagaaaaacatcggatataatcccaaagggattcaccgggcttctggatcacattgtagaggtcgaattgggtgccgggacggtcgaaggtgccttggaaattggtgatgaagtgcttgtgaagctctgccgaagatctaattgtaccatggggtaacatgtgaagctaggattgagcagaatctgctagagctaccggcaagtaatttgccatagccgtgctatctcctcctactgcgcaaattgcgagaccatatacggtgagccaagactcaggttttgttttgccgtcatacttctctatcctagtcggcttgaagccggccggccaatctactcgacgcaggtcgcttgtgaaagctgcaactctagcttcatcatcgtcgtagcggtctattgaacggcgtggaaggtagcctctttctgcgtggcgccgattgagtgtctcgtgaagatcgacgggctacctacgacgtggagagctaggctgttcggcacggcgctccctgtgcctgtcagcagacgaatgaacagatcgttcatcatggtccctgctcctgcgattggatcctgacgcggcgacgctaaggcttggttgatgataatcttgagatcggagaggcggaacccggctaccagtcggcgtgcggacgcttgcagagttaactgggacctaggcgacgatcatggtcttcatctggttgatgatgttgtggacatggttgggcgcgtctttatgaagcaaagtatccagaagagtgattgtcgctaacgcgttctgctgtggggtgcgaaagaccactgtgccttcaacgtcttgttgctcgatgagttcgcgtgcttgtcgcccagcctccagggtgtgttgtcgccggtcctcagcctcctttgcggcccgctcgcattcctgctgctgacgctgcaaccggtatcgctcttgtgcttgtcgttcctcttccagtcggtgacgctcagcttcctgtcgcatgcgttgttcttccgcttcacgggcttggcgctgttccgctgtctcattgtcggccatgaaaacgccgaagaagagaggcgtgtaattgtcttcatagcttttgtcgaaatcgtcgaggttgctaaagtcgtagttgtaaccgaagtcatcatagtcgaggatctccgttggtcaagagtcgacactaggagagatgaggtagccatccagctcttcggttgaaaccatccgagaggctgaagtatgatgccgactccctaaagctagattggatcggggccaaagccggatctcctctagacctacgggaagaggacgcccttgtggtgaagactgcagccagatcatcagggagcttcatcagaatcggaggatacgccgcatcatcttgatcaggtcgcgttggagtagatgggatctcatctgtgtggtttgaagccaactcagatgggatgatcttggagtagatctcaggccgagtttgggagaccgaatggtacagagaccgcatctctttccgacttgtttgaatccgagtcgaagagagagatcttgccgaagttgtcggtgacgaagtcaaggctgccgaaccgaaacatctgcccggaagggaagacgaagtcgtcgatgccggaaatgaatcccatcgcactaatcggcgagaagcttgacgcagcccctacctggcgcgccaactgtcgaaacaagatttcggcaatacaaaaagggggtggctatcaagcaggaaaagtggatgggtttggagacaagagatttatacaggttcaggccctctcaacgagaagtaataccctactcctgtccgaggattgatccgccgagtgtattatcgatcgtatgatctgggagaaaagttatgccccaagaggcacccgaacccctccttatatagtgggaggagcccgtattacaacatatagcccatattcttaacggaataggcaagtaaagataaagtacaatcgtaaccgactagtatcctaggtatttccttaatacataagttaggaatttaacctgagtcccctaaagatattctatctatatatggtacccccatacctagtcggatatatatgccgtgtgggtatggggtatccataatctccacactcgagcttatggatatcgtggtagctttcatccgaaagtattttggggtatccaattaacgagggatggaaatgcactttcccctaatcgattgtttggttttgagttttcaaaaatagtgggcatacttagcatctaactacctaaagtgctctaacaaaatgaattagaaaggtgaaggtgaagcttggttttgagttgtgaattagagggcttcacaactccacccctgattcaaatctaaatttaggagttagagctcaaccaaatggatctaaggtaagagatagattcatgaagaaattaacttaggagttagagctctaccaaatggatctaaggtaagagatagattcatgaagaaatggtccctttggtgtggtaactccggaactcactaatttctaggccttaacacttcacttactaattgcttttagtacaacatcaccacctcctaaagggatgaaaactaactgccttcaagtcggtgacaaaactagtccaaccgagctgattacaatggatgtgcagagttgtcatcacgtgccaccccgttgatctagctttccttgttagtaaaatgaaccttcttgtagatgacgcatactcttgcctaaactccagctcggcaacattcttatagagagcatcaacagcagcaggatgattgataatcgtatctattcattcgccaaactatcctccctaagagacaacattgagatgcctcatcatctgcaaataacttcagatcacgagcgcacatgtggcctagctcatactactgcagcaaagaagaggcttcacataaaaaagagagtcattgattaattcttccaaggatggaggacctgagtggccaagcaggaattctacgtcgttttccaacggcgtcttgctagctccacgacggtgttctccctgtgccttaaggcttaaactgatcagcatcgccttcaacgtcgtgcgcccggcgtgcccgccatcgtcgagcatcacctgcactgtccgtcctccagccgcgccgcagccaacaacgatagattttttttaatcagactattataataatgtgagatcatgttgtaaagatttgattacaatgaatataatggtataatcagattataaatggaattgatgatttagaaaaaaatcatttggaagattcataatatgcacgtcatcagcaagtgatcgatcgagctactagcctttacagtttccatcgcctacattcccacatcctctctcatgtctctgctggtgagtaggattgggcctaatcagatttcacgtcgatgggcgtccgatcgttcgtgcgctcgacatgatgcattgtcgaacctgcattgtcctccagttaccgccatataactcctaaagtatttcatggcagtggcggtctggggagaaatgctcgagggaattttgagcttcgcatgccaggtcatgaactccaatatcttacagaacctcagtgtggaggcatcctagtccgacattatcagatggcgtggggcttattcaagggcatgcccaccatgattcaagggtattcagacgtatatcaagaattatataaataaaaaaataagcatatatactatgtattacacgtatctatatatttttaactctactattataaaaattaaagatgtttttgtcaagattttgatacgtcatccatgtttgagtaggttttttaattatatctgtcgtggctcatgtgggaaccaacaagcttttaaacttagtccgactccaattttggtccatatgtccatcgtccgtatgtatcccgctcacgctcctgtccgtcttgccgatttttctttctttcatgtgcgttaaggattcagctttgtggagattatgggtaccccatacccacacggcatggttatccgagtagtgtagggggtaacttatatttatgaaatatgtaacagatcatgacttgggtattacgtttccttgtatattatggaacggactaaagttctggtttgataagattgtaaagtagatttaggaaaccgacaccgtgttggttaaggtttctatcttgtaatcctgccccccatcctatataaggtagcaggaggccctctaaggggcatgaggatataagatcgtcagatctatactatactcggcggattcaaatccccaaacaggagtatggtgttacctctcattgagagggcctgaacctgtctaaatcccatgtctccgcatccatccacttttaggtctcgtgcgctacccccttttattattgccgaattcatgtttcgatagttggcgcgccaggtaggggttgcgtcgagtttttcgtcgagaagtgcaatggaatcaatttgtctggagatgtgatgagatcgatctcaatgagttcgacggtttcaattttccactcgggtttgccgttccaatcaaacttttatcagattagtttttcattactatttgatctcttgatactttctggttctttatatgcaactatgagatcaaggctaagcggtcggtgacctcgcccatccggccgctgatccgaacaccgtcacgtggtccagcagttgtccctgcacgcggagcagtgctgaacatcaagctgtcatcggctacagggggttatacacgctgcatggcgcgtcgtcggctgtcactcatgattcagcctcattgctcgatccgagtttttcgtttcctatccatatatattatatttatttctaattgcagattgatctgttctagcactactttttttttacagtaccgtcgatgccaagtgatagcttatttttgggcagtactcgtgcgtactccacctcggctatggaggctcaacggccacgtcatcaagttgttacaagttgtacatgtatatatgcacaaatatatatatatgcttgggctagcatacgaacacatggatctgcatctggagtacatgtactccctaatggcggttgtttatctaatcgccttcgtcgttatcgactggtgttctcgccttcatggttggttggtcacaccaccattgatgggcgtctacgtcttcaccgatcggccgcctcgtctgctgccgactggtgtctccggctacatggctggtctattataccactgttgttgggcgtctactacttcaccgccggcctgcctccgtcgccaccgactggtgtccttgcctatacggttggttggtcacaccaccgttcatgggcgtcaacgtcttcaccgactagcttgcctttgccgccgtcgactggtgtctccgcctacacagctggcctattatgccgccgttgttgggcgtctacgacttcaccgctagcctacctccgttgccgccgaccggtgtcctcgcctatacggttggttggtcacaccaccgttcatgggcgtctacatcttcaccgactggcctgccttcgtcaccgccgactggtgctttcgcctatacggcatctacacctttactgtcggccgccgtcatcagcgccgattggtttcttcgcctccatggttggtgtactccgccgccgttgctgatggcgaccatgtcttcactaccggctgcagtcatcgccgccgactggtgttttcatcaccattgatagactattttgtttccccatcggtcacctctatcgccaccgagggaaataaaaaaaaagctaagtcatcaataattttctttatatgatattttccttttcctctgcctcactacatcaactggttcgccattgactagtgagtcgggggctacagatgttatatcatatttttttcaacacttttcataatatttatcttgattgctcgcgacataatctgagtacaaaagtgcctatcgaattatggagtttcatcttcctttgctttccgtttggtttgccaatggatagttgcttttgggctgattcctagcacccgggggctcgttggatggactgaataacacaaggtgctaagtattactcggaataaatcaaaagcatagagataagataatttattttctgctcttaacaattgcaagagtacctgagtagtaaacttcgatccgtgaaactttgttccattaatgacgaactcatgtcactcgtatgcatatttgggagatgcttgggggctatgactagtcggacagagtgtttaaacgtacggagtcatctgctcggggaaatcgaaattgacaagaggagaaatacatatttataaacattttaaaatacttgaaatttcctcgagtattatatttacatcagatactactcatcccatatgtttgttctgtaggattcagatccagatatgcataaaagagattcatggctttaaacttatctcttacgctccaggaatggatcagtcagaacatcatcaaccggcttgccttcgccgccgccgactggtgttttcgcctatacggttggttggtcacaccaccattgttgggcgtctacgtcttcgccaccggtttgccttcgccgccgccgactagtgtctctgcctgcacggctggcctattatgccgccgttgttgggtggctacgtcttcaccgactggttgcctcgctgccgccgactggtatcttcgcctatacggttggcctattatgccgtcattgttgggtgtctacgtcttcaccgatcggcttgccttcaccgccgccgactggtgtctccgcctgcacggctggcctattatgccaccgttgttgggtgtctatgtcttcaccgatcggcttgccttcgccgccgctgactggtatctccgcctgcacggctggcctattatgccaccattgttgggtgtctacgtcttcaccgacaggcttgccttcgtcgccgccgactggtgtctccgcctgcacggctggcctattatgccgccgttgttgggcgtctacgtcttcaccactggctcgccttcgccgccatcgactagtgtctccgcctgcatggctggtttattatgccgccgttgtaggacgtctacatcttcaccggccggccgcctcgtatgacgccaactggtgctatcgtcttcacggctggccacgtcgccgccactgtaaataggcgtcatcaccttcaacacaagctgtctacgtctgctgccgactggtttcttcacttccatggctgcatgattctgccagtgttgattggccttatcgtcttcaccaccggtcatctcgtctgctgttgactagtgccctcgcctctacggctggtttatactgctaccactactgatggacgtcatcgttttcattgctggccgccttgtctgacgccgactggcatgttcacctccacggctgcacgtcttcgtcatcattgactgacgtcatcatcatcgccggtttgccttcggcaccacccatggtgtcttcattttcatggctggcctattttgccgctgttaaagaacattttcgttttcatcatcattctacttcttccgtcgccgactggttatgccgccgccaactggtgtttttatcttcacaactacttgtcttcgccaccggtttgcttctgttgccgctgactcgtgctaacgtcattacggctatgcaactttgtcaccatggtggagctatttcatcttcattgtcttcggcaccggcaaattctattgcctctacttttggtgttccagtattcaagatttctactcgggcatctttaatatgtatcttcactcaagtaatgagtactcgacgacaagaggttacagtttttgactctatgttcagttgttttctaactaaccaaagagttagcggctacgcaaatacaaggctcaaaaattcgatcaaccaggagattaatcagcgatcgaatcgatctacaaccaggcttgttctcgtcatttttactctatcagtgagatcaaatgcatcgccgccatgctgccatgtttgttggtccatcggtttcgtcaccaaggcaagatttaaagcaatcagcaagtagttgccgtcgaaatgatgcaaatatcaccgtcggccgagcctgtatatcaccaaggcaattctatttggatacttatggcaagacaagaagtccaggattcaaattaaatatacctggtcaaacttgtggtcaaggaaattaatccatacacaaatcagatattacatacacaaatcggtttccaaactaatccatgcatgtgctagtgtgctaccaagaccccgtgtcagactcggctgaacgtgctccagaatctggccatgtgcatctcctgtttgatcactttggcttgtgccacgtacatagaaaatcagcaattaacacttataatcagaaggttgaccaggactgtgcatgtaaaattgacaatatacggtcatcaaggtcaccgatcatcaccagcatctgtcatcgtcatcagctggtttctacgcctccacaatcggtggatcccgccgccgtcattgatggcgacatcgtcttcatcttcaccaccggccgcctcgtttgccgctgatatcttcatcttcaccaccggccgcctcgtctgccgctgttgccgactagtgttctcgcttatacggttggtgaactccgccgccgttgatggacatttttatcatcaccgctggtctacctgcgtcgctgccgaccggtgtctctgccttcacggtttcaactctgggagtcattatcttcgtcttcgctttagagcttgtgttctacttcagcaactctaattatttcaccggcaattttagcttctccaagtttctcaagtatcaagtccaagattaaatctacatgacctgtcagggagtttggagttatcaaccaattagctcagtttcgatgtgttggacaacagtttctactttccttcagcacctctacttcattggccctgacatctccaccgttgctaagggatgactacgtccttgccgtcggttgcttttgtcatcaccgactttcatcgctgacttgttatttcgtcttcacggttggcctactacgcaactgctgagagaggacctcatcgtaatcatggttctactttctatgcttgaagactggatcaatcattattccccgtaaaagctatcaaccgaatagttgcgccagtcgggattcgattttatatctattttggagtatcccataagggataatcactcagatcagaagctattcatatgagctacacttggtctatatcacccggaagatttattactcgggagcatgttacatgcgtcatcctttaaagggtgccgaaggcatattttttggcctaggcctaatatgtctgcagcccatattttcaggtgtggcctgtcacattcttttagggacttaggcactttttgcttaggccaaagtgcgcgtgatcaagtgcccaataccttaaaatccttttattccgcagttactcaactttttaggagttggtacaatgcattttaaaaggtgcctaatagtgatgtttttcatagctgccccgctgacttttttatatagtcaaggcgttgtttgggtttataaagcaattgattggatacaatatcgttgatttttgctacgtaagtgtgtgtttttgttgaccaatattatggcttaggctgattatatactgtggtcattttccaggtggttggtaaatcctttatgagtttatttactcggattttataccacatatgccatatatttctaggtgtggtgaaaccatgtgtcttttagggacttaagcacatctgttaaagcagtgtgcgcacgatgtgtgcccaatactttggaaatttctttactcacagcatataagcttctttatagctattttgctatgtgaatttcaatgatgtagtcaactttacaaagcaaacggtatatcacttggatcatattattcagggattcacaccacatatgctatatattaatattaagtcactcggttgactacaattattaaaaccactcatttggttagattatttactccttgactatatgtttagtttgttcaactatccacatagtcgggggctacacctaataggtgcatctagtcgatgcacctaagactacattcaattatttttcagccctccacagtcttcagatttggtaaaagtactcgagagatcatggcaaagatgattgaagcacttggctttggagtaatctagttcgagagaagattatctttttgactgtgaaggtctcaggggctactgtggagattatgggcaccccatacccatacggcatggttatccgactggtgtagggggtaacttatatttatgaaatatgtagcagatcatgacttgggtattacgtttccttgtatattatgaaacggactaaagttctggtttgataaaattgtaaagtagatttaggaaaccgacaccgtattggttaaggtttctatcttataatcctaccccccatcctatataaggtgggcaggaggccctctagggggcatgaggacataagatcgtcatatctatactacacccggcggattcaaatccccaaacaggagtaagggtgttatctctcattgagagggcctgaatctgtctaaatcccttgtctccgcatccatcaacttttagatctcgtgcgctacccccttttattattgccgaattcatgtttcgacaagcttcatgtcagtatcccttcatgcatgcgtccccacaaatcaaccagatatggatcaaagactaatatgcgatatgttgatcatcttagcggcacgctcagcttctgttcttatttcctttgtgcttgctgttctaatcctttaaattttggcttaagctttttcaacgtcagtgcatattttgattgattacagcatatcataggtgcgaacgttttgattttgttttcttttccatattcaagtagagatttgagtgggttgggtttgagtgtccttttgagatcgtgtccatgtgcgactaattaaaagtctgtgtcaaggtccggtctcaattattttgcatcacggtgttgtgaaaatagaaatcacgcgacaaacgtttagcaaaatcgatacacaacagaatatatgcaggtttttgtgccgaagtgcttatcaccaatcattttaggatcgcatgaaatggctacaactatcaaaccatcgtctccatgtaacgagagagtaatgctataccacttttcatgctcagtccagtcttttttttatctaaattaaatagctaattatgttgtctagcaaattacaattgtcttcgttttcttttcaatttgactttgccatgtactattcataggtgataaggatggctagatctcatcccagtggactaccacattgcttgttaaatagatttttctattatgaccgcggtcatcgtgctctcactggtgcgaattaaatcaatattctatcctgtaatgctttgccttttttcaattatgttgtccatcctgaactcagtatgggaggaggtattttggatatactctcgttgttttgcgtgtcacagcaaaatttatcaaagtaagatggatcaaaatgcgaaatatcacttcacaaacatgcatgtaaggcgcggtttgacacggctctagctcccaactctaacttacctagagctggagttgtgctaaatggtacagattctctattttttttagcagaattgatagagctgctccataaatttatactatggggtagagctattttctgcagctccactccactccaaaagacccactaccatttcatttttaatatatttacacaaaaaatgccactgaacaaccccttcacacctcctctcctattctctctctcagtcctcccaatcgacctagggcggcgaccggcagcccgactgcagcggcggcccgtaggttggctgcggtgaccggcgatgcgtagcctggcggccgtgacacgcggcctggtggtgacgcacgggctggctgcgacaaccggcgatgcgcagcctgggcggccgcgcgggggctggcagcggtgactggaggtgcgcgggttggctgcgacgcgcggactgggcggcatcccgcgcgggctgggcggcattgacagcggtggatacaggcggcgggcgaaagtggcgcgggctaggtggtggcggcgcaggtaggcggcgcatggggtgaccagcaacgttggcgcgacaaggaacacggtggtgtggagctaacaagtcagccaaacactttcaaactcacctcggctcctattggggctagctctcactggagttggagtttagagttcagagttggagtttggagctctaccaaacggggcctaagtataaatataatatacacaagtcaaaataaaaataagaaatatgattgtgcatagtgtgcattattgacaaaaacaatgggacattccctcaaggggaaaagactttcacataattctcctattgggattcaatgtatcatcgtcgatttgacgcagtctaggatgaccaaactattgggataggaacgatacggcaccgagttggacggttcgggtttctatcacattcatgttttttataaatgacatttcatcctctgctacatatgcaattccaaatcaatgcaatagtcatgtgtcaacttctttcttttgatctggtggagagtcgtgcgttttctaaccctttccgcatgttgtactcatgcacaatgaagcatttgatctgtttttgaccagagagggtcttggatacatattttaaaaccgttgaactcatgcaatggctcatttacagaaggtcaattgaccagtgtttgaatcatcaaaaattatttatataagtgcagaagatacttatcaattgtgactgtaaagttagcaaaaggcaactcataccaatgatatgaaattttcattcataatgcatttttttcttcaaaaaattcatagtgcatgttagaaatggtaatagtatcttatatataccacaattagccagggatgtgaagcatcaaaaaagaaactatgctatcaatgtatacatttgtcagttatgggtcatatgttttctgccaagttaattacctgaggtattggagtctaccaaattcaatcgtagtgttttcaacacggacatgttgtcattatagagcttgttctgcgtactttagggatcggtgacatggtgcttttccttgtccttgttgggcctgatcgtgtcgtcgttctgactgacaatgagctcagtacggttcacatgtgggctgatgacagcggtggttcggacctcttcggctttggacctgcttggcctaatggcatcatcgttcttatagatgagatagcgctagcagcagccgcgtaacgggtggaatgcttacacctcgatgatgacatccagttgtccacattcgaattgcatttggcagctgcattaggcattggcaatctacatgtcctttagtttggggaaagtgtcaaatattttttccgatatgatcacgtcattgtactcagtagtgccaaataaatcaaatattctatcacataatgacttactcttttggagctttgatgccgctaccatatcttactatgttttgtaatgtaattgatcatacttggtctattcgggtctaattcacgtaatccttgtagtattaagtattataagatcgttaaacaagacatcttcattattagctattatgtatgcacaaaaccactaatgcatggtatgatgccgggaacacaaatgatttccaatgtcttaatccaggctggcaaattttcaccataaactacgaaattggttgtttgtcaaccccctcaactctcaagaacagagacaaataacactataagacatatttttactagttgtttcagatgaagctggttttctgagtctgtacatacctttatcatgaattttgctaatgtagaagcctccacaacaatgaaacttacctaattaaagttcatgtcaacataaaaacaccacatgtgatatgttgattcaaaaccatcaataaactttgagaagtttatggctttgacatggatagtagaaaaaaaaagaagtacatcattgagaaccataggatcattctcatccaaaaaagaatatcgcaagttactactactactactattattattaaaggcaccaaatttgaatttaaaccaataactacataatttaaacccaatgattactcatatcaattaacaggcaattaagctgcacaatttgtataggtggttcaaaatccttgcattatacattatagggcaattaagctacacaatttgtataggtgcttcaatttaagggcatgtacaaccagccaacaaagcttccatcctctcaaacactcgttttgtttttagaagcaaatcaaaccccatggttctgatttctatcacattcatgtcttctgtaaacattcttcttcctttgcaacgggttgaatttcatatcaatgcagcagtcatgtgttaacttccatttttgctggagagtcatgcgtttgctaacccttcccatatgctgtactcatgcacaagctaaggaagtgtttgatatgttgttgacaaaagagtgtcttggatacacatttaaaactgttggactcatgcttttgctcattacagaatggggattgaccactatttgaatgataaaaacaatttctaagggcagaatatactcatcaactgtgacagtaaaactggcaagggaattcataccaatgatatgaaaatcccgttcaaaatgcatgttggaaagggtagtagaatttttcacatggaaattagtcatggatgtgaagcattaaaaaaaaaagaaactttgagcatgcaaagggtagtagaatttttcacatggaaattggccaactaaatttgcatgtgactattattcttcatagtggacaatcaagaatttttcaagaaatcttcaacgcacagaacgcaaagcaacttagtggaacttcgatttggttgattaattctgctctgtttcgctactgattttacagagtatgaaaccacaagtacttcctgtcaagtttttcagccaatggcatccctctctcagcaacattaatattttctgtccaagcgtaaacagttctacattggaaataatgaaattgacgcacatataaatctaaataaaaaaaccgtaatatcaaataaatagaaggggtgaggctttaaacccaggccgacaagcccaccaccttatagagctagccgaaacatccctagtcatttctcgcatataagtctaaataaatatccaatgaaattatactaatcatgaacaccaacaaagaatgctgcaacgtgcagcaggacgatcaacgcgttccccaattatcttcgacacttcttgtgtgataattggggaacgcgccgatcgtcatgctgtacgatgcactccgtcaagtttgtcacagccggaaggaacggcatcgccgcccgttcggacacatctgtccagaggcggcggcgcacggatcacggctggcgtcgccgccgccgcgatccccacgcggcggctggttcttcaccgtagcgagttttgtccgcgcggcgccttgcaagctccacggctgcgttctccctctgccttagactgacaagcatcgccgccaacgtcgtgcggccggcgcgccccccaccgccgtcgtcgagcgccacctgcactgtcctccagccgccgccgtagagctcctcgaggatctcatggcagtcgctgctcgggaagagatccttgagggcgccatgcgggtgtggctctctcctctccagctcctcagaaaaacctcatggtggtcaccagcttcgagtaccacgcgatgaactccagggtcttcctaaacgtccgcgcggcgtcgtgcgggttgtcggtggtggtgacttgccagcacgcgtcgctctcctcgccgtcgtcgagggggtgtcgtgtcatgctgttgatgtctgcggccaggggcttcttggccgcacggctcggcaacacggcgccgtcgtcatcgtcgtcgtcgtcgccgccgccgtcgagcgcgctcttgctggtctgggggtcggcagcgcggggcttcttcttgggcctgacggcgtcgctgttcttgttcacatggaggtcgacgtggttgatttggaggtcgaagatggcggcggtgaggagctgcgtggctctggccttgctcggcctggtggcgtcgccgttctgattgatgtcgacggcggcggcgcacttcgacgacgacgacgacggccggtgtcccacatccggctcgccgtcggctgcggcatgtggcggcggctggtgcttcggtcgagggaagaattcatcgatgccatggagcaggtaggggtgttccgcggcgaggacttcctccaaccgggcgtagacctgatgcgcgtccagccctttgtccttgttcacgtcgtggattacgtgttcgaccctgtcgtgaagctcgacgccgcctacgatcttcaggctcgccaagaactgctcggccttggacaccttcgctcgtcgctcggcggcggcggagctctccgccacggcggcatcgtccgggcggcgccgctgtgcgtcgctcctccgacgcgtccttgccgccgccgctgctgctgcatgatcgccatcgtcgtcgtcggcggcgggtacgagctcgaccctgttgcggggataaataaccgcgttgatctcggcgacgagatcagggtggccacggaggagctccgccgtgcggcggagcaccggcgcggcgggggcggcggggtctctgccgtacgccgtgagcacatcgcagagctcgacttacacggccggcctccgccggaaccgggccttaacattgccgaggaatgccaccgcaccggcggcgcgggattggacgtcctggaactccggtggctgcgccatggcggacagtctgagagagagttgagacggtggtggtagtcaagacgttgttgacgctggcgatggttagtctgtcgaggtattgtaagggaagatgcggtatagaaatgaatccgagtcggagttgattctccgttctttcgtgttggtgtgcgtcccaatttcctcttcctggatttatttctacctctctttttgctggcccaaagcgaacagcacattgctcttccacatgcaaactgagaaaatagacatttggacaggtttgaaaagcgattttgctagaacaccatcccaaaaacgcgtttttgttaaaaatgccaatacggagagcgcgccgtcactttgccattttagggtgtgtttagttctttaggtgtaaaaactttgaagtatacagatacacatttgaagtattaaacgtagactaataacaaaacaaattatagattccgcttgtaaattgcgagataaatttattaagcctaattaatccgtcattaggaaatgtttactgtagcatcacattgtccaatcatggcataattagactcaaaagattcctctcacaatttacatacaaactgtgtaattgattttttttattttcttacatttaatgctccatacatatgtccaaatatttgatgtgacctttttggccaaaaatttttggatctaaataaggccttagccttttgtatattttcaaaataattttcgttagaataccgggtgatgagacggaattgcctctgctcgccgggtgaaaggagatcgatgcgaggccatctataggcccgaggggcgcggctgggttaggacggcgcgacaatcctcagcgacagcaaggacaagatggtcagcgaggatggcgacgcagcttcctactgatcaggatcaagtgcagtgcccacgctgtccacatcctcccgggcatacacgcgcccaagcggagccccatcgccttcaccgtcggcgacggcctctacgtcatggaggcggcgtcaccagagccactgccgatgtgctgggcggagcactgcttcgaagcactcatccactgcctcccgcccgcgccgccgccatcgaggactggaaccggcgctccctcccagcggtgcacaaccccagagacgacaggcccgccgcatcgccgcgcacgcggtggtcggtgactcccaaatttgggtgtccacggagcggcatagcatgttctccttcgacacggcgagcgatgcatggcccaacttcggtgactgggtgctcccgttccgcggccgcattgagcacgtcccggtggacaacctctcgttcggcttctcaccccacgacgacggccacctccgcgcctccgacctcactgccacgcccccattgctgccaccgcacaaggtttgtccagccccggtggcgtcctacctcatcccgctcggtagcagcatgcctcgaagacgacgacctagcactggcgattcaaggccgccgcggaggaagatgaggaggagacggaggtgagggagcggttcgcggtggtgaccggcatggaggtggaggcgttggggagcatgagcatcaaggctgtacgcatggcgagcatgcgcaattccgtctcatcacctggcattccagcgaaaatgatttcaaaaatacacaaaacggtcaaaatggcaaaatagcagttggtgcacgcttcatattagcattttaatgaaatgcattttcggaatagcatttcagtaaaaccgttttttttatcgtggccaaattaccattttctcgtgctttctggcgcgcatcacatcgcacgccatatccgatctttgtttctcttttgtcttccctagcgcctcagttgaagaatactgaaaacttaagactgtctagcctttaaattcctatgtccacaaaccaaaccatacttaaaacatggaaatgctaagcggtcttaagcctcagtccaagatttcttaaaactcctacgtctataaatccatatatatatatatagatctatgattacatagataacatttcgataaatcatttattttatattttctatataaaatttaaaattttaatccactataatttaatatacaaacttcgaatccaccatatatctgagacctgtacctatgtcaaataggccattattctctcaacaatattgtagtaggagtggagtccataacaactagtgttctcaatctcacccgaacgaccatccgcaagaaaaaatacaatataacaaagcaaaactcaccagataatgctttgggtcaggaacctgatcccaatcataaaatcgggtggtctccttcttactgctttgtttcatgcttgtatgttacgtaacttcttacttgcacgtgctattagaattataagtacatattttttttcttatctaattgttctctcttttaaccccatgcatgcaataaccttattattttttctaaattattttttcttctaaattatttatctgatctacaattcgattgtaccaataatttcttacagttaaatctttacaacaaaaccgcacatgattatatattccgacaaaaaaaagttaggtttttaatggatttgtttaaatatcgcaagtgcttcatttaattgtttcggttagtattttacgttgtttccttagttgatttgcaaatgtaccacattgtgttcttcgaaagtaatgttggttgcatgatataaaatgtttaagcagcatcaagtagttgcaaaaatattttttatttcatatgatgtttttcgatgtttcactcattggattcaatatttcatatattggttgttgatgttgtagtcagtattttttagtgttgcgtttctctgaaatattttataaagtgagtcgatacaattttctacaagtagtgaaacaatgtttaagttttcgtcaaaatataataaagtgtgataacaaaccaatacgccgccatatatcgacgtcagagataagcctagacataccccattcggtgcctgcgaaggccggcaagagggatctagtgccatctctgatctcgacgagtccgtattcgaggaggaagactaccttgtcgtcgactgcgagttggttatctagccgccaagtcgatgatagctagataggttatctcatatattgtatttgtgtgatccagatgaataaagagcaacaccggcttcggccaacaagatgtagggctattacctgtcagataaggggcccgaacctatataaaaatttatgtctccatctcttttacctcaatctcgcatataccctggtaccaacgatcctcatactatccaaataccatagtcgcgatctcaaacgtcgacacacatcatatcttcaatcatcggttgtaatggcaacaatttcaacttcaatatcttgtaccatcggcttgtaccctaacgccccctgagccaaatcattagcttcaacattctgctcccgagagacatgcctcaaagttaccaaccaaaaactattcatta

SEQ ID NO: 66872 - DNA, 3543 bp, Oryza sativa
agctcgccggcggcaagagcgccgccatgacgccgctcgtcaacacctccgaagactcctccgattacatgatccatctggaagggatcaaattcggcgacgtgataatcgcgccgcctccgaacggcagcgtcgtcctggtcgacaccatctttggggtgagcttcctggtcgacgccgcgttccaggccatcaagaaggcggtgacggtcgccgtcggcgcggcgccgatggcgacgccgacgaaaccgttcgatctctgcttcccgaaagcagctgcggcggcgggggccaacagcagcttgccgttgccggacgtcgtgctcacgttccagggcgccgccgcgttgacggtgccgccgtcgaagtacatgtacgacgccgggaacggcacggtgtgcctcgccatgatgagctcggcgatgctgaacctgacgacggagctgagcatcctgggaagattgcatcaggagaacatccacttcctcttcgacctcgacaaggagacgctctccttcgaaccagcggattgcagctcactctcctaatcaatggatgatggtgcttcttctcttaggaaaaagttcgtgtgcttagctagatataggtggtgtgtgcttttgtgacttttttatgctgtgactgctttagtaatcggtgtgaggtcctggttttattagatcttgtgttttcatgtctcggtgaattgatgtaattattaactgtagcctttaagtaaaggccgggattctatctcattacctaaaagtttttagctagtaacagtagttagctttgctgttcaaattggccatatattcatgcttattgtcagaataacgctgccagtgccagtcggaatgagctgcggcatgcttatttttgctctccagtgtagcattgtccagtactccattaagtttctctgttcattaatacacgacaccattcagttttgagaatattttgattttttttttagaattacatgtacacttacaacgcatgcgcactcacccctatgaacacacgcacgcaaaccctacccctatgataccattgaaaacacaacgccgttaaatcctagaaaattcgctctcatggggagtcaaacccagaacctcaggtgctactgaagctcttgtaatcactaggttacaggctctttcgcaagaatattttgattatttgtcttaatttaaattgttatatgaatttaaaagatataaattatgcttaaaagtatctttcatgataaaataattttaagaaataaatgttaattacttattttttttaataagataaatattgaaacatatgtctaaaagtcaactgtctaatatattaaaaaaagtaagcatttttctggatgaaactctatagtgtatcggtttcacacctgctttacactggaagaattttagagcgttttggtataaattgcctacgagattttataaaatttgtgtgttccaaagaaatcctcttatattggtgcaagtaatacatggtttcacctgcgcttgatcgttcttctattttgccatataagagtattgttcttgtgttgatttggcccctataggctgacaagggcgctgactaaatgaaatgggcagggtgataagaattaagaatacaacagttggaaaagaggcaaaggaattaagaggaagcagaacataaacggcgggatctggtgttcgcgatgagtatttgtattcactggagtccgatcacaactactaccactgatcactaggcccatgttattaccaacatgcgagataaacattgcgcatgtcctaactgaactttttgttgggatcggtaaaaaaatgctcaataaatcaaccaacctcaacaaatttaaatttttattatataaaaattgggaaactgtgcgttgtagttgtagatggtcgattactagtctaaaaatgatagaattgaacgctcctttcatttgttaatttctctataatcagaactgttcaacttgagttgctaacaaacacaaatctcaaccatgtaatttttaagaaaaacaagctggttaaccggccagctcccacgagttgagtttcgttataaatttatgagttgctacgagtatttttaaccttttccaattatggtttggaaatattccagcaacttactatcgaaatttaacttttgtgacacatcactctctttttttcgcctaaacgataccactctggcactatatacaccacgcataatataagcctcgacaatggctgtggcgtggtaccaacaccatatttgccacaccgttgatttttggaaaaactattagaggtttatttttaaaatttctattagaaggttcactttttttaaaaaaaatatatccttattgcataagtgacgttagattgatgtatcagttcaggattgaagctaccatttgagtggtttctgacaatttcctatatctagcaccatgatcagatatctaacaaacgctactgaatcccattttgagttcatgaatattcaaactgatggagatgatgactaaaaagtggccagtaattacagtgtcattgtctgtcttaaatcttaattggtcctggtcattgcatgaaccagctatagcccctatataatcactattcactaccaccgatcgtgtgatcttgaggaagaacataatcacggtagctaatccttccctgtcgaagtaaccatgggaaggccagtggcaacactgttcgtgctgtgcttcatctctgtgacggcgtgctcgctctcggagcaggccacgcgcggccgcctcctcgccggcgtcgacgcgacaccgccggcggccggaggcgcagtggccgtgcccatctacctgtcgtcccaggggctctacgtcgccaacttcaccatcggcacgccgccgcagcccgtgtcggcggtcgtcgacctcaccggcgagctcgtctggacgcagtgcacgccgtgccagccctgcttcgagcaggacctgccgctgttcgacccgaccaagtcgtccaccttccgtgggctgccgtgcggctcccacctctgcgagtccatcccggagagcagccgcaactgcaccagcgacgtgtgcatctacgaggcgcccaccaaggccggcgacacgggcggcaaggccggcaccgacaccttcgccatcggggcggccaaggagaccctcggcttcggctgcgtcgtgatgactgacaaacgcctcaagaccataggcgggccctctgggatcgtcgggctagggaggacgccgtggtcgctcgtcacccagatgaacgtcacggcgttctcatactgcctggccgggaagagcagcggcgcgctgttcctcggcgccaccgcgaagcagctcgccggcggcaagaacagctcgacgccgttcgtcatcaagacctcagctggctcttccgacaacggctcgaacccgtactacatggtcaagctggcagggataaaaaccggcggcgcgccgctccaggcagcgtcgagcagcggcagcaccgtcctgct

SEQ ID NO: 66873 - DNA, 924 bp, Oryza sativa
gtgccgatggtgaggttcgccatgtagagcggctgggaccagtagatcggcacgacgccgccgccgcctcctgccaccgccgcgtcggcgaggaggcggccgcgcatgttggcacgctctacacctcgccggaggccgccgccgtgcgcgcgcgcgagcgaacacgccgccgagcacatcacgagcactagtgttgccactagccttcccatgattattatgactactgttagttagctaatgagaggattagtgaccgtgattatcttcctcttccccaaatcacactatacaaatcgagactcgaggcatgggcttatataagaacaaggagtccaggactaaggccctgtttggggagcttcttctgctagaaactgccccaaacagtccacagcttctgagaatatgtagttacatattctgaaaaataaactaagaagccaaaagctggagaatctgggttttagtgcttttccagattctcagaaactggctaccaaatatctgcttctcagaatttaaagctccccaaataggctctaagtcaccatgagtcagggttcacgaaactgatgggtttaaccttaaactgatcaatttttatgagatcgctggttatcagtttgtcgttattagcatgtttttataccgtactgattgaaagtcgtcaatttttttaggttttcgataaaccaatgaaaaacgattttcactttgtaaacgaaaaggtaaaccttctcaagaggcattaacactgtaattacgagccacttgagccttcatggtgtcatcctctccatttcaatattcattgacgttcatggagctaccttggatattcctcagaaaccagcgaaactgcgtgccattgagacgaaattaagcttcaactctgcacatatctatcgttcaaccgtcact

SEQ ID NO: 66874 - DNA, 1832 bp, Oryza sativa
tgctcgcgttccagggcggcgccgagatgacggtgccggtgtcgagctacctgttcgacgccgggaacgacacggcgtgcgtagcgatcctgggctcgccggcgctgggcggcgtgagcatcctgggaagcttgcagcaggtgaacatccatctcctcttcgacctcgacaaggagacgctctccttcgagcctgcagattgcagtgctctatcctaaattcctaatggtatttcttcaagcagttcatgctgcaaataatacgtgaacctacgagtttgtaccgttgtacacttgtactacgtatcctagcttcctaggcaatatgatgtcagcttaatgttactgcaaataatatgtatatcatggtactaccagtagcgtatcaaggatttagggtataggtggttgaagcatccgcgtcaacagtacaccatcaaatttttaaaaaattaattaagaaaaaagtaaaaacgacttataatataaaatggagtttaagtttgtaaaatcaaataagtttataagattaagaacagaattttcaagacatatctgcacgtacgttatttatattttcaaactaaagtattttaaagtcgttgatattcaaacattgaaaatgtttgaccagcttttattcaaaatatcaaatatttataaccgtgtgagcatcatgtacgatcctataggctgacaaggatcctatatacgagctcggttgaccggctagttcaaatttattacagcggatacaatagcagattataagccaactataaatatattttaaggagataaaagaggagagaggagagcagtgagctatagatttatagccagctataacacggactccaagatacatgtgtgtatgataggttggaccatgtattaattgtatacttatatgtttatagtacctattgtataaactagctattagattgactataaataatttaaacaatagttggctaaactgctaagcttgctcttactcatcaattcatggcatcgtctcgataatactaccacttaccacgcgtaaatgcgtaatagatggcttgaccatggccgtggcgtggcagcaagaagccgctaccatgtctaccacaccgttggttggaaaaaaatattactcccaccatctcataatataatataagatatggttaaacttaaacttggtacagtcttcaaaactaatctttgacttataatttttcatgtactataaggtttattgcaacaaaattataattgacttaaagtaaatttaaatgtcaatataatgatattaagtttagcaaataaaatttaatttatattacaatatatagcgcccgttccgtcgtggcgcctagcgggaaaatttaattcttaaaaaaccctaattacgaaatttgtttctttgcttgttgtcagtctccgcgccaatctctgatcttgaattccctacccatcgtcgaattcaaattccgaatccaaatctttctaaattcaaattcctccgcaaaagtctagtttgcctccctcaggttcggtgggccaattcccctctcggcccatctctctctctctctctctcacacagccttcccctcgctctgcccgtgcgccgcacgcgcgtgcgcgtgcgcgtgagccgacgccgagccgagcgctctccccctctctcgttctctctctccgctccatccctggcaagctccccgccgcgttttcgagttccccgcacaccgttgcctcgcgcgcgcgcccgccggtgccgcccgtgccgcgcctgcgccgcctagccgctgctctaccgcgccctgccccgcgagccag

SEQ ID NO: 66875 - DNA, 4246 bp, Oryza sativa
agaactgcttcatactcagcctgattattagttgcatagggtttaatagtataagcaaactcaaaacttgctcccctaggtgatattataaccaagccgatgccacaaccatgagtgcaaactgatccatcaaaaaatgatgtccaaggcactaactcaaccgagccgattgaatcatctcgatgttcaacaataaaatcggctatggcctgccccttgactgctttaggtgattcatatctaagatcaaattctgtcaaagcatatatccacttcccaactatccctttcaaaactggagccgataacatatatttgactacatcggctgcacactatagtgcactcgttggataacaaataatgccttaactttgtgcaagaaaaatataaacataaacacaacttctccaccggagaataccttgtttctgcatccaagagcctgtgactaaaatagaaaatagctctctccttgccttccaactcctagagtaaaccgagccgattgacttctcatcggctgataaatacaacctgaaaggcactcctttctgtggaggattaaaactggaggggaacttaaatattccttaatattatccaaagccctctgttgttctgccccccaagtgaattcttgatcggctttcaatctgagtaaaggtgtaaaaggctctaaccttccagacaaattagatataaaccttctaacaaaattaaccttgccaatcaacgactgtagctgtttcttgtcctctggaggtatattagaaacaggctgctggttgtcggtcaccaaattcctatattagggaaacacaccttcaggaagaaacaccgagcccttagcttgatgctcagcaatcgtaccatcaaccacagacttgatcatatttgtcaaagtattgacaagcactcctgattggttgatcaaagcatgatagacagcatagtcaatcttctccctctgatttgtcatctttgggctcatcatctttatctttatcacctttagccttgccatctttagatgtgcctgtctctgaaccatcattgggaacttttagcttatacctctagataactgtgcatgaacgagtttgtttgaatgaatgcaggtactgagtctttaaactgttcatcatctgttcgtattctaacatctgttctggtgtcagcttatccagtgttattgggatgatgttttcgggggcaggatcagacggtggtttagaagtctgcttaccgtccaccatgacgaaaaatcgttacaactcgtgtcccactaggcgtgccaaaagcgtgttgatgcgaaaaaacacacactggcctgggagatctgcttaactccagtgcaggtcctaaatcttgctcttgggttcaaaggcatgccagttgatttgatcctgcaatcaacaagaaagaaagacaaggaaaccgaggttaaatccataaacaatagccgatcggctagaagccgatgacatatcgtcaatcattaagccgatgttattggcattagatcggcaatgaagaataaagtaatataaagctaaatctactccgataccactctatattaagatatcaaaacagacagaatatatcaaacagaaggcccaatatatttttgatgcaataagatcttaatataaagggcggacttagcatggcaagcaagcatacaagatataaaatagctaaatcaggtaagattggctgaaaccctgatactatctctatcaataatcataaaacaggctagatattgcagttatgaatattacttaatagatcaaagtcaaccgatgcagcattaagcataagaataaatacaagatctaaactagatgatgaaaacctcaaagagatggtagatatgctatataatctagattaacaatgatatctaactctatcgactactttctactgatagatactagccgattgcaggttagattgtgaaactaataaagattatgaagcatatatgataactcgacgatttacataaacaagattagagtatcataacgatggaagcactaatcccgataacgcaagccgccatgacaagtttacctcttgatgaagattgaaatcgatgcagctcaacccgaaagaaagaactcgtcgaaacaatgaaagtagaaaaagggtggcgatgcgccgaaagtgttattgaactgtcgttgttaaattacataggatcgggttatatttatacccgagatacatgacgggtccttgtcggacacgactcttatctctaacaaacttctaagatacgaacgagtttttacagcaaactcttgtcgagacatatctctaaagaaactatttaaaatatcctaattaatagatacaattgcctatctgagagcttatctccatcgtggcaattctcatgtagcacgttgatcgatcccagaaacggttctataaccatctcaacaaaatcggctacatcggctatatcggctatcttctgtccgatccatctcagccgatgccctcgcagccggtgtgtactctgttatttgaatacaattttcaccgaatccactttgattccgatgttgaatctggttcatggtttaccaaaattggtcgttaatagagcctcaggggagtaataattcattgataagggaagtttgggggactatcgtaatactcagagggtaattcggactataacgttagtattaatactggatcaaatatagtaaaatccctgaaaagccccaaggaccaattaggcaagggcaaggccgtgccattggataaaaaaaattataggcggtgctgtactgcacggattgaaaagagcactgagtaaccaaaattttgacaagaactagttttcaacccatgcacgggctatatttgaatgcaaaaagagaaaaaaagtacaaatgctataacattgtactccgggctatattggtgtactaatttggatagaacaaaagtctatctttgagtaccagcacgtcctccgtgcattacactatactccgggttatactggagtaattatgaaggtaaccttttaaaaaaaataaagcgggtaaagtatatacaagtttaaaaaaattatgattttggatttcagatttgtgtaaaaaaatcaaaacttatatttttatttcttctatatcatccatgtaatactcaaaccttaattttatacgattactatgtgtatacattgctatagatcatataccctactttacagcttactagagaatcggcgcacgcccaataatttataacctgttaatcttgtttaattggtttttaaatatatatttgaaatgttgatgaacaaaagaaacagtggactggggggattatttcaggttttatattgaaattttttagtaaggtgatgaagtcgttggtatatgactctgtccaccatggttaaaatcctactagatacttaaatatgaattatcactaatactagaaaagagcacttcatatcaatgggatgaaaatctcatttagaatgcatgtttgaaatggtagtgttgcactgaaaaggatagcactatatatatgcactaattagggacggatgtgaagcatctacaagaaactatataggctactaaaagatcattatttatagatcttgtctttttcagccaagttaattatctgagatattgaagtccaccaaattagatcttagtgtttttatcatatctgacattgtagaaggttaacatagacagctgggcagctagccacggttataaactacttcaccatactatttgaacatttttcttcctcccaacaacgcggtatcaccatactatttgagcatttctcttcctcctagcaacgggatcatactatttgagcatttctcttcctcctagcaacgggatcagatgaattagtaccatactggttccacaatgttaggatacaatttgaaaacattaagcatggatctcacaatgttatggtacaacttgaaaaattaagcatggatacatgcgcgtacttataggtagcgattctgcgctaaaagcatctgcaatgtaggaatgtaggaattaagaggtgtactaagagaatctttccactatagcaaaggttttatacataaccatacaactgcacggtttgttaaagtgaaaccggcgaaaaccttacacagaagacacaaaaagcctgaggcaaaacaactacgaattgcagatgatggagggaagag

SEQ ID NO: 66876 - DNA, 5281 bp, Oryza sativa
tgtttttttaaaaataattctatagaaaagttgctttaaaaaatcatattaatctatttttagagtttaaaatagttaatactcaattaatcatgtgctaatggctcactttattttgcgtatcttcccaatcttctcctatttccttatcttaaacacagcagacccgaaaaaagtcaacctagacatggatgggatatattttagaccaacgaatctgaacataagcataagcatgtttaggttggattttttattggacggatggagtactataggttatcaatgttagtttagttcaaatttaattatttattggagctcacacgtcacacgaggtccattctatgagctggatattctagagttctacgttgtacaagtctgaacaacttcttcttcctaaattaatttatattttctgcggagaatgcaaacttgtaaaggtgttgtgtcatttcgagaaggagagaataagggaagataacctaatcggaattattataaggtatttttccactttgggactaatggaattcatgctccaaacgcaagtgtcttcttactccaattctagaaagaaaaccatggaagtttctattgtggcctagtggtggcatttgtgggctattagtttgttattcatatattactaaatcataggcaatctaaaatagttatagtaatgtatattttaagataatgaaatttatttcagaccttgtttccaagaaattatagttaattattacagtgtttgcaacttgaaagactatgcattgccattacatatcacaatttgatactctctccgtctcataacatagtaacctactattgaagaagacacatactaagaatatgaatctgaacatgatgttgttctaggaaataggatatgttctattcagttcaagattgttatattttaagacggaaattagataaaaaaaattaatcggaacatcaccctaaagacagagacagcgttatctatagttggcgaaaaatctacaatttgcttgtatgtaatccttgttctcatcaaacctgaaaacaaactcctcgaaatcaatgcctgattgttcccgccgattggaactttgctagcaacatcgaaccgaaatgaaagatatcatcggcgattaactgtattgcaaatcaaccgctcgcctaaaaatacctgcaaaacgtgcagaatatagtcttgcccttctgaaaaacacaattttcacatgttccctccagaattacctttgggattttcttttacaagaacactgcagcctctagagttgatttaccttgtttgctttacttcgttcttcttttttttttccctatcaagctccattatttgatcgtcaaatttccacacaaactaagtgtcacgtgaaatatttcaaaccaaattatggccaaatgggacggaaactagtgggtgagcgacgccaaaaagatttatcataccgtgtggcctacattgcgtcactacaacgttgctttcagcagcacattgccatcagctttaacgtattatcctcagcagcagcttttgtgaagtgaagcttccttagccacagccccatgatttttatttttttttcctttttgaaaacccgcccgcaaaagctcaatagtgtttggcgtcaataacactagagccaaggatttacttataaaaataattaaaaaaacttatttataatcatttgtaaaataagtttgtctaaaggattatttataaaatacttctccatcccataaaaaaacaaactcatcgtcattattctaccaatccatttagagtggagttatcgtcacctaggggcggaaacccaaacccatggataccctctgagtctccccttcaattttttcgtcatggttaatatgatagaatgtgctaaaggtttcttaatagtattttaacatagtttaatattgagttaatgtatttatgccggtgtactcggtatgttgagtccccaaattttttgttcctggatccgcccctgccgccaccccacggttggcggttatcgcgaggtatactatggttttaaaatccggaaaggttagcgcaggtgatatataactaggataataggataatcgtacggttttataaattctgggaggagtaaatttttaaatagatttaaaatgtaaaaaaaattccatgcccccagcccactgattaatccaccgccacgtcgctgtaacttcacctgcggatatattccccctcccgtccacctcaccccccacgcgcggcggcgcgcgacggcggcgggcgcgcgccgacgcaacgctgacgtcgccccgcgcgcgcgttcggcgccggcgcttgcttactcgctcgctacgttctggctctcgcaggcatggacgcgtggctctccgctgctggcgacgaggagatgaggtgtcgcgtcgcgccggcggcggctggatgctcgcgtgcgtgggcacgcgtgtgctgcggcgctagcgaatgggggtgagattggattggattggaagcgagagtgacgttcgctagctgggcatctgctgcgaacgccacgacgagacgagcgaggagttgtccgtgctctggagacatctgaaactctgaatttttctgaacatccatatgggttctgatcggtttctggtcatctggattattttttttttctgtcatgcctggaccatttcatccaaatttgaccgaatttgagcataaattgctctctgcgtttagcaactggagctatgagatacatctaaaaaccggtgttttggttagctgttcagataaatttgctcttagatatggtttctgccgttaagcaagtaaccgggctttcatttagattaattatcatcactgattaattaattgattatcaacttgattataagattatattaatttttttacaaataaacataataaatactccatccgtctcattatatagcaacctaagattgaatgggatatttcatagtacaacgaatctgaacagagagactcagtcctaggttgctatattatgtgacggagggagtattgtaaaacaagtaatctaaataatacaatcgaagaaagttttttgagaaaatgtatttttcatgtggagctaataatcgaataagctgaaaagaacatggcttctgtttttggagaaaaaaacaacatgcattaattcacataagtttaaaatacatgaaattcagcttgctaaaaaacatatttaagagcaaaaacaacagtgggcagcaatcatattccaaatgaactttgcaaattattcgtcgaatgactaggatgtgtcactctgtcactagatgggttggcccatatatgccggcccacctgcgagcctgacttgttcctactctgctcctctccaatagtggcctcttgcaaccggtcatggccctccaaatatctcgcccaaaaactcaaatcacaaatgcagaatctctctgttcagaggatgcatccgagagctagcatctttccctccctgcagtgcattggaccagggtcattttcagacctagagccgtaccaaaattgagcccgctgactgttgcactctcattactttctccgttctaaaaatataaacatttcttaattatttaataagtattaaaattaaggaaaactatcgtctttcagttgtctcggtggtcgaattttaaattttgaattatttagattcacctcccaagcatctgatcagctgaaaatatatgaatttccgcgtaatgaaatcagcgcccaaaaaaaattacattgccatataaattttaatttgacaagtaaaaataattatattttaggacggaaagatgagctccaagctcgtaaaatggacagcaacgtggagagggagcatggccactatcagcaacaggaaagcaaatttgtgtccatggtcattggtccatggatagctctgaagtgtcctcgccataactatgcaacagcgacctttgcgatggcgttgcccggagcaaagacgaaggagacggctctctggattagtgtgaacacggttgacgacgggtcactgtatacgagtgtatgatcgctacgctacgagctttagttccttccaaagtactgtactttgtggcaatgatctcgagtcgatcacgtagtgacactgttgctgtacggattacaaacgtattgttgcattgaaagatgttaattagaagttttctcatgggctcatggcatttgatatggttaatttgcagtttgggttacatgtctgacaggcaatggcgatacctgtctttcttgggcttttgtgaggcccaatgtgcagaaacagttaatcacggcgtgtttagttccaaagttattcttcaaactttcaacttttccatcacatcaaaactttcatacacacacaaacagtcagctttacgaagcagattcagaaatcagaactagactactagttaatcagttcgatcaggactgttcatatcaacttactatatgaaactagactgctcctcccagaatgttaacttaggaaaaataagtatgtccaatatagtagttttgatttttttttactctcatatgtagttaagaatgaattaaaatgataacattgtagtaccaaacaaggcaagcgaacgcatgattctgcacagtaacacactgacaacttggctacactgcctacacatacaacacaaggcctgtttcaaatgcaggaattttatctgatttctaaaaattctataaaattcctgcgtttcaaacagacttcagataaaacgattttatgctaatacttatgtaatgtaccagtacggggagtactggagtttgcatacatatcatgcaaacctacaaattgtgtaacgtgccatcccggccggccggcgccgtctcagttgccgccgccgccgctgccggcggcggtggcgccaactctgacatccgggttgcgcaccgtcttgagccacatcccggcgagcacccgcgacgacaagctccacacgacgtccggccgctgcctcgcctgagacgacggcgtcgtcgtcgtcgtcggcgtccgcgctctcctgcccgcggcgcgcgccggcccgtgcgcgagcgcccactgcattgccgtcagcttctgcctctccgcgccccagctcgcgcggccgccgccggcgccgcctcccaccgggcaccgcagctgcacgccgccgacgtgcaggctcctcaccttgaacctcccgccggtgttccccgccgggccgagcagcc

SEQ ID NO: 66877 - DNA, 27940 bp, Oryza sativa
atagttttacatatttcacaaaattttttgaataagacgaacggtcaaatatgtgataaaaaatcaacagtgtaaaataatatttagaaacgaagagagtattacgtctacaaggttttgtcacgttgcatccactatttcccccacatggatgatagatgcacatgaccagtgaacagagacggattcaatgtgggtgtcgagggctcaaggccacctcccaaaaaaaacaacctggatccgcccttgttctataattaatcaaataaaatataatcttaacttatactttacatatttataacaaatttttaaataagacgaatggtcaaactttatgaaaaagtcaatagtgtcatatattttaaaaagaagatagtattatacaattaaatgcgtttagacttacagctgccattagtagttagttcgttggtacattaggttggccttgaccagagatgaaactgttattgtataatatcaggcaagcaactgtgacgaaatcaattaagggattttgtgtcaaacgtataatttcaccgcactactagaaaaaatgtttttgtaggcggtcaaaagatattttcgcaagcggtcaaaccttccgcctgcttctaaacgacggtaaaaatccccaagttttactggcgggccaaagcatcgcctcgcaggcagccgttgggattttctcagatgatacaagcgttatagtagccccgtctgcaaaaatactcatggtgcccaaaaacaatttcccgccagccccacccttccctaggtttcaaatcacaaatcacaaattctcacaaatctcatccaagaaacagaatccaatcacaaacatccattcatcaacacaaaacattggattcaaatccacggcaatcaacatgtaaacttagaaaaaaaaaagaaacaacatcatcgtcgtcgccggcaaactcctttgcatgcggtggccgccgccacccccctccctcctcaggccggatctaggagggagggaggtttccgccaccgccaccgccctcccctctcctcgtaggggccggatctaggagagggaggggaggggagccgcgtccgcaccgccgtcgccgtccgggcaaccgctgtcgccccatccatgccgtcgtcgccatccacgtcgtcgtcgctccccctcctccagccagatctaggagcggggagggagagagggggagccgccaccaccgccgtcgtcggcccatccatgcagacgtcgccgtccacgccgccgccgcgtcccccatgtctgcatcgctgctgtcaccgtcgctccccctcctccagtggggagggagagagggggagcgccgcactgccgttgctcccctcctccgatcggattgggagggaggagaggaggtgagccggtggggaggggtggagaggagaagagaattgttgagggagagggagttaagaaaatgagtggtgtgaccggtggggaggacaagataaggatgacttaaagatttttttggtaggtacgatttttgcaggcggaccacataaggtttcgcctgcaaaaatcatatttttctaggcggagcacttaagaagtccgcctgggtattttcgcaggcacttaagtaggtctgcctggaaaaattgattttcgtaggcggatgatgaaaatccacctcggtttatatttttgtagcggatatttggctcggagggtcatacccgtctgcgaaaaaaaaaaagacccaacgtcggtaaaaatgctttttctagtagtggcaagtatcatgtaaactttttttttaagataatggataagtatcaggtaaactatatgcggcagtaagaaaactcttcacagttgagctcaaatggattggatggcagtatggcactacatagtaggaactgcaggagaacgacgcgtcgtcgtagcttcttcacataaggaaatcagtataccgcaactgctacagtgctacctcacttcaccaagattacaatccacaacttcgaatcgaaatcccggtgcctccctcttctattggacatggttgtacatacgtctagtattatagacgacgtgtcattgtcgatcatctcctccggttggcagcagcctgattgccaacaattcaacaggagagattatatatatatatatatatatatatatatatatatatgtttcatgagacacagaaacggatatatatgttgcatgctctacattatttttttttcatgaatggaaggtgtgtagtacattttttttatttgcgcagctaaacgtttggaacttagggtagaagaaccggcctgaattattttttatgcctcggcctgaatttctactcgagtttaatttgcccggctagcggccacatccggcccatcattcatgtcatttcgtttcccctcatatgcaacttaacttagatctggttcatttaatcctcacgaacaagggactgaaggggatttattccatacataccgtggtctgaaattgttccccctcaatcccctgcaatcctcttcaatcccctccagatcgaacaaggccttataggagaaaatgagatatcaacataagctcaaaaagaaatttaaaaaaaaaagcaaagcgaaacagtatgctcactagctacccaaagaaaatagtgcattagagcatctcactaataatccggtagctcaccaatttttatggcggtaaagctagatgcattcacggacaggaatggatttagccataagagacgccgcaatcggttgaaccttcaagtttcaggtcagctgggcgcatggaaagacaagggaggatgcaagctcagatctgctgaatgctaacatacataaacacatgtagtttatgatggtaggcaagagatataacatccatacagatagttctttttaaccagacaagtgagacaactactccacactatgttcttgcttgtaacttgtccaaccaagattgacgttactaacctcgagtcgaaatcccgatgcctccctttcctcttcctattaacacacacacacacatatatatatatatatgttgtgtcgtatctctctaaatttccaatccagttggtacataagttgttccgaggactatatataaccgctgaaacagatattgctacattatttaatgtatctaccctattcatcatgacacatgtgccgttaatggtcaccttcagtttgattgttggagttagtgaacttcttttttatttaaggttttaagaattaatattttaaaaataaaccctctaagagcaggtacaataacaaactataagccagctataaccacatatcgagaagaaaagagaagagagaaaagaaagcgggctgtagatttgtagccagctgcaacacagactctaagacgttatgtgtgtataagaggtgggaccgggtatgaatggtgtagtatatttttatagttaactattgtatgactggctattagattagctatatagatgatttggagccagtggttagctatacaattaaacttgctctaaaagtttattttcaaattcgagcctttcttttaccacgccagtacaccagcataacatttacatgctgccacgatatttatattgtcacaataagcttgccacatatatatactggtcaagacccattcaattggcacgcgtgacaatcacgcagatatactctagtcctattctgcaatgaagtccctcatatttacatcaaagtgcaaattcgttattttcagtttatgactagatatctttatatagttgtgtccagcggcggattcaccgcccggccagcgcgggcaattgcccgggctttgcatgcggcgtgtggaaggcatcgaggatgatttctctatgttaaaaccgaatgattagctagctccttgacaaagttggcaggctatatatacgtacgtagtagtagatgatttctggtacaagcaggagtagcatttgccgcactgtaacatgcaattaggccgtagccactagttaattaccaacttgcttgcttcacaatggatggcataattcattcactaaagtactggagtataggtatacaaatcatcgctttttataacaaaatcatcctgtttatactagtgaaaatttacatctatattgaattatgtttttattaaaaatttgttgtctttagttgataagtaaaataagcatatcatcattacatgagtggtaacgggtttactatttttcttatacttgcccaggcttcacaaaattcctagctccgccactggttgtatcatttcgagaaattattacaatgtagttcatctatgttgttgagttccacacaaagaaatctacaataattgagtataacatatactcctgccatctcaaattatgaggcttctaagttgtttacacggcattaaaaatagaactttgacaattatttcttagaatatattatcaataattaaaaaaatacggagtaagcattatatggaagtatttataaatatgaatataatagtacaaaatgcataacactaacatatactccctccgtcctaatatatagcagcctaataccggatttaacatatccaagctatgactatgaatatgggcatatgcatgatcaaattcgtagtactaggatatatcaaatccggttctagattgctactccctctgtttcaggttataagacgttttgacttgtttcaagtttgactaagtttatagacaaatatagtaatatttataatactaaattagtttcatcgaatcaataattgaatatattttcataataaatttgtccagagcttttttctataaacttggtcaaacttaaagtaatttgactttgatcaaagtcaaaacgtcttataacctgaaacgaagagagtatatattaggacggaatgagtactgtatagttaatttagttattagtataaggttacaaacattaacctttataaaattgtatgcgtgctacactttggaatgaatggagcgagtacattatacgtgacaaggaaatagatcattactatttacatatttcaaattcacttgcatttatgggccaaaagaagtgtgtaccaccaacccgtatttctgcgcactcaagggctatgttttgaacacctgcatctgcatgagctgaaattactcgcacatatcgacctaaaataagcgcactaggccgaaattacacactcctgggcaaaatatttgtgaactaccagctgatgaaagttactgttttcacgggctgaattctcttgtactcgcaggctgggtcggccttaggcacactcgtgggctcaatctacgcactcatgggccaggactagacgcatttgcaagtggaaaaagttcaacttgactccctcaacatatgtgaaactaatttgtattcctcaatttctcgcatgtcgtattacactagcaaatgctggaaatgaaacttcggtcttgtaaaaaaatagcatggcaactaaggagaacagctatggatgcacatctggctgcaatcttctcccagatataaagagtacaaatacagtatatggcctcatcagataagcgaaaaaaatgtttattttcaaaagaaaaggagtaatccctattcatcctcgcaaattttatcgaggatatataaataaagacaacaacaaaaacccaaggtgcagtccatccaccaatcatcacataccgaatgatcaaaattaattggcaaaaataggcatcgcgctttttctttacattcttccctaaaaagaaaacaacaatggcttgaagaacaggtggatcaggctcagttggagagtcagcttggacaatgcggttggatggacggagttgaagggaatcgggtgaaggtacataatcttcaaggagcatataagcacatgcgaatgaatgttgaagaaagccagatgcttttattccccttgcaaacagtagagctggcggatatttcctgaagctggaaatggaatacagaattgttattagttgttcaaacagagtattgcaaaatagaacaggccatcctttgcgtgaacaagaatgagtgtcaacactgaaataggataaagattttttttttcacagaaatcactgattgagtttaccacttcagcgaccagtacaactcacttaataaactacttttatgcttatatccagttggatgaacaactaccaataacatacgtaaataatcgtatccaacattttaatatatgatagattagttaaataatcaagcctctaatcacgataagcaatcaagattcaagcttctaaccatggtaagaattaaaaattgcacttccaggtatccctataagtcctgcccaaatttagacaaatcaaacacttacaggggtccagaactccaataccattgttggactatacacttggcagtgaaagtgatagccatatttgttatttaaaaggtggtcaagaaatggggctgcttggttggcggcttggaatgccacgccacggcgtggctcgccacaggagtgtggcggacgtttcgtccgcctcagaaaacactgtagcgtggcgaaaatactgtagctatggcattcaatggctgggatccaaacacaccttaacatcaattgaatagtagctgatgtagatgagaagagtacattataaacaattacagccccatatccataagcaatcaccagttggtaactactgcacaggaagttgcacatggcacatttgtctaacttgggatcataattggcccagcataatatctgatcacattattcatgtgctcaagtaccaccaattactttaggataacatgagcatcaaatactttaggataaccatgagtccatggattaagaaaaaacagccaaaccatgaaaagataatgttctgagtctaaactaataagacacacacaagtttgaaaaaataggcatgcaactatgtaaaccttaatactccctccgtcccataatataagcgattttggagtgacacaacctagtactacgaatctggacagggttgtatcacataatcccttatattatgggacagagggagtatatattctctaagatttttttttttttttgaaagactctaagcaaattttatcaataggtgagtattaccgtatagccagtccttgaattgggcatgaagggcagatgccaattcttttttccgagtatcatcaagctccaattctcggatattcttttgaatatcttccagagaaacatgctgaaattgtacagaaaggaatcgaacttcagaaataaatatgataatcaagagcatgtcagtgttttatcagaaagcataatttacatgatctgtgctcttgagacttttaacccccaacttgcagtaaataattgttagatttcataatcttgatcaatcctgctcaaactatattcacggaacatccaccacaactttttgctatgaatattgataataaaataggcaaacaatggatgcatatttttatggaattcctatattgtccacagttacatcagataaccaccctaactagcaagcaagcatctcactaaataagccctttctgattaacccattgttagaaagaaatgaaaattgtgttgcagcttgattgtaatgcatacatacctttttcctttgggaggcccaataaacttcaggcaaggtaaatggattatattttgtaggtccttgtgcctcaaaccaactgggaatctgtacagaaaattaggccccaatcacatttttgttacagagaaaaaatagtgattcggggattaaagttttgagctgcatcaaatgctgagcaatagggatattcttgatttcctactagttacaaccaaaaaatgtagcaaaatggcttcatcaattcttaccaaaactgatttggatgagtcaaagaaggcaaaagaaaaaaaaaacatgataatgttaatgcagatacatccacgtattcaggcaggcacatccaattcaacttaatctactaaagtactaatgaaacgtgaaatgaatactactggtcaaccacaccaggccaaaaactaggtaagcaggtgcagcatgataacataaaaagatgatttgaagggtttagtgactccaaagtcttcaactcttttacatctcttttgaactccattcaagttaggcctcggaccatgtacaactagtaagccccaaaggccgattagtcatttgattgcttgctacgtcacacatgtcaacattacattggacacataacgtgtacaaaaggttgtcatatgccaacaaatgaaaagctgaaatctgctcagtacaagcagctaagattttcactaaatccacgtgtctttgaaattgggaaagacaatcggagaagggtaacatatagttacataccaaaaagttggtgaatagatcaggatctagacaagtagcagattcagcttggacatcagaaacccctgcaggatgagataatgaatcatgtggatcaacaactcccagcacaaaaggttggtcccacttgttgatgttagaatccacaccaacttgcaccaaatgttctcccaattgtggataataagtattgaatggagcaacctgacaaagcaagaaataaaaatttatttgatgttgttgaaatacaaagagaattacattgaatcaaattaagtgtaacttccatgtttttaaagcaaacttgtttctgtgtgaatgaaccaaaatcaataaatcaaattataaactcgaaggtttgtctgattccttaacacttttgagggaaaactaaatatgtggtccttcactagaaatggttccttgccaactagcaagtattgccaaataaccaaaatgacataggttaaacatgcgctagtttcttttagcatctcaaatgatgtagtcgccttaatttgatgggatggcttcttattggttaacaattagttatgaaggatatgaaaacattcagatatcagcataggtttctgttaagaaacttgaacatcctgtatgtctccatgcttccttttttttttcctttttgattgtccataaagctatttatcctttatagcaaccagatatgtatatacaacagtgtacatttgtccataagatataaatagttgattagaaaaagatatactcacttgtaatttatggttgtcacccacaataagcggttggtgatttactcccaagtagaagatacattcacgacaattggcgatacaaattcgctttgaagctgcaatgatttgcactcgttcacaatgctccacttttaccacctgatcgcatgaaaattgttagaactacaaacagaaaagagaaaagtgtctataggcctttctagaatgtgcatcacattaagttgtatatctgcaagcacattccacaataggtcattgtgatgctatatggacccaaggtccacccacatgtcaataggcatcagtggcataaaatggtttgccctttggtagagcaaaattctaacaaagtgtgttggttgtcgaaacatcaataaaaaaaattcaagggatctcatactttttcatgttcaagctgaaatattgttaacaaaagttgtatgatatacataccttaccaacagcaccaagaacgatagtagtgtcagaacacccatagacagtggcatatttaacaggagctaatatgtagataacagagtcatggcagttcaaaacctacaaaaaaaaatttcatcaatagtaggctgacaaaatctcgactttcaaataagagtctggagtaggtagtttctgttttttgaattacaacacacagagatatcaataacaaagtaaggctattccgccctctagatgtttatagtactaccaaaaactaatagatgcatacctttattgaatgccctttgatatctgatgcttgtttcactacagaagttttggagaaaccctccaggaaagttgtatttcggtagtgtccttgattgtttggaacagcagttccagttggtgaactgctatgaattcttgaatttgtgacagcctcagccattgtcacatcaggatcagatgcactctgttggctgttttcctttgctgtcaatttttctgctgtattttctaatgaagcagctatattctgcagaatccaatcatgaacctgagcagcgggaacaggtgcagcaggcatgtctggatcagaatttgcaaaaaatgtagccacttggcttaaaggagtcccttcagaaaactgaaataaaaatccgagatgctcaaatgtctctgctgtcaatacctgcataaaaagcaatgtgcataacagttagggtccagggaatcttgagactaaaaataccataaagttgaatatacttttcaaatggaataattaatcctacatgacttaaagtgcccagatttattgggagtttgaaagtagtacacaacgatggacctatacatcaagatcttcaatattctattgatccaaaaaattaaaaagtacatttcattgcagaaattagcctagaatttactttgtcagctgcttcctgaacaggcgatgaagcttccgtacccataactgttcatatcatcatatgaatatgttatctgactattcattatttctttttatcacacagtggagggccctttccagtcctttatttgcttgataaagctttgagttataccccctcctattccaaaatgtgattccaaatgcaggtccatttgatctttcctaaatgtatgctgtttataacttccagtcttccagcacctttttcatcttcccttccatgtttgctcttgccaaacaaatgctactcctctcacaaatagataactcatcttttcaatgtggcaacaaagtcaagtcagttagggtgtgtttagttcacgctaaaattggaagtttggttgaaattggaacgatgtgacggaaaagttggaagtttgtgtgtgtaggaaagttttgatgtgatggaaaagttggaagtttgaagaaatagtttggaactaaactcggccttattttctaaattcttgtgcacaggtttaaaaggacttatatttggaatcaagaggacaaatttaatcgtagttatggactcatgggcactgaacaggaaacaattatatgtttttttccacaaacaactacatcagaaaaggacagacaaacatttatacaatagctatactaaccatagactcatcgccctctccatcaacagaatctgccaaaagactcagaatgttgaccatatgcttttgcagataagataattgatgagcttcttcatctgcttgtgaaggcataaaccggcgactgttactgcgtacaagctgcatattaacataaacaatgaagattaatattaaaaaggcccttacaagtaacaaatatagaaactgttggtctctgcactagcaggagtaaagcaagtcgcaagtgatggcaaagcgctattgtggcaatcatgaaaaggagcaaactggaacagtcaacattcaacagtcccatgcttgcataactcacagagtcatgaaaaagagtgactaaaagagcccttcggcctagccgaggcatctctagtcctaccataggactcctacacgacatgatagaatgatacaataatacaagtaaacagcatttcaaaggggaatatgaacagaaggtgagatggaatttctaaaagcagggatgaggatgaatatagagtagatatcaggataaattagaaaaggaaataggtggaccaagggtcaagcttctcacattttaaatttagaccttataacagtgacgtctgcaaataaattgtggcaatagcagcacattttgtgctgaagtatttttatcacaactattacaacacttaaccaacacatatttgcagtctatgtgaatactgaatagttgtagtcatcatatattggaagagcatattttgaggtataatattacaatccagctacagagaaaagcttacaaaattatgaatcagcttgagcgagcaatgtagctaccaggcaacctgatgattaattgaattgttttgaatgccccactctctgtgaccccgagtagccacagactggtgtccagtactatcataaatattaccagtttaccattgcacaacatcaaatattccaatggatatggataaagaaaaataacactgacaagcgaagagaaccattatcaaaggtttctcatgttcttgtgaagtgccagtagcattgtaaagttgaagcttttgtcagttcttacaatgtattcgtacaaaagcaaatatcttttaggaatcaaacagcatttcagactaaagtttttttttggggccagtccttaaataggaatcattcagctatggacatatcatgttatttctaacttatagtagtgatcccacaattgcattcctcagttggcagaaacattgcccatctctgtacgataaatccatttgaaattacattgaaacgggtcactcggtcgctcccaaatccaacgcaagtgatcataatcggctgccgcaaaccactgtgcacacaaagctaacagaacaagtgcccaccagggcggcggcggaagagggggagggggaggggattgatcgagacctaacctggatcggggagagcgcggagaggtagccatcgaaggcggaggtggagggccacacgtcggtgaccgcgggcgaatccttgtgcgcgcgcgggacgaggcgcttgtaggactggatgtagaggaagaggagcacgtcgcggaggtcggcgtcctccgcctcctcctccgcggggagcaccgcggcgagcgtcccgagcaccagcgccgccagctcccgcgggatctgcagcgcctccgcgagcgccgcggcgcccacccgcggggccgcggaggcgtctccgtctcccccagccgcggcgatgaggcgctccttcgtctgggccagggtctgcgtcagcgtgccctccgggaacaccagcttggggatcgggaggagcccgtgctcgaacgccacccgccgcggccggaggaggagcgccggggaggcggcagcggcagcggcggcggtggcgggggtctccgcctccgccgccgccgccgcggcgtcgaggggctcgtcggccatggctggatagagagagagagagagagagagagagagagagagaagagtggagatctgagagggaaaagtggagacggtgaaagggacggcgacggcgagtctcgtcctcgtctcgtgtagtaacatttctctcgccttttttttaattttttttgtgacgggtaattcgaggggtcgagaaggtgggaggctgtgccactgacaggtggggtagataagtggggcccacatgtcatgctcaggtaatgcgaggtactcgactcccacggccatgaatgaattcagcccatttatttctcgtcaactaaaaaattgggcccaccgacttccatactacaaattaggcccacttaaatcttgtcaacgaattcagcctgctcaataaatgataacgaattcggcccaccgaattcccatcaaccatttcagcccaccaaagaggaagaataaatttgtcctgcctaatcttgtcaacgaattaggcctacggatgaatttggcccatcccagtaaatcaatccagaccactaacgaccactaataggttgagcaggaataagtccattttctctccctcaactcatggccgtgtatgattagcatccctcaaccgcaaaaccgggtataacccatcccccaactccgaaaaccgttacaaatcaactccccggacggttttggaggcggttttatcctacatggcaattgacttgcttacgtggcagttgacttgctgagtcatcaaatgggacccacatgtcagcagtctccacctcatctcatcttctccctcatctgttcccctttctctttcatatcttcctcacctcaccttttgaccttctatcagcagggcggcgacgacggcgcacgggggatgaactcgtcggctggccacgcagcgtgcgggggagcgactcggctcgagcacgcagaggaggcgggagggcgccggggcatcatctgagagggggtcgtgaggacgaggcagcccctccaagtcgccggccatccgcgcgtgtggaggatctcgccggcagtcctcgcgcggggaggagcacgccggccgtccgcgtgcggggaggatctcgtcggccggccgcgcgcgggggaggagctcgccggccatccgagaaggaagccactggggatgtcgccgagcgtcgggttgtactgcagcatgaggacggagaggctctggcacggggacgacggcggcattgcccgcagctgtgcatggcggacacccgctccgcgttgcgcgcacgttagaagaactccgctagcttgtttgctgtttgctcgtgttcttcgacgatttcgtggtctctgatttgttctgttcgttcccctttcttgtttcatgtgatcgccggtgtcttctctgaattcggcaaccaccatgtgctacttgtcttgccgttgatcttgctgctcgattctatcgcctcgcctccgcttcttgatttttcctttcccgtttcttgaagggaatcatggtgagggagaagagatgagttggagactgctgacatgtgggtcccgcttgatgactcagcaagtcaactgccacgtaagcaagtcaattgccatgtaggacaaaaccgcctccaaaactgcctggggagttgatttgcaacggttttcggagttgggggatgggttatatcgggtttgcggttgagggatgctattcatacacggcgatgagttgagggacatctggacttattccggttgagcatgcttaattcctggcaaaaaaatcgatccacagattattcggcccactaaaattccaatcaacaaatcccgccacgaaaaggcccggaggaattcagcccacctatgaatttagcccacgaatctcccgtcaacgaatttggtccatgagtgaaattcggcccactattttaccgtcaagaaaatcagcccgccaaagccacgaacgaattaggcccacttaatttccatcaaattcggctcagacaattcccatgtacgaatttagcccacttattgtacgttagaaatatatgcccatgagaaaattttggcccaccaaatttccgccaacaaattcgccacgtatgaaattggcctacttctttaacgtctatgaatttggcccgcaagtaaattttgcctacaaatgcctacttgtttcacgccgacgaatctggcccgaaagtaaatttagcccagcaattatcttcgaagaattcagcccactaaggtaaaaaaaaaagtctttacctatttcccgtgaaagaattcagcccaccaaggaaaaaggtcttttcctatttcccgtgaagaattcagcccatcaaagaaataggcccattagtttccacatcaatgaattcgaccccaactaaattcagaccagtgaacacccaacaaatcattaggcccactaatggccacaaatgaattcggcccgctaaattgccaagaatgtattggactcaaaattgaatttggcctgcttaactcccaaggatgtattcggcccaaacatgaatttgacctacttaacatccatcgacaaattcggcccaccgataaattttgtccacttaattatcatcgacaaatttgactaggattaaatttggcccacctatttcaagttaacgatttaggcctatcgctgaatttgacccagttcattctcatcagtaatttcggcgagcaggcgtatttagcccaccaattacccatctgtgtattcggcccaggaattaattttttcacttgaacaaatttcagcccaagattaaatttaacatcgacggattcgagccattactgaatttggcctacttaattctggtttataaattgagcccacccgataattaggcccaccctgtcccatcgataaattcagcccgaaggtaaattgggcccacctttttaacgtcgacgaattcgggcctcccatgaatttggcccatcaacaggatgtttacacaaaagcccttacattatcacgaaatcgccaacgacgccagcgccgccgccgtcccccgtccttccgccacatcgacggcgatgtccccgccgacggcgatccttcccgctctccgcctccgccgtggaggtgtcacgatggaagggcaaatccggcgagcaaccaccgggcctggaggttgtgatgtttgcggcggcggcgggcggagcaactgacggcgacggggagacgaggcggcggtggaagagaagaagacggagataaatattgggattgaggatttccgttgaggtgcccatggtttggggttataattactcttctgtttctccaagcaattctttctctaggccgaataattatcactttaccagtcaagtcagtttgaagatttcagtcaaatttatagtttcgctcaacaaaaaatgtttaggtatttgatgaaaatttaggcctttgaatcgagtctctgatttacaacagtagaagagcatatcacagctctgcattgatttagtttttactcctgtcaagtaagccataagattcttgattattggcaaactggccaaattacttattaagttcagttggaggtttggtgagttctgtccttttttttgattctttgtgaagattacaagatcctgtgaatttgatacggcacaagctgcctggacaattatgtgtagagacaattgacaagtcatactgaccgctttttccccgattacaaattcaaagtctaacactgactcaatgatttgcttcaaatgtttcctcttttttttttgtgaagtgcacgagcagtatctaaacttgtgtgggtgtatcatctagatccctaaactctcaaaatatatttttagatcttcaaatttgtcttgggtatcatataagtccaaacgggccatgtactttactcttttgtttttctttttaacggcaatttgcttcaaatgttactatggttcctttacctatttattaatttcttagtgaagtgcatgcggggggtcatatccttaccttcaggctttcagtgcaggtacaaatgcagctgaaatgttcagaaaggttggtcagcctgaaagcttcagtgcttcacacggttgatgatacaatgtggctgaaactccacaggtaaattattttgtgctgctagttattgtacctaatcaaccaggcaatgcttggccaatccagagtaaagtattgtgtatagtatttatatattcatctttttgaaaatttgaattttcgaccttaaatttggagttgatttggggttttttttcatcgaagtttatttttcagcatttgcttttagatcgctaagaacacgtatataaaagttttatttacaaattatttttcgtttgtaaatatgccgtttcgcttattccccgaataagcgaaacgatgggtctgttagtttgttagctgggcaagctggcctgtctgtggttcaagttctaccactgatgactgattgcaaccatggtaataacttaaggcttaagacttgactacttaaggcttaagacttgactgtaggtttctgagactaaatatggcaccactcttgtggtcatgtgtacaagatattaaactactgagtaatacagtggcttagatctgtagtaaatttgaacaactctgtcattgacaaaaattctgttttagtgcccaatgtcaaagaggatatttgtcctgatattgacaaagaaagttccaaagaattgaaacacattacttcacaacagatagacttctttttttccccttgtggtcgaagcaagaaaataagcaaaagacagcccttaaaagattttttttattctaattatggtgaactcagcacttatcagtgcttctagctaattcaatcattttctcaattactccgcatcaggaattaatcatagttcagtcagtctatgtccatgtgtccaaaaggatggcttttcagtgctgtttaaaggaaattgagacaacaagaaaattggcctgacgaattccttagcttgaaactttagtctagtcaagaagatatgtaatgttgaacagataccatccaatttagttggttgcttagtcagataaaaacaagtaattccgttatacttgtataagagtggccttttctgtcattttctcgttctcctaggaggtcttttcattctcttgaccaaatcttgtgaattacaatattataattatataacacaattaaggtagagtgaaatggatctctctgctggaggatgacactacacctaacctagatatataggccaaaacagtaggttgaataacgcaacttatactgtaacctaacaatgtgtcctactagaaaaatagtcacatgtatgtttaggaaaaatctcctaattatgtattgcccaaatccatttattttccactttttgagaatattacatgaattttaaggacgaaccgattaggatccatctgcttgcccttgctgctcttcatgattatacaaaatttaagtagctcgacacaaaagaaatagactatttgttaacaaagcaacaataaagaagttcaaggttatacaaatcattggaaatttggaatatcacctaatcaattgaatccatcaattcaagtagattcaaacatagagtggaattggaccgactctataactatgtttcttttaaccaaatccactttcagaaatattaatatatgatactaaatgagaagggtaaaactgctccaaaactgtctgattcacagagtcttttttacattttttttctttcctgtccgataataagtatgtctgctttccaagttttctttaaccactggttcccgttccatttcttgcacaactactcctctagccaaaagtcatcctttagcttctggtcagaagaacagccgcagggcctgcttggaaggggattaatttgagcaagtcagcaggcaagtttgggagaggaacaaaaagtttgcgggtatcgataaattcatcggttgatcatagaagatcagatgggaaagaagcaggagatggatttggattactaggctgtcagataccatttcaagatgggtgaatcatgtctgaagtgattcagaaggaaggttgaagcactgctgtttagtttaaggaagtatttttcatggcttatccttccacctctggcatgatccaagcttcttcctccctccatggcagcatcacgtaaaaccaacaatttcttccctcaacctttgtcttgattatctatttcatctagtcttgattctctatttcactaaaacaaaggacttgtgtatgtccatatttgtaaaatttaatctatttccctactgacaatactgcttttaatcatgattaccctgaaatggatctctatttcattaaaataatggactttgtgtacgttattgtttgaaaaattaatttatttcccttctgacaatcatgcttgttttctcaaatggattaattgtgatcaatctacgccctttttcaccttagctacttggagtacttctgtttttgttttctcatgcatatgatgattttctcagactaaggtggcattttatataatgattgagattgcgaagatcgcttaagaagttttacccttcccccacatgtttaattcttctctgtttttagttgtttaggggggattaattgattgactaaaagtttttttcctgcagaaaagaacccatatttccccctcccttttttttttgtttttaagcaatgagtatgtttaacttttgcacccttttccaacatcaatttgttcatttctaattctatggaccacattcagataatcagcttaattgttcctttctaattccatccccccccctcttttttgtaaagcaatgagtatgtttaactttttgcacccttttccaacatcaatttgttcctttctaattccatggaccacattcggacaatataccattaagaaaaatcaagctctaaatcagtcgcagtagagctacgtactaaatgcaaaatagagactaatggtatattgtcataatgtgtaaatgcagaagaaggaaccctgaaggatatgacatgccatctgatttggatcaagctctcctcctctactttgatggccaggaacaagataagccatctactcaagaagaaccccacaaaccacttaattttgtaaaaggtcgatctactgttaagagtattttgtcatagtatattacaaacatggcttgaagaaaatcacaaagaatgtcatgcatacattgatttctgtgatttgacttgctttagcttatagctagatgtgtaagattaggaatggctaccaatcttctcattccctttcttttccttttggtcattatagtcatacatgattttattagctaattggagaagagtgacacgtaacaaacatagctgatatggtcgcaggatcttgctagaagattgcaaccaaaaagaacatattttttgccccacttttttgaagatcttggccacacgcatttgaaaaattagcacagatatatatctgggagacacatcagttgcatgtgtgcatgaaagcatgcaagcacctgcctacaaactatgtaaattactaagtcataatgcataattactgaacttgttcatgtgtgcatgcagagactctcaacatcttcccctcccagccaatggatggagagccaactccaacaccaaaggtatatatgttaatatgtgcacatatgtatctctagctagctatcacaatttaagcgtgttgttcacaaggtgccagttctcctcttaaggcttcgatgtcagcgccgcccatcgccggcttttccaggagatcgccggcgccagcggcggcagatggcaggccactcaccctaggcaagacctccaaggcagcattcaaggttttaacttttttacacacgtacgcctctgtagttgtccggaatttttctcggttagacagttgtatcatttttttaccccatcatatgggtggcgttctagtctttggatagatggcttttgatcaatcttgtgttcccttttagttgtgtatgttgggtgttttggctgtgtgcactttcgtggtacagaggctatgagtatactcagacttttgagttcaataaaccttccattatctaattaaaaaaggatagttgtatcacattggtataactgggtgagttaaataaagtttccattatcttagatgttactataattttgtatccatatggcaactagaaagaaggtggcagtggcagcggcggcgccatggcagcgtcagcaagttcagagctcaaggggcccaagacgccggaccccaaaacgctgagaaggctggcgcagaatagagaggccgcaagaaagagcaggctaaggaagaaggtgattacttactatagttactactattactatataccccattgattaaccagctcaatagcaagctaagctagttaattagtactagtactcttgtactaatatcagtcaacaaatgaacaagtagtcagccctcagaagcctaaataaacaaaaatctttggagctagcaagaaaagcaaagagatggtggaagtagctagtgaagttaacctaccacctaatgggagttgtgtgttagacacatgcatgggctttgcatttgttttttctttgcagaatctgataccttcgcttcatattatcatgtgtaattaatccttaatttgttctctttttatttttgtctgtgtgacaggcttacattcagcagctagagacaggcaggatcaggctggcgcatcttgaacaggagatacaattcacaagagctcaggtgaaaattaataagcagcaaagaactgaatcatctcacagaggacggatttggtttgggaaatattaattactactcgcaatttataaaccaccaatatttgtaggagaatcgaagtttctactactaggcaaataatcaatatctaaaattaagaacaaattatctcgaacgaacaatttgtgtttgtaaaaaaaacaatttataagttatatgatgtgtttctgtatctccctgcagggtgcattctgcggtgctggaattctaagcccaggttaacactttcgaactagcatttaatcataataaagagatttacactgctccatctcacgttaaacttaacacgcctagcaacaatagttatttgcatgtcttggtgcaaagaccataagtatttatatatgtcatatcatctaacaaaaatgcatttatatatacattatgtgagggcgtttcagacgctgcattgttcaacttggagtatgagcggtggcaggaggcacaccaccaagtgatcagccggctccgggccgctgtggaggagcaccgaccggatggcgagctgcagccccatgtcgatgaagccatgtcacactatggggtgctgatggctcacaaggctaggctggttggtgctgaccccctccacctcctctccggcctgtggaagggcgccgtagagcaatgcttcctctggataggcggcttccgcccctcggagcttatcaaggtaggctacttctcttctgtgaatgtttgaattttttatagttttatatcagattcatgctttctttttaaaatagtatgaaagttttgttggatcaatcagacggtccaaatcccttacaaagtaccgtacatgacatcttttacaatggtctatactgataacaccccaccaacaagtaacataccacctcacgtgctaccttgatccatctcaccaacatcgctcatgggccttcctctactgcaaccagttttctcctttgctgtttacgaaaattgatttttcataagtggtacagtactttaagagtatccctgtttttatagtcagctgccataaaactaccgtttccacaagcagtcacagagcaggatttttttaagtccacctgtaaaaataaataatatgtaatgcccgcgaaaatggtttttagtagtgagcttcctcccctctcctgttcatatatttttttaaaagagacattaatttgctaaattatattaggaggcaagcatctttttatgtacaagacgtggcacacccatagaggtgtgccttgaaaaatggaagaattttcttaagcagctgtcccgataaaataaaatgttagctggagatgaatctatacccacgtcttaatgtccaaattcattaaaattccacatacgcttttcaatctacctgtcatgttctagatgaaggtcaaaatttactcaatactttgcctccatatattttcctcgttacaaaagcctgattgaaacttgaaaggggcagcaaaagaatttgccgttaatttgaaatttcacaatttctttgttaattttgcaatttcggtccatacctgtattgtgaagcaaaatttaaaaccttgattctttaaagaagcaagagcaggctaagaaaggtataacgcataaatgagcttgaatactcttagaaaaataattacattcaagtaaatatatttatttgtgctagtttggatattgagagcagtgtactataaatcagtcagcaccttcttctatttttcttttttttttcccatgagttagacacattaggtacctaagttgacaactaatgcaaaaatagcagaaatacagtttaggtacccaaagtttctttttgctgggattacccaaagttttacgggatattataggaaagcacaaatttaagagcacgttatatttacgggattttacccaaaattgtacaaaatccatacgttccaaattaagctaggagccctatatatatgtcttggagcacggaaaactattgttctggaggaggatatatagatgctttgttcgactgattaaatgctacagatagcatatatacgaaatcacgaaataaaattgtgcactggagacatatatatgttccaatcatcaacccaaacaaaacatttttaagattatgtggcactcttgaaatcgacaaaataaaactcccaatggcaatggtaatggcccttgccacctgccgctcagctaccaaagtaattactagtagctactccctctgtcccataatataacaatctagtatcggatggaacatttcatagtacaactaatctagataggaaggtgtctagatttattatactatgaaatgtcacatccagtactaggacgaagagagtagttaggtaggtgatgggcagttaggctttggaattcttcatggattgagaagtagagatgcgtacatgcgcaagcgtcgatcaccagatggccggggttggtggagatcgatatatcgagcaggtagaggtagccgatcgatctagctacgtttgtgtcacattctcgatggagacatcgtctggaaccgttgatagagatgcattttagttaggacccctgaacatgcgtgttgtcgctcgttaatttctttcgtctaataatctaattttgttgttaaaataactgaattaaataacgatgttgcgagtattccatattttaccatgcgaaaagataaaattttcatttgattagatgaacgagaacagataagtagtacagctacatgattttgtttttctttctcttttttaagatataaattgaacttgaacttacacatatctatggaatgacatgtggtagaggaatctataaatattcaaaatatttcctgactttaattttgtcatgattaattagtttgaagatatattttacttttcttcttagcaatttcataaaagagcgtggtgcgcaacaaattaatataactcgataaaaagcccttaacattagtcctataatcaaattcaaaatggatcatacatagcatttggcgcaattcatatgttgaattacatagcatctcgcacaattcatatgttgaattaatttttaggtatagcttattagatacttcctccattttaaaataagcaaaccttgtaaatcttttctgaatcaattactgcatttatgcacaggttgtggtccggcatgtggagcccctgacggagcagcagctcgccgccgtctacagcgcgcagcaggcggcgaggcaggaggagaacgcgctcgacggcggcctgcaggcgctgctccggtcgctctccgacgtcgtctcctcctcggacgcgccgtcgtcgtcgcagcagacgccgccggtgatgtaccacccctccgcagccgccgccatggctgcggcgagcttcatggggcagtacggcagctacagcaacctgcagctcgccatggacaagctcgccaacctcgccatcttcctacgacaggtaaatcaacaatcctttcttctagactttttaagttaatttctctgagcactgaagctgatttgggttgggaaattattctaaaactctcgagggatgtcctctcgttttttttgcatggtctcacgtagttatgaaaaaaattaaaaagataatttgtttacaagaaaattaagaagataaattaatatgtgatatattactccacaaacatacaattttaagttgtatgttcgtagagtgatagcatactacatatcttcttaaaaaaaattaaaatcttttatagttatttaagtgacatgcaaacaataagataacatccattcgagagtttcaaatccaccctcgatttgggttgcaagttttcgcatcggtgacgacgttgtgcgtgtatgtgtaggcggatgaggagaggatgcggacgctgcacgcgctgcggcggatgctgacggtgaggcaggcggcgcgctgcttcgtcgccgtcgacgactacttcggccgcctccgcgcgctcgccttgttctggaccaccacccggccgcacccggccgccggctagaaatcaattgaatcggcttagcttaggttattagccacacacgcacacatgcaaagagtagctaaggctatatagcgacatgtaagagggagacgaggagtagatatatagctagagagagcatatgcaccatcttaacgatcaaaataaggttgtatgtgtattcgatcgggaaaatagttttaaaaatagactcgacgtgttgatcttgattcttttttttactttttgaatgtttaattttaaaatgaaccttttcaaaacttacttccagaatctaaactttttttaatcgagctaatgtgcttggcatgacaaaacaatactgacatgtcactcgtagtgggcgtgacagttttatcttgccaccctagtgaggatggcgtgactaaataatattgtcacacttgtcagatcgtggtgatagatcttgaaaataataaatttcaaaaagatcatatcttgaaataaattttactaatgtttaaaaaggtttaaaaagttacaaacatcattgatcttaggacttatttggattggaactaatctttacactagcaactcttgaccttaccaaatttggtagcgtagaatttgtacgtatgggtaaaagattcatagaaaatccaccaaacatccatgtggcattattgaagttgtcaaaaatttagtacggcaaaaattaacctcagtggaacaagcccctttcttaatctaaaaggagatggtttgcaaatgtatcgaggaaattgcaagtatcattagctttaggccactgatgccgcctcgagtaaaagcccaaattaacagcatcctgggcttggcctgtaaattataatttcaatgggctggagttgcagatgttaattaatttgggctgaaagctataccaactttcttccaggccacatgctctcaagaaagaaattaagaagaaaaagaatccagaacggctagatgcagtgtgttcctgatgtagaggatcttgcctctgaccaaaccaagctacttactgtatgcttaagactacagaacaatgatgcaaccatgaaatcatctgcatacaccgattagctatgaccgatgggcttgattagacctcggaatccatattagtttcattttagataatagaagctttattaagactcagttacatacaccaaaatgatacattctaactgagttcacccccggtctctgtatagaatgtacacagccaaaaaactggacctaagaagacttcctcatcataaaacacagaaaccagtggctatcaatctgtagactagaaacacgtaaacatattagtttcatgctgagcctgagaacgatgcaagatacacactgatattgccggtggtggtgaggcgagagaatatattcgctgctgcctttttgacacatttgcagcttagccagtggatgcatgcatgcctcctctgctcggaataaaggcaacttccgtctgcttctttcttaagcttattctgcaacgcatgtcatgtgtctcatgtctactgtattggcattctggttctctctagcttccagaatttttcagccactatctcgtgaattggcggctaagaacatctatgtgcaatctgtgtatcgttctgttgctgctagctagtggaaatggattctgaatttctaactcttacaggatgacctagtgcatgcttttacttctaaaaatgtaacattacaacaaagattaacattataccccccccccccccttcattgaaaaatataagacatatttcgactatttgattttgagtttttataaacgattaatccaataatatttaat

SEQ ID NO: 66878 - DNA, 18537 bp, Oryza sativa
tgtgcagtacatcgccgagtggaaacgatgtgaccaccgttaccgggtgaccttgaaagtaatgagacagcttcctggtagtaattaaaataccatataacagcttctgaacctgagggtacctcgttttggagtcggccaggacctcgctgacgaagtagattggtcgctgaactttctggacatggccttcttcctcacgctcgacaaccaagactgtgctcacgacctgggaggtggctgatacatacagcaacaacggctcctgcgggtgtggtgaagctaagaccggtggcttgatgaggagttgtttgaaatcttcgaaggccttctgtgcttcgggtccccattggaaattatctgttttcttcagtagcttgaaaaagggcatcccccgctcgccaagtcttgaaacgaatcggctgagcgccgccatgcatccagtcagcttctgaacatctttctgagtgcttggcggtttcatgttgaggatagcagtaactttctccgggttggcttggatgcccctatgagacaccataaaaccaagcagcttccctgacggtactccgaaggtgcacttttcaggattcaatttcatcctgaaagcacggatgcttgcaaaggtttcttctagatccgagatcaaatcatccttttgcttggtcttgacgactacatcatccacataggcttcaacgttgcggccaatttgtgttgagaaacatctctgaatcatacgttgataagttgctcctgcattttttagtccaaacggcatggtgacgtagcagtatgcaccaaaaggcgtgatgaatgaagtcttcaagcagtcggattccttcagtcggatctgatgataccccgagtagcagtccaaaaaactgagaagctcacagccggcggttgagtcaactacctggtcaatgcgaggcaacccaaaaggatctttgggacaagacttgttgaggtcggtataatcaacacacatgcgccactgtcctgtctttttccgaaccaggaccgggttagccagccagtcgggatgaaggacttctttgatgaagcctgctgctaacagcttggtcaattcctccttgatcgcgtccttcctatcttgtgcaaatcggcggagtcgttgtttaataggcttggcgtcttctttgacatgtaaggagtgctcaatcacctctctgggaataccgggcatatccgaaggtttccacgcaaagatatctttattattttgaagaaaggtgatgagcgcgctttcctatttacaatctaactcggcgcctattacagcagttttggtaggatcagaaggatctaagggaatctttttagtcgcggcttctgtttccccaccttttgaaatcttggcagcgggcacttcgccttcgctcaccgtggttgcagccagtcggatttcctctcgggcagacgccatctcgcgggtttgggccatgtcgcaactctccttgtcgcatgtgacggcttgcttgatgtcgctccgtagggataggactccacggggaccaggcatcttcatcatcatgtacgtgtagtgcgggacggccatgaacttggctaacgccgggcgtccgagtatggcatggtatgctgtctcgaaatcggcaacttcaaagctgatattctccgtgcggaagttttcccgagtgccgaaagtgaccggaagagtgatctggccgagtggagttgcggataatcctggaattactccgtgaaaaggcgcattgcttggctttagctcggagcgaggaatctgcatatcatccaaggtcttggcgaagaggatattgagtgcactgccgccatcaatgagggttctgcgaagcttgacattacggaccactgggtctagtaccagggggtaccgccccgggtggaccactcggtcaggatgatccgagcggtcaaacttgattgcaatctctgaccatcgaagatactggggcgtgtcgggctgaacagcattgatctcccgttcagtcaacttttgcttccgtttagactcataagccatggggccgccgaaaatatggttgagctccttgcggtggtcttgaaatccagccggggtgtcgccgtcatccttcttcctggacgtgctttgctcttcgtcggagttcttccgagtagacttggtgtactgctccgcgaactgcttgtagatgaagcactctttggccacatggttggagtttgggtgatgcgggcattgggagttcatgatcttgtcgaaggtgttgacgcgcgaacgctgtcgagaagagtgagcggcggtcgcaacaagttcctcaggcttacgcttgcggtccttatgattgttacttccacctcctcccgtagccggcgtatttttcggtttccaactgggacccgactgcttcgatgcggtgacggcgtcttcggctttggcgtactcgttggctttttcaaacatgagcttgactgttctgggaggtttgcgcccaaatttgccgaccaattcttcgtggcgaatccctttggtgaatgcggcgatgatgacgtcgtcggagatgtcggagatcttgttacgttgttcagaaaatcgtcggatatactctcgaagggattctccggatttctggataacgttgtaaagatcatattgtgtgccaggacgctcgaaggtgccttggaagttggcaatgaagtggtcgcgtaattcggcccaagatccgatcgtaccacggggcagtccatggagccaagatcgggcggaatccgctaaagccactggtaaatagttcgccatggccttgttgtcacctcctgctgcgcggattgcgagactgtagacggtaagccacgattcagggttagtggtgccgtcatacttctctattccagtcggtttgaagccggctggccaatccactcgacgcaggtcgtcggtgaaggctgctactccatcaaggtcgtcgtcgtggcggtccggcgagtgatggtagcctcgagctgctcggcgctgtatgattgtgtcgcgaagatcgatggggcggcgacgaggtggtgagcgaggccgttccactcggcgctccctatgaaagtcgggaggtgagtgaacagaccgctcgtcgtgacccctgctcctgcggttggatcctgcgccggtgatgctgaggcttggatgacggtagtcatgagatcggaagtgggggactcggctgccagtcggcgtgtggacgctttcggagttaactggaaccgaggccgcaatcatggtctttgtctggttcaagatgttgacgacgtggtcggaacgattgagctcgttttggttgaggagggtgtcgaggagggtgatcgcggcaaccgcattctgttgaggggtgcggaaaaccggtgtcccttcgacgtcttgttggccgatgagatcacgcgctcggcgccctgcttccaaagctcgctgacgtcgatcttcagcctccttggcgatccgctcacggtcctgctgctcacgccgtagccgctcttgttcttgtgcttgatgctcctcctccagtcggcgacgttcttcggtctcccgggcttggcgttgctcctccgtctcattattggccatgaaaacgccaaagtagagaggggtgtagttgtcatcaaggcttccgtcgaagtcgtcgaagtcgttgtagcgagaactaaattcgtcgtactccacgatgtcagtaggacgtgagtcgacggtgggagagctgttgtagtcatctagttgatccgtcgaaaccgtgccgagtggttggaggatgacgccgacttccctgaagctaggcgaaatcggtgttgaagccgacttccgcctaggcctacgggatgaagacgctgtcgtggtgaagacggccgctaaatcgtcggggagcttcatcaggactggtgggtaagccccatcatcttgatctggtgtcgttggagaaggtacgatctcggccgagtggtttgaagccgactcgattgagatggtcttgaagtaggtttcagccgcgtttgggaatccaaacgggactgagatccggttctctcccgactggtccgattccgagtcaaggagagaaatcttgccgaagttgttggtgacgaagtcgaggctgccgaaccgaaacgtctgcccgggtgggaagacgaggtcgtcgatgccggagaaaggacccattgcactgatcggcgaaaagcttgacgctacccctacctggcgcgccaactgtcgaaactagatttcggcaataataaaagggggtggctatcaagctggaaaagtgtatgggttttgagacaaaggatttatacaggttcaggccttcttataaaagaagtaataccctactcctgtccggggatgaatccgccgagtgtattattgattgtatgattcgagaaaaatcaacatatgcccctagaggcgcccggaccccccttatatatgggaaggagtccgggttacaaaagataatctatatccctaacggaatatgaaaatataggtaagatacagtcgtaaccgactaagtttcagggtgtttccttgatacacaagttaagaaacaaacccaagatacaaataagaaattctatctacattaggtatcctgtgcccagctcgaataccatcgccgtgtagatatgggatacccatgatctccacacctgtagcgtgggccgttgtttatgagggcgttcttgcgccgcggccggagctccacaagatatgcggtggacagtttctgctccggcagcggcagcggggaagagacccggctcggggacagcggtgagggtggctcctcgtccaactgctgctcgtagtcttccgtgacgccgcagtatcgcaccggcggcggcgcgacctgctccatggatcgatcgtctctggatcagcactactaggaagatcgatctgatgacgcgtggcgacgaatgaaatatatagacggatactctgatccagtcccaaaccgtctcggtgtcggtgtccgcgtcgcatcaggtcacgcgtgcggaacagcggaacgcgcgaacgacaatgcgtttcttcggaaaagactccgcgtaggacgtcaaatatcggacgccgtgcatcatcacaccacctacgtatgcagcatgaaaaagttgaaaaatttatgtataggaaagttcgatctgacgaaaaagttgaaaagttgaaagtttgaagaaaaaagttaaaatctaaacagggcctataatacatgcagttgtagttgaagtagctagctagctactccctttgtcccaaaatgtaaatatttttaactatgaatctatataactgtatgtccagatttatagataaaaattatatgtctagatttatagataaaaattgttatattttggaatggacgtagtagatggctacaggaagtgtccggcatggtaggatgttccgtccttgggatgcttcatctcgtcgtcacagctgaaccagtagttcctccgcgacggcgaggtgatctccggcaggtccacctgcgggtcggcgccggcgccgccgactcggtcggcctcgtcgtccagggaccagaggcacgtcgggatataccgtttcttgtccttgcgcacctcggcgaagaagagccgctggtcgcacgagctgccgccgccaatggccctggcgatgaagttgacgtacgtggccgtaggcggccttgcaggtgaagatggcgccgctgaagatggccctgacgagctcgtacttgacgccgccaccgccgacgtcgacggcggcgttgtagtgctccagcaccgcctccgcgtacatcgtgctctgccgcatccagactgggtcgtcgggttcgaaggtcggatattcctcgtaggggcagatcggcgaaggcgggctcggcctcggcgttggagaaggcggcggcggcgtgtggtggtgcttggacttgttgtgtttcttcttcttcttcctcctcctcttttcgccggggcggcgaaacctgtagcgtgggccgttgtttatgagggcgttttgtcgccggagctccgcgcggtatgcggcggacagcttctgctccgcagcggcagcggggaagagacccggctgggcgacttgggcgagggtggctcctcgtccacctgttgctcgtagtcttccagaacgccgcagtatcgcaccggcggcggcagcggggaaggcgcgtccttctgcatggatgtcgcgcctctcgatcgatccgttgcgtgcgctttaatttcctcgtggcaacgaatggaagcagcttctggcctcgcctcggcccacggtccaccccgccaatatatagaccgatcgattatggatccaattccaaaccggcttggcgtcggagtccgcattgcattaggtggcctagcgttgacggacgcgtttctttcccttctgtctccctcctcctttgccgcgccagggtttgcagttacaaaacgtttttttttctgggcgaaagaaccgaaatttcggaattttttcttccgaaatttttttaattcaaatatgaaaatttcgatcgaaaatttggagtataaaaacttggggcgctccgagcacaattttgcagtcagataattcatgattttcaaaaaaaaaaataagtcatcttgcaaatcaatcagtccattacaattgcatacaccaataaatccattacaagttcatcacatagctttgacagtccattacaaaggtttcaaacattccaaatgtgcttaacaatatatcaccagtccaaaaattgtctcaacaagtcaacatagcaaaataacatcatccaacaggtagtttgtacagtccgttacatagtaaaataacataatccaacagatagtttcaacatcttccaaaagtgctccctccgtcagaaaaaaaaaaaagccaaatcctgagttttcgtgtccaacgtttgactgtccgtcttatatgaaatttttttataattagtattttcattgttgttagatgataaaacatgattaatactttatgcgtgacttgtcttttttaattttttttcttaattttttcaaataagacggatagttaaacgttggacacggaaactcagggtttgtcttttttttggatggagagagtagttattcatggacatccatctcctcattctcagtaaattcgtgttggagttactctttctttgtctgatctgaaacaattaaataaagtatatatgtactagtcagtgcacattccatgtgatttgttacaagcaacatcatatggtgtttttttcttctaaagatgaagataaagattaagttttttacgcaaaataaagtggtattaacgtttgattgattgggttttaattattaaaaacttgaaaaatatattaatataatattttagagtaactttcatatagaaagttttcacacaaaacataccatttaacagtttgaaaagtgtgccacgaaaatctttatcttcatccaactcttgttggagaaatgaacgggacatgtaggtttctaatttgtccatcacagagctagtgtaaaatacaagttttatttcttattttctaaaaatacaggaccagtgtgtggatgttgtcatatgcttaattgctgtcacatcgaatgtttgaacacatgcatggagtattaaatataggaaaaaactaattatatagcttgcgtgtaaattgcgagatgaatcttttaagactaattactccatgatctgacaatgtggtgctacagtaaacatttgctaatgtcggattaattaggtttaataaatttgtctcgcagttcaaaggcggaatctgtaatttattttgttattagtctatggttaatacttcaaatatatgtccgtatatccgatgtgacacgtcaaaaacttttcaccctagcatctaaacacaacctaaatacactcagaacgcaaagtgagctggttttagtgattgagggagcctctctatggctgattttacagttaaaaggatacgaatagttgaggcagtcgaaatggattttcttcaaaagattgctccttattttgaataggacaaatgtttgcatcagaatttaactggacctgggatccctatatgagcttctcttgggcctcggttgggcccaccgtttcttccaaccaaaatgggcccatgtaaaccgatgttagctcaaggcccaactagcccagctgacggtgtcctcctcctcgcgttgccagcatttcacaccgtgcgccgccgatcatggccgccgcccgccctcccgccgcgcgccggcgacgcgcatcgctgggcagccggagacccgcgccggccgcggcgctcctgttgcagcaaactccatctccgtttctccactgcaacggtacgagcaatagctgctctctttctccgtctttctgtgtctgcacgaggtcgttagggtttggggttagaaaggggatcgttgagatgcgacatcccggcgttcatcctgttaaattccaatcaaattgatgccgaaagccgatgctgcggctcatctgatccaatcaagttgaatcacagctgcagcagcggctgtgctggtgctgtgaattgccccaactgcgtctcaaaatctgccatgggaacgagcaatctaggagcgtagcagggttcgtaatagtaaggtgcgatgcaaatatcagcacgattcattctaccataggacaccaatgcacactttgtccaggactccaggttctagctataagttcgaatcattgcaacaaaatatatgtagcatagtaattgcattactaccccattatttctaaattgatacattgcacatttcagaaagcatagtacatgaaaaatcatgcattcagtacacaatggggcttaagcagttcctcttaatgcatcagaccaaaagacattttcttaagtagatgatattttagccaattatgaaagactacaagatatattctgtggatgtcaaatggcaaagctctttaccagaattataactcctaaattgtagaactggcttcatcaactgaaacaagcacctccaccacactttccatggtgggtcttctacctctgtcttcctctaggcatgaaacagcaagcttcatcattgctcttgcttgcaagtcattgaatcggccatttaatctggtgtcaatgaactcaacaatccacgattgtccatccccacctgacttcaaactttccgcgagtgtcctaattatcctcccgaggaccatttccacctcttcatcctcatttgtttcaagatccgaaacacgagctcccttgagtaattctagaagcactactccgaagctgtacacatcaacctttgctgttatcgggagacttgaaacccactcaggtgctaaatagcctctagttccttggatccgtgacacatttaatttggatcctcctctatttagcagcttcgcaaggccaaaatcggcaatctttggctccatgttttcatccagcagtatattttcaggtttcacgtcacagtggatgacccactccaagcactcatgatgaagatatgccaatcccttagcgactcctagagcaatgttaaatctttgcttccatccaagtaaggcctgtgagcccttagcaccaaataatattttatccaatgatccattctcgacatactctgaaatcaacatcctgtgtggatcatcagaacagaatccccaaaccctcactagattcatgtggtagatcctgccaatcacactcagttcatgcttgaattcttcctcgccctggtttatgtctaacaactttttcacggctactgctctcatgtcctttaagatccccttgtatacaatgcctgatgctcctcgtccaatctcatcctgaaactttctggtggctatcatcagctctctgtaggtgtacctacggaaatggtttgttaccatttcatagccaacctcagatattcctcttgctagtttgccctcccttcgcaaaataaaccatccgaatacaataaatgttacctctgcaagaaatattgctgataagaaaccatagaagtacaaatacttcgattcattttgaccactcttatgctcgtccaaatttttgttagcattgcagtcaggaccgtattttggaccaaaaggctgtgactgtgggattgaagtcattgaatgctccgacagttgtaattcctccaacacttcttccatagggagcttgagatacatggtgccagtactaccaatgtgaggtaagcttacaccactaagaagaacggactttggatagcacttaccaattccttgccaatatacaaaccccatacaattgcagtccttcaagcatatgttctcgcaagctccaagagaaacataacgaagaggacttaaatcagaatctaggaattgagtgtttggaaggctaacaaacattaccttctgttgtacatcacaagtgatattgactcttgggctgcagcctttgctctgatcacttggatcaatgaagtcataaccgggaggacacgcacaggcaggcacaggtgtgtacacacatatgccatttataccacacacaccacgtacattgcagagctgaggaaatgccatccatgtgactgaccatgttccgcttgaattgttcagactgtataacctgagattgccgtcataatctagtgttaatctcctcataatcccaagaccccaatcagcagccatgaaagttaaattttcactttcaagaaaatgccccgagctattaagagtaccggtcggtatgatattatacaacatcctttccctccccgagatagtccgagtcggatttggccagtaaataaaagggatatcattctcttcataaaacagtgaaagctggaattgatcattaaagtggaaactatagcgaccgggaacaagtaatctgttagtagatgtgagcttaattcgaacagtaatgttttgagtgggtaacaaggtatcggtaggagaatcaaaactttgccataaaatggtgtcacctttgcccttcacaatgaggtttccagtattcaagagctgagcttgaacttgttcaccatttgaagagctcacgttgttggtccaaacaatctggccactattatctgtcaaaaccatgctgccatcggatttcaactccattttggatccctgagtgtagacagggtggagaggatttgcgctccagacaactgttttgtcagccgagttggtgaaccagatagagaaggtgcaggaattgggggagatcttgtagaggccgcaggcgaaatcgccattcggcgaatagagcacatcgtcttcagatagagatgcgcctggcgagaggaaatcatgtgctgatatgcacaaaagaggatgaatcaggagaaggagcagagaggcagagcttgcaaccatttttgctggagctggagagcaggtgttcgtctttcaagcgttgctgttaacttattataagaatccatactggtcagtggtttctggatccagtaaagaaaagtgtacttctttggataacaggtttttgaagcttgaacttcgtggcagatgcagcctctgaacaactgtgcacacatgcattccttaaaaattcaagggtgtagagatctctactgttaaaaaacaagtggggtacagtgtattgattagcatacatttaggctcccccaccagtaggcattaaccttatccgttgttcatatggcgttgttcaaataagaaccttcaattgccaaaaacaccagaaaacgcgagagattctgacatccttcaattgcaataggaggttgatagcactggagtcatcacccagtcagccattcagcgagcctgtgtgctcagtccaagtcagtgtgcaagcttctttcaaaccaggaataggattttaggagtatgcaagatttcaagttgcacagcaatgcaatgttgcgagtaattcatggttttatgcatacatttccaacctgcttgacatacactgtatatggcaaatgtggcatgacctgtccttgtcgatcaggaaccgttaatttaggcagtaaggtaacatctgcaacatggtgatgaattctgtgctactaccatgcttcatggctgcacatgcacatattgatctcgctttttcaaagaaactgacttgtaaataaacaagataattttgctttcttttttaaggtttgctcccaatgataggattcagagggagtgcaaatttgaagtgttctcagcaggtcaccacgcctggtcactgtcagcaatctaacacatactgtcaacgaaatagcggtgcagccgacaggtcacacatctccaggaaaccgaaatgtactactgctatcaaccaaaaaaatagtggattacagtgtattgagcaatgcattggttttcaacaagcagttgtgacttgtgacttgtgattcgattttttttggtcggtaccattttttaaatacaatattgaagtttttataggaagaacatatttagtaacttttttttgttcatagggatacggtattgtctcaggtataatgctagctcatccaaatgatccttataaagatcactcccatgatgtgtatatatgcacagcttaagatctctgtttccacattccacattgctgatgcactcgacgaagaaaccttcatttggtgaaacccaatttttggaggaaacgctccgccattgcttcgggagacgctgagacacgatatcaaccccggccaaccaccggagtaactcaccgtgctaaaaaaaaagtatcttctggttgcatctactccctccgtcccaaaataagtgcagttttgcactattcacgttcaacgttttactgctcgtcttatttgaaaattttttatgattagtatttttattgctattagatgataaaacatgaatagtactttatgtgtgactaaatatttttaattttttcacaaaattttcaaataagacggacggtcaaacgttgggcacggatattcacagctgcacttattttgggacggaggtagtacacaataattataattaattaacttcatattttcttacaaactttagtgaattaagatattgatatatatactccatctgtcaaaaagaaataatcatgggtttatatccatattcaaatttaggattgggtttttttttctggatagatgaagtatatgtcacaattctcgtgacatgtatgtgtgcatccccaacataattttttttgggtctggccatggtttgaaagcaccattttgtagttccgggcgtccgtcgtcagtttaagatcaatgcggttagagtgggattagagcgaccatcacacctttggtagagctgacactttcatgtaccagttgcatgtatctagcacagccatttcttaaacgatacgagtgactgtgaagtcgaagcttgcagcattggaagacgtgatgtgtgatgtgtggcaacaatggcatgagtttagttttttttaagaaaaaaagggtaaaagctttgcctcatatatattttgatagagcaaaaagagaaaaaattataaatttttatttacagggcatcaaccgaggctcaggtaagcttttttttttttttgttttttaacttcccaaagcggtaagctcatggcatgagtctagtggagttgctgggtgttggtgtgggccgagttgctgatcttgttccataggttttaatgttttatataacagcgtattgtaagatttgataacaatttttaagtaaaataagacactcttctttaatataacgcgtcgggccttaattaattgcggtggtcttgatgtcgaggaagccgttcagtccccggatgtcgtagttgcatgacacaactgtctcggttaatcggttgaggatcacaagtatcacacgatcttgatcgattgcatgatagattactatatgactatatatataaggcaatgcatgcatagaaactcaagcctcttttagcttactcaagcccttggtcatcaaatggcaaacaacaacggtaggtacatgcagtatttgtgttgattagttgattatggctagctagcttagtttattctctcttgaccatcagttagtataatccatattgtcagttttttttttttttttgagaactactcatatcttcagtcagcatttttatacatggtaccaagtaattgctaccctaatttccaggatatggggatggtgatgatcagctcaccacatgcaccaagctggcgttagaccacattgtaagtgactagctaattaattaactgctatcatgcatgtcatctctagatctcttgatatagatcatcatgcattgaattgaatattgtcatttccaatcgattatatttgtgtgtatgcataattgatcagagtgatatatgctcctgtgcaggacatcgacctggagaatgtccaaggcttcgacagcaacgccttcaccatgaagctgttcgacgacaacgacgatttgatctacttccacgtcgtgtttaccggcgagacgccgggacggcgcggcggcggcggcaagcgttactccttcgccgagatcgtcggaaaagacaagccggaggaggtcagaatgtggaaagagatggacgaagaaagtgaaagtaagcaagcacacatatataccaccagcagctaattaactgatcaataattaattagattcatgcaactgaagcgttttcaatatgcatctgggcaactaattaactagctaaatattaatcctgtgtgttttcttttgcaattacagattgcaccgtggagaactgcatcttctgcaccgggatgtggcaccctctgtcgggtggcttctgtggatacaagaggaagaagaagaaccggagataggctcttctgcaattatcagccactgaagctgcatgtctcgtcgtctcatctttcttctaactttgttttctagaaataaattgggtaccaattaagtttagttgttatcgatgagttgtcgctttgatagatcgcgacgtagctggctgccgtgcttgcttgcattgcttagtatacatatgtgcccaaattaatttatatgtaatttctgttgcttgcttgaagaattaattacttcatcagtgcgtttaattaatttcatgcgtgtgctacattaatttctgttgagcttttctccatttcattatgcttgcgaatgtgaatatgtgatcggttaagtagttttggcagctgtcatagacttatagtactctcaattccattatatttggagtaatacatatggtatatattaattaacgtacccttgaaccttgatttctacttcccattgagcaagctacatgaaacatttacctcttaatttttcccttttttcacggaaatcttgacctcttaattaatcaagtgatcacaaaatatatttatagatccatgatactgttaaagtgaaccggtaactttcgatataattcaaaactgaaatcgttaagtttcgatgctttagaaccaaattttgtatgcgtttttttttctacaaacctcattcatctatcctccggattttggattttaatgtggacaaactatctccatgactcaatcccatcatgcattcaacctgcattttattactccctccagcatacatttcatgtttggttcacgtactgtaagtttaattgatgttctaactaccaccaactacctcagagagaagatgtttggttacttgtacatagtaactcacagtttgccagccattgcgtcaacaaagtgagactaccaaaaattgccagagaagtgttttgtgcaatttttgcatttctttagactacaaacaacaatatttaatttgcactaataaatcaagtcaacaaaaatcgatcagaaaacttaagattaacatcaaattgcaaacacccctgattcatgagcaacgtatgaagcatttgataattaaaatggcatgcaaagggcatgtccatatgcagacaccccaaaatcacaataatctgttttgtgagggatacgtatccacaaaccacctcacacatagataaggcacaaaaaatataggtctctttaatttactatactccactccatcatgcttgcacatgtatccaatcagcagtgtttcctattttagcggaaaacaaattaataaaacatgatttattacacttatttacatcatagagccaacaactgtgactagcaagaaatttcagaggcaaatacattcaatcgcagtcttttacagcatgattattccagttatttataacattctattacatacattactaattgtcccaactagcaaatacattcatacaaaaaatctcacgaccgaatctaattttcaccaaaagttgaatagctaatgagctacagccaagaacatccccaagaacagccgcaagaacacatgaaacaaaaaacttaagagtatagttattaggaccggaccaaacagactagcaaagaaaaaaaaggaaataaaaaacagaagttgagccttagttggtcccgtttagttaaaatgaagggaccagaccgataatccgaccagaactaaaatggaaccatgcaaactgatggttgggaaggcagttccttaccactacattgcgttgatgttagtgtgatagctatgaaatctttaatttcttaaaacatctttagaccagtgatccaaccggttgtaccactcaaaccgtgaactaagaacctaaaatttcagtacaaacaccctcaaaccgatggttagacaaaacaaattaaacatatattaattagaggatatgtcgagagcttatgccttagactttggtgggacttgggataagagttggccctatgcaggattttcttacaacaacagctatcaagatagccttatagatagccacattcgaggcattgtgtaggagaaaatgctgcaccccctctcctttaattgggatcaaacgagagaatgtcggctctttgggagttgggactggcatccaaaacgaagcagagaaaaaagtgaaaatcattcaagaaaggctgagggtagcccaatcctgccagaagagctaagctgatagtcgttaaagagatttgtgttttagtgaaggagattttgtgtaccttcgagtccccccgtttcgaggtgtaccctcttacaaaccaagggaaaattggcaccatgctatgtggggacatacaaggttttgagtcacaaaggagaagtggcatagaagtggcataccagttggagttaccccaagtggcataccagttggagttacccccaaccatggttgtcatatatgatgtattctatgtttctcaattgaagaaatgcttaagagtgctcattgagcaaattggcctggatcagatcgagatacagaggatctgacttgtggaaagaaatccatccgcatccaaaccagcaaaagaaacacacaaagacgagtggtcagtttctacaaggccaaatgaagcaatcattcaaagttgaggctacatgggaacgagaggataaattgaagtccacccatctgcacttcttagccagcacctccgaatcttagggatgagatttcatttaatacgggtagatttgtaataccctgagtttttcccctaagtaataattccattaatagtacatttctagaaattgccaaaaaaatcttataggaaaatctacaacaataaaacccttaaataataatctattctagttgggtgtaattttcttaaattccccatgctttaaattactcacagtatttttgcttgattttttttagagaattggagctacttttaataacccataaacaaatatcataataaataaattcataagagcttagaaaaaactctcatactcttgggtccactctcggtgcatccttcctccccttccgcccgcgcatgctagcaagtcgccatagccatatcctcttcacactcatgccagcctagcctcccatgtagtcgtcaccctaggacactgtgtcacgtcctaaaatgaccctaaaaatatatccttaaaattatgctcagaataattaaaatccaagtgaaagcctccaaaattaaaatgtgcaaagttaaaagtcaaataaggcttgggggattttttatatttcctaaaagctaaaatgtgtaaatagattttagtggaattttcagagcacaaataataattatcaagaaataaacaaagttaaaaaagttttataaaaagaaaaaccctaaaaatcccctccctctctctctctgggctgaattcggcccatctccctccccctctctctcttcccccgcggccccactcggcccctccccgtgcggacgtcgctgacgggcgggcccgcccgccaccctcgctgacgggtggggcccacccatcatccccctcatcccgccgctcccttcgcccgcgcctaacaccgccgccaccgccaaat

SEQ ID NO: 66879 - DNA, 4154 bp, Oryza sativa
tcgcccgcgccggccacagagctcgtcgcctctctcgccggccaccgcgctggttgcccgcgccggccgcagagctcgtcgcctctctcgtcggccgccgcgctggtcgcctctctcgccggccgctgagctcatcgcccctctcgtcgcccacgccggccgccgagctcgtcgcccctctcgccggccgccgcgctcgtcacctcgctcgcatcgtggtggtgaggggtgacacgagtcacgcaactcgcttgcccggctcgcccgagcctcgagcggttacatccggccaaatcagccgaatccctctatccagcatctggagggaatattcatctctgggctgccctatcccactctcgcccagcatccaaacaccctccaaaaagcggcggccatgtcctatccgggtatatcccaccaaccaaacacaccctaacttctttcagaccagaaactttaatcgctaaaatcaagcggcaaacagctactttaagtaaaatcagggaaacatttagcttctaataatcctaacatatccaagatcagctaaaccttcttccaatcacctgcgctagattttaagaagcaacctaagcaaaatgataaacactctgcagtaatatttacatataagtgcttcatctagtgtcgtaggtaattgcaaaataaacatgatggttggcatattcaaacgaaacagtgagagtctgcacacctcttaaatagaagcatggtacaaagatgaaatattacatgcttcaatgaatctggatacagaaagaatgtccagtgccaattgtacagaaaatctgcataattaaaatcaatatataaaggcaagatttagaggaatgaagtcctatataaagataaaatgaaaggccactgaatcctaaccattaattttctggcttcctcatcacaccaaaccactacaacttttagtttggaacaatatttgctagctgcttcattcagcagcaagcagacagcagtaaacaatagcccaccaggcagcaaaacgaatcgccccgatgttgttgacggctgtgagagtggaaggatcaagtctatagccatctgacatagaggaaaaaaccagatcaagactatctcacggtaggcaaagcgagtaaaaactgaagaaaagcaaataaaaaggggaaccacctcaatggcgaccgaacctggcatcctcgagcttgtttcccatcacaggccaatgtctggttcttgagtgagtgtgtccttgccaaatgctcccaccattggtccatgggtcgcttcctggccgaggctaccgtcgtcgcagctccgtggagcccaacacaaaacagggtaactgctgcaacgggtggcgaggagaaacgggcggagagtgcttgagggtgcggcaggagatgggcaggacatggaagagcgtgagggggaggccgtcgccggcaaaactccatcaccgcacccaaatccaacgctgcgccatccagtccctaaatccccttgctctactgggaggggggtgatggagggagcgccaagaaaggaggagggtacgggagagcgtgaggggaaagccgtcgtcggcgaggagaagccggggaggtaaggcaaggcggcggcggcgcaagggcaggggaaaggaagagaaagggcgggagaacagtgatgggtagggtttcaggggaatggagaggatagaatagggatgttctcttttgcagaaaacacccttatttcccttttttcagagcgcggtcctatatctagaatttcgtctccttcacgtagtatataccaagacattgagggctgttacgaaagagtacaaaacacaggaacatagggtgagggacgtaagagtaattatcaagttaatcgaggacttttttgcaagatgaccagttccaacgcggggcgatgtggataccaccggaagcgaacacgccagccaaaaaaccgcaaaatcgctatggtgcgaagcgaacacgccagccaaaaaaccgcaaaatcgctatggtgcgagcattctgcgatggtctttaatatctccgattgtctaccctctaccccgcagcttattagtaacctcaccaagctggcagccaaaagatatatatataagagcggtaggattacacaattggatggaaatgcatggcatggtggtaagactgcactacgtgcgtgtcgtagcttctccacgtcagggaatcggtatacctacctcacttcccccagttcgatatccttgacttcgaatcgaatcctggtgcctccctctcctattggatatggttatacatacgtcgtctaggattatgaaggacttgtcacggtcatcgattggcagcctgattattgcctacaattcaacaggagggtatctattcttattttattttgaggaattatatatatatatatatatacatatatatatatatatggtaaatttgtttggtgctccatggtgcccgggcaccattgttgaaattgagtatatacccaattcaaatgagtatgaaactttttcaattacttaggtattaacattaactactttactaacttgtttaaagcaagtttgaactgaatttgaacttgtttttgttagattttgattctaggtatatagcatccatacatataattagttaggtatgtaatcatggattgtgaaataaagttaaatttgagttgttttgttgataagtatagggtatgaatcaaattattataactaggtatatactcacaatttgaaaattttgaaaaatttgagtgattttgtgcattagataccatggtgcccgggcaccatggtgccccatatgagtgtcctatatatatatatatatatatatatatatatatatatatatatatatatatatatatatatatatatatatatagagagagagagagagactactgaaagggatgtgatgcatgttctatttatcatgaatgaaaggtaagccgtccatagtaggtacaactagtttgtcacattccttgttactatgctttccgcacctttttacaaatatagaagttaaacctcaatgaagagatttgtgaaatgtgtgatttttataaaaaatattcagtagaactaaattattcatgtaaaagtcctatatattactagggaccttaaataaacatagtatatttctgctacaaaccaatagatctaatgatgcttttttttatcagcatttaaacctaaaatttaaatcccattaaataatattacgggctataaaaaatgggtgcgccaaccggcgcaacgattttctagtatttcgtataatcctggatgagatagctaccgatgggcctaccttttacaatggttcttctgttattagcagcatgatctgtgttgctgagagacaagcacgatcatgaacttccatggagaacattacgtcaggttcacaccaaaacagctttgctctggcatgcctccatgtcaacttatctcggtactcctgttgcagttgttccatacacgatgaaggaagaacacctcgtcagtattcctgatgtctcctattcatacccaacccgagattacatgcttgtaatcagtttgccctctcgatcgtttacatcttcctttgtcttattgtctatgttgtttttcctcttttcttgcatactttatatgaagggaataaagatattttttttgggggtcattcataacgtagatagacatgtgtgtgttacttatcgccggatgtagataggtaaatgtgctactcccttcgtttcaaaatatagtatttactaacattctctttccaaccaatcacaaccctccaccattcactttttccacctatctccactactcatccaatcacaaccctccaccatttacttctacctactttctaaataaccgtgtccaactctaaaacttcttatattctaatacgaacgaatgaagtagctcatggcctacaagataatccaccggctgtatatcatctctccatgggcaaagtgcattcgtggcagtgcacagtggtggagccaaaagccaaaaatttctcaaaagtatggctcaattgatgtagttttcataggcttgtcttctttgttctaaattttcaaaatttggtgtgttcaatggg

SEQ ID NO: 66880 - DNA, 34958 bp, Oryza sativa
ttattgccctgtgctcgtaggtgtgcccatcagcagcaacataagggtcatccattacctcctgcaccaaaattgtcattgtttctatttagtctagggagataatcagaactggcgcactcaactagttagcaaattttacctgcaatattgggcagatgaagtggctcggcacagctgcgtttggacttcttaatgtgggagaagcagtaattctgctcagaatgctctcgatctctggcagcacctccgattcaaggctaggcctgtctctacattttaaagctgtacaccgcaccgccaattttgccaagatctctgcctcagcgattggccaatcaatctgagaactgtcaagaacatcggaaattgagtctttttttatcgcttcttctgcactaagtatcagcccgtgtgggcgcttgccagtcagtagttgaagaatgatgatccccagagcataaacatcagatttcggacgaattgtcccagttaactggtattccggatccatgtaatacagtgtgccggcaactgcagtatctctgtactctgtgagcccttccggcacaatatctgatatgagcttggcaagacctacatcaccaattttgctgacgtagttcttgtcgagcaatatgtttccaggcttcaggtcacgatggacaatgggctctggtttcgttgcatgcaagaaagcaagcccacaagccacctcaaagatgatttggatgcgcaggaaccaatgtagtgattgctgacctttgttgttaataagttgatcttctagacttccattctccatgtattcatacacgaggcatccaatttcagggcagaaaccaagcagaagaactaagttgggatggtgaagttggctgaggatctcgacctacataatatcagataaccaaataagtaattctaagcgccagtaacaactttattgcctagccaagaaagtcatccatcagttatgatgaagattagaaaaagataggttaggatacctctctcaagaactcatcaatcttgtcactggaatcttgctgaataaccttgacagctacttcagtatgatcaagggtacacctgtacacattcccatagcccccctcaccaatcttctttgcatcggagaagttatcggtggcaagctgtatttcacgttttgagtaccgcctgcaacttttgccagttgacagaagagcatccataacctttgtcttctcagcaatcaccatatcagctactatttcagccttatgcttggaaaaagcctcctgagcgaacaaagtttttgccatctcaacttctgtaacagcttctagatgtctggtcttctcatctgcaaccttctgcttcaacaattcctccctatgtagtgcatcttgcaccttcttcgcttcctcagtacactcactagaaagaaccttaatctgaaacatcagagtaacatggaaaaaaactaattaaaacattcacttttaatatatgaatatagatatcttcatgtacctagtaatgtaaaaaactggtcacagtaactcaagccaaacagcagccaaaagaacttaaccttatcttggttagatcatcacaagctttatcacacatcactaacctttttcttggcatggacgagatcttcacaagctttatcatacatcactaacgtatcctgcaattcctttctcagttttgctacttcatctactggttgagactgcagatcctgctaagaattgaatcacaattaatacaacttatggaaagcttatgaaagccaacactagtcagaatattttcaaggctggaaacaggtctgacctcatcaattgagctcaaggcaacataagggatttccttcaatcggccaatagcatcgggatccgtgttcacatctctgcccggtgtttttcgccctaagcttccaaaaaggcttcttccatgacttcctgaacttttaccagcattagtagaagtgctacgagagctgcaggtatgagagcctgcataactcgtatctccagaagattttggtgttccatcctcagggtggtcatgcaaagattgtttgtctagcagccagttcttctgtattcgggaaaatgatttatgactgattgactgagtccttacacaagcgcttgactctgcaaaaaatagaaaggtttaaggcaaaatgagtgcctcaccattgcatttcccaaaagaaatagtagagaatatgggcaaaacatactgcttgttcgagcctgatttgcaaacttaatagtcaatctgtgcctggacacaacaaatacattgcacgaacatggcatagctttcaggacagtagagggcacatctcggagccgtaatatcctgaaaaaggtaacagcaataccatttaacaacaacagtggatttggcaaaagtggccagaaatcgatttacatttacagagatgctcattaattttgcttatgagtttaaagttgacaaataatgaagataaaaatcccccgcattaaccagctaaagtgactaatctatttatcagcatcatgaagacaaactgatgttagttgcgctggctcttaccaatatctgtggcttcctgggtcctaattactcaaaaggcataaatgcgagaaaaaaagaaacgaatgtcaacagaaaaaggaaagtttaatcaagatatatgtacgtgcacacacctatcacctttactcagaacaagtgacaccatcccaaaaaggggctcaatcttcccttttttttttctgaaaaactttttgtcccatatacacagcatatctagtatgcactttccagttatttttatactttggggggaataaagctatacaggtaagaacaaaaatcccccttatccctatcaatctatcattggtagttgaattctcaaaagcgaaattctaacctttactagtagttgggaaaggagatttgtcacccaaaataaagtgaagaggattatatttttcaaaaaaaaaacaattaatctagtataccttttgaaccagttgagggaggtggatccaaccacgaggttgcggacgccggagtccgccgcgtacctgaccagcgccgccgtgacgctcggctcctccagaatcaccgtctccacctgcaggggaggaggaggaggagggggagctcgaattttgaggcgcggatcgagcaaaatcggcggagattttcgaggaggaggaggaggagacttacggttgtgcgggcgaagaggcggcgcagggggaggaagacctcctcctgcgcacgcgcgcggcggtcctccgcgtacatctccaccgtctccgcgtccatcttctccaccggcaccctctcccccgctgcgcgcgccacgcagagaaaaacccatcagctcgaaccgaatcgacgacggcgacgacgaggaggaggaggaaggaggaggagagggcttacagggggaggggacgaaggagacgggggggatgacgtggacgagcgcgacgcgcccggccccggcgccgtgggcggcgaggttggcggccgcccacctcgccgcgcggcggctggcgcgcccgtccccgcgcaccgccaccgccacgacgatcgcgcccgccgccgcagcagcagaggcagaagcagaagcagaagcagcgtcgcctccacccgaggaggaggcgagcgacgacgaggaggaggaggaagacgaggccatatgctcttcgtcggcggcgccaaccactcgacggcggcggaggcggaggtgggtggcgaggggggagggggggaaggggagcgagtcaaccgcgacgaaataaataaaccgcgggggaagggaagcaagcgaggcaacggcttcgcgcagtttcttcgggtgggacgaggacgagtcgagtgataaactaacgctcttttttttttttttcgcgcgcgaggcgggggcggctcaacggctgtgtgggggtgggcccacacgtgtgggacccacactcttgttgttgtttgactgtggcggcgaagtcgctggctcgctgctcactggaactggaatgtttaaccacgtgtggatatatgatgcttttattatccatcaggcccgccagatttttctggctaggctgatataaacagataggaggagatgggagaagaacgactctgtgtgtttaaagtagtaaagaaataaaaatgatagtattaggaagaggctagtaaggcctttagaatgaagattttttttataaatttcatgagaattgaaatagtttatgtatgaaaacctggtgaaattttcacattcaaaaagaactttcataaggcatgtcaaaaggtcacacttgattttcgatgcatcctactctagttactctagttagattctcggcgtagctcgaagcgggaagatgatcacgaacagcatgagggtgtagggatggcagcgatcaaaaacgacaattgactacaattgagctatgttccccatgctgcttgtacacattgacagagatggactgattcggctattcacatacgtggacaagtttgagtgagcagtcatttacaacaaattaacctttgggggtttgaaaacaagagtgacaattgaggtggttatttcttaaatctttataacaaaatatcatatggtaatatttttttaaaaaaaaaagatgttttactctttgttctctttttttttcactctgttgcactttaacgtttccttggatattgcacgtattaggttcctgatgttgcaatcaggttttcactgttcaccaagtgattaaacattttttattgagcagtgaaacattttaaatcatttttctaaaatatttttttactgagtatgagacatcttaaatcattttttttgctaaaataatttttattgggtgataaaacatcttaaatatttttgtacatatggtaaaacaccattcggggttttaattatgatccgacatctgatcatagttgccttgtatttttctttctgctaggcccgtcaatatgagagtttcgtagaggtcgtatttttcttttctgccaggcccgcctttaagaaaaataggaagtgctgtgaaggggatagtaagacattctttacattagaaaaaacttcttaggaattgaaatacttcctctgtttcataatataagtctttctagcattacccatatttatatagatattaatgaatctagacatatatgtatatatagattcattaacatttatatgaatgtgagccatgctagaaagtcttacattataaaacagatagagtagtttatatgaaaatctcataattaaaattataacattcaaaaatgcctaaaatataagttgctaatacagagcaaaacttcatatttattgaaagcatagccttacacttgactaacagaaaagatatcttcatcctttaagagaaaaaagagagatccatgttgtaaacaggtgttagtgtgtggatatatacataaggaaaacagtccaaacaaccactaaacttttgatggaagtacatcaagcacctttaacattaaaaccagacatctaacgcactaaacttaaaaataccgttcatactgtcagggttaccgataagacataccctctctcctagaaatcatgaaatatacggatacgatatatcctcaagtatacggaaaggactcgtatttaagataaggaaatcaatgagtccgtatggaaatattctttaagggtggaaagtattagagtactacttagagaggataaggagtgtgtcatattgtacgaggtccgacgtctccgagttctattgggagacaaaggtgatatgaggtacaaatgcatacccccaggaagatacaaggcatcgaatcttagtgcaagacacccgccatcatagacgcaatccggacgacttgaagcctattcaccaatgatctcgtcagtaatctcggagttcaattgttctcttttgtaccacaatgttttcttctataataccatataaactggattagggctattaccttacagaggagcctatcgtgtagattctcgtaccaacgtacctcaataccctcagattataatccgtggtatctcccgtcggcacatattatcctgagatagttttgattggtggtttgtgtatttgaaagcttaaatgggtggctttgaataactaatataatgtttttatatataatcaacggtactcccttcgccccaaaaatataagcacttataatgttcaaattttatcccaaaatataacaacttatagcgtaaaaatttatcctaaaatataacaatttttccaccaacattctcttcagcattcaaattttccagcatcataaccttccaccattcaattttcctcactgcctcttctcaaccaatcacaagaatcctaatcctacctacttctttctaagtgagagtgaacatgaggtaaaaagaaatatttaagtgaagattttaacacatatatccaatgcctatgtcatgtgatgtgatcaaactcatctactgtataatacaaattagaaaaaaaaaatactatgcaaagctatattagagggctatataaatggtattgtaaagtttaaggatctaaatgtccggttttaaaatgtccggttttaaagtttaggtgataaatgaacttccatcaaagtttaggggtgtatttggactttttctttttagtaaataaaacccatcctaaatttttatcaaactttggatgttggaggtccatctttactttcctcttcccttagcatgtggttaacattagtaatctttctaatggattgaatattatgcatcacataaatgatatatcctatcttttgcacaacgacatttctcatatcaatgatgggaatggctatatgaagtggggatctatatactccctccatcccaaaatataatgctcaaccacttttctctcatatctctaatataagacgtgcatgcatacatacattaactagcacctcttggtccaatagaattgatttgtcttaaatcctataccatcaaaccacccaatcacattactcgcatgcatcaaggtgatccaatcaagaaggtgattaaatgttttcttggtttttgtgttatgagtggttgagtcttatattttaagatggagggagtatcaaatatgcttgtctcaacctattacatgcatgtatagtactctatactcaagtaaatttatggggataagatgactagaagcactttatagaccttattatatggtcatgaccaatctagctataaattctcacatggttatacgtgacagcgggtatatatatgaaaagccatatggtaaaaagacagttgatcgaacaagtttgtgtattggtcgttctcgtataaacaacaaagacccccgaaaaccaaacatccgtagtcaagatcggaagcaaaatagtagtgtctcatttccattggaaaaatccacaaagggcttaatttcgatcaatctgcgggcgaatttccccgtgtcgtgtagcgtgtacaaggacattaattctgaaagctatatgcattgaccaatgaattctctctatctgcagttgtcttctcctcatcggaagcttcagaattgaccgctcgatcataccagtgccatgcatgctgcactttgctccgatgtgtgtagggatgaaaatggttcagatagtattcagtttttggcttttttttccggaaacaaaaagtgcgggtctgaatattattttcagaaagtttcgaaaacggaaacaaatttagaatattttttttcttcttggaaacgagtatggtaatactactatccttttgaaactggaattagtcaaaaactttccggaaacgaatttgaaacagtaagctggttttcaagccgtttttcaccctacccgtgtgcatgtgtgctcattgctctttgtggcagtggcgcatggcagcaaacggccggcaagggaattaggttgtgtttagatccaaaatttgtattcaaacttccaacttttctcatcacatcaacctatcatacacacaaactttcaatcacatcgttttaattttcaaccaaacttacaacttcaccatgaactaaacacagccttaggctacgacgtgtgcaaaggcggcgcagcgcccttgtctcactcgtggtttctgactttgatcttctgatttttttaaaaaaaaaatttgctgactccgttcgtagcttgttcctgctcgtgtgtccccctcttcttcggttcttttttttttcttaaggattgttctttgacatgatcaaattgactgaatatggctggtgttttttttcttttaaatttccccttgacgaacagattgtattttgtctgacagagagcatgtcgcgaaaagatcgatggatttaattattggaagggtatgttctagaaatgcgaaatgaaaactctttttttttcctcatctcggttgctaattaatgacaagtgcggcgatgtacgggctgatctactagtcaatatgaaactctctagtagagtgcagtgcagtcatttggctcaattgtccggtttgagtccaactcgcgatcaaaataactgttccgagtccaacacggtcctagcagtatccagtcggtctcgaatgaaatatgtagttcttttctacgcagtaatataaatatttgtgaaaggagagagtattacgtccctccgtccaacaatataaacatttaaagcatttaaattttattcaagaatgtaagcatttctacactactatttatcctctcccaactaaactcccacctctctctcccaaaaacaaaactcacctatattcatctcttatttaataagttttttttcatcaatctcaattgatgttaaacaacctagaaatatgtttgatggatggattactattgattcgtacatagttagctagctgtctggttggctccatggggttaatggcgacaacgccgaccagtagttaggtatagcttggtttgacgtcaaagtcagtctccatgttgacgcgttgctcaaaacgtagtacgtggtatccgtactagtcgctgctgggtctagctcacggtctactcccgggctggagtagtgaatcatgaattaattaggagtaatcaatcttgtcccgggctcatgattggtcaggactcacaggccatagccataaaaattgggttcatgacattgcattggaggagtagtagtagcataagagatgaaactgcttgtgtttgcagaagaagttggtagtgatcgtccacatggaagttggtgaagaagtacccagccatcttccccgatgcctctcgctgatctacttgccaatttggtcccattctgcttgaactttccaaggtgacaactgtgacgttgatcgatctgtgaagcttcagaccggcgagaaccgagcatagtggagtagtacctatatatggagttatactagtacgtagtacatactacaaatgataatggcagaacttgtttgttttcttttgcaaaattaaaaatggtgtagtggtggcacgcattcattctctagttcgatgtgatcatgtgatgtgaagttacatcacataactctttcatcatctcatgaataaacatgcaaaaaaaactgatgatgcattcaacatatactccgtactatataaacagaatgaaatgagacaggcatgctaacagacgagacgacaatttttcaaaaacaagaaaaagtgttcggtactgcatcaggattaccaccagcgacaccaattgatggttcttgtcctcaaaatgtaatccacaaatccataattctgatggggcgaaatgggccaagcgtccatgtaacagttctagctaggccttcagcatgttgttgtcagttttatttgtagcgccaggtttgtactcgtcaaccgcaactatgattctctagttgtttaatttgtcgttggcacatattatgttatgtacgatcgccaagacttttgcgccttagcgcatgtgaaacgtttttaattgggccatttatcgatcgatcaatcgatgtctttaatctctggattctcacctaaaagagaagaattcatgcatctcgcaagctagaattcttcaagatttcaaatcttcagctaacttcatcactacattgtgaatcttgtgcaatttgcagaacaaaacctttgagcacgtcctgcggtatgatttttttttccgaacatcaaggatggcacatgatcaatttaagaaatacaacacaaagatatacaagtaatattcctgaaagcaggagagcatttacctcatgatcgatgacgcttctgggcatagcaccgggataagcgatttaaccagcttatttcgcactttgatagaaccgctgcactggaaaacgaagccatatgccttgctattgtgaatgacatacaatcctgctgaaaagctttgtcaaggacatcagaagtccatgatttggcatatgactccaaaatttcttcgtcaccctacaaatttaatgtgaaaataagaattgcaaaatatgaaactgttttatcgcagacgcatgcaggaaagtacacacatgaagatgggaacaagcatacaaagaatcaaggcatgcagctcaggaaaatagcatgcaggtgtgtatcctagaggtgtgtaatgtgcaagcccaaaatagttactttcttcattttatattataagactttctagtatttctagattcattaacatatactccctccgtttcgttttgtttgtcgctgtagctcatttcaaaaagagtcaaaatgtttgacgtcgtagtacaccggccgataccgtttccatctttacccctcagtcggcggcgcggagaagcaggaggagctcctccgccggcggtcctcctgcccctgccacggcgaggccctccacgcatggcgctcaagtccggcgccgcctcccacgcgcatagtccccttccgccgacgaagcgccgccgcggcaccatggccggaggaggagccacgctggcggcggcagcgtgggagatcgccgtcgtcttccgtcctccggccgctcctcgccttcgccttcgtcctctccatcatcgccctcagtacggctgccctctcctcctctcgattcggctttggctcgagggcttttccctgattctttcgttcgctgctcgcggcggcggcgggttcgcaggctgatacatggcgtggaggacggtgctggtgcacgtctcgttggtgcaggagatcgccgggcttcgaaaagctccattgccacaagtctcctcctttcttttttctttcttcagctggatgtccagaatttacctgattatttcatccggttaagatagctgtgcacttgattgcagattaagctactgaacggcctgcagattgtctgatttggttagccgtatgttgattgttgatgttcgttttttagagaatgcacattgcatttgcttggctatttgatgttcatcgaaggggaaatttttctgtttctgggaaattctggtcgtgttcactggggactgattgttgtgtatttgatcagatgattagtgcttagtactgtcagtgatgtaatatgcgtgggaattttggatgttataatgagaaattggaaacaaaaattggaacttgagatacagattcagagatgcacaccaagcttgtaaagtggctgctgccatcccagctgatgtttcttgtaaattgagatagctagtctgtaaacagagtattcagacacagagcttgtaaagtggctgctgccatcccagttgctatttcttgtaaattgagatagctagtctgtaattatatcaaaggaccattgacagttcacaccattgatcttagataagcttagctaatgtgttcatgtgaaataaaaatactaataaaaaaatcaaaggacatattcaggtccatatatcctcctgctttctcaaaaatcaaaggacatgttctgcacagaatgactgcacacatgggctactttctagaaaaagagagaaaaaaaagaaagcctccaattcattctgttcagatcaacaacagcaccaacaatttcagatatcagcaacagcagtaacaccaacaatttcagatatcaacaacagcagcaacagcaacagcagcaacaccaaaaatttcagattagcttagcagcaatttcatatccgcaccctgctgcagcaacaaacaaattcatatcaggtatctgccatggtcctgaaaaggagtaaaaagaatgccactaattagcacacatcaaactagttaggcacatgaagcgattttcatgaaaataaaatataaccaaagtagtttacctgagataattgttagcattatttactgacttagcatcacaccttagttgcaaaggaaggcgaccttgcctttcaagcactcctttttttatgtgtggaagatcataggagttgtcaccgagtacttctatgacttccctcatgcatgcgtgaagagacaagaaaatcctgtttgatagcctcactggataatcttcaaatgctcgatcgatggcggctacaagttcttctgttgttgttgaggctgatttgtactggatggactgaatggagttgaagaaacccagatccaagacattcaaatatggggaatttgccggctggcaaacaagtttgatgttaaagccgtcttgcttcgcggcctcacaaaacattctgtcgtccggtgcaatatgaggccgagcattatcctgctggatgtatataggtttgccagcgtcttcacgaggccacttagcccgaacagctggcaataccttttctatcatgaagcttcggattacctcctttgtgattgactcaatgggcttcatctcgattgtccctgcaggacggttcacacttgacctctttgcagctgtgtatgtcacaaaaggaaaacatccaattttcatttgagtcaaaccttggtctggcgagagctgttaagatcattatttttgggatgaagtttttgttttgaattgtcctgatgcgacgcgaggcagttggagctgcgtaatatcgcacagtcttcctcgtaatgttgaaccacttctcatctatgaaaatgaaatcaaacagtggtttgaagacaagattgtgaggcacactccttgggtcaagcatttcaatacaccacttcagccgatcaattttgttttggtctgtcaagtggggatccaatgagctagatacacgctttatagcaccctcttttttcattctgtagaccttactcgtgctaacaccaagttgagtagctacatcttgtattgtggtgcggctcaatattgaaatatcttcgagacaggacacatccaccaccttcttctttctgccacacctagatcttccactcgcaacatcaactgaaataccttgatccaaacagcttttgccttttttccatatccgctgtactgtcctgataggcaccgagaatttagctgaaacctccttgctctcatggcccttcaaatatccttttcttgcctttacaagcatggcgtcaaagattgctctccgtttgtcattatcaagcacgacattcttgtgtgtattctcctgaggaactaggatagcatcatcaacatcagaatcgaagaaaggatcaaactgaggctgtacattctcctggccagggtcaacacctatctcctctagagtgactaggacatcatcatcagcatttgaatcgaagggatcaaatccagcctctccattgccttgagcatctatggcagcactgtgatcgaatctagcctctccattgccttgagcatctttggcagcactgtgatcaaatccagcctctccgggatctgtggcagcatatgtatctcccggttccaaatttaaatcaatatccattgttctttgctctcgaccttgacaaattccatgggttgtagcagaaggtgatgttcgttgttgtatagaaggagaccttatccgtatgctaggggacagtaacattctgctcaacggggttctaaagaatggcattgccacgcagggagacttcctttttttgcctcttttccctccaacattggacccatctagtgtaaccctgcaaaaggtgttgcaacgaagttgtcatgaatgcacattttggattataagttgcatcaaatgttaagagtgaaaagcatagtaaggttctgagaaaagataaaagcatccattctgtaagacatctagtactggttgtatagcataactggacagacaaccatgtgatctaacaagaaattatacaataacaagaactccaatttatgaagcaataagataaggaaaagacttatgctaaatgtttgcataaactagaacaaccagcaacagctccctgtaaatagaaatacagtgctatttccttgctctaattaatcgaattttgcacaagcagtagccatgaactgaactatgtgaggttagatgtgaaaattcatttaacctcgcaatagtgagcatctatagagttttcctgaaaataacacattttaggaacacaaaatacatcatcgaaaaaaaatcgaatacgaaccttggagagagagcagttgaggacaaagccgcggcagcgaggcgctcgacacgatcctctgcaccgccgtcgccgacctcctgagccgctttcttccatggtgtgacaaatttgcgacgtctacctaccctgccctcctccttcgtcatgaccaacggcgtccaggaagaacacccggtatcttccatacaaaatcaagaacggacaagaaatgaacaaccaaataaacatggtaaaaaataccagaagacaagaaacacatggtaaacaacaaccgatcaattcaaagaaactactccgtaaaccatacactgttgtccaggaatcagatagaatttatcattttaatttagttctgctggtgtagctcaactatagtgtcagcattacattaggcacaaataatgttcagataatatctactttatccactgatctagctcaactgtggtgtcagcattgcattagtcacagattacctaggtaaaactgctaattacaagtgaaatattggtgccatgatggtcattgtcacactaagcattttattagaagcaaatcgttcctgcaaaatgaagaattatctgcaacacaccttgcaaaaattcagagcaaatctacaagtaatattgcgaataatcaaaagatcaaaagctactgccacatgaacaattcaagatcaaaccttaatcaccacccactaaaaccttattaaaccaacatcaattcatcatcatcatcatcatcatcatcttgaacgtgatcagcatcatctaaacccaatatgctaaacctccaacgagccgccggacttggcagtgccgcagtgtgagtactaccctgaccaaaatctcagtacgccagcttcttgctgggctccggcgatggcgagccggcggcgctgcccagtggtggcaaatcgcaaagaacgccacccgccactacactactctacagcttcggaggagaggatgcgtcggccagatacccctagtagccggagagcggcggcgggatgcggtggccggcgacttcgccggcggcggtgggcgcaggctcgcgaagagacgggagggaggtgagagaaggtgtgggaagaggggaaagagaagggtgtgctcaccggcggggggaagcaggatgccggcgccgctgcccgtgggaaggggaagccgcgacaggggtggtggggaagagcaccgccgtccccgccgtcggccctgccacgacgctcgggatcgggatggggcaccgccgccgtcacgcgtagaagggaaggggaatgaatcagtgaagaggaagggcaaaagggtaaattcacgtcaaccttaatctcgccgaagctgtcggaaacgacaaacaaaacgaaacggagggagtatataaatgtgggcaatactagaaagttttataacctgaaacggaggtagtataaattaagcaaacttctaaaacgaaatttacgcagttaattatactaccaaaaacgccaccgaaaagacaaagcaatgaaaaaacttaagaaacaaatacctcaagaagctaagtatccttggacgtcaccaatgcattttttccagaggaggtaattaataacagttcaagcacataagtattagacagtagtgcattccaagccacaaggcgaattgtggattcaacactccgatgcaagtaattaatgtctccaaatgggaacagctagctgcaaattgctcaataaggctatcgacaaaaagtagtatagctttcatgaatgttgtcttgaaatctgagaaaaatatcgtaatatttttaacataaagcaagcatattatcaaaatatattaaattatagttttaatgaaactaatttggtattatatatagatgttgctaaatttttctataaatttagtcaaactaaaaaagtttgacaaaaaaaagtcaaagctagttataatatgaaacggaggaggtagagcttatatattcttacatgggcctggtttagtttccaacttttccatcacatcaaaactttcttacacacataaacttccaactttttcatcacatcgttccaatttcaatcaaacttttaatttttgcgtgaactaaacacacccataattatacgtgacaggggtatgaaaagctagctatgtgataaaatgtacggtgatggaacatgtatatatgagttctcgtaggcctgtttagatcccacctcaaaattttacaccctatcatatcgaacatttaaacacatacatgaagtattaaatatagggtaaaaaaataactaattgaatagattgcgactaatttgcgagatgaatcttttaagcctaatttctcaatgatttgacaatgtgatgctatattaaacatttgctaatgacagattaattaggcttaataaattcgtctcgcagtttacggattctgtaattagttttttttattagtgcccgaacacctcatgtgacaccccacataatatccgatgtgacacgctaaaattttacacccctgaatctaaaacacactctaaataaataaaaaaggacccccacgaaaccaaacatcgatagtcaagattggaagcaatacagtgaagtattactccctatgtcccaaattataaggcatatatttttttacacggtcttcaatgatatactttgaccattaatttattccatattatgttactaacgaatatgaaattagcattacatgaaagtactttaaaatatgaatctagtgatataacatgcataatacttagcatatatatggttagtgtgattgttagtcaaaagttatcgggtttaatttttcttaaaaagagagcgccctatattttgggatgaagggagtatttcatttcctcgggataaacgagaaaaatccacgaggccccctttccattgatctgcgggcgaatttcccaggtcttctggtaaaaaaaaattcccaggtcttgtactaatgaattctgaaagttacgcttacgcacattgactaatgaatactctctctctctctctctgcgtagttgtcttctccttatgggaagctttagaattagcagtttctaccgcacgttttttttcagactatttaacagtacgttttgtgcaaaaaatttatatataaaagttgctttaaaatacaaatatattcattttcaagtttataataattaaaactaattaattatttactactacatccgtcctatataaattgcacttctatctaatttaggacaaaatagtaggattgaaaaatgactataataatcatatttaatgaacacaaaagatgcacacattctatatatataaaattgattaaaggaagtttgagacaattaaggaaacatttttagattaaaaggaagattgtggaatgaaatgttaggagactatatgaaacatatttagattaatcaatttgctaggtcttacgtgattagaattatagttttttgagacaaagcctgagagcatagttgcagtttatatgggacggaggtaataataggtttcacgttttacgtacgataacttactctttattttcatcggtttcaaacaccacattactagtgccaatgcatgctagctgcttctttttttaaaaaaaaaacaactacatgctgcttttctgcgtgtgtttccttgctctgtgtgtcggtggttcatggcagctgacagccggcaaggcttagctaagacgcgcctgtctcctctcctctcctggcgatggcggcatcatcttcaaaccgcccgtatttgagtccgaggcatcatcttcgtctctccttctatctcctaccttcacaagtccagatcactcgtggtttctgacttttttttgttgactccgttcccaacttgttcgtggcttcgtgctcgatcgtactacgtgtcccctctcagcctcttgtgctcttcaattagtttaaaggaaagaaaaaaaaagggttattctccgtgtcaaattgactgctgttttttttttctttcttaacgaacaaattatattgtctgactgacagagaacgtgccgaaaagatcgaccgacgacctaattattgcaagtgtttgttctagaacagccaaactatgttctttttccctctgaaatgcatggctaactggtaaactaaagacaagtgcggtgcggcaatggcgctgctctgctatagttgttcatgctcaaggatactataatcttcctaattgtccatttgaccctgatgacgtgcatttatccggtttgagtccaactcgcgatcaaaacaaatggtggtccctgatagcggtcggtctcgcttgaaatagttcttttcacgcagtatcagacgagaagaacagaacaagtcatgtgtgctcacatttcttaatctcatgataaatgtaaaattaaggatgtttttcttcttggcacagcacacgtacgtaaactcatgtctcatcaagatgatcaggggcggtcctggcggagataagtgtggggcaactaactatagaaataactatagatgccgattgggaaacccttatatgtgccggttttctcaatcgacatctattggtcggcacttttgtgattagaaaaaaagggctcgatgcatcggctcgaaattaagccgatgcaccgagccaactctccatcatcatcatcatcgtcacaaatcaacatcatcccatcaactaaacacaatcaatatcatccaaacacaatcgcaaaaaatgtccaaacacaatcacaaaaagattacaatcacggtaatcccacggcctcccatcgtcgcgtcgtggcggagaggaggccgcacccaccgtggcggagaggacagtgataaccgaagatctaggttgccccccaagtatttaatgggacgacgttggtttgtaagggtctgtttggttgctacccgaaaaagttgtgcttctggatgtacggatttaggatttatttgactcttccattgcgttctctcttttttttttcatgctttttctttcaagatttcaatcctcgtaatgtacgcaagatttgtgcttgtgcatgggaggttagagtaatagatggatcttagttggatcttgtgccaacgtcccattaatacttcatttagttgtataatgatcaaaggcataattgcgggcttaattattcactttatagccaattttatctttttaaaatttggcattgccaaaattttagcaaattagcaacattagtaagttttgataaaattggctaaatatgagatatgaccaatatttaataacaaactaaacgccaccatatatttatcaatttaccaaacaataatatggtttaaaatattgtttaaaatggtattaatctgaacagacggccatgcatatttgttgctcaggcagcaataaccaaccaaacaagcacatactcaggctgcctgaccaggctagatgcattgtcttctcatatgccactcaggcacacagaaatttcaggcatgttgctcagggtagcaagcaaacaactcgtaaagctccagggcaaacagctcgtaaagctccagggcagactggcagtgacagccggagatacatgcggcaagtgataacggcaatttatttcttttcttttgcaaagaaacaggtatagtgctggcacgtatccatgctttgatagttctacgtaacttgcatcacataactcgttcctctcatgaataaacttgtacagaaaaacgtatgatgcattctgctaccgatgtatgcaagttagcatgtataattctttttagataatgagttagcatgtatatacaaacagaatgaaatgagatgggcatgctaacagataaacaccatgaataaatgtcttctttcaagaacacaagagagggagaaaatgttggatactggagcataaggttggagttagcatctctgtaacaccagtctgtttcattgtcctttaaaatgtaacccacaagccacaaccgggagcactcctacacacactgatgttttcctttggttggtttgtaatgcaaagtaaactcgaacaatgcaactattctctagccatttgtcattgacacatgttactatttacaatcaccaaaaaaattgctccttctctgagtgcatgtgaaatgcttttggggccatttatctatcaattgatgtcttcagtctccgaacctcagctaaaagagaagaattcatctcacaagcatccttcatgatttcaaatcgtcggctaacttcatcattacgttgtgaatcttgcgcaatgccttgtagaacaaaacccttgagcatatcctgcggtatagaattttccaaacatcaaggatggttcatgatttatgaaatatatgactaatattccggaaagcacgagggaattacctcgtgatggcgcttctggccatagcaccggataagcgatttaaccagcttattccgcactttgccagaaccgctgcactggaagacgaagccagaaaggtgatgccttgctactgtgaaagacattgcatcccgctgaaaagctttgtcaagggcaccagaagtccatgatttagcataagactccaaaattccttcgtcatcctacaaaattattgtgaaaataataatcagaaaatctgaaactgttttatcacacagatgcaacaaagtacaagcaggtgggaacatgcttacaaagaatcatggcatgtgctcatgtatgtaccgaaatcaaatagttaagaaaaatagcatgcattgtttactctttgcatactctatgtaatgtgcaaccccaaaagcagtagtataaagcaaacttctagacccaaatttacattgttactacaaaatgccaaccaaaagacaagcatacaagaaactaaagagacaatacctcaagaggctccaagtacccttgaacatcaccgacgcatttgtctagtggaggtaacagttcaagcacataagcattagacagagcgttccaggccgcaagccgaattgtgggttcaacactccggtgcaaataaatggctacttgtcgaccaaaaagagcatcaccatatgagacagctgcaaattgctcaataaggctctcaacaaaagtagtatagtttgcatggattttctcctgaaatctgagaacttcagtcctggtcaccttttcttcgtccacagaggctgatccttctttcttgacagagtgagcactgtcatatttctggcataatctatccaaatgcaggccatacagttcttgcaaagcatgaaaaatatccctacttctgtcttctagaagcaaatccatgctactgcggatagaggcagaaagtgcatgcatcttccaaaccaaaggagcatgaagacatggagccgctgaaatggcttccagacctaaaagaaagaagagaccagcttttgaaacatcaacagcataactggttgataggttggcttttggatcatcaatgcaacagactgcacttagaatccagtgcacaggaaggggcaatctctggtgtgcccactctacagctaacacactgcaaggtggatttacagcttctgctaactctgtttcttcttgaatcgtctccaatgtctctggtatttttggcacatttgtgccattgttatttcttgtaaattcatctgaatgcttcttcttgatgaccaaccatctggatctgaaatgtgaattcagtacactgctaaaatggagatactcatcttcagttatgtcccattcaaaagcttttgctaatttcatgtgtgagtctagtactgaagatttgagaaacttcagaacagaagggtggaagaggatatcaaaggctttctctagtgtagatatctgcccaggtcctgccatcaaagatacactgaggacagaactgattctctctgaagtgatggcaactgaatcagtcacattatttccttcttgcacaattggattcacacttttattgacggtgacaaggccttctggccccgtggacaagattttcatcaattctagaacaaaatgtgaatccaattgtgcaagaaggaaattcaaagaccaaaatcctccaccatatgctccccaaccaaaaccaacaccaggtgctggtcctcctctaccaaacatctctatgttttgtaatatggaccactgtgaggaaatcattggcaacaatgaagttagcatgtccaacaagttattacgccagaaattgcaaataccttgttctagtatcctgccagctatccctgtttttgattctttcagatgctctgtacaatttgttgtggcgttctggattactctgtcaatagagcaagatagctgcaataacctttggaagcaactaattgaacacaatgatgtgtcaacattaccctgggatctcaaatgaaaaagtccctgcaccaacgatgaaccatggaaagatgtatgttgctcaagttcaacggcattatcatccaagaagttgaaaaatccattagtaataactcccaggccaattttgggtacaaagtcaggtatccaaggcaagcagtaacttttaccatcatgtgtactatctggagatatcctttctagtattgaatcaagcatgcctagcacagaagaaataaccaaagcaaagtagcttccctctagtatattcttactttgcccactgattagcaaacacacataaggaatatcattcaggcatagccaagatagcgccaaatctaccattggaactgcatggctccacgaccatgtctcaacttggataccagaaagtcccatgtcttgcttgttaagctgctcaactgaatgaagaagtggaagcctttgagccagagctcctaatacaagataactctctgttgcaatggaaataaattcagctacaacatgctttcacttagcttctgaaacatcgaagggctaagccacaggcataaaataggaaagaaatctgtgaaatgcgttatacaaaacccgtaagagatacaggtcctccaaaaccgcagctgctcaaccattaatgctgaagtaagcttgcagtgctcctttccagatcttatccaatcctcaagagtataggcttttctgtaccagtgccacatagcctgatgaaaaactccagtgttcacaaaattgaagcatgtttgcctgttgtacttggacaaaacctaggcaaaaggaacaagaaattagatgctagtgaaaaaaaaatctttgacaaatttagaaatagaagtaatgattttttttagcataatctgaacattcaaatcttatgactatggtgtttctcatcttaccataataatgaattaatggggcaactaaagtgcccgcaggagggggggggaccaaacagttgtgtgttgacagtgaaggcattgtgcaaggagtgtgattgattcagataacagcaggcatggctaatacaattgctatgtgttaagatatcagaagcagcaaacaaaaaaaaaactcataatgatgctgttggtagctaattaccaacaaaaggaaaccatttcagatgtacaatcagcaattgcaagtggtattactggcagacttgatctagttatccttcagaaggaatccttctgaaggataactagatcaagttattatcaaccaatgatatagaagaaaaactatataataaataatctgcaacttccaaaactacacaaaatcagcatactcctataataaaagattatttatatcaccagaagataccttcaagagattgactcctttaatttgcgaggagtgaatttccattgatccttgcttgactaacaacttaacaacactttgaacgagccttgggcagttcaagatagcatcagcagattgtggagagtgtctcgctaatcccaaaagaattgaaacaagattatcttctagaattggatgtgggtccatctgaatcaacaaaaacttgaccattaagatccgtaatcatgaccatcactttctcgtagaataggaaatgaaaacataaataaaaagaagaccaactagctcaaatgatgtttactagtgaagtaatagaactgcaatataaagctatcactataaaacaaacagtcaacaagcaagagcaccaagggtgaacagaacaatctacgagacagtccaataaccagataagaagtttgaaagattacgggtatcagatgacatgacatcatagaactacaaaatacttaaaactgcaaatggataaggcccatagcttcaggaaataaaaaatattgctaaaaatgaaaggctatacacaatttatcatagtttggttgttgaatatcaaaattgtaattttccgatggtaaaagaacaatcaaagccagccacaaattctgctgcaaaccagatttcctggtgaaaacaagtgatgtgtcaaccaggtaaggaggcatttcactgccatttcaaggatggatggcaagtactagacaggattgaacatcaaggaaccagacaattcacggatatagtaaacaaaagatgacctaatgcacccatattgtgcatgcatggcggtgggattctgggtgcatgcatggcagtgggattctgaaagaaacaatggcagataggggatgagggagagcagatggccagaccctcacctccaaaaggaagcagatccgtggaagtattcccattctaacaagaccagcagcaacatcttgacctgatacaaccacatcatcttgaatggtatgtttctcatcaccttcttcctcatcattctcaccataatgtgggagtatattggatggttttgtgttgtatttccagaaacctccttcaagaaaacccccattctgatcaggtttgctacggaaaacaggagctgtacagatatccttcccttgatctactactttctgtaatgttgaaaatcagccatttaaggataaagttctcaacgaaaaacaaattagaagataaattagtaaagttacctctaaaacatcgaaatacatctcattcatttcatagctcagcatagcattgataactttagcacaagtcaaaactacagaatcatggttatcatccaatgacatcctgcagatattccagttagtgatgacacataagtagaataaacaatgaaaaaagcataggccattttaaggtctaacactggtgcaattaactcatataagcaaagaaactaattagatggcatatgagagaactaaataaaaaaaacctatagacaacagttaattaggtcacaccgcagttttctgagattataacttattagggaaaattccatctatagcacaaagttttcactggtacctaataataccatggatttttccaccctttcagaaataccacaactcagaacagaacaaggcggggatggacagtgccattttacaaagaaaatgcccagattaccacgaaggcaatggattatttggcttgattcgcagcaaatcctgccaaaacgaggtgttttctgtggccaagagaataacacaaggaggaaatggatttaggcgttcggatttggggacatatgattcggatgcatgtgtggatgttgcaatggccgccggcaataagagcatcatggagacctgtgagaccaagtgattggatcacgctagagcaggtcagaggcatggccatggttgccagaccttcatcggttacgggaggagtgcggaagacttcacctcgagagccaacgcctcagcggcctcggcgctggcggcctccgcggctggcggcggtcgctagtcctcgaggacggattgtaggtaggaccgtgcttcattgccggaattcgtggccaccagcttcacttcatctcgccgagagagagagagagagagagagagagagagagagagagagaggagacgagtggaatcacggggagactactgaatgcagattgaagaaaggccaggggcaattttgtccatggtaatagttcaatttgtcatacgttcagttctgtaaaattttgtggtattttttacgtgtggtgtcacattgtggcatttctggaagggttgaaaattgtggtatttattagtacctatgaaaactttgtgctatagatggaattttcctaacttattatacatgaaacagccaacgtgactgcaaaaagaaagacaataagggcatgtctagtgcacaccttgaccgatgctagcaagcggatttgaaggcttagtaatgattctaggcactagaagaggagatgctaggaacaaaatcgatgcatatatggtttgatgcgaagcaaaatgttttatttgcatacactaggaaagccagtttttaaaatttctagtggagtccactcaaaaactaaaatcgatgctagcacactagagaagaaaaattatccaccctgtgtatcacatggctgtgatgtgacaaccttagcttcacctacactagacatggcctaagttaactggatacatcttcttacaagtgctaactgatagctaatggacaagatgaccttatgctgttaatgcttgcctgctgtcatgaattcatgactaaaatacaagatgtggcagcccaaattttcaggcatacaattttaagcataggtgcagacactaaagcatgtgttaaggtttcttgattatttagtcttaatagaattgtccggtatatttcagttaagtactcttcactttggtaactaataaactcttgcatggaataagcaaatccaaattaaaattattattatagtttgaaaacaaccagtttaccttagagagagaaccaactcaggttcaggtccgatggcatatgcccaaaccgcttgccagtcattaaacttgtcatcatcatttgattctttaaagttatcaattagatccgtcttatgtaggttctgcaaggccctattaagaatcaaagcaaggagctgaagcgcaagcacgcgctgtccaggaacctatggtttgaacgtaaaaactgaattattacatttatttatcttgcaatattttggaggcacactttagaaatgatgtaagaaaaacattaagcgatgatggtgtatctcagttatgcatgatatgacatttaaaaaaaaaaacaacaaaatccattcacatgcaaaggttaatatctctaaaaatactaaagagaaactagatgttgtattgcattgggtaaagtccatttttagcccttgaactttactcaaaagtccattttcacactgaacaacaaaagaaagtaacaaaccatgctcctgctaagtgccactgcttcattaattgtgtacccaacagctgcgggatctccctctgttcgaagaaaatcacgctcacctacagtttccacatgtgctttcttgcctgtaagtgggaaagccaggttgacatgtaacgggtaccagaacactagaagctaaaagcaacacaagagcaaagaaaaatgatttaccatgttgttgctcctgacaagattgaaaccccaaaatatctccttccaatgtgaacctacaagacctgatccgctctactctctcactccatgccttccaagtgtgtccactatgctcaccagctgacaaccattctccaggcatagccttcgagatcttccctgggcctgaaatccccccacccttgccctttcccccatctttcctgctcccagacttctccttcccccgtcgtttcagcatctccacaaatgccgggtccatcctattcaggatctctgcctgtgcctctgcaatctccccagctgacatccctgccagcctagccatgttctccgcattaatctctgcggtaagagatggttccccattatccgattccataccctctcctcgcaattccacattcctcacatcatctctagcatcaacctgtttcatcggcttccttggcgccacatcagacatcaaagcagctccacccaattcttccttaccatttccaacttccagctgcataccaattcccccggagcgcttctcctgtgcggtgccacccgtcgttgcagccacgaccccggtgtcaattttctgcgcagtctgtttcttcggctgcaacggctttgcctgccttcgcttcgggggcgcatcgtcagcgacgaactcccgccacctgctgaaatccatgcccttcttctccttcctcttaacgggcccagctgcggcggccacgggctggtagtccgtctcgtccacatccatcccttcctcctcctcgccctccccctccgccatggcagcatccctcgccgccggtttccagtgctgcggaagagcagatagtcagtcagggagtacaaaaccaaagcaccacatcaaacctagggttccgagatagagggcggcggcggaggaggcgtaggcggcttacggggccgtgggagcggtggcgggcgacggggaaggggaggacggtgggactcggggcggaggagggcgcggcggcggccgcgccggaggagaagcccttctcgacgatggcgccgacgaggcgggaggaaggcggcgccacggcggcggccgggggaggggaggggtcgaagggctcctccacgaccttgcggcgcgcggggtgggcggcgcctggctgctgctgctgctgctgccgccgcctccgctccgccgcgtcgtccatcgcggtggtggggttttggttaggggagctcgctgtcgccgcgtggcgacgaggaagggaaggattaggagaggagtagggtttaaggggaggaggcaggagggggatggtttggtgcttttgccgatcaccaagtcggctgtcgcgccgccaccgctgtgttttggctgaaagcgtgaaggcgaggtcgaaccgtcaaacaggaaacccctttgaaacagattatttcctaacaattcctttgaaatttgcatcgaatggaccttcctagagcaattttagagaaaaataagtgtgaggtctcacctcatgttttcctcgtatgtctaagattcctacgattttcctgtgtgataatcaaacgctagtttggagattttaatgtgtttaaaatctcataggaatccaataagtgtggcattctgtttctacgtttttcctatttctctgttttctcaatcctgcaatttaaaggggcccttgggctgcgctcggcagccaaggttgtcgactaatcacttatatgcacggaaacagccgtatattagcgtgtgattagttaagtattacttcctccattttatattataagactttctaacattgcccatatttatatgtcattaattgtgggcaatgctagaaagtcttatataattgttaacaatgaaattcggtaagcccctgagagaattatcacgtcgccaatagtcggattcctactatattcggttatgaaaattaatctgttaaagaaagcttatctagaagtgaccgagtttaagaaggatgcggcatgacagtttatctattaattaggcaacatttgttagttttcttttatatttaggaaagcgtgtttagtgtcctataagaactttatgttttccttttatctatttatgttttccttaggaaagtttctttcttgtcctataaggactagtatcttcccatgggtataaatatgtacacccttgtgttaacgaccaaatttggtaagatatgaactaggttcggcattggaaacagagtggattcggcaaagaaatagattcgaagaacagagtatgcatcagctgcgaaggaatcggctggagtctgcatcggctgagatggatcggacagaggacagccgatatagccgattttgttgaagacagttgtaaaattgtttctagaatcaatcaacgtactacacaaggattgccacgatgcgagataagctctcagatagataattgtacctattaattaggatattttaaatagtttcgttagagatatgtttaggcaaaagtctgtcgtaaagacttatgtgtatcttagagatttagagataagagtcgtgtccaccaaggacatatcatgtatctcgggtataaatatgacccgaacccatgtaattaacaacaacagttcaataacactttcggcgcatcgccatccttttactttcgttctatttcgatgagttcttactttcgggttgagctgcatcggtttcgatcttcaactagaggtaaacttgtcatggcggtttgcattctcgggattagtgcttccatctttatgacaccctaatcttgtttatgtaattcgtcgagttatcatatatacttcataatctttattagttgctctatgtaacttgtaatcagctggtttttactgttagaaagtagccgatagagttagatttcgttattaatctagattatattgtgtatctaccatctcttagagattttcattatcttgtttagatcttacagttatctttatacttaatgctgcatcggttgagttcgatctattaagttatatctataattgtgatatctagcctgtttcatgatcatcagtagagatagtgtcggagtttcagccgatcttatctgatttagttatttttatctcatatgcttaattgttatgctaaatatgccctttatattaagatcttattgcattagagtatattatgcttcttgtttgatatattttgcttgttttaatatcttagtataaagtggtgtcggagtattagctgatacatgctagttctatctgaccagctatgctataaacgcctatataatcattgctttaatgtatttttcgacttaagtgatttatactgtctcggcatggcgaccaatctatcccaatcacttagtttaaacatacgtcgaaggaaagattatatgtcgttaatatctacagccgaccaagtagatttagtcttatcttattcattcattactgccgatcgattccaacatgacatcggctcgaagataaatgatatatcatcggcaactagccgatcggttatcgtttatggatttaacctcattttcttgtcttttattcttgttgattgcaggatcaaatcaactggcacgctcatgaacctaaaagcaagattttggacctgcacaggagttaagcagatcttccaggccagtgtgtgtttttcgcatcaacaccggggtcattgtaaacaatctccacaatcaatacaattcggcgcatcgccaccttttaccttttctactttattttattgtccaacgggacttggcacctgacgcggggctccatcggtgttcgatctccggcgaaggggtaagtccaatgttccgccggcccaggcaattgtctcatctacgtcggcgttgttcaaggctgcatcagtacattcgacctcttggattgctctggtttggatgatatatttgcctacctatttatcatatgtgttagttaatctagtcttagtatcttaatttagctctatcggttgtctctcgctttagggtttctgccggtatcagctaaattgttttactaaattagattagctaaggcatctaccaccttaaagattagtcaagggcttgattgcctagatattacgtttcttttcatacttagtgctgcatcagttaagtttgatctactaagttgtgcttagaactataatctctagcctgcttcttgactgccaataagggtttcatcggggtttcagccgatgaggtatctggacgttgcatcggtttacaaggattgcatacatattggatttagccgatgacaataaaggttttcagtgttttatctactcttatggattttatggcattggacctccagccgatgtatgctttaaccttcggatcaatactcattctatcatatcattgttagccgagccgattggtttctactagattatattattgttatattgtattatcatcagctgattgcctttatattggtatttatatcaagtgtcagaatatacattggatatatatccggtagctccgaatcctatcactatcggctggtatcggcatcggctggaattactccatcggcttgtcagccgatcgactatttgatctgctatttctatatcttgtcaattgaggatcaaactgactggcacacccgcatctcatcaacctttggacctgcactggagctaagcggatctcctaggccagtgtgtgtttttcgcgtcaacacatctttggcacgcctggtgggacacgagttttgcacccaacatgtctaagaggaagtcaatgccaagaaggaacaatctcctaagtcgatggttgaaacatttcaagctacagtagatgaagcagttcatcgtgccttgttcgatcaatcagaagttttggcggatacattgtaaaatttgatcaaaaggacagttgatgagttaattatgtgtgtgtgtgtgggggggggggggggcgagcggtgaagtacgcacgtcgcggaggcaaagcagctcgcgcgccaccacagcccacgtaggttgtccccacacacttcgctagcaccatgtcctccctgagtgtcgttgaagatgggttgcgcccacatactccgccaacatagcgtccttcccggataaatgggtggagcactcctacgtgtgagatgagggtcgtgccgtcagacgaaggtcccatggatctacactgccaagaacgcttgtgcctccttggcgaagcgatggagttgtccggtcatgcggtcatggagaaaagacacgaccttgacgtcgggactccttgagtgtgacaaagagtccctagcagaggaggcaaatcggtcgtgccctagtcggtattgtgatttgggagaagattggaagacattggagctaggatgggagtcttggatacacaaacacgagttgggaagatgcaagataggtcttgcggtaggcaagagatgttttggctcctatcttaatcaggacggtagttttggaataaagatatcggacgtgatttaatcagaataggacaaaggaaaaaaaatcatgatgggacaaaatgccttataatctgtaatagagggaatactgttatattattattttattacatcatcatcaaccgattgtctttatatcattatttacatcaagtgtcatattctacattaaacatatagccgatagctcaaaatcctattgctatcggctggtatcggcatcggctggaattactccatcggcttatcagccgatcggctcattgatctgctatttgtatatcttgtcagttgcaggatcaaactggctagcacgctcgtatctcatgaacctttggacttgcactggagctaagcagatctctcaggccgttgtgttcgtcgacttagttcgcgccaatacagttctagcaccatcagccaagcgcggatttttcatcaacagtaagcacggggatccccaaaccctccccaacgacagttttatatcaggccttattttcacatagtgactatgttgaggatgaagctcatgttgttgtacatgataaaactagaaatgcctatttgataccgcaatttccttgtttacatgttgactccaccaataaacaacaactatttgtactttgtagtaaaattgattagttgcgcaataattatggcaataatccaaaatctgagaaaaggcatcacacctaaacatgtgtttgagctcccataaagaaagattatttcaaccactgtcaatgctgttgtaagtattgattgctgattcattgtatatgactttgacacccttctcaatgttagcggctggtcgaagaaagagacaagacggactatagcaatggaagaaaatatatagttcttttggccgcactctattattataaggaagaagcagattggctcgaacacttttgctaatttggtaattcggtgtcacactgctactagctaatatcacggcactttctatatgatgatgagaaaatgttgtgatattttatttatcttgatgatttattgaatgcattgaaccaaaatgataaattgatgtgcctcaatctagttcttaatgcaagtatgctattaaatatatcctaatgatcaggcaatatattcaaagccacaaactattttcctacaatcattcctggtgaacaatgcacaattggacaaatgagtgaaaactagacaagccatatgccatgactcatggctaatttccaatcactaattatagccagagatttataacacaacaaatatagtggcatatgacatatatttttatctcccacaaatcacatcattatat

SEQ ID NO: 66881 - DNA, 671 bp, Oryza sativa
cctgcagcccgatgtagggctattatccaacctggaggcctgaaccagtataaaatccttgtgtctttcgcctttttacttatgtgaatgataaatcgtggaaaaaccctaaggcaaacgcctgatcagcgaaagcaccggggggcgaaagaaatcggccgaagcatcgctcaccgaacgttgaaaccgcgacagcttgtttcgggaaataagtaaccgaacaccgcaatactcgagttatgtgaaaacacaagcgcttcttttagcgcggaataccacagatcgaaagcggaagtcgaaagctaaaaagtcagcagacctatttcgctaatatacgcaagggggccgacatgtttcgacctacgaaagcacgaaaggtgactatgcgaacaatagcgaaaaggaaatgaaacacatctttattaacttcaaaaaatatcaaagaatacatgccatacaacatgctataggtgaaagaaagtaacgggctttacagcctagcttacaagaaaattatatcttcgcccccaaaacaccctccactcccaaaggtgtgatttggcgaacttggttcgtcatcactactaatattatacactaccctaagaggagaagggggcgaaacacaaactaagccatagtggcgctgggcgatcgcttcctagcgatca

SEQ ID NO: 66882 - DNA, 8403 bp, Oryza sativa
aagacaggacaccaagacatcggtgtcaaccatgtttccggcgtggaactctgggcttcgcaggaccaatcccaaagcaaactatggcgaccacctgcaacttcaccaccagcacaaagagaggagcgctgggaggagggggagaagggacggtctccccaacagcttgtgccgagaggcagcatagataggaagagaaagaagaggaggtagagagaaaggaagggaggaagggtggtcagaggggtcaggggtgcttgaggggggcagcgagccgatgcacacccctagcaggtcgatgcaccgccgacccagagccggttaccgccgcccgccatctcacgagcggcctcgcgccatgacatgccgccaacccgtcgcactggcgcctcgcgagcgccggccgaaccgcctccgcaacgcacttcccgacactgccgttgtagatccggcagcggaggggccggatctgctgctgcccaacctgaaggcctcgccacagccggcgaaccgcgcatcccctgcactgagaagcggcgccgccgcaagaaggccccttctgtcatgtttttgaaggagttctgttatgcatctgtattacatagtctgaaacaaagcacacttgtaaagttgttaggctaatgccgttccacgctcagcaacaagattcttgtctaaaccataattagatcgccctggaaacaatgaaatctatgtactaaactaccaatctcaaaaaaatagaatgatattcatgtactaaaatcgatcaggacaaagaatgaaatcaatgtacaacaagttgttggggaaatccgtcgtgtgttgcactgtatagctaattcttttaaagcaaaacagccattcaatagatgctgttgtaaacactcattttgatttgaaaagcacagtaaatgaaaaaaaatggatggtcgactgttgcaatgttgcaacgctcttgttatgtcttctataaattaacttcattgcatcctatatattctctgtgtgcaataccagatcaatgcaatagtcatgtgttaactttcttttcatctcttcttttttcttttgcggagagtcatgcattagctaactgtttggatgtactctactcatgcacaaggaagcgtttgttccgttgttgaacagagagagagtccgggatacacattgtgaagtcactgggctcatgcacttgcacgcttaaaaaaggtggatagaacactatttggatcaccaaaaaaaattataaggcgcaaacctacaagatacttatgcattgtgatagtaataccagcaaaaaagtaattcatatcaatgagatgaaaatctcattcaaaatgcatgttggaaatggtagcgttaccgttatggcactgcaacacagggcagcattatatatacaccccaattagggaaggatgtgacgcatctacaacaaactgtatatagctgctaatgtgaacattcattatttatggatcatatttggtaatatgatccatgtgaaaacaccatgagatattatttatggaacatataaaaacgctacattggagttcaccaaattagatcatagtgtttttatcatatccgagatatcgatatgatatacttagtaagaacgatgttggacagacacaagcatatatcacgacattccttgatcatgttaagtggttgtgtaattctcgaaaatgagatcatgctgattgcagaggagctccgtcaacggaataattaactatttgccactcttacaagtggttctaaaggatttactattgaacccacatatcatagacatgagaacccacacatcatagacaacaagtgacaaattctaaattaccatatcttaaaagtggtatataaggtggtatatagtttaaatgtccctccatcaagagacgcacaccacaatagtgaaatatgtgaccgggtctttaccgaagtctttgtggacatcacttagcttgtttgaggacgtcacatagatcatcatagacggccagcctttactggaagcggacctcactttccgcatgacacagcagcgccgacaaggcctttgcatactcttaaaaaagaaaagactttaatatgttttactttctaaatttatttcttgtttcttttattccttaattgtgaggaatggagtctaaataggttgtaatgtttgcctgtgcatatccatgtatggatatagaaaccggatttttatctattataaaaaaatactccatccctagctttcgtatttatttctggtaacttttttttctattttctgctcttacttcctttctttcctcctcccttgcatgtgtcttcattcgtcatcttttattgctgtgttttgtttgtctcaactcaaaccaaatacaccctccgtttcaaaatatgtgacgccgttgattttttaaaatatgtttgaccattcatcttattcaaaaaatttaagtaattactaattatttttatatcatttgattcattgttaaatgtacctatatttatacatataattttacatatttcacaaaagtttttgaataggcaaaatttgctacaagacattcaaaaaacgtgtaattcgctagaggacatcgaaagaatgtgtatttgctgtagggcatcataaaaaactggtaattagctcctggacacccactgcattactttattatttctagaggaataggagagagaaacgatcattaaagacaaatttgcccttagctcaaatgaatccacgtgggcccacatgtaagcccctctctctcccggcacagcgccgcgtcggccagccagaacatgccggcggtggcaggctcttcgccgtgcaatcatgtctcgcgtcgcgtcgtcgtgcagcgaggcgtcgacggccgaggggaactccatgccgtacgaccaccagtccatgcctgcgccgtgcccaccgccgcgcgccacctccggcgccacatactcgtgtgtgccgacgaacgagctcgaccgtgcgtgcactggttctgcccgcgatgcccatcatgtgcagatactcgagcgcgaggagcacctcagtggcgtagaacctggcgaacgggattgggaatcgacgaccgggcatgctttggcgttgtgagtgagggagtagatctggccggcgtcgaagtcgtcgaacatggcgagcatgaaagggtggtcgagccaacgcaggatgcgcttctccgcggcggcgtggcccagcttgcccttcttggagagcgcgcggcagtccaccaccttcatggcgtactcgcacgaggacgatgagccgacgcattctccttcagacgatgtccctggcgccgacgtggtggatgagggtgaagtcccgcgggcgtagcggcgacgaggatgggcgcccaagcgaggtcggccgcgtggtgcgggcgtggtagggaagaggtgggtgtggccatgtcaagtgagaacatggaggagctgaaagcgacacccactgacccaccgtgctactgctgccgctggcctgctgctacttatgcttgagctgggcatggaggcagcgtgtatgtgcatgtcgtggtaggcctgcgcgcgacagcgcagtgccgcaccaggcccgcgcctcgccgcaccgtagctgatgctctccctctccctcgggcttgcttggagaaaagagcagagagagagagaatgagagagaaaagaacaaggaagaaggagcagggaaggatagagaaaaacaaaaagaaaaaaattcgaagggtagaaccgtacttacacagtttttctctctccaatttctccggatataataaaataatcccgtgggtgtccagcagctaattaccaatattttgtgatgccctatagcatattcgcgttcttgcagtgtctcccagctaattatacgttttttggatgtcctgtagcaaattttgccttttgaataagacgaacagtcaaacatttgctaaaaagtcaacggtgtcaaatatttagaaatagagggagttttacgtagtacacaccaaccgatcgtgccctagccacactcgtactcattgaaatcatactgaaagcacatcaacgtgtgcataatatttatgagcactatgattgagtcatgcacacatgattttaccatcacactgcgtttctctaagttgaaatgaaagttcaagttgaaaaaagaatgggcttagagaagagttttgaaggctaaaaatgaaagagttttgccattggctaggctaaaaaaaaataggttcaaaccacaacgaagctcaccagaaggttagaagagaaggtgtgctagtatgacaggagcatcgcttcagtatccatgtaataaaagataaaaattcagttattgacagcaagagatgataatattacgtatgatcagagaagtgtggattgacgtggtctgaactcatcttccgggtgcacgaacacgtactattcgaagcatctctagaattagaaagcagaaattgcaggtgtatttatcatcactggcaaacaaaaacctacagtacatagtagaaaactcaaatcaacgtatcggatggatgatggatggtcttgttgcatttttcctgtgtccacacttcgcagttcacacaaataatttcggtcgcgtgcaaagcaatagtagtaaccaataatgaaccaactaagggacaatttgaaccatgccacacaaattttgcaaaatttgtgatatgccacctgacccacatgtcattgactcatgtgggtcctacatgtcattgagatacgggtggcatatctcaaattttgtaaatatagggtggcatggttctaacaaacccactaactaattcatagttttgatcgtttggccaacgggtgatagcctgtaaaatggcttattagaaacaaattatttatgaataaactttttatattttatctttaacgatttaaaagtatgctgaaaaataaactacgaaaaaaaaatctcgaaatcaactacaaagttcaaattttggctatggctcatgagccaaaattcaaaaggctaacgttggcaacttttacatcgagatgtcgacaggatcgatatgaatatcttttcttgaggcttaaaatccaagctacggagtcgccgtgaacttgcgggtgaaaggacgtacaggtgccgacttgatgatccatgtccggcaccatcatttaaggagagcactgtccaatagaagctgtccatatataccatcagacattcagagtttcagacggcacaagttttcattccatatcatcaggagaacttcaggtacaaactgcactttctttgtttccgttcatattttgccaggccggttactgttcatgttcctcagaaagtaacatcatgcatgatctagggcataatgatctcctgttgaacctggtaggctatgcttctatttttgatataagctaccaagtcattatattataatagacaaaaaaaatggcaaaaccaaccagaggttaatcgactggagattctgagttcctgacctgatttttcttatacctgtacaaacagattgaaaatttaattcacgtcttgtttttcctgctttgcttttagaaattcaatttcaacgaagaaaggttcaaggtgtgaccaaattgccacatatatgagaacacgtgaatggcatatttaatgaaacactcattcgttttggacaataccagagcatgtttacttattttaaagagagcggagatcatttttatgattagaaaaataaaatgtaaggatttagctgaataactcttaactagccatggagattatcgacaaaaatagatgcaacctatcatgcataataacaacctattcggcgaacaaccaccgctgttgtacttcttctccaaaccatcataccagttaaaaaatatatttaaacaaatgcatcaccatgtcattgtcctcagtcataatgcacacatgacaagaactgtttacaaaactacaacagggattatttgcacatgtcctcatattttggagggtggaattctcgatttcatgttccaggaggttaagtaggccaaaccactgtatcatgcaggcggttaagtttccaacctttaaactttcaaaagtttagattgatacatgtagatttgcttgagtactttcatagcattataacactaatgagctttataaatagtattttatataaagatcagatatcaaagttttatttgggagaccatgtcaatgtccaaaatggcgtatttctgagttgtgaccgatgggagttttttctggcacacttattattccaagtgaaacttacctgggcatggaattgaagactaattcttttttgtttttagctgccagaaaagtgcttcaaaatgtttactgccctaaaattgcttctcttgccatatctgctcctactggcatcagcttcatgtactcaaggattgcctttcagcaataacactgatctggatgccttgctaggattcaaggcaggtctaagccatcagtcagatgcactggcttcatggaacacaacaacaagctactgtcagtggtctggtgtcatctgcagtcataggcataagcaaagggtattagcactgaatctcacctcgactgggctccatggctacatatccgcttccattgggaatctcacatatttgagaagtctagatcttagttgcaatcaactttatggtgaaatccctttgacgattggttggctgtcgaagttgtcatatctcgacttgtcaaacaattcattccaaggtgaaattcctaggacaattggccagctaccacagttatcctacctgtacctgtcaaacaattcacttcaaggcgagatcactgatgaactaaggaactgcactaaccttgctagcatcaaacttgacttaaacagcctgaacggaaaaatccctgattggtttggaggttttctgaagctcaattccatttcagtagggaagaacatcttcaccgggatcatcccgcaatcacttggcaacctctcggcgctgtcggaacttttcctcaatgagaatcacctcactggaccaatccctgaggcccttggcaagatcagcagtcttgagaggttggcactgcaagtaaatcatctgtcaggcaccatcccaagaacactcctcaacctttcctcgctgatccacattggcctgcaggagaatgagttgcatggaagattgccttctgatttgggcaatggcctaccaaaaatccaatacttcatcgttgccttgaaccatttcacaggaagcatcccaccttcaatagcaaatgcaaccaacatgcgctccatagacctctcttctaacaacttcactggaatcatacctccggagattggaatgctctgcctgaaatacctgatgctgcaaagaaaccagctgaaggcaaccagtgtcaaggactggaggttcatcacgttcttgacaaattgcacaagacttcgtgctgtgacaatacaaaacaacaggcttggtggagcactgccaaactctatcaccaacctatcagcacagctcgaactcctggatatcggatttaacaaaatttcaggtaaaataccagatggtattaacaacttcctcaaactaattaagttgggtctctctaacaatcgtttcagtggtccgatacctgacagcataggaaggcttgaaacactgcagtacttgacactagaaaataacctattgtctgggatcataccatcctcactcggaaacttaacgcaactgcagcaactctctctagataacaatagcttggaggggccattgccagcaagcattgggaacctgcaacaacttatcatcgcaaccttttcaaacaataaacttagagatcaattacctggagatatttttaatcttccatccttgtcgtacattctggatctgtcaaggaatcattttagcggttctcttccatcagcagtaggtggtctcacaaaacttacatacttatacatgtacagtaacaacttttctgggttgctaccaaatagtctcagcaactgtcagagcttgatggaacttcatttggacgataacttctttaatggtaccattcctgtatcagtgagcaaaatgcgaggattagtactgctaaatttgaccaaaaatagccttcttggtgcaattcctcaggacttaagactcatggatggactgaaagagctatatctttcacacaataatctatctgcacaaatcccagagaacatggaaaacatgacatcattatattggcttgacatatcctttaataaccttgatggccaagtcccagcacatggagtgtttgccaatttgacaggatttaagacaggatttaagtttgatgggaatgat

SEQ ID NO: 66883 - DNA, 1885 bp, Oryza sativa
ctgatgagcttatttatatgtctcaactgactttagagaagtgtttaaaggatgagaactgattgagatttgagaaatgaattcaccatttttgttgagttgcataattttttgtatcgctatttaccagaatcataaaccattgaaaagctcatagttgtccctggaggtggcaagtggcaacagaaactgcggaagagttctgctttccatgcccattgggagatgcagacagcattaagaaggaaacaattagacatgtggaaattgttactgttattgttcttttcctgggaatgtggttgggaaaagcttgggataatccaaatgcactctcagttggctggttgaaatcttgccggactagtttctcagcttgattaggttgcatttctgttttacaaacgagccccaatatagcatcatgctcattcttgattgtcagaattgtttcttgcatagttggaatatgtcctttgttctctgttttttttttaactgtgatgttctttgttctctttaactccctagataaatggatatttaaaatttaaaatttcctattctatcaggtgtcttaataattatttggagttgatgattgaggaaccacggtttagttcaattgcctatgttcgtctggattcacaagtcaagaaactcgataaggagaacacgtctgcgatggatttatcatccagtttgcaccagatgcttcagaagttaaatttaagagtacaagatgaagaagtctgggtgtcacagttaggctcaaatttgcaggcttcattcagaaaaatcatggatacctcctcagaaataggaaaattagaagatgaagttttgcagctgaaggtcgatatagctgagtttgctccaggtgaagtaaccagttgtgcagtatatgaaatgatcaagacacttcaaattgttgaactgttcatgaataattccaccagacatttgaaacttatcgatggaattaattctgaaatgagagagtttggaagtatctttaatggcaaagtgagatgccttgttcgctttgctagatatcaacaaactattatggagaagtctacacaggtttgctctaacttactttttaagtgttatgacaagttctggatcacttactcatttgacagataaatttgttccagataatcaatttccttggtgacatccgtgctaaagttgacaaaatgactcaaatgtatggtctatctgaagttgtgcccattgtctcaaaccagtttatagaggtgtgttgcaaactgaccagccttcatttaatcacttttggaactgtatctttgttatgcattctattgttgattccaatcaaatctgacatggtgtactgcatgtatttctaggggagcttcaatgccgatgcatatggttagtctagtgatattgatagcatttgttaattcacatcttgtttcagttttgatcaatctcctttcttatgcacagcttttgagagtttgaaagagcacagcactgatctctgttttagttggagaacaaggaagtttcataacagattaattctccctccagtgaggcaacaaacttctggtatgaaataaatgacttcttgatgaaaactttatgtatgtcataagaataaaatatgtcgttatgatgccatgaaaataattgaacgatcagcaaaaattgcaccttttcctgtcgcaatcagttttacctaataatttacttcctagactgatattttacatacatgttgatattttactctgctggctcaccctttttatgtcctgcttctgatggcctcaagtacttcccctcacacctctttctagtcatttgatcatggttgatttgtctactagggcccacctcgacacag

SEQ ID NO: 66884 - DNA, 15264 bp, Oryza sativa
ataaagtgaaaattactgtattataatttaataaaatgggggtattctattattttttgggtatgcgtaaggtgagtaaaaaaataaatttattttggacggagggagtacgtgatatttccccttgcaggccgcggcccagaagaaacaggctagcagctgtggcccactcgggacggcgagcccactcggatcagatccccccctcggcgtcgcgtcgcgtcgccaccacgcgacgcgccgcgcgcggccgggctgctcctctcctctcccacccacaccacacaaaacgcaacgcgccgcacgcttcaccaccgcgcgcgcatccgcgtatgattttttcccccctttccccacagccacgagaagatcgagatcaacacgagcgcgcgcgcgccgacgccgacgcggcggcgagggcgccgcagcccgcccccgcggcgtgtggccgtgtgccaccgtgcgcgcggcgcggcttcgtggtggagcgggcagagcgcgccgcggcttgcggcagcatccatccaggtctcggatcatcatcctctcttcgcagcttttgatcgggtttgtcatgttttgattcttcagactttcagcgcctggcctttatatcacttctgcagttccaaaagttctggtttctgtctgaatttctgattgctgttaccaccccaaaactcttcaccatcgaagagatatgagataatcacttgcacaaaaaaaaatcacttaaaaactgcagaaaataaccacaattaacaacaccagcacagagatatatgcagaaccaagaggggttcttcgggtattattgatattattattagatagcagggtagcaaaccaaccacccaaacgaacgaacgaacgaacttatgaggttcatacatatacgatgtctttagaccacacatttatatgctattaggtactaagagagtcttcttccaccactgctatagggtgattactgataaaccatctagtcttggctctcttctctcaaatccacaactatgtgttgtgataaacagatgaaaggctcaggagaacaaactgaattcttgggggtgccaggcgacaggagttcagtatacttggggtgcctccctcagggctacattcaggctgctttccaccgtttgccacccaagtccaaagttgttgctttgcatcattgtgacaaattcagcataatcgatttgaccatcctgaaaatttaccaaaaaaaaaagaacaagaaaaacataattactgatgagatgttcagcaaggaagcaaaaataatctcaatgacaccttttctgttctgagaaaaacataacttgctttcctatgttactaagcaaatataagtattcatcttatgataattcaacagtatatgccaaataattgaggcccttttgaacatatgggaagtcttccctcagctgttcagtttatcctcaaacaaagaggacaataagttgggggtgaaagcgcaaaagtatgaaacctctaaactatacatttttaaacagcctgtaaataacatcattatagttgttcatatcggatccaggtcttccactgcagaggatccaaattggttcatatctattgctgaaggtaatactgaaagtgaaacatcatttaggaccaacttctaccacatacatgctgctattctataaccagtgccatcaaattcttcacgagtagaacaattagctactgaacagcaataactaatactagcacactgatcttatagcttgaaaaacagtacagaacttacattgttttgatcaacctccagaatcatctcttcaaggaaagtatcttccatgttacgttccatgcaagccttttgaagcttgtcaactgtgataaaaccacttccatctttgtcaaagtatgtaaaggctgccatcaagtgtttctcacgttctattttattaagagacactgctgcagcaataaactcttcccagttgatggtggaggtggtgtcatcagcctgaagtagtactcaaaaaggttaaaatatataaaacagttctgcaatgaagacagtatttcatcacagatgcatgacatactccatttcaactaaaccaatggtttaagtaatcttttgacatgaatgtgttggccccgacttttcacacacattcaaaacaatacagaattctgaaaagcagcatgatcaaaaggttgacaaacaatatccagtctatatactacagataccatgtatatggtttaagtgtgctacagtacattttgcatcgtattttgcaataacagtgaccacttactgcttccattaagtcgttaatttcagtatccttgaacatgagctgtatcttttcagtcccttaagctcaccaaatgtaaccacacttctgtttttggtgtccatagccttgaacatttctcttaacccaacaatctcctcttctgaaagacgctcagcaataatctggatgaacagcaagtaagaaacatagattactgcaatctgtaatatttttaaatatgagaaatagatagacataatagtttaagtaaaaattgatgccttaattaatctcatcctgattcctagcatctcctacttttgtatcatagcaatttatgaaattatatctgggtcaatttagaatagtaaatttaggtgcaccataaaagtctgtaactctcaacttggaagcaatgctggaacaggtacaataccgacaaaagatcttcgtatatgataacaataaacaattcaccaatgaagaaaatattactgagtcagatttaaaaacaatttcagtgctgtcaaatttttaagatcctacgaggaaaaatctgaactgcagcaaatcaatttggccatgatggcatgatgtacacaaggtagctttgtttttattcttgtagaagtagctatgcttctggaatttaaaaaggttcacacttctgttagatttagtattaaaggacagcagtaatagaataatgatttccctggaaattgtgaaagcatttaatgatgcttcaccatgatgacaaaatggaaacaaataaatgacttttctatgacaagatgaaacggtaaaaaaaaatatacctggagagacaatttctttaacctattcattgcagaaaattgcttgagacgaggaagtacacttggatccagagctcgattagtagccactccattatcacatatccatggatgctctgaacatataatagaaaaactgtaagaaactgctctttgtttactcttgagatcttactatagtttcggaacttatgaaatttcgtggataacaaaaacattggtccaaaattattctacgaggtactaaattgaataaaagtgatactaatgaacgaaatattaaatatactaacttagcacttcatgggctttcaaacgctctgatggataagggcagagcatcttttttataagatcctttgcactgtcagatatcctgggccaccggtttgatttaaaatcaatacgtccatccagtactttttcatatatcccgctttgtgtatctagtaagagtgaaagaagtccttttagcaattcactaaaaccaatgaagcagaattttgcaaatcttgtcaaatcaatcacctgcccaaaatggaggaacaccagtcagcaatacatagagaatcactccagcagtccatatatcagcctctggtccataacgcttctccaatacctctggagcaatataatatggacttcccactacctctctgaaaacctgacctgatttgtggatagatatgaatcagttaggaaaaacagccaaaggaagcatagattgtatgcaagagtaacaattacattattatttgtttttgttaaagctgcattataaggaactacaacaaactaatgtttccaagactaaattactggtagaaaatttgattgggattgtttttctactctgccatactttcaccttactcgctctttgtacggaactatttacatcataactaaataagttagcaggatatcaaacagctgattgctaacatgactaaatatagaaacaaccccattgaatatacttattgactctgacataatacctggtctgaagaacacagatagaccaaagtcaattgctttaaccgagaattcatcgtctgcgtccagtaagaggaaattttctggcttgagatcccggtgcatcactccatgtgaatggcatgtttctatgatgccaactataatttttataagctctgcagccttccgttcactgtaatgacctcgcttctgaatcttgctgaagagctcaccacctgcacagagctccatgacgatgtgcacggcctgctcatcctcatatgtgtccttgattgtcactatattcttctggcccgaaagatggtgcattatctggatttcacggcgcacgtcctcgatatctgacacacatcggagattactctttaagatagtcttgcatgcatattgacaccctgtgctaatctcagtgcagaggtatgttttcccgaactgtccctgtccaagctcccggccaagagtatagagctcccttacatttggagtcttgtatccaaggacaggggactttaggttcagcccttgccgcagagcacccgctaagctggcccttgacgagcccgagtagcaatcctcagtatcattcccatcaacgtaccgagaagcaaaacggtcattctgaaaccggttgctgttctggtaattgttcccataggttccattttgcaagaattccccattcccacaaaaatgtatatcctgcatgatacaatatgcaagttagatatctacaacacttcacagggatccggaaaagcctgctaaaaaggagaactccagcttaatttagtactcattcagaacttgtacttattgtagtaatacagtaagagtagagcaagaccttagcctaaaactggacaccccaacaaccagactctatgttatcaaaacacaaccaatcgacaagtaactaatcacctaaacaattgtgatattatccaaagtttcgagctctcctaagctcctacgagcagcaaattccccaaccttctatagctctatgcatcctacaccctcaccaaattcagtacagtttcctccaaaggcatctccctttaaaccttcctacagctcacaatccccaacccaaaggctcccagcaccaaaatctccaccaaaaatctcctcctggaagaaccacttcacttcacctcctccaatccacccaaccccaaagccatggccagccaaaaacaaacgaaatctaaatcgagacgatgaactcgctacaaaatgtatatccaagcgaatcaagaatcgccaggacggggctcacctgaagccgcttcagcctcgatcggaggagcaagggaggcaaggagagccggggggagcggcacagggaccggagccggattccctgcctccctaggggctaaattgcaaaatcgataggaggaaaaaaatggagaggagagcgctgaggagacggaggtggcaggagaccccccttttatacccccggccgggggaggagagggtggttggtcgcgccacgtcagcagggcctcgtgggggagggggctggacgcatcaacggccaggatttgtcgatcgcggatgatggaaacgttgatgagcggctgggatgtcatggtgaggaattgaggatacactcatacacgccatttggtaagcttttttttttttgggttgctggaaggcaatggtgaagtggtgaactggtgattggtgtttcttggggagtcaggcgatgcttaatataaagatggtgatctgctaccgggattttagccagatgtgtccgcggcgttgatgcggtacaatgatgtggcgtggagtgcgggaggatgcaggggttcaacgacaaaccgagtgttacgtggaaaggtaaaaggttgtaacagaacggtaaaatgacaaatgcctttctaagctggatgcactaatttggtatgtttcgtgttctaattacatcgcgacataaaatagccaggtttcggatacgttatcgttgcttttaggtacgataaaacatttatgtaaagagaagaaatcattgcgtcacggaaaaataatgatgtgtcctgataagaaattttggtccgtggtatatttgaacggatggttctagatgtttcagttaattgatatagcgtgaaagtttaataaattatatctaatacgacaagaaaccattaaccttacatagggtgtggggtttttcgttatttcagcagcttagttacatcaaaccctttctcaaatgtataaaagaaatgtctcaaacttatatagttaatggcaatcacgtcttaagctagctttctttggtatggataaattttagggtgaagtatattttcaacccttaaaccttgctcgaagttaatttatttttcgccttgaaaaaaaaacaggtaaaaaaacaccctatgatgttattttagatgttttattggaaatagaggtggtttactaattcatatgctcgtatcgtgcaaaatttgtcgatgtaaatgttatttaggtaggcccatgactatggctgtgttttttagcctaagttcacaattcacctgcctcgtttttcacgctcatgtttcccaaattgctaaacaatgtgtttttttaaaagaaatactataggaaagttgttttaaaaaatatattagttcttttttaagttttttatagctaatactatctaatcatgcattaatccattgcatagttttgcgtgtggataggaggggttcccaacaaaaaaaagtacacaccttataaaatctacctaaatggggtttctgtaagcgaaaagactttcatagagaaaatcaccttgaaatatattatagggtttcacatgtccagttttaaaagttgcaggggaaaaataatcaattttatagtttaaagtaaaaaaaacagatttgacccttatttttaccggaatggaaaaggaagtattaccctacagtatatgatgtgggtaatttttgattgatgccaaatggcgccatattgattttttgggtagttgaatagtaaaattgatagttcggtttgaagcccaatggttagtagaacatttttttaataatacatagcacaatcctaaaactttattcacccgtaatataaaattctaacatgctcatttatattgccatcgtgatcgtaccaaaacatgcatatatgacgagcatcacgatgacagtggatatcgcgatgtacgtacatgtacactgctgccatccatcgccgtgagcttacgctcacggggccgatcgaagtgacgctagctaagctccagcttgagcagcagtgagcgcgcggcttcatgccccttgcacaaggcaccaaattagatctgacatgcattacaccatgccgcctgccgactgccgtgtgtcacgctgcatgcgagatggtacgtactggctagctcgatctcttcgtttcgtcgtcactcgcgataaaatatcgatcgtctccgctgatttccgaacaccgtacgtacccaagcttgggtgagctctcgctagcttagagcagatacagtagcaaattataaatcaactataattataaatcaactataaacttctaaaggtgcaagtgggtttacccacgaatatgcttatagacaaaaatagtgcgtaaccgccggtttgactagcgggttaactatgaatttgacttataaatgggtttatagttcgatccacttatatatttagatgcggcaagccggaccgcaatgcgaaaacccataaattattatttatttaaactcgcggatcggcccgcttgcacccctactactataaacacatgtcgaaaagataaaagaagagagaagaacaacgagctacaaatttatagctaaactataacacagactctaaaacgtaatgtgtgtatgatatgtgagaccagatattaattatatattatgtatgtttataagtaaatattatatgaattgactatggataatttaaattaaaagtagtagttgttgcctatgttcttacagtgttttgcatgtactaccagctatatatagctataggtgaagcgtcgatgttaccatacctgatttctgcttggttaacttaattatggcctatggggccccgtttctttcattcatatgtgatttaatttttggagggttaggtgaagtgttgcgttttgtgtccaattcgtaccacaagtccactacacacatgcatgcttgttgaaaaacatgaaggtcgatttaccactagctagtagtaccatctagttaaaaaatctcgaaaaagtaggagtaccatttttaataactcgactatatatgaattctgtttaattgatatataatactactaatcaataacacgccgtcacaaccataaacattaagacaaagttaaactaactctcacaaacatgcatggctagccatatattacattatctcgttctttaattctacataatttgtgccgtcaatccatctatattttgacaacaaatatcttttaggttatctagctagctagagatgtggtttttagttactgcaccatcactcgtgtcggcggcggcggtggtaggtgggtgaaggaggcaggtggtcagggcgtgtggcgggtgggcggaggagtaggcgtcgacggcggggaggagaaggagtaggcccggcagtgaggatctgcagcggagtaggaggcagtgggggtgttggcggcggtcacaggtggacgtcgacagtgtcgctggcaggaatctggagcgaaggaggcaagcgggtggaggagtcaccgacggggatgggtaggcggaggaggagtcggagtgcgcaatgggtgggttacgcgacaggtgggaggtccaggctattggatatgacgatctgatggttaatattaaagcaagaataatagtgggctgtaaaaatgctgaatgttgaggtggatgatagatgatagagatgagaagcgggctgtaagcttacagccggcttagacacaggaactaagaaaatcagtgagacagacaggtggaccatatatttatagtgaagagctaaccactatatgagtgagctgagagataggctataaagatctatacagtcagtagctggctatattattagccttgctcttagcatgtttgtcagatgtgtctgctatatcatgaactaagaaaatcagtgagacagacaggtggaccatatatttatagtgaagagctaaccactatatgagtgagctgagagataggctataaagatctatacaatcagcagctgactgtattattagccttgctcttagcatgtttgtcagatgtgtctgctatataaaaatcgagaccactattacaaatttaagtagtagagatacaattataaaaacaaacctgccccaccttagaaaaaaaaaactttctgtgaaaaagaacgaaactacatgagattgaggagaagatcatgttttgccttctgcccagatcgtcactactttaaccctaaacaaatctttggcgcatctaaaaggcaaaaacaaaagacacaactatgtgctcaacacacttgttttcctaccctactaatttaatgattcctcctgttgcatttatccatccacgcaagcaagctgcaggtactaaccatatgtaactccgaaagcacctgtgttatactaagataattaaggtttaaaactaacacaacttgctagacactacacgtactacatgacagtgaatcattctttcatagacaaggttaatattatcgctatgcgctcttgacagtgaacatcatccaacccgaagctaaggttaattgtcaccatgtgcttcttcagttctccttttctgtgacgaccatgcattatactttttctatccataaatccataataaacttgtctcactagttcaaccggcttatgtcagatgaacctgtcatccaatttagttgatttctaccgttactgtgttctaatgggaaaattggattggctacttaatttcttgattttcgttagcatattttaaaattgttaaactttgcatttttttagaaaaataaagtaaatttatttatttattcaattattaatgcttcattttgcgattatttttcattttgcatgtgactaataagccgttctcatcctccgattagaacgtgaataaagtatgttagtactttctttaacatggtccatcaataaacaggaggtaaatgcgatgattttttaaagccagaggtaaatgatttttcagagtttagagagagagcaacactttgcactggcagaagagtggccgtagagattgcgtgctggctgggccccgcaatgggcccatgggcccacaagccgggcaaaaacttcgcacgagggactcatgcagagccgttcattcactttcactggggcccaccagctcgtccggtgcgtgaaagcctagtgggcggcgttccgtggaccgagtacggtacatgggcccagtgttgtggttgtacggtcggatcggagaccatccctagcccatactgaattctgtatctccaaaagtttctcaaattctcatccaaatcaagccaagtagccaactgtttcttatatgttgtcaaatttcaccgcaagtcaccttaccgcataaaatttctcaatgtgtttgtacctcattttgttaccgcaatatattttttcacttcccattgtgaatagggcgaaaggtaaatgtttttgttaaacttctataggtttgattaaatttatataaaaaattagcaacatctacaacaccagataagtttaactaaatataacattgaatatatcttaacaatatatttactatatttttatataaacttactctctccgtttcataatgtaagtcattctatcattgtccataattcatataaatattaatgaatctagacatataacatccatatgaatatggacaatactagaatgacttacattataaaacggaggaagtagataaataaaagtcaaaagcgactcataacaaatggagtagtacaagacactcagaaggggatacgtacagacatgccgtaaatcaaaaggaaaaagtccacttagactcccttaattattcaccgaatctaattcgtgacccttaactgtaaaaccggataggatgactctcgaattattgaaaccagtgcaatttgactcctccagcggttttggagagcggttttgcttacgtggcgctgatgtggcagtgctaacccggttttcattctatgtggtgcttatgtggcatttagaattaaaaaaatatatgtgggacccatctgtcattcatacacaaaatatatcatgggacccaccgatatatgggcccacgtgtcatcctttttccttcccttcttcctcctccttctctctcccttctctctcttctctctcccccttttctcttcccccttgggaagcatcggtggcggcggcggccgggggctggagtggcgacggcagcgtgcgggcgagggctggagcggcgacggccgcgccaccgcctgccccgtctccaagcaggctcgtcgccgctccccctctaggcccggccggcgcttggatccagcgcgaacccggatgttggaagcaagcagtaattatgcatgtgccacttaattgaatgtgcaaatgtagatgaaatcgatttttttttgactgaaatgaaatcgattgtgaaaatggatgaagaagcacacaaacctgtgagctgcagctgctgacgcagcgggcaatccgggagcagacagtggatctcgacgatctcctcgagctcgtcgatgagcagcacctccttctggcatttggtcgccggccagtggcggaggaagatgtctcgagcgacggatgctgccgcagtaggagagctggcggtggtacgtgtgcacccaccgcgtccggtgcagcggcagcagcacacgcgccatgaacgcccggtgctcctccttgagtggcacggcgaagccgttgatgatgctgccgcagatctcgagcagctcgccgacgccgcagtggcgctcggcctcctccggggacgtgtcgtagacgaaccggagtagcgcggcggccatgatgcgctgcataaacgcgcgctcgacggtgagcttggagtagagctggtggtagacgtacttgaggcggtcgcgctcgcgcgagtcctcgaaggcgaagagcgccacgaggccggcgaggaagctccgatcgacgtggttgcggagcgtcctggcgtccgcggcggtgagcacgtcgtagacgaggtggaggtgcggccacgatcgacgggagcagcaccatcacggggacctcgtcgtcgagcacgtcggacggcggcgagggcgacgacgggtaggcggacggcggcactgcccggaggcaggaacaagttggcggcgaccatcttgaccagcgccaccatcacccggtggtccagcccctgcggcggctgcttcttcccgctcgccacgtcagcgccatgtgagcaaaactaccctctaaaatcgatggaggagtcaaattgcactggttttaataattctgagagtcatcctacccggttttacagttaaggatgacgaactagatttggtgaacaattaagggtgtctaagtgcactttttcctaaatcgaaatgacacaaataagcccatctacttgtaaaggcccaaggcccatgtggccgtgcacctacaaccaaccacgtcatcgatccatactcccccatttcaaaaccagaatccaccgtccattctcatccaacggtggagcacaaccctcccacggatcgcgtccctcctccccgtcgtcacaagccacgtcatcgatccgcaccgatcccccactacccaatcccacccctccatttccaatccaacgctccaaacccaacaccccacggatcgcacccctcgccttcacctcctataaatatccgcacaccccaagtgtgtctctccatctaaaccaaaaaaatccccaaatctcaaatcctcctccgtctccaagctctcgtcgtcgtcgtcagacatgtcgggccgtggcaagggaggcaaggggctgggcaagggaggcgcgaagaggcacaggaaggtgctgcgcgacaacatccaggggatcacgaagcccgcgatccggaggctggcgaggaggggcggcgtgaagcgcatctccgggctgatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgattccttccttccttccttcctggtggcgtgcgggtggtggtggtggtgtaggagctagggtttcgatgggattcggggggaatttctgctttgtgttggcttctgtgtagcgactcttctgtttaaatgaattcgatgaatctgaactgaagatttggttcccctgtgattccgtcattttatatttctgtttcctgtgatgtgaatttgtgcgaagttcgtgaaactgcctttcggatgaaacgaattttgttttcgtggaagttcagattggttgtgcatttaatatttggggaaatttgtagtctgccaagtatgtgtaatcagcgtgtggagttgaaaaatgttggtatagagaacacaataggtcagaagacgacgcggcgtgagtcgtgacaatgcggtcgcctggagtgctggaccatggcgaacctgtacagtacagctttggtgggtacagtacagcacacgctatacggggtgcgacacggccatttctgccttcaaccgtcccaatctttttatttcgaagtaaaaaccgcttctcacggtttatcgaaatatgtctgaaccaaaaaaaaccaatgaatttcagtcaacatcatacagaaactggctcataccaattggttttcacaaatcaagtactaacggtttcacaaaaatctcataccaattggttttcacaaatcaagtactaacggtttcacaaaaatctaccatttttcacgaaattccatcggttctatgaacatgctcatcacccaccggcattctacctgcatattgttttcttttttcaaacacagcagcacgcacacttgtcattacaattgcacataggagtactactcagcatttccatagactgaatagtcgtatgttgagattactgtcaccgttattgaaaaaataaatgaagttaccttaaaaaataaacgaaacaataaaaataatttatgaatagtttttcaacctgttagcagtttagaagctaatattgagaaatgtaattgatatacacttaaaaacctcaaaatcaacttaaaattgactttcaaaacttaaatttaccgctgataacaccagaattcaaatatgggtaaaggcatctggatttgaccatctcaaattgtttatcaggattctccctaaacgaagcaggagggaacagcagtgattaatggaacagaagtcatccatccatccactgatccccaccttctctctccccgaagcaatcgaaatcggcgcggtgtgaaaccaaccacgccggtggatccacggcggggcgcgcacccccgccaccgacgattgccggcgacgcgccgaccccgggagggagggagggagggagggagggagaccccgcacctgccgcttgccgctccgctgttcccatcccgctcccacctcggcgcccgcctccccccaccaacatctcctctcccatacttctcgcttccgctccacgcctcactgcctgccgctccaccgatcgctcgctcgcttcccgcgatctcgcctccgagagcagatctggtggcggggcgtcgggccccgtcggccgatggtttccgccgcggcgcaggcgggcgtggtcgccgcgtgcgtcgtgctgttcgtccccatggggctcgccgggtggcacctcagccggaacaaggtgctcttcttctccggggcgctgttcgtctcgctcgccgtcggggtacacctctcgccttacctcccttccctcccgcacctcctcctcgccgcatccttccacccccatcccatct

SEQ ID NO: 66885 - DNA, 3498 bp, Oryza sativa
tgcgatgagggaacgtgataaggaagaagtaagcattgttgacaagaagtgtataggaaagaagaaaaaaaggaggttcagaaaaaagatgagaatgaaggagcacatatttctgacgaagataaagaaagttattgagagccatataatggatggaaaggtgctcattgctagtttccgggtaacaactggttacttcaggttgctacctcatcaaatctacaaaattccagaagaagatccccaatatgaattgaataaaaaaggtaatccctgttctcattgtgtcgttgttgttggttttgggattcgggacggtgaatgttatctgatctatctaaattcatatgggacttcctggggacatgacggattcggtagaatataccttgatagtgtcaggaagctttttttagctcaggtctaaactttgcgtgtaaaacagtgaaattgtaaactgaaatgttattgaataatatttcttgatttggttatctatatttctttcctatgcattgattaatgtgagatatttgagcttttttttgtgaaaaagttacttttattgcaaggataaatctgtcctaatgtcaaacatgaggtatctgtccttctgaccgatgcacgtactactgctctgttgtctgtggcgccttccgagcttcaactgcattgtgagggatttgcgtgctgttgtggtcaaggagcgcatgcaagtgcttgtgcttgtgcttgatggcgtttgaatctcatttgcctgttactgtctaaatcaagtttttctgagttttgattttctcaataaacatggtaatcctctatccaatattctaaaatagcccaaattgtaaaagtacgtgttactcctatataaattttattcaacgtggctaaataacattaggttgaatatacctggcagtatctaatccatatccttatgaaacattcacagcatgtagaaaggaatactgataacaaggtatgtattatgaaacattcacagcatgtagatcaaaatgctcacggggtgcttgactcaacgactctgtggtcgtatctcagaaaagtcttgcgctgtcatcggcaacaactgactagtctttttttatccaatgcggaattgaataaacgctaaataaactccaactaatatatgctcataaatgcatggaattcaattagtgtacatatcttgattttatattatttgagtataaagatcttgatctttgttagtgagcatatccaaacgggaaaaaaaagagatcagaaaagcagcaaggcagtgagaaagatgtcaatcaaagcttgatggcgtccacatcagagaataccaaccatatactccgtcaaaaaatggatggagggagtatgtttctaatatggcatggtacaggaggattactattcatacatcttcagttccctagtccccaagctctgttcgcaagaacaggttcccagcccaaatagtacgcatgaaaacggagcggtccattagcacgtgattaattaattatttattatttttttcaaaaatggaccaatataatttttttaagcaactttcgtatagaaactttttaaaaaaacacaccgtttagcagtttgaaaagcgtaagcgtggaaaaacgagtatagggagttggtaaccagctcttgcaaacagagcagccaggccaccgaagttcaggcatgtttggtttgtttcccaacctaaccatttcgctacgccgaaaaatcatcgcccatttagttcgtaaaaagaatggcattgcaaaacaagtaaaaggctaatcaaattttgtcagcattacaaaaattatcactcatttggtttggaaaaagaatggcattgcaaaacgagttaaaaggctaatcaatcttgtgaaaaattacaaaatgttgatatggctagcattggcatagaaccaaacagaataagagtaactgagcaagtgaaacaaagaatatattttgattcatgagtctcactcccacagttcaaataaatcaaaatttcagaaatcactgatgggaaaagctagcttcgtgaagtccaatgcccagttcacactggaccaactttgaagtttgaacgagtgaatagagatatttgctacagctatatatataacttctccagtgtatttgggctgtgtacacctttctaaggtgtagaggccgggttaatataatatattatctaaaaataatttccccagtgtatattcttgattgaagttattaaagacattgactacataatggtataatttaaaatctagtgcgtacaaatttctcaagcaaacattcttcttgtattacatattatcaatagataaatcctactgataacactggcagcttttcaagattacaagaatacatttactaatatggccatcagtggtcagcacagcagcaatgtaagctttcatccccgaacaagaacttgtcggtgcttgggtgtacaaggtaaatctcataactcatgcatcgcacacaacaccctgtaaaaaaaataaatataaaggatcagtttatctccttcagagaatatcactactagaaggaatgaaaaatcattacaagatttgttggaaaactattattggaaatatttggacagaatagatagtagtgcagtagcgtagacttggtatcagaaacaatttgcaaacaatcggcagtcaaatatgctagtagcacatattcactcactagttttcctaaaacagaacagttgcttgtaatatataaaatcaggtaaaactgtggtcttctggagagtgctacacaagtaaataaaaaaatgcagcaatgaattaaaaataataagcaatcccatacaccgttaagttgtgaagtcctcttatgtttttgctcgattattgtgtatccaaaaggataggcaaagtgatttaaccaaatgctaattttacagtaataatcaccccactgacatcatgtgaaatgaaattgtgtcccatgtcaaatgagataagaaaatggtcattactttataaatgtctaagcgaaatgccacaaaagtaaacagaataaatcattgccatacctatttcgcctgtttcgattgaacaccacgagtgaacttggtcctcacatttaacatcgtcgctcgtctcggcgaagaagaacccaaatccactgcttggggagtacgcagtgaagttgtagtggcaataggatagttccatctcaacgatcgtgctctttgcagagatctcccagagctcgtagtttctgcccggatgcttcctgttgatgatgttcaaggccatttgcacattcttggtgtgcctcttctcagccagaacttgccagtcaaacatatcatccatagcctccttctgcagctgctctttacgcggtgccttcccggcggcatatttctcccgccagcgtgttcgtacttgctctatgcgctgctggcgttgcagcgcctcgttcttgcgctgcttcgcctctcgg

SEQ ID NO: 66886 - DNA, 4069 bp, Oryza sativa
tcccaatacatataagcataacaacaagtaatataatgcccctaaaaagtggcatataggattcggtgatgaggtggaggagataaatgataagctacccctaaattaagaaacaacctccacacaaacactaagaagagtctgagagtgttaaaggtattgatatttgtgtattagggatgacatattatatatgttgactcttaatttataagtgaacggcatggataaattgaaggtagcagtcacatctattatagcacttgctctaatgcatccaaaccgggattcgatggcagcccgacagcccgacacctctaattttccatctaatcaaatacttaactcccataggcgcataggcatcagagcaggagcttccaaaattgcggagattatcctccatggagagtagtcctatttttgagtctcttcggtagataggccagtatatatttttcagtaaagtttttacttcttctctatgaatataatgtggcaaagctttcgcctttcttaaaaaaaaacaaaacaaaacaaaaggcgcataggcagaattaggcatacatcagagattgagattcagagtatggcattcatagcttattaggtcatgtatccatctggccaagaatttggtactgaccaattgagccaaaaattttaaaaatttaatgcgctccacctccgctgcttagcttgcaaatctactactacttaaaaaataagaggtgcttccatcgtccgtaaaaaaaaccgggtgaaaaaaaaccgggcgaaaaaaaccagtttgtccgatcaaaaaaaaaccggtaaaaaaaccgggtgaaaaaaaaccgggcgaaaaaaaccagtttgtccgatcaaaaaaaaaccggtaaaaaaaccgggtgaaaaaaaaccgggcgaaaaaaaccagtttgtccgatccaaaaaaaaccggtaaagaaatttccgtttttaattataaaaaaattacccacaaaaatagtttctgtccgattccaaataaaaaaaattccgagcgacaaaagagtttccatcttcctacaaaaggaaagaatagtgcgaaaaaaaaagtttctatccgaagggaaacacgcgtgaataaatacctaattaaaaataaatatctatctctaaaaaaccttctgtcgtaaaaaaaggaaaaaaaggaccgactcccgtagagaaaaaaaaagtccgactcgtgaaaaagaggttttctcgtccgtaataaaaaaaaagaaaaaaaacatctaactcaaactccgtaaaaagaaaaggaggaaaaaacgacccgaccaaacttaaagtcgccccttgttatccgtatatatctctttaactctaatctaatctatcaatctaatctaactttttagaaagagaagtttccatcatccgttaaaaaggaaaaaaatgcgcaagaaaaaaataatttccaaaaaaatgcgcgggaaaaatacggtttccttcgtctgaaaaaaacaaaaaaaatgctattaaaaactatcagaaagaaatacaccatttctaaaaaaaatggtttcaaaaaaccacacaagaaaaaaaaaactgtttataaaaaaaagccgctctaaaaaaactaaccgatgaaacactgtttataaaataacagatccaaaaaaaacaaacggactcaacacgcgaaaaaaaccgatgtttcaaaataaggttcgagaaaaccgtccgacttaatgcgagaaaaaaaccatcatttcgaaaaaaaaatagaggaaaccatccaactcaatgcgagaaaaaaaccgccgtttataaaaagaaccgctccgagaaaccatccgactcaaagcgagataaaattgatggacgcttgggtcggataagatccatcgatattttttcatctcctacacatcatttcctacacatcatttgtttcctcatctaatccctgcactttttgtatgcaattatcattatcagactttttttaataacatattatatgaaaatagtattaaaaataaacatatttttaattgttatttagagaagagtgcacggtgactattttgtgtagacttgatcctgagtgtaggatttgattaacctattattggttgcaagaataatattgaaagaatatttttttattatatgtatattgttatatgaataatccaattattttagttaaagcaagcattggtaaaaagattgccatcatcgagtttgggtcattacataaagatgctctaattttctaattgtgttagctacaacgatccatagaaacattatcattgatatgggtacgcttgaaaaatgtctattgtcattggattattttttttacccgttgcaacgcacgggtatttttgctagtaataaataaataaaaggagaaagcaaacgagggcgggggggcttaccgtggattgggcgcggcggacggcgacgccatcgctcggcgtgtgcttttcgcggagctgcgtgcgtgcgtggtccggactccggcggcggcgcgcgagggttttaatgggtggccgaccgacggcgagccggagccggagttggagtcggagaagggttcggggcggagtacgaaacggactagaatgctgcctgcacaatcggtgcggcctatatagcccatcacatcttatcatctatttctagccggcccataaattttttttttattgaaccgtgtgttgtgcctaaaattgcattcattaatcttagatgatcgcccacttctaaaattcagttttctttaggacaaatagatatagtttctaaatatttgtggaaacaaacgagggacttgcctattgaacagttgacagatttttgtagattgaaatcttgcagattttgcagtcactggatgtagcatccacgttgtttgttaacgggcccgcaacacactaatgttgataagtcgacccgttaagacgaatttggggctacaaatcactttagcctagcccattagctgctaagcaacccgtttggatcaaataacaaagcaaaaagtccactttgactcccttaaaaaagtaggccgaatctaattcgtatccctcaacccaaaaaccggatatgacgactccctgaactattgatgccagtgcaatttgactcctccaacgattttggagggcggttttgctaatgtggcactgttgacccggtcttcatctcacgtggcgtttatgtggcattagaattaaaaaaatatatgtgagacccatttgtcattcacacacaaaaatatattgtggggcccacatgtcatcctttctccttcccttcttcctcctccctctctctcacttctctctcttttctctcccccttttctcttccccttccgacgcacgtaaggagtgggagctggactggcgacggcgacgtgcgggcaagggctggagcggagacgggcgggcagggccagagcgatagcggcgacaggcactggagccgcttcgacgtctgggcatgccacgccacctctcgtctccaagccggcccgccactgcaccccctctaggccgggccggcgctcgcttcgccgccgctctgcttgaggccgggcctgcaacggccgacgacgaaagaggagaggaaggggaagagaaagaaagagagaaggaatggagcaggcggtaagggcaaggagaaggactagggaggtggaggcaggtgcagggccaaggagcgggagcggcggcaacggtgggtagggggaggcgcagcggcagtgctcactcgacgctcctagaatcgattgggttgtcactatttgggctaagccacgccgctctccccgcacttgaggccgttgtcgctccggccctcgcccgctcgcctccgccgccactccagcacctgttgtcttgcctgccgccgccatggctgagggggaaatgaaaagagagagagagagagataagggagagaggaaggaggaagaagagttagcgtgagaggatgacatgtgggccttataatatactccctccgttcgaaatgtttgacgccgttgactttttagcatatgtttgaccgctcgtct

SEQ ID NO: 66887 - DNA, 15832 bp, Oryza sativa
agctagcagttataatcccgatcgggaggccggccgagacgatcgatcgaccttggcgacgagatgaacggatcaggggatggatggatggatggaacgaggcggctggccgggagggaggtgtccgagttatatatgggcgtgcgtggtggtggcgcggcgggatcggagttgggatccgaatcggaatcggaatcggaagccaggaaggaattaattcttctctccgattcggtcgccgtcgggctcgaacgtacgtacgcgcgtcgggcgcgccgcatcctcacgagatcgcacgcacacgcacgcagctcgggagccgatggccggcctcgacaccgacacgtccacgtccaccacgtcgaatatccatggctccatggcccatgcaagcagacgcgcgcggcggtggcgctgtacatgccgcaggagtgcaaactgcaaaggcaagagcaagttcgtcctggagcaccaggccatgtgggagaaggaagggaggaacaaaggctacgacaccaccgtgcaccgctggcgctttgccaccgtgcctgaaggcaaaatccttgccggctgggagaaatcggacattctgccactgtcaaagagggtttcactcaaatgtcacttcgcggattgaatttgttaaaaagccactctcaaccgatgccaaacggctgctttgccatattcactgttacctccgtcacatattactcggccgaggatttcctagtggccgacgacgcgccaagcctgcagcacctcggctgcgacggacggggtcttgccgtcttggtatgcctcacggacgacgagctgaaagtccaagacaaggtgtactatgatgggttgttggagagcaggtgggcagaggacactggctcatcctatgctccaaggacggcggcggtggcgagctccgtcactggacgacggcatgaccaacgtggacagaggcacgatggcggtgatgaggagcacagcggcggtaaggtgccacagggccaggacagtggcgaagctaggatttgaggttaggggggtgtgggggagaaagtcataaaaccgattaaccaatatgaatagtaaatgagccaaatagtcactaccgataataatcaatgtgtatataaatatagcttcgttgtagctagattataaaaccatcatatgttatgtttttttcaaaaaagcggttcaaatgttcaatataacaagacatcatatgttttgcctaaaaaacttgaattcagttctttcataatatcattgaaagtttggaaccagtccttgttgctaaattctttcaatgtaaactaccaaatagtctcataaaaagcattttctgttttactttgaaaagatgaaaatcataagactaagtactgagagtctgcctataatctaacgtgctaatgccctaacagtggatgctgcctaattgcctaaccctgtaatatactactagcagccagggggttcgggataggggggtgctggccccctccggcacccccggtagcttcgccactgggccaggagcttccacgggctgtggctgacggtggccgcgggcggggagatgcctgcggcggccttggtggttagggcagatgacttggcggaaatggcagtaccatttttgcactttggactagctagggttcataatttgggtattcatccttcagccatgcatcgtgcaagtttttcttgtgaaactgagcatcatgagagcagaaagatcggtagggcagcaaccaaaaacacaaaagtacaaagatttgttcttgcaattgggtgtttcacaaaagtgtgagttaaaaaaagaatatatagtttgattttcggtattaagtgacaagggctttggttgtggtggaatccctcaaatcaattcatatgacttatgtcgagtgtttgaaatatcgagctaagacatttagcgattggccttctcaaatagtagtagctatagcggactaaatggatctatagcggcgaaattctacatgagattaaatagctagatccttctcaaacagctagccggagatagcggcaactatatatgatattaagtgaaaagatagacttgtctctaattcattgtaaaactttggttaataaaggtggatccgatgtgaaatttactcttgttacaagcaactagccacatttaggaaatgagcactactacatgcccgtaaaaaatacttatgaaagtcttacaaataattatcttaaccatttaacttaaagagatacaagctataggaaatctaaatatactagcaggatggcaacatcagtgttggtaagagtatcagtgttagtatgagtgaaataagaaaaaaaattagtagtgaataggcaaattttgctacaggacatcgtaattgtgtggttttagctcagggacaccgtgaaagtgaagttttgggggaagacatcccataatcgtggatatttactgatggacaccgcgccgtctgccgtgctgacgtggcggacgggaggcccttttttgatgcgatcggacgtaaatacccctgcgcaagagataataaggttatgtggggcccacttgacagtgtcccccctcctcttctttttcctctctcggtttcttctcctctcgatctctcctcatctctctccctctcgtttccctttctcctcacgcgcgtgcgcgcctgagcggtatgcggcaggcgtgcgatggcgcggcaagcgaccggccgcagcggcgcgggctgaggcaatggcggcggcctgaaggcggcccgacggcgtcgggtggatggggaggcagcgtggcggacggcgacagcgtcgggcgacgccggcggcgaacgagctgccgagcaaggccatgggcgacgccgccgtgatgaaggtggacacgggcggcacgtcgcggagtgcgcgccagacggcgctgttgcacttgaagcctgagccgaagccgatctgccagacacggtggccgcggcggacgcgccccttggcctcggcgtaagcaagctcgtaccagagcgagccgttactggtgttaattgcacattaggctcgacatcccgtggttaataggcacattaggctctctctttgatttcctgcatcaatcaagctaagcttggttaattaatcaactagcagattattgtatatcactcatcattgtttgtactagatcaatcacttttgtgcgtgtggttacctcgatgccgggagcaagagcaatggcaggcggcggcggcggcggtgcgagccagatgcagccgtcgtcttcgctccaccactcggctaccgcccgaggcagcagctccacttccgccggcaggcgtcgtgcgggccggcttggccgcgcgtgggggcggcgctcgcagcgtggtggtggccccgagcaagacgaagacggcggcggtcgcggtggcgattcgtccgggcggagatggaggttggaggtgctaacagtcatggtggcgaagcggcagtggcgcgcgggtggtgctcgcgcgggagatgtggccgcgcgcggcggcagcggccgagcgtggcaacggctttggcgcggcggcagagaggtgaaagaggtagctggcggcggtggggagtggcctgacgggaggcccttttttttttctgacgtggcataggggtatttacgtccgaccgcgttaaaaaatggactttcgtccgccacatcagcacggcaagtaccctttagatggcgtggtgtctatcggtaaatatccacgattatgggatgtcttctcccaaaactaaaaccacacaattgcgatgtcctgtagcaaaaattgcgtagtgaatataggctagattatttcagttgtggccccaatgtgctccatattgacccgggattgcatcgggtcggagaataagttcgttgggagtttgttacctgatgcaagcgatgcggcgatcaggggatggagatcgcgtcagtagcgtgggcgtgagtttagcgtaggtgcgcgagtaaatgaattcaaagatttgtggatcgtggggtggtggcacgatttagcctcagattctttctttgtgttgagtataagtaggagattagctcaacttctaatttgtatgttttccaattcatttgaatgaaatccccagtaaatcgctccacaaatttcttcaaaatcttcagttttttctgaaacttctctcgttcctacgttcgtcagtttcgtcagtcgaaactgttttcgtctgttgccatacaagacaggagcaatgtgcgcacaaggtattcgacaagcgttcttctccaacatgcccaacgtacaccgtggcggatttaggatttaagatatgggtggtccaacctaaattttctttttaaaacacagtaaatgtaatgatgctaatatatgcaatgcaaatatagatagtaaaatagacaaaatcaccaaaagtgtaccatgatatactagtaatatacccgtgctaacgctacgtctatgtttagtaatagaaataacagcacatggttcggtatccaagtatctaataagataaatttaatatttaggaaaaaaactacggagagagttattatattgttgctaattatatagcctccaaaatataaaatcacaacttttgtatcttaggaatacaaacaaaacttattacctacaaataatacaaaccaaacttcatattacaaggagaagcgttttgattattttatactatattaatcaccggagacaaatctgacctaaatggaaggatataattatacagaaaagacctaccaaagtttcaggagtcattgtctagctcaagtatgatcataagtaacaagaaccctatctggaccagtcctcatgccttcgcaaagcatgttaaacagtgcaaaagcattttttgtcattctgcataataaattgaaatttgtcatttatgaattagtttatagaacatgctgtaaatttgaaccgcaaatgtatagaatatataaggatataccaactatcctgaattctttcaagtgcatgcaatcctataataaaccagatattaagagagtatttcatcaagtattcgctactataattatctttaaaaataaattgttataaaatggcagcaaaccaccagcagtactacttcatgctttgtaaaattagaatatacttgaataaattcagatgcatcaatggctgatgaatttttcatgcaaaattctacttactttcggttatgaagaatatagatagcacttaccatcaccaactggcttgccatcccatttgacaatgggcagaaaaggatctgaatgctgcatcccagcacacttccttgcagttggtgatatagtcaaaccttctccccatgctcattagttttgcaccttccactgttctccaccaatattattggcaagggaaaatcctaaaagagtaaaatattattaaatttaacattcaaagaggaaaatggcaagagattttacaagcacgactgtttgtgaacacctaaaaaaagggtacagtttatgaacaaatcaacagtccaaatgaaatatattggctatgaaatcaacagagtctgtagtatatagagaatggttaattacagaaatcatttgctatgaaagagcatgtcaaaaagcaaaacattgggtctaaatgaaatatattggcataacttaagatgactgacgcactacacacatttggctatggatgagaaaaatgtggagttcaagtccatctacataattgcatcttgtcatatttacaacatgcagctgtcgggtctttccatggacctacagtgcatatgaacatggagatataaaaaaaatacaacaaaaatacaagaccaagaagttaccattagagtaatgtggttatagtgcacatgaaaacagtttaatagaaatataggatcaagactcgttgcatgacagcctaaattccatgtgtaagatttagattccaattgatttaagacaagtatcaccataactcaagatgaatacctatttatgacattgacagcctgctcattaattatccacttacaatgaggcggggaagacaggatcacaggaaggagtactgcatccgagcaacaactgtaatggtggaggaatttcctaatgcccaatgatactacacatgaattcttttttccaatttcaataattaattggctaataccatgaacctgcagccatatgaatggagggaaaaataataggagaaattcaagcattaggcaagccccaaaaatatttcaggaaaccaatttttttggaaacttgggtattgcaagaactgaaaaaacagagacactaagaaatgtgttcccttgccttttagtcataacaacaaacatgcatagtggcactatgactggactaaaaaagagagaaagtacattatgtgttttttcaaccctgtattccaacagaatagaagatgagcctattatgtgcagtcatgtatctctacaaattatccttatgaaagccaaatcaattctagtaccataatctaaggaaaagcaagaaagatactgtaatgtgagatcaaatcatacaccctaaagctctgttcatcttttatgtgcttactaaagcaagctaatatatcacccaaaattggatatttgggcacatggtataatatatcacatgataatagaaatattctcttaaatagttagtataatgtatagctttgtattaactgaaaatggaaaacaaacctttccattgtttgtgtatttaaaaaaatcactatatacccctataggaaataaagcagcatataccctctccaaggaaacatgcagtatatacgatttttgcactgcactgaatatcactaaagcaaaatattgttaaaaaggaagcttaacataaacttgtacttacatacataccaacaaaaataagggagaaccagatgtgcattcagtgatggtggcagtgtaggagtctagttctaactgtataagttgcctataggaataatagtaaacatgaacatcacaagaaaaattacctgcttggtggtcaatacaatcaccatcaccaagtccgttttgatctttgtactgtatgaataaactctacataaactatcatgacacactgaatgagaacatgaaaaggaagagaggaaattcgttgtaccttgtagggggtggaacagagaggatgggggccagcttaccccaaccgccaaagaagatgcaacccaactgccaatgctgcatatgtctatgcaattaacccttttctccctaggatctatgaggtttagttaaaattcagtgacaaccagtgatttttaagtctcctgtatacttgcatcagctatcctactattcctaaaaagcttatatacatgtgttaggttataaaagcaagtcggaaattcttaactatgcatcactaaaagtcttctattgttcaagaatcaagataagagaggcataactggatccaaactgaccttggccaaagatcttggtcacaaattttcttaaccaaaacaggggactgagttaagcggaattctcacggttagcaacatcgtgttttcctacaatacaaacatgctaggaaaacacaaaagcaatctctgtggtaaacaatttggcagatctgcaatatgtatatagtgaaatcacaatctgagaatgtactgaagatagaaatctgcaccatgtaaattgctaaaatatattagccaaacaaatgaagcacaaaaaacttaattttgaaagaaatataacataacataacctttacccccagaacctcagtagtgtacctgctcaatcacacttaaggatggagctttatccctgcagcttgattccggttctttgcacatattctgttgccggcgtttgcggccatagaaacggacaaagtgttgatctccccaactttggtccatatcacctgcatagtttatggtcagtataacatttttcgcttttagcgtaagcccacgagaaaaggtctaaaaaatcatctcataataaactttttgaaaattactacaatattaaatgattggcattctaacatctatgattgggctaaaaacggcataactgtagaaggaagcaacaactgacaaacaaatggtcaatatctgaattggcaaatgtgtttagtcagcatatcagtgctgcattgcaggaatgaaaatgttacttccaaaaagcaaataatttcactgtcaaatatgcacatggtaccatgatcttattagagaacacttgccattgcaggcccagcaccatctgccactgcttccgagttccgacctggtcgcctctggctgggatcgattcgtaaccgccagggagagatcggagaggcgatgcggcgtgcgacggcggtggaggtggtctaacttctaagggggagagagcggagcggagatgcggagggaggcgtctgcctgctgccaaggtctcctcctcccgccgccacccggagtcgtgcgacggccagcggaggggagagcggagcagatcacgggcgcgcatggtggatggcgcgacggggctgcacaggagagggagacgaagggagacggcggcggcgggggaggggtcacgggctaagagagaggagaggagagggggaggagatggcgtcggtaggccgcgtcggcggcagaaattacgggcggagcgtttcggtcttttgggagggagaggagaggtgaggtgggagcgatttgggacgtaggatctgagagagataatctggaccgttgagtgatgaatgaaagaatgagtgaaactatttgtttaactataggctagatagactagatagaattatttaataaagcatattgaaacatataaaattagttattatgtaaaaatttagcttcaaaaacttatacggttatagaagtttaaagaagactaccatactactttttctttttatcaggtctacgccttctaatggccagaaaagtattcattatatcttcttcacccactttaaagaaaacatatttgttgtatacttttgaagaagagatgcaatatcttcatctttcttcgtgattcaacaatctataatatagtactacaatttaatattacaatgtacaagagttcaaaaattttaaatctagaaattaaaaaaggtacacaagtggaaaacctaaaattgttggtgcaggcggccagacgtcggcggcagcgcactgcacacaagaaggcagatttccgtgagtatgtgactctatttttcagttttactcggctcgacgacggctcctcgcggcgggggcacacacagcagcagtgcggcgcagtggcagccaaggcggcagactcgcgtgcggtgcagtgtgggcgtgggaggcgcgtcgtgcgtgggccggcgacggcgcggcgtggcgctcgctctaatcgcgtgatcaaatgagattgcattgacgcgtcgtgttacgaggctagggcgaggaggagagagtcgcgcgacacttctgttctgatcaatacacgcgcgtgtgggcggcgggcgccatgaatcaggaagaaataaggatcgctattttccttttttaaaaaaatagtcactattttctttctttttttttaatagtggggtcgatcgtcgtttgtttgccccggaccacctatggtccgccattgaggattcaatctatagtcaatcgaagtaaagagtcttcctggtgataaattacttacttaactcaatggtgctttcatacgcaggagtcattgattcaaatccaatagtaggtaggttggtagaaaaattactagatagcattggccctacttcgcttcgctatctaataactttttctacccctcttctctttttctttgtatcaactaaactgttgggttgtttttaattagatggggaatccaattaatagcctcgactcgtatcctagctcgtctgagagctagcttcgcttcaaccaattttttcgtaccctcagctctactcacgttagcttcggctattccaggaatacgtaacctattttactgctgattatgtgtaaactgcttctggcgacggacggtactatctattctgtcaaaaaagttcaatagtagttttttaagcaaatcatgcaatggtttttcatttcatccattgacgtgttgatcacttaaaagttagttctcggaaggagatggactaatcaccttatctcttctttctataaagttaatgcccactaaacacctaaaatttatcatacaaacatactctctccgtctccgttttttaatagatgacgccgttgacttttaaacatatgtttgaccattcgtcttatttaaaaaaatttatgtaaatgtatatatataaatcatgcttaaaatactttaagtgataaaacaacttacaataaaataaattataattacgtaaattttttggataagacgaatggtcaaacgtgtgataaaaagtcaacagtgtcatctattaaaaaacagaggtagtagtatttattagtactcctaaggctgtgttcgggagacaaggttcctaatcttgccttccaacacgaaaaacaaagcccacgcgagattaattaagtattagctaaaaaaacttaaaaaatagattaatatgattttctaaagcaactttcatataaaaaactttttaaaaaaagcatgttcatgtaagcatagagtaaaacaagggaagtgaattaggaaagagggaaaatgaacacagcctaaagtctacatgcaagcatgccacatcaatccatttagcacacaaagctcaacatgtaagcatagagtaattatacctacaatttatttcattataaaactcaacataacatgctaaatcatcattctcaaatcattttcataatatttcaatacaaatcatttcatcatttctccaatatttaatatatatcccatagcaaagtacaaggtatcatctaatattttattatttgtgtggtatttgtgcgaactttacgagtctcggggtctgccttgtgcacccaagcagcgacaagtacatcctctaattagagagcaggtacaatagaagactataagctagctacaaacatatatcgataagataaaataggagagagaagcagcggactatagatctatagccagctacagcacgggcttcaagatataatgtgtgtataacatatgagaccatgtattaataatatagtatatgtttataggtaactattgtatgaattggctattaaattggatatagatgatttgaagccattagttggctatactattaaacttgctcttaactaatgcaaaattttcatgtaatcttcataagctgctaggttttgttgataggattatttgtagtatcttctgatattgtgtaggtaatgccgattgaaaaaaaaaaaagatgaagttgtatccatagctaatatctatatgttcctttagtggcatgttgggatcgtgggaaaattgcatgagaaaatgcatagtacggcaatcactgctactccctctggtttaaaattttttacgttttaaacaatgttaatattttctaacgtttcaaacaaaggcactagtctccaaaggatatatttagctacaattttctattataacctatacaataaataaaaaatatttatttttattgtagtacttttcaaaactaattaatctatatatgttgttctagtgcctttaactaaattaaataaatagttttatatagttttatagtaattgatagtcaaagttcaaaatattcgatctcaagctttttcagagcgtccagagaatattgataacgtaagtagtacatgccacttggatctcagcatagaatgaagcgtgtctgtcaggttggcttcaccgccaccactacatactttttaagtagtaaagataaagatgctaagatttgtgcactgtgaaagttttgtatgtagttttgggtttttttgattgtttgccgagataaaaatattgtttctttccttgtaaccgaaaatcccttttataaatgtaatctatttccatatatttcacccatgtacggctcggtccccaccaccgtaaaaagctaggtcgtgtagtcgtcgtcgtcctctcgtcgaaaggttggtgggcatggacctctcctcgtcgttggcggcggcggcgtcggcgtcggcggcgtcaccgtcgttggccaaggcggtggacacctacagaaaggcggtcggcacggcggccacgctgacggcctacaccgtgctggcgcgtggcatggcgagggagctcgtgccgcacgacctgcgcgcggcggtggcatgggcggcgtcgctcgtccgcgcccgcttcgagccccgccccgcggagcgccgcaccgtcatcatccggcgacggcgacccgtacggccgcggccacgagaaccgcgtcttcgctgacgcccactcgtacctcgccaccaagatcgacccccggtccatgacccggttctgcctcagcggcggcgcctcaggcggcgagcgacgcgcgcggagcagcgtcgtgatctccatggttcccggcgactcgatgaccgacgtgttcgagggcgtggagttcacgtggacctccgttcccggcgagggcgggggcggcggcgggagatcgaacggcggcggcacggcggcggagtcggactcgagggagctcagcttcgacgcggagcacacggacacggcgctcgacaggtacgtgcccttcatcagggacgaggtggagcgggcgcggcggcgcgaccgcgagctggagatcagcatgaacgagggctcgtcgtggaacggcatcgtgcaccaccacccggccacgttcgacacggtcgccatggatccggccctcaagaagcagttcgattttaataaaagtcaaaacatcttgttaaccttaaacgaggaagtaccttataaatgacatgtgaaaacgaaaggatatccacttgagggatgaatagtgtttcccatgccaatgaggcaacgacgtttgttgtttgtgagtccaggagaaggagaagctgacgctgtccgggctgctcaacttcatcgacgggctgtggtcgacgagcggcgaggagagggtcatcgtcttcaccaccaactacagggagcgcctcgacccggcgctgctccggccggggcggatggacaagcacgtctacatgggccactgcggctgggacgccttcacgacgctcgcccgcaactacttcctcgtcgacgaccacccgctgttcccggagatccggcggctcatctcccaggccgaggtgacgccggcggaggtgtccgagatgctgctgcgcagcgaggacgccggcgccgcgctcgccggcctcgcggagttcctcgaggtgaagaagaagaagatgaatcaggccgccgtgtgaatgtgaaggcgagtagcgtcgtcgttgcatcaagaacagtcggatgattcagttcttttgctcctaatttcatgtgaaccgtcactgctttctgaatctctgattgttctggttctctcctagctagttaggaactaatttgggatgattgatttttgtttcaaacaaatttcggttagttgattggtttcacaatttttttgggtgattattgtattcgtgattggataatctgtcctccacttgggttatgtagagtgcacaaactgattcagatttaagtatgttatccattatgcagaggaacaagttagctaagaacaccaattggtcctagcttgtttcctcttctgttctttcacttgagagcatcatgtttcaattatgatcatttttagtggtgatattcttcagggacaagtattataatctcgtagttcgtattcgttgtatcttaggttcagggtaggtaagtgtagatgttaggtgggtagatgaattggggtgctcgatgggagagtgaggcctgccgccccgctttcttgattaccttcaaatgactgtcccaatgctagtaacaaccctacgtaatactccttccgtctcaaaatataacaacttctagcgtttaaaatttgtcctagaatataataacttcttcacatatattctcttctcaaccaatcacaatcttccacctttcaaattctccatcaactttttttttcccaaccaatcacaactttcttccatttcattctacttactttcttaaatattaatacccgtgtataaacctaaaactctagttggcgcgtgcgtggctccggcgcacgttttctgggactaaaagttagttaactaatcaattagttttagataattacagtatgacataatgacattagtaattaggatttttcttttttccacgagatttttttacctaacaaattgaaaagaaatcaatatctgaagtctaattttcaaattttaaatccagatttgaaaattttaactcaaaatttgaattttttaagtcaaattttgaaaactttcaactttccatctcaaatttgaaaaactttcaactcaactttgaaaactttgaacccagatttgaaaactttcaactcgagatttgaacactttcaacttagatttaaaaacttttcaactcgagatttgaaaatgttcaaatcgagatttgaaaactttcaaatcagatttgaaaatttttaagtcaagatttaaaatctttcaactcaggatttgaaactttcagctcgaatttgaaaactttcatatcaaaattcaaaacatttctcttacatttaaaaaacattcaaactaaaaatttaaaacttctaactacaattttaaaaacttttgactccaaatttgagttgaatcacgtgcctagattacaaaagttcaccaaaaaatcaccaaaaagatgttgggaaaagagaaaatcatgcgcatatggaaaaaatcgtaaaaaaaaaaaagcctaaaagtcgcaagtgggcaacgcgcgcgagatagccaactaacgcgtctgcgcgaattagttttttcggcttggagtaatggagttggatgcatatgctgcagatgcactacagtgggaatgcaaaaccgcaagcaaaaaaaaatgaacgccgttgccggggatcgaacccgggtcacccgcgtgacaggcgggaatactcaccactatactacaacgacttgcgtgtcccctcgttatacagtactttacttctccgcagtccacacgaagacgattgttcgattgttgtagccattccaggcaatcctaacatggttgctgctaaaacgtttcagcaaaataacctccattttttttttgtcatcacaaatggcgacaaacatatgctctccacttttttttcgcaggtagaactacaattgatcttcaatggacatcttaaacacttgttgatcattttataaataaattgattaactaggccattaattgagggttttcgttagttggccacggacatagcaaaagcattttctatttttttaaacaaacaaaactcaaattactatatgtatatttacaattaaatttattatttttgttacaacttatagaagttgaatttgaactggcatgtttatagagtgatatattacatattaatctatcttgtcattttttaaaaaaaaattcgtaatcatctagttgatatgcaataagcgaatgaacgttcactcgagctattagaatccatctccggattttaaaggatgtttgcacgacttgaactaaatcttgtgaacacgctataaaatacttgtataatagcctaataaaaaatcatacatatata

SEQ ID NO: 66888 - DNA, 508 bp, Oryza sativa
gccgaactggcaaaggggggcctgcgcggtctcccggtgaggagccacgagctccgtcaactttacacatagatggttctttctccataatacttctttgaacactaagatattgttctattatgaatagtgcagattccatgtgcaataccagtatttatcaatcatgattacgataagaccatcacactctaatcatatgttatacaagtataagaataatggagcaaagtgcatgctaattgctgctggagagcttttttttttctattccctctattttatattactgagtttatcctaagttaaacaaatttgtagaaaaatgtactaatatgcacaacatcaaattagtttcattaaatttgtcatcaagtatgtttttttattttatgttaaaaatgttattaattttttatataaacttaatcaaacatgagtaggattgacgcaaagttaaagtgactttgccctcagtcaaacttttttttagaaaaatgtactattc

SEQ ID NO: 66889 - DNA, 863 bp, Oryza sativa
aaaaaatttatatatagaaatactatatataaaaaaatatttgaattcaaattcaaatttgaatcaggtatgtaaacttttggcttataaactttgggtctataaacttaggtgtataaacattagatgtatagacatactatatatagaaaatatttgaattcaaattcaaatttgaatcagatataattcaaattcaaatttaaaccgggtatgtaaacttttgacttataaactttaggtctataaactttaggtgtataaactttagatgcataaaaatactatatatagaaaatatttgaattcaaattcaaatttgaaacgggtatgtaaacttttgacttataaactttgggtctataaactttaggtgtataaactttagttgtatagaaataatatatagaaaaaatttgaattcaaattcaaatttgaatcggatatataaactttgggcctttaaactttatatgcgtaaacttgagatgtataaactttaggtgcataaatttactaaaatataaaagaaatatggtgcaaaaaaaaaaaccaggtaaagggaggtaaagggagggggagacccgatccgatcgcccccggcggcccccggcgatcaatcgcccaataggagtttcgatccaatacccccctcttgttgctgacgtgtcacggcgcaatggtcaatgggtttggaggtcaataggggacagagctcgctatccatcccgaatcccaattccctactcccaaatcccaacctcccattcatcgggtcgtgtcgccgccgacgaacaacacggcgagcggcgccggtggcgagctacctaccctccatctctccagatcccttccaggtgaga

SEQ ID NO: 66890 - DNA, 3889 bp, Oryza sativa
  unsure (1)..(3889): unsure at all n locations
ccacgtcattttcgccgccctctgggagggcgatttttaaaaatcgccctcccaaagggcggtaggcgactatttccgttaattttcaaaatggaaaattatttttgtaaaacttttaataaaaaaaattataaataaaaaaaattcggcagtgtttgctatgatgcggcccagtggagtaagcaagagatatcttagtgggctctccttcagtccttcccggcctttcatgggctcccgtcccgttagtgcgagatggaccgagttctaatcggtgggctttcctactgctcgtgggcctaaaacgacaagagggagagagcggtacgatgcggagtcgaccaatattttcagtgtattgtaggggggcgcctagctcgcgcatacgcgcttccccacctaaccacctatattagtattatattagtattagttaacactacttaacactaataacagtaattaggaaagattttagagatttttttgagatatttttactaacagattgaaaatttttcaagttagattaagaaactttcgatttaagatttaaattttaaagtcaaattttgaagatatttaactcagatttaaaaactttcaactcagattcgaaaactttcaagtacagattngaaagttttgaaaagtttcaactcgagatttgaaaactttcaactcgattcgaaaacttcaaagtccagatttgaaacttttgaaactttcaacttgagatttgaaaattttcatgtctaaatttgaaaattttaaagttaaaatttaaaaattactagtaaaccaaccactagtaaaaatatgaagctaatctaaactaattatatttttttcttttatccgtacgacagggaccatatacggcgaaaaaaaagaaacagcggcgtaaaaaaaagaaaaaaaagagagaagcgcaaaagcatgcgcgtgcatgggcctcgtgggccggcgtgcgcgccagcaacgcgcgcgcggattagcctttccgacgcatgaatctgaacttatgctactaccacgaatttagatatagctcatgttcagattcatcgtattaagatatatcttatattctactagatttatttttacggggatattctactttattgttatattataagacggagcgagtattttagattgcattatcgccgtgtgatgacaaatcagggcgttgctcatgtcgactataggaggaccaacacaaccgcacatcaaaaagatcgaccggctagctactgctccctcatgcatgttttttttcaacgcttggaacctacaaactgcctctcttgtggcattgacgtgctaccttatgatagaatattaatttcattgatcaatattggcaaggattaaaatgcattatagggtagcttcgtcttcccatgtactcctttttgtttaaaaatatactccgtaataattttggctagattcatatccaatatttgtatatgtatatgctcgctcgaaaaaggcaaaaagcacgcacacgcgaaaaggtatagacctgcacgtgatgtccagcgagaagcgatcgaattagcgcacgtatgtacgtacgtatacacatacgctggcctgtctttctcctgtctgtcttatactacctactccctccgtcccagaaaaaggcaaaccctgggtttacgtgtccaactttgactgtccgtcttatataaattttttttataattcgtatttttattattgttagatgataaaacatgatcaatattttatgcgtgacttgtctttttaatttttttcataatttttttaaataagacggacggtcaaatattaggcacggaaaccagagtttatcttttttttgacagagggagtacctaccagcctgcacaatcgaaccgtagatgcgtacatatatacgtgtattgtcctggatactatatatactagtgtgcgtatatgtaggcaggccagagaccagagcaggtgcacatcatataatagtacactcatctttagcttcatacagtatttgccaaaacgacaaaaccacacattccgacattatattccacctagtttagtagctcgatacactttattctgttatgttctatactattttgcaaacaatatgtgtttgttagcatatatagatggatacatgttaattattccacttaacaatgtgtgtgtgtgagagagagagagaggggtagcgtactagatgttgtaatcaagttagttggttaaccacttaacaactcaatagatcgccatacacatacccatcgtcacgatcgaattagttggtgtaaatcaatcgatcgatcgaccgagtgagatatatgcatgcatgatgttgaattgttgacgactaccgatcgatcgaccggccaaatgattaattattttctgtgcctatatatctgtctggttgtttttctttaattttactgcattatatgtgtcactctctgcagatcgagctctctagctacacgttacatcctgcaaccgctctccaactaacacactacacctgcatgctgatgctgggttaataattttggcttcttgtcgattactaaatcttaattagtgaccatcgatcacttctaaatcaagcagctatatatctagctacattggattaatattttcgaatgatccatctcacgaatgtacgcccagtgacgaccatgtctattgattttaaaaataataataatagaaactttcattgaattagaataactacatcaagtttaatcacgagtttggtattatatatactgatactacccatcgtttcacttattcaggaaataaaccaaacagcatatttgcaaatggaatataatttatgaataaaacttttatatacgtgcgtgttcttaactagtataaaaaaaaaggatgaaaaataattttcgatgataaaaacctcaaattaactttaaatttaaagttgaaaattcaaattttgttcaaggaaagttccggccgccaagcagaactgaccgacctcctacttgccggctgaaaatttgactttgtacttctcttctatgaccaataattgattaaagagtgagagaaaataaaatggcatactgttccattcaactgggaattaattgtgcagcgattagttgacaggaaaatgacctggcagcacagccatggatgcttaagcttgcatttttaattaattaatgttgcggcatgcatgaagcagctagcgatggatcacgatcacatcgatcgttttgatctactcatcgtggcaacataatggacaggtttttgcttcatctgctgttgctcgaaacttcacaaaaaagagaggtaaaaaggttattcagaaagtgaaaaaagtgacataaagcagagtggaaggaaggtgcagaccgtgttctttacagaagaataattgtaaaggaaaaagtatgaggtaattaagtcacttgacagtgaaattaggagaaatcagcaactagctagctagcatccagctgtacttaacctagatttagctagacctttatatccttttgctttaacagtagatcattaaaagaactccaattgataagttaattctagaagagattttagctttgcgtgatcgatcgatcgatcgatggagagtatagtagattagtagttggtggtcatgcgtgatgcatatatacttgtctgcacatgcttgcccagttgcccctgttcgaatttcatttcatattcgcctctcatcaactgtaaataattcagaagctggttgttcaaaccgtataataatatattctcccaactaattgcacgtatgcgtgctcacgagctgaacaatacgttactgctcagtccatccccttcacagaatggagtt

SEQ ID NO: 66891 - DNA, 845 bp, Oryza sativa
tactaccacggggtttcatgctagcaaacaatcatccgggaggaatcttgtcaagagacgataagcaattataggattggagggtgaacatacagaggataaaagaagaaagatagaagtagggtaagaagatatatacatgtaggcatagtatattggttttggtaatggattgtttgttgttttatttggttgtttgttgttttatttggccttcggctgtttatatttatcagagagatcatcttgcatgaacaaagctcctcaaaatatcttattaggcttagagatgtattaggactctacaaaccctaaccctaagcaaggaaacataaaaaacgtaagtaaatttgactttgacttaggattatcgtttagatcgatcggtcatgacctccagtagagtctccgatcagaataaccagggttttattagaccgacaagaggcctaatcatacgcgtttgctaattggcatgtatgtgttgaattttttttatttttaattcttctattaaaagttttacaaaaataattttctatttcgaaaattgacagaagtagtcacccgccgtctcccaaagggcggcgaatgtgacgtggcagacggccgttcgctctcgggtgacggccgtcaatgaaatttgcaggcggcccccttgccgccctccgctagggcgattttacactgtgcggggggccgcctacaaatgggcgtttagggggggcatggaaatttgcaggcggcccccttgccgccctgggggagggcgatttttgcctcccccctatataaccctgtcccctctctctgaaatttcattataatctctaaaaatccaaaaa

SEQ ID NO: 66892 - DNA, 3816 bp, Oryza sativa
  unsure (1)..(3816): unsure at all n locations
aatgctagaaagtcttataatatgaaacggaggaagtacaaatttagttatgcttaatgtttctatatacgttatctctaacctttatccctccatgcagatgaggataatgatgtatatgctgaccatgtggacattctcttcgttcaggatgaggtacatgtatgaaccgatgaaacaggtattcctatgagagcaactatactttacgaaatgacataaatccaaacaacacgttttaatttaaattttgcatattatgaaccgttgacatggcacaccaccaagatgcacatgaaaaatattaggagaagaaaatatttatcagatgaacagcgacaagatatttatgaagctttacttgcaaaaagtatcaatggcaaaatagaaaggaacgcgacaaccatcgttgcaaatttgttcaatgttagaagaagggttgtccaggatttgtggacaaaagtgaagaaatgccaagcagcaggtatcaaagttgacattacatcaaaaaagtccaagaaatgtggctggaaaagggttgatagagattggtcacaggctgcaacaattccattgaaccagcggacaactattagagatcttgcctcagctttgaatgttccaaaatccacagtgcatagagctttcaaagaaggcatccttcttcgtcactcaaacacactgaagccttttctcaaagatgcaaataagaagctttgcctgcaattttgtgtgtccatgctggacatgcaaacagtacatactcaacccacttttgatgacatgcgcaacgttgtgcacatagatgagaagtggttcaacaacactaaaattgctagggaggttttacttgtatggtggagaggatgaaccggtgaggttagttcaaaataaacaagcaatagacaaagtcatgtttttagcagcacttgcaaggcctagatatcatgcgaatagaaattgctactttgatggcaatctaggtatatggcccttcgttaagaaggtgagggaatctatttgctctatttgtgttggtttgaaatcattttgaaactaactttccatttcatcaatgtcgtaggagccatcacagaggagtagctagaacagaccgagggttactttgatcacaaaatctttgacaatttccagggatacaagtagagctttcttgattacgaaagtgattccagctattgtctcatgttggcctcaagaagatattgggcagaccatatggatataacaggacaatgcacgaacacatattgcagtagacgaccctgcatttgcccttgcggttgcccaaacatgactagacatatgaataaaaaattagcccctaaaatcccctgatatgaatgtgcttgacctcggatttttattttctcttcaatgcaaaacattcctaaagaattctaaatccatggaagagattatagaaaacgtgcaaaaggagtacagtgagtatgacgaagatttggttaatcgggttttcttaaccctacaatcttgcttcatagaagtcatcaaagttgatggaggcaacgggtacaagatacaccatatgaacaaggatcgcttacaaaggcttggcatgctccctactagtcttacttgtgaacttgaactttatcaaagtgctatgcagtctttaagttaagcgaatagtagttggaacaatggttgtttagaaaggctattttattttattgtgatgcagcctttttgtacatagagttgtattatattttgcaagtactgtatgcaaaatataagaaaatacatgcttaccctaccaaccggcaactctctctctctcgtcgctgcatcccgtcgctttctctcttcctctcatgcctgtcgagttctctcccaccaccatcgccgctgctatgcgttttctcctcaccgcctcgatcgtgaggctccatgccgacctaagacggacacagtgtcacccacacgaaggcgtttaccacccgattctggtgctcgatattaattccagtgtactttttatgtgtcatttgtttatcctctctgatgcaccagacccaacatcaattattgttgttacaaaatcttgcaaactagttacctctacatatcaattattattgttacaaaatcttgcaaaccagttacctctatgtagtataaaataattgctcggtgtataaatgattgcttacagtgtgactaaaatttacaacatatcctaatacctcttgtattttgaaacctcctgcaagggcatactaatgaagcataaatactaccagctttgttttttctagctcattaagttggttcataactataataattggtcatatgcatcatatgcatattgatgtgttgtacatatcattgcatggctaagaccctgtttagatggagctaaaattttttagtccctgttacatcggatatttggatgataatttggagtattgaacatagactaattacaaaacacattccataaccttagactaattcatgaaacaaatctattgagcctaattaattcatgattagcctatgtgatgctacagcaaacatttgctaattatagattaattaggcttaaaaaattcgtctcgtgaattagttctcatttatacacttagttttattattagtctatatttaatactccaaattagtgtccaaacatccgatatgatagggactaaagtttagcccctggatccaaacaccacctaagcttatcatactactctaggcattaagtttggttatctagaattcaacattgaactctctctctctatctttagtaatgtaaaataaaaaaaacagaatgagtatatgcatgtcctaccaccaatcctgacactatttaaggaattatttagctccattattctctcttttagttttcatgacacatgagtcataatattggtcacaagtgacatgtatgactttacgttgtaacgctaatacacagctgtcaacttcatatactcctataaacgaaacggtgtgaaagcgtgtcaactagtcatctccatccagacatcattagtaagaagctaaatattctcgtgcaaaaattcgaatacatatttatcacatttaatcttatatagtataatggtttgcttcttatttcctcaatacgctaaaattatatttgtgtaataaaagttcattgaaaaatatattaactatttttttataaaaaaagtatttgctaacanccaaaactattgagttttgacacatccattctcataaaacgagctaaaaaaatattaagttaaaatcatagcataatactaacaaggcaacaccaatatttattgattgagcataaggtgagatgctgtttttttttctttttttaacaaaaaaacgagtaaggttcactataaccaacctaacacgacaagaaaaacaagataaaaaactttaaaaaataaaaatgctgcaaggagcatacatagcaattagtacatgttgatgcattgaaggcacttcgtgcgatcagatattaagcataacgagcaaaacataatatagtatcacaccacaaggtaatcttaaagctatagttaatttgttttgttgtagtagcaccaaaatatgattatactagtttcatactacaatatcaagttgacaactagtagtaaccgattctatacaacaaactctatttcaatacacaattaagcatggatatgccaatttagggagaagaagagaggaattacggattcgacaatgcgttggattgaggcccttagggctaatatgtagtaattacgagaatatcat

SEQ ID NO: 66893 - DNA, 4103 bp, Oryza sativa
ggtgggaatggagaggtgcgccgaccttctccccaccgttccatggcgcgccatcgcctcacgggccgccgaaggcggaggagctcgggcgccgcccggtgacgctgcgtggggcggcggcggccgccgcgtccattggcgtcagcggcggaagggacgaggccctgccggctgcggcccgcgaggcgatggcgctgggcacgctcctccgcccgcgaggcgatgacctgaacgccgcggagggagggggccgtggcggtggcggtggcggtggccggaacagatcgacccgggcgataaaaggggatcggcgataacagggagtcgccgaggatgccgaggtcgacgtcgacgtcgtccgcggcggagggcggtcgccactccctctcccgctggccgccgtcagctgcgcacctctccctccgtccgtcgccatcaagtccccgcccatggctctcggccatcgccggcctccctgcgtcctccctccctgcccgcctcgccggtctttgcgcgttgctccctcctctcttgccgccggccgcgcgtcgccgcgcgccgttgtcttctgtggcgcctggagagagcagagatagggagatgaagagagggaggtggggagagaggaggaagaagagggggtgagttggactgacatgtgggacccacgtgggtcccactatttttttattattttctatgtgagactgacatgtgggtcccatgggtcgaattgctacgtaagcgccacgtcggacaaagaccgagtcaaattagccacgtaggcgccacgtcagccaaaaccgctctcaaaaccgccgagggacctaatctgcaccggttttaatagttgagggacccgttgtgtctggttttccgatcgagggacgaaaatcgaattcggtgtaaagttaagggacctcagattaacttattccacatgagcagagatatgggctgagtttctgcccttctctactcaattgcaggtgggcagtgtttgaattttttttatttataattttttttattaaaagttttacaaaaataattttccattttgaaaattaacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgcgagggcgattttctactgtgcggggggccgcctgcaaatgggcggcgagggggggcatggaattttgcaggcggcccccttgccgccctccgctagggcgattttgcactgtgcggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattatttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctataggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttcacaggggaggggctgggctttataggggggaggcaaaaatcgccctcccccagggcggcaagggggccgcctgcaaaattccatgccccctcgccgcccatttgcaggcggccccccgcacagtgcaaaatcgccctagcggagggcggcaagggggccgcctgcaaaattccatgccccccctcgccgcccatttgcaggcggcccccc

SEQ ID NO: 66894 - DNA, 4979 bp, Oryza sativa
cgctaccttgcaccaaaacagacagaccattcataccgtaccataattagttgcagctttgcaggggccatcatcacacaaaagctttaataaaggtactcaaatacaaatcaactataagtctataacttttcctgggtcctttggcctaaagtcaagaatgaaggcccaaaagagcaaaacaacatcacaatgtatttcaacacattgacaaactaaatgtccactagcataaacacaatcaattcaacccacaaaaagataaccaaaacctgcactcgaaaaatatcatattaatcatcttattgagcagtgatcacccagtacaagatagttgtcttttctaaaaagaaagatagcgagaatgaatcgcagcctcacatagagacagatatactgcagttacaattttcccatttcaagcagcaggatcgcaggcagaacacaataaataacccatgcaaaacacaagagtttcatgctgtgaaataaactctgatccgaatctacacaattacaaagcattccagcatttttaattcacaattactcaagagccagatcataagctcacttgctcacctgcttgttgtagatgttgaagtagatgttgaagaggtaccacagcccgaacagcgcgccgagctgcagcgtcttggcgaggccgctttcctcctcctccgccttggcgtccccggccgccgcgccgcacgccacgtggcgcgccctccccctccccgcccggtccggcgagatcggcggcggcggcggcagcagcagcagccgcccaagcgaccgcgccgccacggcggcgggccctcgcgaagaggaggcgatgccggcggcgaggggccgggcatggagcaggatgggacgacagctactgctgccggggcccagctggagcggcggccgcgcggggcacggccggacgaggccgaacgccgccgcggcgctctgcatggcggcgggaggcgagaaggttcccccgggggaaggggaggccggaggttctagaagcttccggagtgcgtggggtggagagcttggaggaggaggaggtggtggcgcggcggggaggtcgagggggaggagaggtgagtgagtggaggggtttggtgggatttagcagggggcgaggtggaaggctgagccgacacttgggcccgcatggcagtgagtgggcggatctaccaaaatatccaagctggctgcggttggtgtctctggcggcttgcagttgcaggaagggggttatggagagagccgattatggagttggtggagggagtttcacttgtactcaaggttccgattcgtatccattattttaccatgtttcgatcctaccaaattaaaacgatatcgatccacttagtattctaatttttaatagtatctcgatccaactattcattactacacgatcctacgaaatcttaggtggtatcccgattctacgatccctacgatactataaaatattatttgaaatagcatgatttgaaaataatgtaaataaatatgcccaagtttatataaaaatcagttaaatatatcaaaaccaatgtggtttctcttgataaatgtctcgatttgtatgacattgtcggagggtgtactcctccaccagggaaccgaaaggcctatcttttttagttcggccggggacggtgattgtagattgagaggttcgctgtcaagtgtgaagaagagggggtgcgacccctcgggggaaaggcaaccgtggtttatacaagttcgggccgctgagaagcgtaataccctactcatgtgctatgcttattgagagggagagattacaagatctccttgttggagtagaaggtgttgatgatgaggggcaagagactgtgctagtcaaaatggatcatccctccctcagtaggccaggacctccttttatactccatttgtccctaaatatttgacgccgttaacttttctaaacatgtttgaccgttcgtcttattcaaaaacttttttgaaatatgtaaaactatatgtatatataaaagtatatttaacaatgaatcaaatgataggaaaagaattcataatttcttaaattttttgaataaaacgaacgctcaaacattttaaaaaaagtcaatggcgtcaaatatttagagacggaggggttaccacaggggtccaccgagcctaactagggaggataatcatactaagctcgcgtctcgttgcttgacttggaaggcacttgcatgccttgctatagcgtggggcccatcaaatccatccgcctaacacgggggatgcgcccgtcacttggcatttaatgaatgaggaggtcctcattcgtaccgggaagtgggaaccctgccctaaacgggttaggcaaaccgtatccggccctgacatggcaggcgcactactctagccacgtcaatcatcggtcacagaccggtctgacgaaccacgccgcattaaatgttgcgcgcggagcgctcgctcagaccgtcttaaatgttgttaggtgggtgctaggagcgcccgtctggcgcggcacacttggcgccacgcggagggggtgacccgaccccgggacgtgtggggaacggccgccgtcctgcctcgggccgaacccccttgggggaaggccacgcggctaccgggggcaggcccttcctcacagcctgggtaacccccgggcccatatcactagcagacatatattattaccacatttttatatagaatggctatacgtaattaacataaatattaactaaacttgaaaaaaaaaaagaaaatctcatagtatcccgatactacgatacgatactactttgagcaaaacgatactacataggataccgatcttgacaatcttgcttaaactttctccgtcccacaatataggagattattcccattttagcagaaattaaggtgatgaccaaaagactcatataaccctgaaaaaggtactaatgcagtgaaaaacagactaatagaatgtattcttgcagtaatcaaagcactgcaaaagatacatattgagaataaacttatacttcaattaatgagaatgccagacacatctctagcaatgtcagacttatctcaagcgtgagatttaattgcctccactattaggcaatttttgccgcaatttacacaaaccctgatttaaacatacaaatttgaatcaaaaggttataaatactcccttgcctctttgctctaaactttccctcccagcctcttattcccattctcacaatattgccagcaacccaattgaatctcatcatgcacatccaccaatccatgccaatcgatcttaattcatctccaatagaagtggaggaagatgaacttccttacttcaatcaagaatttaccatacaagttgtaggagatgtagaagtccctgttgtgcatcaagacgatgttgctatagaactccgagctgtgcaacgagaagatatttgtcgaaacaagatttcggcaatacaaaaaggggtggctatcaaaaaggaaaagtggatgggtttgaagacaatgaattttatataggtttaggcctcctcgatgagaagtaataccctacttctgtccgggattgatctgccgagtgtgttattgataatatgatctgggataaaagttatgccccaagaggcaaccggacccctccttatatagtggaaggagtccgtattacaaaatacatcccatattcctaacagaataggtgagtaaagataaaatacaatcgtagccgactaggaccctgggtatttccttgatacacaagttagaaatttaactcgagtcccttaaagatatttcatctacatatggtaccccaatacccagtcagatatacatgccgtgtgggtatggggtatccataatctccacaatattgttatagaagcccctgttgtgggtcaagaagatgttgctgtccaggaggaggtcgaccactacccttttgacctgaacatggacacaggtatgtcagtttgcatacattacatgtgaagtttcagccactttgacctactcttcatctccctgctcccattcacattagcaccaatacaattgcatctgctactacagcacacccactaatccatgtcatcctatttcagtgccaacagaggaagatgaagaaattcctgacctcaaccaacctgttgccattgaagaagaccaagtccattgtgtgcatcaagatgatgttgtccaagaagaggaaaatcaaggcgatttccttctcaacttgatggcaggcatgtcatcttcttatttcaaaagttatatactccctattggagtttatagcaacataaaacagtcaaatgaatgacataggaagaaaaatagaatatggttaaggaaatgtactcactgcactgatgtgaagatagatggttattctatacttgcaatgcaagagttgtcctgaactcaaagtgagctgcaatgagtttaaaacgagctgcaaatatatctggccaggattgattcccatttgtcagtgtgttgatcctacacagaagaaaaataatattaggattgcgattagtactagcaagttcaagctgttcatcattagtgtattactgtactacacattaccctcaatatgacagtaggaaacatatacatgtatccataaattagaaattaaaaatttcattgaagtgttaccttgctagcttgatgttcaaaatccatcatttaatctactcataccttcaataatgtcattaagtaggagtagcaaatttacatatatatatatatatatatatatatatcgtcaattataaaactaatttcactagactttttggcacagaacactacagttggagtaacacactgcaaaaaaaaaaagctcataagtcaaattaattatgaagggattgctaattatactactacctccatttcaggttataagactttctagcatt

SEQ ID NO: 66895 - DNA, 27739 bp, Oryza sativa
ggccttgcgcttgctggtgtagcgcggggagcagaagaagtaccagacgctgccgctcccatgggttcccggcgccggtctgtgctcgccgacgagctccgtcggatcgtcggagtagacgtcggcgtggttgatgaggcggtgctcgaaggggatcttggcgatcttggggcggaggaagagggtgatgaggccgtcgtcggaagggcgaaaagcgtagcctggctccagagcgatctcgtcgtcgtccatggcgatcgatgagatgaactggatgaggaggtgaatcgatctggggaaggagagctgaggatgaggattgaggagtagggatcgatggaaccccttttatcgtcggcgcaacgcgcgatcgaatcgtagtcggaatccgatcgggacaagaagaactttcgcgcgcaaattaaataaccgttttttggcgggaatcaaacgagcggtcgagatggggcgtcagattgcaagatcaacgaacgacgagcgagcaaatgcgtcagacacagtacacagtacagcgaatgctctagcttcaggtgttgaaacttgtagacgcacgagtctccttgtggacacgctcacagctgcatttgtatgcaactctgacccatgtgttcatagttagctcgatcgatccgtctggaggacccattcgagggaggtcggggcatggtttagcgtatcgtttggaccggggttatcgtcaccccgcggtagcatgataaccacgataatcatctaaaatcgcacaaaaatcacatccaaaaattcgaattcaaaactcggcggttttgcagtttcaccgtgataatcgcacggtttatcgcaataaccacgatattcgcacggatatcgtgggttgtgtagctgaaatcatataaatgaaaaataaatagggaaaaaatacggttgaatatgtgtagaaaactagaaattgagaataattggaagaatatgtaggatacttaaggcccaatattgtcttcctttttccaatttgtaaaccttttcagttttgccttgaatttagcttactctattttaaaaaatttcttcaccattggcaattacaaatcaagaactatatccatgattttttttccggaatcttaaatttggtcaaaattcatccaaaccatattgccggtttctcttaccgtacccccgcggtaagcgcgataaccgcgataatcacgcgattatcgcgcgataagtgaaaccctgggtcggggattaaaaatccgactccctttcacctcttctctaatcacgctatgtattttgttgtcggcccattgagccaggtcgcgtggcggtgactaaatggaccgaatcagaggtctagccatgcagcatcgcacattcacatgatgtgcgatgctgcttggatatgcctataattcggcctcaagtctatctatgaataggttcactttaggttccttgtcttagttcgatattcgtcctcaaatcgtagaacaagatacaacacatatctcaactcataaaaccggtgtatgatatataggtcccatgattatatagcaactggtttcatcggacgtgacaattgattagagctatatatgacaatgaccatcccaccacaatattttttctcattccgagaagtgactattacccattgaaatggaacctaaccacaagagtgtccaacatatccataaccgaatacatcacctagcctgcatgcactacagaacaaagaatcaattatctccattttaaactccctaaattcagatcccaaccacgatcctcccacccactatccaatataatagctcccaaattgagcagatccaacaatgttctaactaaaaaagtactcctatgtactaaacaacaccaaaattgagagaatcatcgcatcgcataatacaaaaaagagaatagtaatggcatttctaaaccataaaatttataatggcatagatccaattaaacctaaaaaagaacaccatataccacgactacatttttttaacgactcgcataagacagtacggagtttatattgatagcagaaaaaaaaaacaatatcacaaccctggaaagattgtaactaggagaaacaaaaacaaacataccgacaccacgagttggcaactcctcacacaataccctggagaagacactattaccaagccgaccaccgctaagcgtgaccaattgccactaggccaacaaggggtttacaaacgcctcgccaaaacacctgcttaactccgaaagacaactgcttttactgtaaaagaacaccatgccacaactgtttttaatggatcaatattttctatgatcaataatagttctcgtgtcatggtgaaatcctgcttgatcagcagctgcgtcctcctccgttctccaagctgttcatcttctccaaatctctcatgaactcatcaaatgcaatctcagaagacccacctccgttgatggcatccagcgccatgtctctcgtctccaccaccctctccctgagcttcctcccttcctcggtctccatcaccagcctcaccttcgcctccacctcctccgccgccaccgccaccaacgcgccacccacctcgccgccgtcgagcgccacggcgaccttcatctcctccaccatgagcaccctgttcatcgcctgctccgcgtaaagcggccagcaaatcatcggcagcgccgacatgatcgcctccagcgtcgagttccacccgcagtgcgtcacgaacgcgccggccgcctcgtgccgcaccacctccgcctgtggcgcccagttcttgaccaccatgccgcgatgcttcgtcctctccaagaaccccgccggcagcagccgctccaggtcaggctccggcgatgtgctctgctcctccggcgggctcctcactgcccacaggaaacggtggccggagttctccagcccacgagctatgtccttcagctgcgccgccgggaacgcgcccttgctgccgaagcagaggaacacgacactctggcgcggctgcgcgtccagccacgcgaggcacgggtgtctctcgccgttcttgccggcggcggcgtcgaccagtggcccgatgcagtagaccctcggcgtgggcttgtcgggaacgcagacgccggcggcgagcgcgttcagggccttgggctccagccgatcgaagctgttcacgagcacgcccttcgcctccgccatccgcttgaactggtacagccggaccttggtcgcgtcgctctccttgtcctgcaccgtcgccaccatgtcgacggcgcggagcggcggcatgccggggaggcggacgagcgccatgcccatctccctgaacgacggcacgtcggggtagtaatacgggaggtggagcaaggcggcgagggcgctggcaccggaggggaagaagaagtaggcggggatggcgagctcggccgcgacgtcgagcgcgtcgacgcagaacgcgtcgagcaggagggcgtcggcggcgtcgggcagcgagcggaggaactcccggagcacggggttggccaggcggagcgcgtcgagggcgcgcctggccgggtgcgcggcggcgtccgggctgggcggcgccggcaggaggcggaacgtgatggacgggttggccgcggcgaggcgcgccgtcgcgtcggccgaggtggcgtcgttgtcgggcgggtcgatcaccgcgacgacgacggcgaggccgcggcggcgcaggtgcttggccatctccaccatggggttgaggtggccgacgccaagagacgggaacaacacaaacgtctttgtcctcatggctccgatcgatcaaaagggatgcgaaaatacgggaacaaatgctcataaatatagtgagagtgagagcggcgttgaatggtaagtaaccccatttcttggcaaaaaagccatgggaagaaagtttgacacgccataaggttatataaatattgctgtaccagaaaatttttccacatgagcttttatttaagttttggaggaattaattcaaaggatttttttctcagaagtctaatctaccatcacttgagtgagtcagcagttgagtgggctggtagacgaggaaggaaggtatatcaggtagtatcaggtagctcgcgtgtcacgttacggccgttctcgtcagcaatgactagaacactttgcgagtttttatttttttttaaaaaaaaggacgcgaatagtcgggcttttttttttaaaacattgtccgagcatatacagatcgcacgcaggatgccgaatagtcggtctttttttaatggcttctactgtatccgtcctataaggctataagtgaacttttaacctctaaagttctccacggagattaaggagagagcccattttctagtagtaacatttcaatcttaagagacatcaccattcaccaatgctgcagctgaacaagcacctgtaactgtaaggcagcctgcctgtgccttcatcggttcatcacttcatctccttgcagccctctatcaacacatttagatttcacccatttttattcagaacttacaacatccccgatcgattttcaaaaatggcagtcaagttctagccattcgatgctcactgctgcctagttagcacaggaatcaggaaacatgtgcagcaatccagctgttagaggcacagcctgcgttacagcgaccgaactcaaaataacaaagacgaactggcaaagtggccatggcaactaagatatcgaagagagtattcaagttatatttttttacagcagcaaaaatgataacctccacttcacttgcgagtactccttcaaatgcaatgatgaaaaaggatgccacctgttgatctcacttcctaaaccagaaccttttctgacataagctaaagactatgcgattttcttagaagtactctcccatggagaaaccaacaatgatcaactgatgatcagaaactgtaatgatcatctgatgacaagaaactgtttcacttcttgtttttgttgtccacattcagctgctggagcccaagcaagaggtccttggaatccaggtacaccttgttgtttgagcttgccatggtgtgagagatctccctggcagcttcaatctgtcggagagcgaggaaggcagggttgttgttaatcgcctcaccaatcagctgtgcactcttagcctcaccctgttcaagcaggcctcacagtcagactcaacccacaccaacaaaaatgaaatatatgaaacaatgaagaaataaacagtgccattgatatgtcttaacaattgtcactaaaactacaggtagtaaacttatcaaggaatatggtgaaagccatctaaaccagaaataatccattgcatctttgcttacctgtgctctgatgatcgcactcctcttgtcttgttcagccttctcaacaatgaactttgcacgctcagcttcttgtgcagcaacctgcttggcttcaattgcatgagtgaactcttttccaaagctgagacttgtgatggacacatcatccagagcaatgttgaagttgctagccctctctgtcaggatcttcctaatctccctgctcacagcctgtgttggataaaggaataattattaccatatatcctactatattagctcttaaactaaatatcatactactatattagctcttaaactagcatagcataccatggaaacatattagatatttaaacacagatagatatgataagacagtacctctctctgtgtgattagttgactggcattgtactgtgcaaccaccgctttgagtgtttcatgaatgattgaaggcaaaactctctcattgaaattctcccccagggacctgtagatggttggtagcttctctggtaacggtcttgtaaggacacgaagaccaattctcacctgtccaagttatcaaattgtatcaaactaaaaatgtgttggtactgacctctaccaatgttactttgaagcaaaggtctaaaacaagaaatttgcacacaggtaccgatgagcaaaccaatttgtatggtcaataagagttctaagttgtgaagaatcggaatttaaatgcatgtcaacaaaaaaaaaagtgtactgcctccattgcaggcaaagcataacacgcattgcaatgctagtcacacacgtaaatgttggttctaaaccaatgtaccaaaccactcacattctcaaaatgctaagcacatgatgaaaatgctaagcagttcagatatacccaacaaagaagcatctcacatacaagagtcacttagcgacaagtcctagtatagggacccaaattaagtgattaagcaagcacagcaagaacattccacacaactttgctaacattcgcaaatcacaaccaacaaatcaccttctacatgctacaaatcatcatctcaacgacatgacctagtcagaaaccccaagtgcaaggacagaattttaccatctggagatcacggcttccagaagtgctctcgacgaggttggggcgggctcggacatcgtagatgatcggcctctcgaaccacgggatcatgaagtgagtcccctcagggtacacctgcaccgagcacacaaccaaccacaacaattcattcaaacgcaacccaccaaatcacaagcacacgcatagcttctctgaaacccatcggcatcacatcacaagttcactagtaggcttcgatcgatgggttaccttgtccttgatgccctcgaggcggttgaagacgatggcgcggtggcctccctcgacgttgtagaggctgttgaaggcggcgtagatggcggcgccgcccagcagccccaccttcaccagccgccccgcggcagccgccggcggcgggctcggcatcttcgcgcccttgaagttcatctcgccggaggggggacgcgctcgcggcggcggaagcgtagggttttagctagggttttgcgtgatccggcgaggaggcggcggcggcggcggcgaggagaagaggtggcggaggagaggaaatgagaaaggagaaggggtgggggtgttaaagaggacgaacaggaggaatcacagccgttggatcttgatccgacggcgaggagggggcgacggggttgggtttctttcctccactgcaagaaaggagacggtgtgctttacttcctctgcaagatgaggcgcactcccgaaatcggacggtcgtgatcgtcttttcttgcgtatgtacgaagttggtggttatttccgctggagattttgaattttatttttcaatttctttccttcttttttcttcagggagatggaaagactctgatttcatatgatttcatgtagtcacagccagtttaaaagcggattaaaagctcccttcaatcttctgaagataagattaaaagtggacatgcaaaacaagaaaaccattaatatgtgattaattgagttttaattactataaacttgaaaaatagatatatttaatattttaaaacaactttcatataaaattttttcgcaaaaaacatgtcaatttatagtttgaaaagcgtgctaacggaaactgaggtaaaatcattatctttatgagaaaagaacggggcacactttattgagagatcattctattgagaatcttctgaagatttataagaaaactgagatcctttgtgcacactttctgaatggtgaagcatgtaacataaacaaaactctgaagttgaacatatctgcacctgcatcgacagtattgaatggtgaagcactgaacataaacaaaactttctgaatgattttctttatcatcaccagaccactctgaactgaagttgaaccaagcactgttactgcacacaatcttcaaaccaaagtccaaagagaactggaggagttacacagcctggaaccctgaagcatagattccaacctcaaaccaactgcacaagcacaccaaagcacaagcctcttcttctccaacctcactcacatcacatcctgccatgaacaacaacaacaacaactctagccaaagaccttatccacactgagatgggcacatagaagccactacacctttacagagcttccctcaggaagaaaaactgcgaaaaaagaagagctagagaactaggtgcgcagcgccatgaacaaactctgccttctcgcatgctcgggaaccagacgttcgatggcttctggagggatgccatttagctctgccaatgttgcaaatgttgtatcagtttagctgaggataaattcaaagcagcaggattcattttgacattgaggcgaacaaacaattaacggaacaattctgccatttcgggaagtggaagatcgagcattggcttcagtttgttcacctaaatgctaggtaccattttgaacataattcatgaaataattctctcagctcacataaatactgtctacatgaggtgttagacgaggcagagagatttaggaatgtttaggttgatgagaatcaaatcagcaaatgctaaggttcatatgctgttatcgctgtttcattcagctatgataccttgtgttctgaagttgaagagaggaggaagaggacgcccattaggtagacgagtgtttggatctctcaactcatcaaagaaagggtgcatgcaggcttccatctggagaataattaaataggttagatgagagagaaatctaacagtataccacatcaggctgctcaggccatcataacaaccaaaatctcatgtggccttacagcggtgcaccgaagatttggtgagtattgcagaaacctgcttacaaggtccactgcttcaggtggaagccttttttggaaaacctgggtaaaaaacaaaacttttgagttacaaaaagaacagtgagaaagtattgtttaattttccaattgaacacacacataatatggacattgctcacacacgcaggacccaactaataggaatgtcgaagcgcaaatggtaacacagaaattggatttcttttccatttggtttttaatcctttttgtcttcaacaaatatttcaaaatttaacagcatagtaatttgcgttaaaagatctccctgtcccaaaagtatgtaccaaatcggacatcgatattgcattagttttgtcaaggatgggcagaataccttgtgccatggatgagccttaatttgagggaatttgaactccgtgtagttcggattcatgcacttgatctcttcccttgttggagtacccaaaacctgcaaggcgctatgactaaacatgttattgtcaagatcaatggtcacaggagagaacagtttaggacatcatagaaaaatgttaccttgataatctcgaccagctgatcaactccactttccccagggaacagaggctgcatggatgaatgttattagaataagaaattgaacaaaagcaaaatattgtatgcatgaatgaaacctgtccaagcagaagctctgccatgacacagcctgtagaccacaaatcaatggcagtagtatattcagttgcaccaaatatgagctctggtgccctgtaatatcttgagcatatgtaggagatatttggctctcctttgacctgcacattcggcggggaaaaagctgcaatttaagactatcatgtgtaggctacctgcctaagttcacatttccttgcaagaaaacccagtgtgtccattcagaaaacagaaatgcttgtgaatttaaatttctgccaaattcagaacttaccaaaacttttgcactgccaaaatcacatattttgagctggtgtgtatgtgggttaacctacagtgcgaaggaagaccttattagtaccatcaaaacttagtgaatttcagtctgtaagtacatgcatgatcacggttttaaaataaataattgaagtactaacagtttgtctgcataaatgttcctttatatgtgcagtttataccgttttaataatcttatatatgagacttaatcttaaatcctgctgttctatatgtcaaataatttggcatcatagtcctagtagtggacctagtggtagttgatgcaatccaaatatgtggagccatggatattttctctttcaataaagaacaaaaatgactatgtataaccaaagtgctcttccatcagccaatatcatcaacaagcaaaacaatataaacagtaacatacagtttgataatatgataagttgataacatgtagcattggcaccaaacaatgcacatgggatggctcagctataggaaactaaataatgcacatgtggattgcttttttcagtttcagaatgttatatcatgtatgtggaaccaaccaataattaagatatttggatacatatgaaccagaatctcagtcccaatgagcaatatactttatgctcttcagaaatatgcaacagtaaacatatgaaagctcaatggaacaaaaggagaaaataagattgcccaagttcatttatgaattatgactaatattttcagggaaatgcagatacataaaaatgcaaagctttattaccaacattatgcaccttctctacaggatatagagtttgctgtgaatatttcatatagttaaaagtagacaatgttacatatatgcaactccttcatgtaccaattagttatgttttattttccatgatccccattaatttatatttgaggatctgtacagcaaaacatattaagcatagaaaataaaggggttaaaatctcacaagaacattctgtggttttatatcacggtggcagatgccaacacagttatgtatgtaagcaagtgctcggcatatctgcaaagacaacaggaacaacgatttagatgacttagtagttaataaataatcaaattttgtcttaagatatgatatcataaagaaaaatacaactggaagcacggtttagtgcatgttgggagaatttatttcaacagctacagagagcaaacaggtgtatagaacaactcattagctagaattctaactggagtaaatagataaatctaaccattagttaagagtatataaacaattacatgcactaatgtgaaaattttcagttaaacagtaaatgatctctgctggttcctagagagtagattgaagtcacgcaatcaaatctcagaatttttttaccggccaaaatgatgtgctacttatctcatgaaaaatgttatatttcactatcatctcaaatcatatgacagaaaaattattagataagtagatagcgcttgatgtttagctagacaaacaagaagcaagctgttgaacatacatatgaagtcaggaaaattgacaagctggcttgagtagatgtttaaatgccgattctccatggaagaaatcaatctgaatcattaatccaaaacttctaaacgttccagtgcagtcctgggctacttgaagataatactcgagtggacacaaggacaacacatgactgccaccaagtttgaaccatgcttcacatgacaggttttagaacatgcaaacaaattgggagagcatgaatgcctacattacataaaaattatggcactcagtgctcccttgcagatggttgaacatggtccattgatattttacaggaaaaaaatatgcatcaactattgataagctctagtgtggcatgcatgcccgaaggcactggataacccagctgaaaaattaagaactttgcaaatgtgcccccttgttcctcgaaaataagataaccaaaaatagattatgaccggacatccaaagagtttattctcttgaatctatagaagcaatcggtttggaatggggcatgagatggaaaattatattatttcctaaaggttactggtccaatgcaaaggcgagtcactcagaaaaatagacaacaaatcagggctgacctgataagtgtataatttgacataaatgaggggcacccgttgattcattctgctgtactgtctcgcaattcggtttactgtctctggaacatactcaaggacaagattgaggtaaagttcatccctttcagtggttgagaagaagtaatgcttaagaccaacaatattaggatgatccagcatatgcataatttgcaattccctgttcttgtaacgtttatcttgaagaacctttttaatggcaacaatttctcctgtttctcgacatttggcctaagagttgacacgaacaggttatttgcctttcacagtcacatagagaaatttttacaatgaaaaagccacaggcttacctgatatacaaccccaaaagaaccagttccgaccacatgctcagcaatataagtgacagactgttccattaccataaccactttatcagcattgtttcatggccaaacatcacaaattgcaaggatgaaagcgaaactatttttacctgtttaggtagaccatttcggccacggatcgtagtagctattatgtgaccagcttcagcgctagagccgtcgactacatctcgttcagtgttctgcaaatgaattgttggtaaaccaaagtgcagtcttggttcatatttccgtaggctttctgtgaatattcatgagccgtagaagtatgaagcagtgtcataaaaccatgcttttctagggtggacaacatgtcaaatttgcagagtagcaaattacagacaaattttttgaagttatgcagtgattatttactactttctcagaaaggcacagtggctcattgctacaggaggtgaacaaaataacaggaaccacagaaacaagagtttgattctggtgacaggtgactcttcatcctacatcaacactagttcactcagtgacaaacaaacacgaacagaaacctaccttttcatcaccaacatctggtttggaatccctcaattgcatttccagcatctcccttcctagacattcaaccgaactagccgggcccttgaatccatgtcccggccgagaggagctcccaacgccgccatgccttagtccagaataggccatcccccactacccgagattccccaggtcaggacaagaaaaacagaccagtattcactccattgcttgcagaagatcagcccgccattgcaatgccgtttcctccagcatcacttcagcaacagctgcatacacattccataaaaatgtgtcaagatcgagatgaaccttctatggcatagtaggaaatttttcttgtaaaagttgcttcatcaatttataactgatgaagaacatccaaaaaatcttcaggaagtaagtacactgcactcaagtacgaaacacataattcgtctgttagtacactactccaaaaggcatccggatttccagccacacagcgatcaagaagggccactaaataatcatcaagaaaaaccgcaaaacttgcactaaatcccgaacagatcaatctcaaaaatggcccaaagatcctccgaaaataaaccgtgcgatccatcccaaatcctataactcgataattgggtccaaaccgccgcaaaccgggtccgaaggagcattaaaaaacgacccttttttttctctctggtgggatcaaagaatctggagccacagtacctggagccaaaatcccacagagatgaaagaaaaattcttggagcaagcagatcaacaggctccagtgctcttggaataattatgggcgagcagggaatcggaagaggatgagatgagatggtttggggctctctctggtgtggagcaagtaggttaggtagggggggagagtggagtgaggtagtggagggcagctgctcttctccttccaaacttttccttttctggtaaaaaagaataggcaagggcatggaggagcagagagaaatttatggaggtgatgccatggatggaatggaaggatgggggagatgaggggggagaagcaaacaaaaaattgggttgtgagctgtggatgtgaagtgacatttgatttgaggggtttttggtgtttggctgcagtcaatttggcagtgaacatacttggattgattgacaggagtgttgacttgggagtgaactttttctgaattgtgattttgcaaggattttcattcttggggtagtgcaatttgtaattgtttaaacagatggaatcatgccaaattgccaatgttgcaattacaacaggcatcgacttttaggtgaaaataaaacattagagttaagctctgcttttaatattatggatttccgttgcttttcaaacttatataaacagtgtgtttagtaccaaaaaacctatggaggacttttctaaagtagcatttcaacttcatggcagtagtttattcattcgtaaaggctataaaaaattagataaactaccaattgatgagctatgataaaaattaaattaatatatcaatccatcattttcagctatcccagattgggcaatgttgctaaagttcagattttgccgaacaagattcagctcccttgtggttaagtgcggcttccgtcgtagcaaggcatccattcttctcttccaagcccttcctaactttttcttcgaactttcatcttttccatcacatcaaaactttcctatacacataaactttcaattttttttctttaaactttcaattttagtcaaacttttaattttagcgtagaactaaacacaccctaaccgcaaatccaactcatggagtcatgttcatctccccataccagaaaagaaatcgacaaaagcctgcatgtgccacagaactttcggtagaacgatacaacatgcatggttcgcctcaggagaccaacttgtcagcagctgcattaacaatgcgggaaaaaacaaacttcatgtagccctgcgtgtgttatcaagttcatcgttcatcagaactatggagtgtacaggatcatgcaggttttttctttaagaaaaacttctgtacataaccgtggttctcatgtactagttgtaaacgacaatcgggtcacagaaaataactcaaaattatccaatgtaaaattcctgcttatccatatgtttcttgtagtatctactgtatgttgtaatgtagtcatatactgttatccacagatctgcctgcctacctgcaaccagagagacttgatgtaatacaggaaaacaagagaaacatataacagaggcagtcacatggctatgcccgaatgaatagaaacaagaaacaagtggtagtaacaaacaggagaacccgaaaggtccaccgagatagctgttctgttcatgctcatcatgctaagagaccagggtcccgtcattcgttgaccaggtcatgggcctcacaggcggctatcacttcagtttgcatatgctactgtaaagtgctcatgtgtgctgtgagatgtggctacatcactattcaaagggggtcatctgttagctgtacctctgcatgtggggaggatgaacttagcttttaatcttcatagattaatattgatctctgtcaaaagctccacacagtagtattcttgcaaaacaaagtcatttgttccagtttcagtagccaaaatttgttccagtttccagattcttcagaatgaaacggttatgtgaaaggaagtagatactgacctgcacgtctgcatgtcaaattccaacagcatcaagaagctctgaatgttgtgacacggagactagcgtgtttgcgacaattgcaccacttgcagcgacggccggtacaccgatgcctggaaaagtcgagtcaccacagcagaatagctggggtataggtgttgcctgcccagggaaagtggcctccccagcttttatggctggaccataggttcctctatttcttcggaggaacctcttgtgtgttaatggtgatccaaccagcttcacatcgcatttttctctgctaaatcttggaccaagggcaagctccacggctttccacatcacctgagaggtttaaattaacttatcatagaatacagcaagtttctatttacaatcagtgaataaaagagtactttataaaaagtgtgtctagcttcgataactttttacttaacttttgatcatatttgcttcctatgagtcaagaaaattgcttccttaaaattctaacatgtagtagattattgttctagcctctggagtctagacggctacacaagccacccatgtttgcacgtgtggaaaagaagggtaaagagatgaaatttctaggaaatatctgaactgataaaacggtgttaaagcgcatggatttctagggactaattcccagttatcaggggagtaacgctagaagaacaagagcacagcatttgttctatgttgtacctcagagcgttcttctttcagccttcgatactcggcgcttttcctatctagtccttcccacaaactgaaaggttctgttcctggtgtataagcatgtaggacgtgctttccaggcggtgctaagccatttccaagaacagtaggaactgatatcaatacaacgttctggtcagcatcaactcctttgttccaatcattaaccacaatatgatggattccaaggtcctctctggcattctgttccagttacgtaagtagttaccgtgagagattgcctgagttaatgtaaaaacacacatcttaatgaatatgagtgtatgacaaccaacctcgacatcaaaacccaagtggagatgcataaatgattcacattgtggagttgctttcactttgtcttgatatgatcttgggacagcatctggtggcagcaaatccaaagtatcccacatagatgcattgctaacaactgctttccttgcgcgcacaatctgcatgagaagcaaattcccgacaagatttcaacagctgctgaatcttcaaaacataggttgcatgatggaagtcaatacaagggaataggttactatctagtgacctagaataacatgtggcacaatcatgcctctcaaaaatagattgcataagacaacagggcgagaaaagatatgccatcttggcctacatgatttctatggtctgccactactgcaaatgggtggaccaaggcctaaagcccctaaactaaatgtgatatgcagtactgaagatggtactttttggagggagggagggaaaatatatagtgattatcgtggattgtacactaaagactttgatgcatccatgaggctcaaggtaatgtaagtatcatatttgatgaaatcattaccaatagtaataatatggatctgcattgctatcattggttttgtgttcataacttgtatcacacaaatcctttcctactaggtaacagtttgttttttgtttggtaataacatatccttagaagatgcttacttgtccactttgtagcttgacaccaactgctcgaccattctcaattaaaatcttttcaacatgcgaacgaagagcaagcctgccaccaaatttttttattcctcgcacaagagcatctattattgctccgcttccctcaagaggatactcaagcgagcatcctggtttataccattctgcaaacatataaacctgtggttgtagttagaccaaatgatgaaacagaaaacatcataatcatcacttttaaagtatttgtgtgaatttgaatagacacaacagatgggagctaagtatcatagaggtaaatatatggaaaactctgcactgtaacttattcagaatcgcattgttttttgatgcaatgaatcgcattgctcagtgccaaatatttcgacatccagttgctgtggagcactccaacaagataaaagtgctaagattcaggtataagtcactgccatccaccaatgggaatgcatgccatcaacctatacaatttagatccactataaatacaatcactaccatgtagactgcattgactggtttagggtcacatgagagtgactacggaatagtatagattctgaaatagtatctgctaaataaactagatgtagaatatgctacattgaggttgttccaagttcagatgacatgagaacgtgtaacaccagcacagctattttatggaaagaagaggaacattgcaccgatgtaatactaatcccatgatgtcctcaccattagggtcaatgcacccacaaatatattgatagaagttgtgcaacaaaattattctcttattcatctatatattgccataatggtattggtcggtttcaacagtgaactaaatgttgtttctggaaaccagttggaaatggtaattcactaaattatggcaaagcaaaaggtactgaaattaaaggaaaacacaaatggaaggataatgaattcaatgttaggcaaagcaacagctactgcaaatggaagtaaacctgatggaaattagtttaccatttctgcagaaagagcaccatcagatttgactccagcaagtagaaaacacaagagatcgatccaattacgaacaaaggggtttttcaggcccaatgaatcaacgatctctgagaaaggtcttagaagttttgtagcaccaagagccccttgaggtcccatttgcaggattgatttcaacagagaaggagcatatctaccagcagatgtggagagaacacctaaatcacctcgaatggaaagtggaggcaaagccattgcagctgcagagataggaataactgcatcctgagattgttttagtatggtattagctcatgctctagtggaacataaaatgtcccaaagataaaaaaaataagaaatgatcctggaaaagaaactagtatcatatcatattcaagtacggtgcttttacattttttacaaaatatgcctataaaaggatagcacaggaaaggaaagcattaataatttatggattgctcatgtgttgcttagtactccagttcagtgagtagtgagttcatctacacgactatggctgcaaaagtattttccaaagagtcacaatgcagacaaaagaaactcacaagaagctttttccactcctggactgcatcagcaccaacaaattcatcaaggtcctgaaagaattgcgagtcagaatcgtgttcagagcatccaacataaataaattgttagcatcaaaactgcataaatgggagagaacatctctaagttcaataaccagccataccatttgagaagaaataacatatctgagtgagaactgataatgtcacaggtaaagttaagtgaatggttccaacgattacatatctaatggcaaaagactgctcaccttgaggaaatcagttggacctatccgcgaaaggaactggccttcaggtacataaaccatccaggaatcatatgaggcacatggaactgattcgcctagcgcatcaaggacctgaccaattgaatgaccacatcagcttccaagctctcaccacaattaacttgctctaaacccacaatgccataatgggaagaacaatttgctgcaatcaagtatcacctgggcgaggggattggcctgggggcctctggactggaagccggagaacagggaagggcccgagtcgaagttgaagcccttgatgtcaaacgagtgcgcggcgcctccggggcggtcatggctctcgagcacgagcacgtcctggttatacctcgccaggagccccgcgcagcacagcccgccgatcccgctcccgatgacgacgacgtccgcctccggcctctccgcctccctgaccccgattcagaacgcaaaaccggctatgcctatgagcatcgatcaatcgccggagagtagtggtgcggtgcgaaacgtacccggagagcgcgccgtcctcgccctcggggatggaggggtccgcggggcgctcgtcggcggccaccgccctgcagcgcgcgggacgagcggcggccgcgcatccgcgtcgtggccgtggggcggtggtcggtggagcgcgcgggcggcgagcgcagtggcggggcggaggcggcagcgcgcgggaggccaaggcggcggaagccatgtcggaggcggagaatagcgcgcgtctcgccggctacgccacatagcttcgggatcaggccgcggttggagtgaggcggccgtcgtggacacgtggcacttcgccggcctttctccttccgcggcagccgacccgatctctcccgtgagacatggagaagatgggaagcgaggcccatacggcccaacccaatggcccattatgggcttactgggaagcccattttaaagcgttcttcttcctctcctcggcccgcgcgcgcttctcttcctctctgctacctcttccggccgaaagctaagaaaccaaaaacgtacgcggcgagcttccaagaaaggcaagaacacaagaatctgcgaaatatatggatcaattaagtgaaaagaaggtgcctgaaaatctccaaacttaatttcgatcgattttcatggccattaggaaagtgaggaaaaaaaaacacggcctaataggtacggtactcagtcggtttcagaataagtaaacattatttttggaacctttttttttttgcggggaagagctgggaattactattgctcaaccgacaagtccttacaaactagctgagaaataagattacatgtgtcgcctacccaaaggaaagaaagcctatcagtgcgagctatgtctgctaaagcatggctaatctggttttgagatctgtggaccttcctgatgatgaaatccctctctccatcaatcaacactttaatatgtctaacaatgaaagcaagggaagagcggtccggttccttggtctgcatcaactgggccgccgtcaaacaatccgtctccacttcaataggaagctcatcgtccattgcatcgccaggctgattccttccacacatgctagaagctccgattctaacgcatcggagcacccttatttatatgtctctcgcctctcccttgacttgaggcggaggatcgaggattactggcatcgtcgtcttccttcgttccctccacacaagagaagaccaggcaagtcctcttaatttaccttcttcataccctaacatacatatctcagtttcttctaccggctctcggtgacctcctttggtctgtgtcctccctcctgttcgttcggctgccaatccacatggattaagttagtctgaataagctcgtttcttagctcaactatgcatggactgctaccctcaaactgtttcaccctcacctatccaagtttattttgtagtacacagctagcctgtttattacttatgttttctccaaccgtatgtacgtatgtacgttagggtcaagcaagcaccatcaaccttgacataaagccactaacgtctcttctgtagtactccctatgcattttattttaatgtatgacgtcgttgatttttcaaccaacgcttgaccattcattttattcaaattttttgtgcaaatatgaaaatatttatgtcatgcttaaagaatatttgatgacaaatcaagtcacaataaaatcaatgataattacataatttttttgaatgagacgaataatcaaatgttagacaaaaagtcaacgacgtcatacattaaaatattaaaatatagaggtagtagtaatatataacctcttatgaattggatttacaatgttacttttgattctgcttcagttaacgaaaagacgcggaaaattaagaggacgtctgctacgtactcatctcacaagaagctacaatactaaatattttgcttcagtcatggaatacagcaacatagctaagaagagggagggtgttattgttaagatcgtgacatgatacaaagccccaggagtagagacaagtaataagtcattgacctcaacttcatttgttatcctcttttctgccatatcttcttgtacatgctactatatttgatgactaacacccgtgttctatggcgttttaacttatgtctgggctctaatcaagataatctcaaccaaccacgaaatttgtctaagagcgttgtctcacttgctttgtatgatggtgagtatgctgctatagttacccaatttataatttaacaacaattaatatattacccccagttataaattaatgctttaacttgctgtcttgtgtaacaattaatatatgctttgtaatggaatctgtttttaaggttcttactggtggtgtgagagattagctttttatatttgaacattctagttttgagttaacttatcatatttagtattaattgtatttcattgccgaccactccttgtgcagcaccaggacaaaggtgtgggaatgactatctaaccgaaaagaattatcccaagccaccactaaacatattatatggtgagttatttgatgatattctaccagtaaacacctttttacagttctgttttatcactaactattctaccatgcaccttctaccagatggcatgattttggctaattcttttgaagagacttttggccatctatatggtcaaggttcctggtgtgaattcacatcagaaagctttcctaacaacattcgtcgtagtgttgttgcacttacttcatggagtggtgattttacactaattaatgttttattgattgtactatttcatttttgtatattttgcaatcactaataagatataataatcaacagtatgcatggtatgcaggagggaggaggcattttgcctgcacgggtttttttattgaatggacgaacggatacagaattattctcacatcagcgagcttggttagagagtctgatgatggatggtagattgctaaaaacttggctgtaggtgctagagctcatcataatttttattctcctatacttcctccgtcccataatataaaggattttgactttttacttgcactgtttgatcactcgtcttattcataaaaaaaatgtgcaaatataaaaaacgaaaagttgtgcttaaaatactttagataataaagtaagtcacaaataaaataaataataattctaatttttttaataagacgaatggtaaataaaacaaataaaaagttaaaatcttatattatagaacggatggagtatatcgctagcttctctttcaattctcacacactttatcattactttgcagatacaggtgttgcttccaaacagtacatgcgatgtagggtatttacaacattatagcttacactacaatgttgctctagtcagtacccatcacagttggaatgctcctccagtatgtactcggcttgaccagcacaattgtactccctccgtctcaaaaaaagtcaaaccttgggtttccgtgtccaactttaactatccgtcttatatgaaattttttttataattcgtatttttattattgttagatgataaaacatgattaatattttatacatgacttgtctttttaatttttttcgtaattttttcaaataagatgaatggtcaaatattggacacgaaaaccagggtttgtcttttttttttggaacggagggagtagttgggtagcagctataggatatttcttcgattcaggcaaattaatgtttgaaagtggacatttggttccctggaccggcacacttgattgccgcttccttttacgttcgtgttgcagaatcactaaggtacatatatactgctggctagctctgtcaatttttaatttctcacctatttgatttacatggtggaaatgaatatattagttgcatgtaacttatcccatctgtttgtgatgacaaatgacaacttaattacttgcccatgtcatgttggcagggtgggattggagggcctcttgttgatttggacgggaatgttttgggcatgaacttctatgataagaagataggaaccccttacttgcgatggcatgtgattagtaagattctgggacacttaataacagaagcaagtagattcatttctctttttttttggttattcaagtgctgctcatctgaagtcttcatgtttttttttaaaaaaaaatacttggttgtatgatttgctgtaaattaaatatattcaatggtgtgtttggcagcagctctgctgaagttgacttcggtagttaccctagaggggccactcccatgctacgcaggttagtttaatgatacatcacaaaactagtaaattacgacgcctcacaaaaaatttcttatcacgttgcatatattgaactacaggagtatatctacctggctggaatggaggtgacaatgccaacctaaacagggtttttgatcagactgcatgtacttcaaaatattgtttcgtgcttccccaatctccacctgttgcgcctgactggacaatcgaaacaggtaacagtgtcacgctaaacaggttagttttatgatacaattaatactagtgagtattacaaaatgtctcccaaaattaattttgtaatcacattgcatatacattgaactgtaggtggcccgtgcccctgccatattggcgtcaacctgacgatatggaggaggaagaacccccacgtggctttgaggacatgtacacatacgtggacggagtcagattgtgtaacttttagaatcatcatgtccttgttctgctctgttgaatttcttcctccttccgatgtgttcgctggtgtgacttgtgccatgtcattgaagttaattatacaactatgcccgctgttagtcctgtaatattattacatatgctgtgtgcacttgtgttttagaccattcagctatagtggtgttggaacttggaaggtatatgagtatataagtagcttttgttaactttggagtacataaatagcgtgcctatcttggatgtgttaaaaaaaaaccctaaagtattttgcagtacggaaagtgctgaattttcaagttggacatgtttgagtttgaatttgctgtatatgttgggtgattttttttcttaaaaatcacatgattttttaaccttgatagttttgccttagattttattttggggtaattgcatatttgccactgccggaacggtgaatttaccattataaaaactataattgcacatttaccataaaaacagtcagaacttagcatacctaccattagactcacagtttgaaccaacacggttagcaatgtgtattttaactaaaataggacaatagtaccccttccaacgaaatcgcagaagtcaatcaaaaatacgcgatcaaaactggtcgcgagactgtgtggcacttcgccggccattctccttccgcggcagccgctctctcccgtgagccatggagaagacgggaaacgaggcccataaggcccaacccaatggcttattatgggcttactgggaagcccattttaaagcgttcttcttcttctccccgcgcgcgcttcccttcgtctccacccgaaagccaagaaaccaagaacgcaagaaatcaagaacctgcgacatggatcaagaattccatttcgaccctttcaccggcggcgacttcgactaccccgacggcgagtctttctccggcggtgccgcaagcggcgggtttgactaccccggatcctgcggccgctcttcttccgccggcgaggaacttcacggccatccataccgcgacggctattctttctccggcggcgccgcaagcgacgaatgccacttcttgggcaggagcggcttcccttcttcaggcggtgagcgacttctcgttcaccggcatccagaccgctaccgctgcggcgagcctttctccggcggttacgcaagaggccacggcgacttgttgggatggagcagctgccattcttcctgcagccaacttctgcaagaccctgcaaccatcgtcatcgtcatcaatgacggtgctcatgcccatggcggcggattagcacaggctgggcaagcctcctccatgagcgttccattggtacggctacttctcctgcttctgatcaacgttctgtgctgcttctgatctcgttcatggcggattgccgcattttttttcccgatcatgatgttctacatttgcataacatttttgtgcacgataactctcttcttctaatcaatattactccatttggtctaattaaatatgcctaatcatgctgttcgatttacttaattaaggagctgataagaaaactcggtctttgtctgttgaaataagagtaaactggcatacgttgtgttgcgtgtatgggtacaaatgtttaaaaagacatcgtagttatcagtgttaactgggaaacatacatacatatacatattagtattttaacaagtttcaaatatgaatcattttgtgatatgggtagcattgtggttaattatgaatcatgctgaatatataatgttattcttattttgtaaatgttacttaatctaaattatgataatgggacaggtaaaatcaaaacaaggaacatcactggtgccacagctcaagcttggtccatcagctgccccaaacttattacactggctcatggagcacatcttatgggatgcattagaattctccatcagttggaccacactacgacggcatcaaccaaaactcccgagtgaatggagttggtggatggcaatgggttcaccgttcattcagatagatggttagttactgtccatatcctctaatttagaaattttgatgaactgctgaacaaaacaaacgtgtgttgattctactgatcttgttacaggaatatgctctatagctgccagttttatgtgtgtggaagcacaacataggctagcctttgagatcctacatggaattggtaggttccccttaaaagcaaagagactcaagggtgtaaagaagaaatgcataaacaaaaaggtgtggagccctgcagacggagcatttgtagaggatgtgctgaaggtggtggcgaagggaaggggagtgagacaatacagggtatcttcttaccaataaatggatatcatatgtacaaaaatgtccagaaagacgtcagtcatgaggcagcagtgcgtctcttactcgcccatggtccactgctggcaacattgtgggtgaatgacgagtacatgatctgcacaacaaagaatgatcttgtctaccgtgggagcagcaacagtgaaaaggatcccaatcatacggtggtctgcttcgcttatcggtttgttggcgaggaattacacctcagggtcctcgacgaccataccgaagatgggccagtgagatgggtattgtacgagtgcatagatgaaatccacctgttgacactaaaggaacctttgaccaaagaactcatcgacagatacagaaagaagggacagactgagagcttcttgtcaaactctgcaaacaaagtaaaggccatgctgattcgaagactaatgactaagtactcagaattagagagcagtcagggatctagcagttgtggtaggcagagttgggaaaaatagtcaaacttgttcaggtatacacattgaacaacagatcaaggagctccatggctaggcccggaggttgaggctttgttgtattgaactcggaagcaaagtacatgagttacattgcctcaagagtagttctgacagccacggttatgcacttattcacttcaaacataatatagtgaacttaacaagttttcagatattagcacacaaactatttgaactaatgtgacctctgctcagcctctgttatacacaaccacagaaaaaaggatttctataaaaagaacctttaaaaaaatggcactgtgatgaaactgtagcaattaatcatggtgcaagcagatttattgctttcccatcactt

SEQ ID NO: 66896 - DNA, 661 bp, Oryza sativa
ctgagaactgaaaaaaagtttagcagaaagctttatgccagttacttcctgactcctctatagggcagaacattgtagatttgtagtttcctcacatgttagcgtgcaggagaatttcgaacaaagggacatactgaagtagtattttgtccaaaataatgtcggccaaaggagatttttcacctttttgcaaatgtcagggtctaactttggtgttggagtgaaaaatagctgcagattatgtttagtttactttttagaactcgtgtgtataataatatcatgttttttcctctttgcaggaccatctattcgacaatcagttgaaactgctgaacataataactgtgctttgaggtattgacacaaatatttatttcatactgaataatgtgaatgtagtatttcttagttattgaatctattagccatccactaggcgatgcacatagccatctatctctttaggacacctgggttgaacataaattgtggtcaccttggtcacctttaattctggccaaaataacataatggattaaggccatattcataacactcgatgattttttcatcatttcacaattttacaaaccaaagtagcaattcaatcttaaaacattcacattggggtaggtgataggaactgttggcgaatatg

SEQ ID NO: 66897 - DNA, 859 bp, Oryza sativa
tgtctgtattctgcaagcatcaacgcacttccaatatccattctttgcctttctgaaaacattgttctcgtcatcatagcatagctggttatcaggccaattcaagaaccaaagggttcctgcagatgagtactgcataagcaaactacttgtcccatttagcaaagattataagcctcaagtcattataaccgactaaaagcatgattacgtacatctcacacaaaacttgcagtcatatccttaaactgcatgttaacaaattgaccaccagtgctaattagtaaataaatatatgcaagatattttattcatctgaggtccacataattgtatagtgagaatggctaacataataataccaatactctataatgtggatatagcacaaaaacttaggtgcaaattttaacgcagtaaataaattcaagtgctctatcttatccatgatctggttaaattgaactacagtttaggaggtcgtttccaactaatggaagaaattaaacagataagtaccactgtctagtgattctattagtactagaaagtagtgttaaggatgtggtatatatatatgtagtagtcaagggttagagtattatggttttttcccatgttaggatggaacgcctgatccatagagttaggcccataaattgagtaaaagaggtattcctaacatgggaaaagaccatgataccttaacccttgactagtagtacatatatacacattgacgcattattatatccttaacatttgcatgcatgaagataaatccaaagataaatgcaatatatacacattgatgcattattatatccttaacccttgactagtacatatatacacattg

SEQ ID NO: 66898 - DNA, 2761 bp, Oryza sativa
gcagcaagtttgaggcaactaagagcctagtcttccacaagcatgatctaagttaatggcaccccaagatctaaaaatagaagtgaattgatttctccttaatctgattgttggtactatctggtagaaaaatccaatactgaccaaaatattctgatcaattgacaaaattgggcgacacaaaacttgtagataccataagagctcttccacagaaaaccattttatgcaagtaatcattagaaatcatcagttctgtgcaccagtgacctgttctgaatagaactatcgacccattacttgtgtgttgttatttttgtactgccaaacaataagttaattaaactaaaataacagctcaaaggacaattagacccagctccagatcaataagtgaattataaaaataaatcataaaaatatcataatcagaatgcgagaatgactacaacaacaggaacaaaaatgtgattacactaaccaggggagtcccgtggatcaatcatagtaaggtcaacccccaccagtatgttctgtggaagaggatcccatgtttttctctcagccaagaacatgatgatttcagtatcagaccaagagtcccccatagcaatgccaagtggtggtagtaccctagaaaataactccattttcagcaatgcactgcgataagatgcaatggtgtttctggtccaagaaaaactacatacatgctatgttcctcaaaaaaatatctctgattgaacacacttctccacttaaagattcaagaacttgcaatcccaccaagtagaataaacatatagctaaacaaataataagcagggttctcttgtcagactaatggaagatcaagaaagtacacatacataaacatgaagaaagaaaaaaggcacttgaagttttgtaatgacaagggccatgcagcagattcacagttggacagtaaggtgatgacatcaattccagccagagttaggcagaactgggggcaatggaggcagcattgacattctcgtgttggaggatggaacaaatagctagctgaggtaatcgtttgccaatatcatctaaatccaaaaaaaaaaaaagaagaagctaatggctagatggagaacagcaaaccctgtgaacaaaacactcatggcatgaatagacaagattaaaacccagcctaactaacaacaaaacgaggaccacctaattaacagtgatcaaacttcaccataataactaagtgaacaagaagctggctaacaattcactatgaactgaccagctgacagggatgacaaacacaaatatctcaataaaaaatcaggattcaaaccaacagtctctgcctaaaaacaataccagatggataatcaacacaatctccagtttctccacacatgtcaccacaatgcaggagcacaaatacacaatctacataagtaaaggactactactaacatgtcacaattatcacaattcacaggttacactcaccaactcacgtccacacagatatgagatattagtagattaacaagtagtaaacaacaatatccatgagcatgaaaggtaaaaggagtgagtgcgaagggcatgggggtgaaccggagaggcataatctgcgaagaagccgaggctcgatgtcgacgacgaaactgacgaacaccctggggtcgccgtcggagcagaggaaggaggtgcagtagggtaaccaagcacagaaatccacgtactctacggcggcggtgatccttcgccctagggaggccagaaatggaggagcggcgcggtgccggcggcggtgcccggatgcagaggatcgagtggattgggaaggtcgcgggtcgccggtggcctccggcgaggggagcccggcctcgccggcgccgacgatgacttcccgcggcctcctcgccgcgccttggcggagaagggagaggaggggacacaaactttgggctcaatttggcgcttgcggcgcgatgggtatttctagggcttagcggtcgtcgtatattttcattttactccctttatctcttcaaaaatacgaatacggccttccaaattagatttcttcgcccgcagctctgagaatccgacctgatcagaatacaagattaaaatcgagccccaatagcggtcgatttatcagattaaaatcgtgcattaaaatcgagctctgagttgcgcctaggaatgcaacgaggcagaaatatcaggtggagtgcgcatgctcttcattttgtatgcgtatcgaaaaaaaacacttttctatctactttctttattttaaaatgtataacgtcatttactttttcgcataacatttaaccatttattttattagaaatatatatatatatatatataatttattttttgacttgttttatcattaaataaaatataatcctaacttatacttttacatatttatactaaacttttttttgaataagatgaatggtcaaatgttgtaaaaatattaacaatttcatatattttgaaaaggatggagtattttgcaaaaagaaaaaaatagtagaaaagaatggatggaaagctagaggaataagttcaccggaggtccctcaacttaacagtgagattttttaaggtcccttaaccacaaaaccagaaatatgtacccctaaactcacacaaaccgtgcattcaaggtcctagggcaatatatatgggtggtttcgttgatgtggcatcctagtcagcaaaaaaaaaaaaaaaaaagtacgtggggcac

SEQ ID NO: 66899 - DNA, 1183 bp, Oryza sativa
tccacccaccgccgcctatcatcgctccgcccgcagcccggcgccgcttcacgcactgcgctcgctcgccgttgcccatcgccgctccgcctactgccgcgctcggccaccgctgcccatcaccgctccaccctccgccgctctgctgccacgcgggcctgccgcctgcccattgccgttccgcccgccggccgccggcctccctcactgaagaggaagagaagagagaaaagagaagagaaggagaagaaaagaggagagggtggctgacatgtgggcccacacacttttttttatttttttttactgactaggatgccacgtcagcgaaaccacccatatatactgcataggaccttgagtacttggtttgtgtgagtttatgagcacatttctggttttgtggttaagggatcttaaaaaaatctcgctgttaagtcttaaacctccgatgaacttattccaaagctagaggagaggagcaggcggcccaaaaagagacacgaacttggcaaatctcaaaagtccggcccaagcgtactggcatatcacaccgaccaccggcgcggcacggcgcggcgggggcggaagggcgggaaaaagcgcgcctcgccgctcacctcaccggaaaaggcggcggcggtccgagggcccccgaccccagggcaggggccactgcgctgctcgcacgcttcaaggtgcggccccgagcaaccgccgacggcgaatcggcttctccgggagcttgcctgccttgccggcctccccgtctccccgacgacctcgctagctacgaccgcagcttcggcgacctcctccgccgcccttcccgacgtcctccggccggcgccctcccgcgcaacaccactggatcgacgtcgtcctccggccgtcgccctcgccggcatcccctgacccctgcaggctgcagtagagatcggtggtgtgtactagacgtcattcactcgctgtcctcgttcagatcgactgcgaggtggagaagccctggtgccgtcatcctcaagaacggagaaccaccacagtacaccggtcatcgtccccagccgtcgccaccggcccaccgccgccgccaactccagtaattctttgtgtccactgtctactactccctacttttatatttcatattatataagtcgtttaacttttttactagtcaagt

SEQ ID NO: 66900 - DNA, 6966 bp, Oryza sativa
tcgatgcccatgcttctggaagagatcattcgtccaacaacgctgttggaatgcaaacaaaggaagaacctgcatttagcaggaccctttacgtgcagagaagatcagctcaagcaaatgaatgctggccatggaagaaagcctggtatgccgaacgcgcagagtagcgctggtcatacgtccaacgccaaatgagacgattctcgacacccggtgagagctgtacgtgaagcaccgcatcccaaataaggagaaactgggagatgactgggatagtgagggcaccgcggatgtcagagacataggagttgttcgccagaccagaagcaaccgtgcgtgaacctggaagacgctggggaacaacgaagaggagatctggagccaaggacgccaccgagcggccatcgatccattggtcggaccagaagagcatagactcaccatttcccggcacgaagaaagtggatgccgcgaacatgtcggagacggtctgcttgactggggacttcaggccatcccagcaggggtgccctgagcgctgaagccagagccagcgaacacgcagggcaaatcctgccaacctgaggtcagggatccccaacccaccgcaagttttgggacgacagacgttcgtctaggacacccgacactgcccccatgagccgagtccatacccgtccacaagaaagcacgacgtttcttgtcaatggccttaataacccagactggaaggccgatcaccatagatacatggatcggaatggaggagagaaccgactggaccagcatagaacggccagctagagtggtaagtcgtcccttccaaggcggaagtcgatgggagactttatccacaagcgtttgcaaaggctggcttcggcaacttgcaaacggacaacggaatgccgaggtaggtgcaagggaaattagaaaccgagcaggggaagtagaactgaaccagctctaggttctcagccgagcaacggatcagagtaatcgagcatttggctcttgactaggtttattaatttttactagagaattaaaggttcaaaatgtaatgttatcctcaccgttgtaggtaactgtatcgatcggtgacgtttgtgtttgaatggaactcctagctccagtggctcatccatttcacagttatttcgtgctcacttattaacgattattcgaagttaacatcaatttattcagtcctatgttctcgtggttcgtccatgcaaaccaatcatctgcagctactgtccctatataaacctagctagtactcatcaacttcgatcacaatcaagcatcaattcctcattagcatcgctggttgatactaaactaacagtagccataatcatgggaaggccagtggcaacgctgctggtgctgtgcttcatctctgtcacggcgcgcgccgccgcgttccgcgtgcacggccgcctcctcgccgacgccgcgacggagggaggcgccgtcgtgcccatccactggacccaggcaatgaactacgtcgcgaacttcaccatcggcacgccgccgcagccggcgtcggcggtcatcgacctcgccggggagctcgtctggacgcagtgcaagcagtgcagccgctgcttcgagcaggacacgcccctgttcgacccgaccgcgtcgaacacctaccgggcggagccgtgcggcaccccgctctgcgagtccatcccgagcgacagccgcaactgctccggcaacgtgtgcgcgtaccaggcgtccaccaatgccggggacaccggcggcaaggtcggcaccgacaccttcgccgtcgggacggccaaggcgagcctcgcgttcgggtgcgtcgtggcgagcgacatcgacaccatgggcgggccttccgggatcgtcgggctagggaggacgccgtggtcgctcgtcacccagacgggcgtcgccgcgttctcctactgcctggcgccgcacgacgccgggaggaacagcgcgctgttcctcggctcctccgcgaagctcgccggcggcggcaaggccgcctcgacgccgttcgtcaacatctccggcaacggcaatgacctgagcaactactacaaggtccaactcgaagggctgaaagccggcgacgcgatgatcccgctgccgccgagcggcagcaccgtcctgctcgacaccttctcgccgatcagcttcctcgtcgacggcgcctaccaggccgtcaagaaggcggtgacggccgccgtcggcgcaccgccgatggcgacgccggtggagccgttcgacctctgcttcccgaaatcgggggcgagcggcgcggcgccggacctcgtgttcacgttccggggcggcgccgccatgacggtgccggcgacgaactacctgctcgactacaagaacggcacggtgtgcctcgccatgctgagctcggcgcggctgaactcgacgacggagctgagcttgctgggaagcttgcagcaggagaacatccatttcctcttcgacctcgacaaggagacgctctccttcgagcctgcagactgcactaaactctcctagctaatcaatggctgctgtgctgctacttaattactttcaggaagcaggagagtgcaggctatatgtatgtgtacttctgaataacgcagccatatatgcggcatgagctgcacgctgctcatgttggtgaaaataatacccccattcttattattctgtggcgatatattctggactacttcgatttcaatctctgttccatgtttaatactttaatggttcatcaaccactgtaggaattaggatgctctcctacagtttttctttcaaaaaaaaatgtggttcatcaaccaagtttcgtcttacagcttcagaaacaaactgcatgcctcttcagttatcttagcaaaacacagagaaattaaatcagaccggtagcttcgagtcgatcaattgttgggaggcattgctaagaaatctaattagtcaatagtcatggattacgagttacgacgactgactaatataccaaattaatcaccaaatatgacaagtggaactctgaaacagcaacatttatgcttaatccaccttgcatttctggatcacgtgctggagacgactttttccaccagaagccgcttcacacgtaccaccacactcgcactaacaaatcaaatattcgctccattaaaaaataaacaaatgtcgcataaaatgtgagaaattctgataatacgaatctggatagattcttaattactataaatttaaacagaccaaatttataataatgctattatgtatcacatcttgtactacgtttatttattttaaaatgaatggggtagtagatgaagtagactagaccaagcatgaagccagcaaatcagggtaaatgtggtaaggaaaatagatcctctaacttgctattctctaactttaaatgactaatatatccacagctcatgtgtgtccaggctgcccttatcctttctttttgggcgcgtaaccgccgaaaaccacataaaattcacctcgaaaaataggacatttttcatttaacttgtttcaataatatttataataagcttttgtcaaatctaaaaccttttgaacggaacattctcattttatctttacgatactttttttacaattgcacagtacaacgcagacactcacaacgcacgcaaaccctacccttatgagcatcttcgaagactaggccggcaaatccatcctagagattgatgaagtcaccacaagcgcctcgctgtcaacagcaatccatccttgagattgacgaagtcaccacatgtcacgccccgaactagtaccgaccggaactagcccgtgacgctccaaattaacctgttaatcgataccagtcccaggaaacagtgctggtaccacaggaagacggattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagcaggatccgcttcatcttcttcagcaactgggggggggattatttatatagagcaagggtgagtacgggagtactcagcaagccatgggaaataagtgtttaatgcaggcttcaaggaaaggctgttgtttttacaattgattttattcgaactcttttctaaaaacaactaagtgagtgcttctcaaacgacacggatgagacagtgcgtctcgtccggtcggagtatgtgcaatgtatcagtctttagaattgttcaagattggcacccggccaacaactttcaaacggccacccgggccaacaactttcaaacggccacccgggcctagctgatcccatcagctgcagatttttcaaacatcgaacccctttccataacagcaatctcacaaggcaatagtcaaacaaaactacgctaggaatcacctcacatccgcccatgaccgtgggcacggctgttcgaacagtttgttaacctctacagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcgagagcggaaaaccgtacacccggtacgtcccccggtccgcggttttggaaattcatttagttcgcaagcaccgacccaggtgtcgggttttccaagtcttttgtaaaacccgagttttacccaagaagttttttcagattttaagtttgaaggcgtccgtcgatactcgcacagggtgcacgaatatcgagacgcaactagatggttacaaggggacacgatataacaattatcaaaggaaggatcaaatgcaacaaattaggtaggtccgccaatctgccttgcagacgggacagcagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaaaaaataaagccctattaatgacctctatgtatgccattagatagatctcgagatttgaggaattttggaagttgaacggagtcaaacggatttacggttgggaagatattgaatttctaagattattggatttttggtctaaaagaaaaggatttaattaaatcctttttgaaaaagaaaacaaaagaaaggaaagagggagggaatatagacttttctcgggcggctagggcgcggcccaagagaatttggggcggtccggccgagctaaatgggccggccggcccaaggcggcccaagacgcgcgcgcgcgggagggaggagagagagagccggtggaccgggcttaccacgcgcggtcccgggtgggacccgcttgtcggtgacacggctcaccgtgtggagcgagcacgcggcgtacgcgcgcgggcgggggagggacgcggtgcacgcgcgcggttcgcggaggaacggttgcggtgggcccacgcgcagcctcacggctcgtggtggaacgcgcgcacgggaggggctgaccggggtcggcccgacccgatctcggccgagctggcgccgacgtggcgtctacgtggcgcctacgtggctgccacgcgggccggcgggaggaagacgaaggcgccggccgcgaatggacggcgggcggcggcggtttctccggggcgccttgcgacgatgaggggcgacggggcgtacaccgggatgacgaggaagaaagagacggagcgagccaacggcttggattcgccggagggagtccgtcggcggcggatttcggcggcggcaaccggcggagagcaaaagggggaaacggcgacgaggtcacgaggggccaattcccggcggtgagaacatctacgcggctacgggaatccgttgctagcgtcggattgggcggagctacgccgagcgaggccggcgacgagcgggtgctacggagcacgggcggcgacggcggcgagcacactgcgagcggcggcaacggtcggggcggcgccggctagctacggggaggctactcgagctactaccgaaaactaagggggggagatggagcgaggagggagaacggagggaggcactaccgagatgaggaggggcgctgtgacgagaggccgacggcgcgggagtaatctctccggcctcgggtcggggaagaggaggaagacgagcgcccggagtccccttccgcgtccacgaacgcaccggatttcccgacgcttggcgatgaacggcggaggcgagacagagctcggaaggcggcgacaatggcgatgggagggagaagagagggagggcgcccggggctttaagggcggcaatgtcggtttggaaccgacttgggcggtcaaggcgcgagctggcgctcggcgctcgcgtccaatcggcgacagggcggagggaggatgacgccggcgggaggaagaaggggaaaaggagggagagaaagggggctcgtccctttcttctttgggaaaaaggaggggagcgggggcgtcgcggca

SEQ ID NO: 66901 - DNA, 4706 bp, Oryza sativa
cagggtgaagacgcctcgccgtgtcacttctctgaatcttacaaatcgaggtttagtagggaagatttctccttcacttggaaacctcacatttctgaagtttctgctcctgccaacaaactcgttaactggagagattccttcatcctttggttacctgcatcgcctccaattcctctacttgagtaacaacacattgcaaggaatgatacctgatctgacaaattgttccaacctgaaggcgatatggctggatagtaatgatctagttggacagatacctaatattctccctcctcatcttcaacaattgcagctttacaacaataacctcaccggaaccattccttcttatcttgccaatatcacatctctgaaagaacttatctttgtttccaaccaaattgagggaaacatcccaaatgagtttgccaagttgccgaatctgaaggtcctgtatgccggtgcgaacaaattagaaggtaagtttccacaagccatcttaaacatttctactctcaccggtcttagcctcgcttataataatcttagtggtgagttaccatcaaatctcttcacatatctaccaaatctccaagatcttggtttagccgcgaacctctttcaaggacatatcccaaattcacttgcaaatgcttccaaactatatatgttggatatagcactgaattatttcactggaatcatacctacctccattggcaaacttaccgaactatcatggttaaatcttgagcaccaccgactccaagctcgtagcaagcaagattgggagtttatgacaagcttagccaactgcagtgagctgaacattttctcgatgaaggacaatcttctggaaggccatgtgccaagttcattaggcaacctttctgttcaacttcaacatctgctcttgggaacaaataaattatcaggagattttccttttggcatagcaaaccttcctggcctaacgatgttaggattggaagataacaaatttaccggcattgttcctgaatggcttggatctctacaaaatttacagggaatagagttggcaaacaactttttcacaggacttattccatcatccctagcaaacatatctatgttggaagaactctttctagaatccaaccagttatatggatatataccctctagtttgggaaaactcaacgttcttagtgtattgagtatgtccaacaatagtctacatggcagcataccagaggagatattcagaattccaaccataaggaagattagtttatctttcaataatttagatgcaccccttcatgatgacattggcaacgcaaaacaactcacatatctgcagctttcgtcaaataatataaccgggtatattcctagcactttgggtaattgtgaaagtttggaagacatcgaattggaccataatgttttcagtggaagcatccctacaactctgggcaacataaagactctaaaagttctcaaattatctaacaacaacctgactggatcgataccggcttctcttggaaacctacaacttcttgagcaactagatttatcattcaataatcttaagggtgaggtcccaaccaaaggcatcttcaagaatgcaactgctatgcgggttgatggaaatgaaggactttgtggggggtcactggagctacacctactcacctgttctaacaagcctttggattcagttaagcataaacaatctattttgctgaaagtagtactcccaatgaccatcatggtgtcacttgttgctgcgatctctattatgtggttctgtaagagaaaacataagagacagtctatctcttcaccctcatttggtaggaaatttcccaaagtttcttatcatgatcttgtcagagcaactgaggggttctccacatccaatctaagtggcagaggaagatatggctctgtatatcaagggaaattatttgaagggagaaatgtggttgcagtgaaagtcttcaatcttgaaactaggggagcaggaaagagcttcatcgcagaatgtaatgccctgaaaaatgtacgacatcgcaatctagtcactatccttactgcatgctccagtattgattcagctggaaatgatttcaaagccctagtctatgaatttatgccacaaggggacttgcataatttactatactcaactcgagatggtgatggatcttcaaatctgcgcaatgtttcacttgctcaaaggtaagcattgcagtggatgtgtcagatgcattggcatacttgcatcataaccaccaaggaaccattgttcacagtgatataaaacctagccacatccttctaaatgatgacatgacggctcatgttggagactttggactagcaaggttcaaatctgattctgccacatcatcttttgtcaactcaaattcgacctcttctattgcaataaagggaactataggatatgttgctccacgtattgtgaattatgcattgacatttcttgctattcgactgacacattgcaattttttcatattcatgtgagcatgtgaattagtgggaactaaactcttcctttcttgatctactcaatgtgctgaggatggtcaagtttcaactagcccggatgtttacagcttccgaattgttctactaaatatattcattctaaagaacccgacggatgacatgtttaaggacggactgagcattgtaaagtatacagagatcaacttgcctgagatgttgcagattgttgatcctcagctgctgcaggagttgcacatttggcacgaaaccccaacggatgttgagaagaatgaagtcaattgcctgctttctgtgctaaatattggacttaattgcaccaggttggtcccaagcgagcgcatgagcatgcaggaggtggcctccaagctgcatggaatcagggatgaatatctgagaggagactgaagattgaagaaacagatcactgatgattccatctgagattgaagaaacagatcactgatggatacgaggggaaaattatctgagatcagtactttttccctggataatttgtgaacgaactataatggcatgatttttgtaccatcataaatgtagttgatgcatggagtaccggcatcacatgccactgatgcatccggtacataatttactgtgttccaaatgtttctgtaatgatatcagttcttgttaatacagtgttccatctgctatgtcaagaaaacggaaactaatattgttgcttatcaaattatgctaatgaaataactcgcatgacaaaatactgaagtgtaaaacaattgccttctcatattttattttgatcaggtacatggcatttaggggacatcaagaaagatcaacaccaggattgaagtcgaagtctcagggggagtacaaaggtgagcaaagaatagacagtatcataaaacatctgggagcacatatcacggttttgtaagctaaaaacaatacaaggctacacaatgatgttcatgtaggataatctctactgcctgtcattccaactcaaacaaattgacaacaactgacaactcatgaaaattgggagtagcaaaaattgagttcggatgggcctttgtaataatttgatatacgtgtgacgtcttcgtcacagctcagttaactgctgcctcccttctgtttgagggtgatcttgtcgcctaagctgagggcgattccttgggtcttactccgtattctgatatagccactcagcttgccatcggcttgcttttcaacgctgatgttcaccaatgcatcctcaccaaaaacactcttggcatagagattagcagcgataaacccacattctccatcaagcgcagatctgatgttatcatatacaagtataatagggtcagcggtattagcaaccaagcagcagtggcattagacatgctatgaagaacccagctttgatgttggaaaaatgtaaatatgacactcagataaataaattggtgagggaaaaagaacatgattcaaccaattcactccatcaagacaaaagaggggttcttgcagtgagattattctgtttagctacaccaaactaaccaaccatgtacttactacaagccatgtacagatattttgaccatttgggttgttctagtttctgatatcctataaaggtgtctcaaaagaatagctgctaataaaatgattaaaaatagattcagcatatttgatttattacgcgtgcaatgttggtttggtaggatggaaactaaatcacgtgtctagtttgtgagaccctacgcccagttctcaatagcaaaacaggtccacaaccatcccattctagtatataaaccaaagcacctggtatatctttattaagtaactaggaaataatgcagaagctactcttggcccaagttgaccagccttatatgcttaatgtacagcgcaagtgcacaccattactctagtttatctggcacatgcataagagaaaagtgggcgactttccaattaacagttgtgtatgtacaaggctgtacccatggagacaaatgcagtatatcaaagaagaaataaccctaactgcctgttaatgtggaagaatagtttcattgtaacttacggtggtgttagacacttcatatttgtcgatttgatgatatgatccaaaaattccttctcatcctgaatgggggtgcagg

SEQ ID NO: 66902 - DNA, 5546 bp, Oryza sativa
taacccaccaccagtcccccacaatgttacctcttcataacacaaatagtgaattacaattttggtgttcacaagctaataacagaagtaaaagaatatgttaataaagaggagccagacaaaaagatcacagtgaagaagaaaatctagcagctgcaaataatacatgaaagaatcttgtaaaacaagcatttgcaaaagctgaagcttgagaaagaaccctaccttgttttcccactcaaattctgcccacatgttccggaaagcaacatcggcacaagtagcaggtgagatataatccatgatgtcaatgtgaatatcgtttaggaccaccactgatcgctccattacatttgaggtctcataaacaatgttaccgaatataactcccgtctctgttgatgaaaccttgatgttggcccgaatttgcttgcttgactcaggagccagcgtgtaattctgggggcggtcaacaagtttgagatcacccattgttgctaactccaagcacaagttctgaagtgtttcctttgttcggtttatgactgtaacatcaagcacaatatcatagtggtgaacagttacatatgcttcagcatacacaggatcactgaaccctgttagttgaagaatgcgattcagtctgtttgcgtcatctgcatcttttgtaaattcaccagtagcagccttcaaatcatcttggactgcatcttccaactcaagttggctcattccctgcaagaatgaatggcatgttttagtgaagaaagaaccgcaggccatcttttcaaatactagacaggaaaaaacagtaacatagtaacacgtcagtccatgtgttaccatattaaacaataacattaaatctctactgtacaaacaaaatgttccatgcccatttctgtcagaatagtctacacaagcctatccaaatattcttacagagaatcaagttttctgcttaattattacctttaaattttaaaagcatgcagaatatttggataatttgattcctgaaccagaataataacaaatccaacagaacacttatgtagccatcaattgaagtatttaactatccatgttaatacttactagtactacaagacatattcagtttataatttgatggggcatgggagtattgggaccattcactgaaacacaaaacagagaaggaaaatgatattgtctatcgggtataatattcgtggaacaataaagtaaacacccacacagaacctgttaatgacatctgacatctggttaagtaaaatctaattgagacaggagaaggatattgataggcctttttcttttgaatgtttagaagttacttgtagcagtacactcgattgtacacaattgttcaaattctatgtctagcactcaccaataggaaatgcttcatttcaacctgaacactagacttaatcattctttcatttgttaaggatatgcaacatcaacagatgaccgataattggcattatcaatgcacgtgtcattatgtggtttgattaagctttggatgtttgtaaacagctgatacccactattagccaatacatatggatgatgtggattctataaagcaaacagtgaaataagcttaccctccggctcttcaggtggtagaaatcaatgagatcatcaggctgggcatgagagatctgcgccttggccttcatctcctcagtctctcggaattgtttttcagcaagcatctttgtaaagctctggcggcatgactgcaaccagaccttcctcacatcatcaccagtattgcaaagcaacctcacacagagcacaatcctatcatatgagtcattgtcaatagggtggggaaggtacgaggactgccccaactgcagtatggacaccatgatcagcaaggccccagtagaagccttgtttgcttcagcctttgatggctggacctcctccagcctcagcacaagcttggtgagggtacaggcaacaacagcagctaaaaagaaatcaccagacagaatgagagatctgagattctgtgtggaactcagtgaccctggagcaacagctggagacgaaatggcagtctctgtggcagcactctgtgtggcataagtaccatctgcaagaacaacaggcctcctagaagatactgtgacagagttcaccacaggctgggctggctttgacgcatcagttgattctccttcctcagagacagtgtagaatggcagatcaccaaggcactgcttgatggtggaaatggcactctcaacctcagatagtgaaagggagtactccccaaggatccagagagcacatgagcagacacgggatgcacggatctgataaaatgtatcaatcagcctctgaatcattgacacacggagcttggggttggtctcaatgatctcgcgcacaaacaaaacaacatcaaccgctgcagcaacattagtgtcaccaaggaagtccatgaggaggtggaccaccgatccagccacctctgggtactcgacagcgcaggaatggatcgcctgcaccagcatctgccggtactcaccacccttctcgagatccccggcctgtgtcttaacaacctccttcttgaggtacatcaccacctcctccacatttcggggggtaagcagatcaagcaccaaatcaagcaccttcctcctgacatccacattggggctagatagcgcacgcagcacatccatgaccacatccaccatgacatcacggtgcgaggcacgcagctcgtgcaggcggtcaaggacaataagcttcacattgttgtcgctctgcgacgacagcagctggcagtaggtgttggcagcagcacgcacggcagtgggcgccgacgacagcgacacgagcgcgccggcggactcgtacacgacggcactgttgggcgcggagaggagggagatgataatcttgatataccttcccttgtcagcgcggttgggcgagcggcagaccttgcggatgagatcgacggcagccatctggaggagatcaggccactcggcgacgcgctcggcgttggtgagcaggtacgcgacggcgcgctcctgcgcgcaggcgcagagcatgaggaacccgttccggcgcgcggacgcgtcctgctccccggtgagcgcgcgctcgacgacctcgggcgcgtcggggaggagctggtcgccgtgcgggaggcggtagatggcggagatcgcggagagcgcgtgcctgcggatgaagtggtggcggtggtcgaggttggcgaggatggacgggatgagcggctcgagcagctcgggctcgttgaggcggcagaggaagcgcagcgtgaccccgcggatgtactcgttggggtgctggaggttgttgcggaggttctggcagatgaggatcatctccgggagtaccttgccggaggcgacgtcgcgcttgtcgacgatctcgaggtagaggaggaggagcttctggatggtgtggtcctcggaggggaggacgtagcggacgacggtgatgaagaggtgggggagggtctcgccgttgaggagcagcatgatggcgcgcttcatggcgtcgaccttggcggcgacgtcgctgccctcgaggtcggccttgatctcgttggccatggagggggagcccttgtcgaagtggaccaggagggtgcatggcttctccatggccgccgacgccgccgctgcacggccgccggtggggggtggatctgggggagtggtcggtggatctgggctctgtgcggggatcggatctgggggggagaagcctctctatgcctatgcggcacggggaagacgaagacgaagaagagaaaaaaagagtgggctgttcggtgcggtgcgggggggcacccaccggtagacgcgctctctctcttcttgggccgaatgaaaaaggccgatatattttggcccattaaaacaaacggccttctgcagcctggtctttcggactattacgccatacgaacaacgggccggatgcaatcgggtaagggtaaggttgtcattatccagaggaataagttcatctaaggtcccttaacttgttaacgaatccaattttcatccttcaaagaatccaattttcgtccttcaaaaccagatacaacgggtccctcaactgtcaaaaccagtgcagatgagatcactcggtggtttggacagcggttttggctgacgtggctaatttgactttggtcttcatctaatgtggcattgacatgtcgattacgtggtaatttgattcgaaaaaataataaacctcatgggacccacatattagcttcaaaaaaaatatataaatggtggggcccacgtaagccccatgtgtcattctcaaccctcctcttcttcctcctctctcccccctctcttcaacagttcatctctctcccctcttctctcacttcctcctatctctctctttctcacttttctccttgttttcaaaaatgacagggcgaggcaggaaagaacgggcagcgagccaggcgtaggcgggcaccacggcggtgggcgcggaggaggggggtcctagtcggcgcgtacgcgtcagggacgcacgtttttttccacacttaaggcagttaactaatctagttagagataatgacggtagtagttaggattttctttttttcgtgagattttttaactaacaaattgaaaatgaaatttatatctgtagtcaaatttttcaaaattttaaacccaaatttgaaaactttcaactcgaaaattgaattttttaagtcaaaatttgaaaactttcaacttttcatcttaaatttgaaaaactttcaacttagatttaaaaactttcaactcagattttgaaaacttttaacccagatttgaaaaatttcaactcaagattcgaaaactttcaagttcaaatttgaaaacttttaacttgagatttaaaaatttttaactcgacattaaaaactttcaactcgagatttgaaaactttcaagtccaaatttaacaatttttaagttcaaattaaaaaattactagtaaactaatcactagtaaaaataggaaactaatcactactaaaactaattacaattttttctcctacccatacggcatcaaactgcgagaaaaaaaaaaagaaaacgacgataggttagcgaaaaaaattgcgcgcgcgccctacgtgggccatgtggaccgggagtgcgcgctgccggcgcgcgaacaaattaggattctggcggaggaggcggagccgggcgccgcggtaatggacgcgaaggtggaggcaagcgctgtggcaaccgtcaacgagcttcttggcggtgacagataggctaataggcatcggaggagcgggaggacctctggatcgaagccgaagccatggaaggccgcaccgagaacgactccgccacctacgccgactctggcaagtggcaaactggcaacccctgcctcgacttcttcttccatgtcgcagtcatccatggagctcgcggtcagagcaaccgccgcggcctcctgctcctacggcaccgcacctc

SEQ ID NO: 66903 - DNA, 9397 bp, Oryza sativa
ttttgtctttgcaatactaatccaatatgtctaatacaatggcatgataagaagccgttgatatatctatcacccgccgcaatacggtaaatattaaaagctatagcctagccatggtcaaaggtacggttggcgacatggctgaaaggtttatttaagaaaaaaaattctaaagctatatacagtttttactatagaacggtttaaaccgaagaaaacattatccattcggatgtaacaacatcagtgatgtctgaatgatacttatatgtataattaaacctttatagtctgaatgacaccggtattttttagagaagaatgacaccaatatggtgcagttgttgtcaatggcttttgagatagaatgtcctagctacagggtcgaggcgtgacctatacgaacaggtggtcagaaatgttaaagaaaacttctgctacgtagccaaccaaaagttgccatgttgcgcgttcaacacatattctatagagatccatgtgacgactacgtacatgatagggtttaccatccgatgtaatccggacttccctaaccaggtcgaaaacacaaattgctagtttttttttgttaattaaaaaatcaaactgaattttaaattttcagaagctagatttatccatgttttttgtttttatcgatttatcaatggttactgtaaaatccaaagacaccgctcatgaacggtttttattctcactatcagaattgtgaacccaaccttgctccatgaaggctcaagtggttcattcaatttcactgtcatttcgtgcccactaatcctcgacgagtctctctcgcgtaccaattaaacgatgaggcgttgacatccgttgctttgtttttattttcagttattcagttactacgtacaacattacagtgttaataattaacccatcttaattactcctggtttagtgcatgcagccaatcatgtgcagctacgcttcctatataaaccctacctctcgacttcgataccatgcatattaccatactcattagctcgagacagtaattaatcatcatcataatatataatgggaaggctagttgtaacagtactgttcgtgttgtgctcgatctctctgacgacgacgtgcgccgcggcgcttcgcgggcacgatctccggcgagccatgcgcggccgcctcctcgccgacggcggcggcgcggtcgtgccgctccactggtcccgcgagctctacaacgtggcgagcttcaccatcggcacgccgccgcagcccgcgtcggcgttcatcgacgtcggcgggctgctcgtctggacgcagtgctcgcagtgcagcagcagcagctgcttcaaccaggagctcccgccgttcgacccgaccaagtcgtccacctaccggccggagccgtgcggcaccgccctctgcgagttcttcccggcgagcatccgcaactgctccggcgacgtgtgcgcctacgaggcgagcacccagctgttcgagcacacctccgggaagatcggcaccgacgccgtcgccatcggcacggccacggcggcgagcgtcgccttcgggtgcgtcatggcgagcgacatcaagctcatggacggcggcccttccggattcgtcgggctagcgaggacgccgctgtctctcgtcgcgcagatgaacgtcaccgcgttctcgcactgcctggcgccgcacgacggcggcggcgggaagaacagccggctgttcctcggcgccgccgcgaagcttgccggcggcggcaagagcgccgccatgacgacgccgttcgtcaagagctctcccgacgacatcaagagcctctattacctgatcaatttggaagggataaaagccggcgacgaggcgatcatcacggtgccccagagcggccgcaccgtcctacttcagaccttctcgccggtcagcttcctggtcgacggcgtgtaccaggacctcaagaaggcggtgacggccgccgtcggcgggccgacggcgacgccgccggagcaattccaatctatattcgacctttgcttcaagagaggaggggtcagcggagccccggacgtcgtgctcacgttccagggcgccgccgcgttgacggtgccgccgacgaactatctgctcgacgtcggggacgacacggtgtgcgtggcgatcgcgagctcggcgaggctgaactcgacggaggtggcagggatgagcatcctgggaggcttgcagcagcagaacgtccacttcctctacgacctggagaaggagacgctctccttcgaagctgcagactgcagctcactgtctcctaattaattcatggcaatggccgctgctgctgcttccttcaggaagcagttcttgcttagatttgcaggtgtgcatacttatattgtcagaataacacaaccaggcggcatgctttgcttctcaacttcagtagcatcgtgctcttccgcttacgtgcttgtatcctaatctgattttatgtcagatttatgctaggtagtctaaataatattcggtggtgatttttttttcgaaatccaatctttattccatgtcttactccctccgtcatgaaaaaaaacgaatctagtactggatataacatattatagtacaacgaatatagacatattctaatactgtatgtccagattcgtagtactagaatgtgtcatattcggtattgtattaggttggttttttatgcgacagagggagagggagtatggtttattaacagtatttgatctttgtgactctgtccaacacggctgtctatgtcagcaggtattgtacgacatgtaccaactcagcaagttttatacaattataaatattagcaagttttatacaaataaaacatatgccataccagtagagtgcagagagataagtatttgaacttcagtcaaaatgcatatataaacatactgcctctggttttttaatggacgttgatttttaaatatttaaccatttgttttatttagaaaaagtgtaatatgctaaaatacaagtcatgtttaaattttttaatgttaaaatatgtgtcaccaaaataaataatatttatataaattttttgaagaggacagatggttactcactccgtccataaatataaggtgttatgtctaaaatagcacaaattaagaaagagtaactagtactagtacgtctatgtagcttgaaaataagtatttcatccgtcctatattagttgccgtggttatttagtatatgttaaggtttgagaaaaaagactttagtacccctcattaaattttgtatgtttagatgtaggagggtggttgagagtaaaaagaaataaatttgaattaaaagtgattgatgagacaagtagtattccattgtgacaagtattttgggacaaagtttgaattctaaagagacaagtaatttgggacggaaggagtacattattgacacaataaacaaagtagtactccctccgtttcagcatttcccacattcatattgatgttaatgaatctagataacatcaatatgtatgtgggaaatgctagaatgacttacattgtgaaacggaggaagtagtacactagtactagtacgttctcagtagtacgccatccgtcccaaaatgtaagtacttttggactccgatacgatttccaaattgctactttaaccaacattatccacaaaaataaaacattttgaataaaaagagttgtatattattatagtttgtttaaggataaatctagtaacatcaattttacatgatttatcttttttattattttgctattaatagtcaaagttaaaaatgtttgacttgttactattctaaaactacttatattttaaaacggagggagtatcttttttttcctttttgaaatggaccgtgcgaagtagtacgagtgctagacattctttgtatttctttagttctgataaattagcatcacataggttaatcatggattaattaggcttaatagattcatctcgtgaattagtccagggttatggaatgggttttgtcattagtctacgtttaatacttctaattagtgttctaatatcagatgtgacagggactaaaatttagtccatgatctaaggctgtgtttagatccaaagtttggatccaaacttcagtccttttcaatcacatcaacctgtcatacacataacttttcagtcacatcatatccaatttcaaccaaaatccaaactttgcgctgaacaaaacacagcctaaatagggcctgagtgatggatggtggaggctgacaggctgtgcttgcttgcttcgggaggagacaaatccactattgccctggacatacccagggaataaaatccctcgtagtacttctggacagagggagtaaatgtcataagtaaagagtcaacaatattatgtacttaaaaaaaagagtaattaattacatacagttactgagttaagcttgggctgtgtaagtccggtttggagcatatattctgctcaaccacagttccaaagttaaaacctcccccagtttgtaattgtagctactagtttgtcatattccaaatattcctatggagcaattgccattatgcaggctggtcatgacatatctaacctgctccattacagacgaaggtataggttacatttcgacaacatcccattcttaatgttctgcccaaatagagaaataattctggtagtatgttattatgtgaatagatagaaatacgttcacattgccatttcattcagtgcccactatagatcacgagttcacgactttaacagagatgcaaaccatttttattattaaaaaataatcttgcatgcgtctctatctcacttcaacaaaatgtccgacacaatgaggcgttgacatcagttttattcagttacggttggtgtcgaactgtcaatatcttaattaatttctcccggttatgctgatgcacgcacacccaatccgctgcgctgcatccctgcagcatcgatctaattttccctatataaaccatagctgcacatctcttcgatcaaaatcacgatcaaactcatccttgcgctcttgaaacagcagttaaaatcacgatcattagctcgctgattgataactaacagtggtcataatcatgggaaggctagtgacaacactgctcgtgctgtgcttgatctacgtgacgacatgttcgctctcgacgcgcacggcggcgttccgcgcgcacgacctccggcgaggtctagagcaagccatgcgcggccgcctcctcgccgacgcgacgccggcaggaggctcggccgtgcccatccactggtccagacacctctacaacgtggcgaacttcaccatcggcacgccgccgcagcccgcgtcggcgatcatcgacgtcgccggtgagctcgtctggacgcagtgctcgatgtgcagccgctgcttcaagcaggacctgcccctgttcgtcccgaacgcgtcgtccaccttccggccggagccgtgcggcaccgacgcctgcaagtccatcccgacgagcaactgctccagcaacatgtgcacctacgagggcaccatcaacagcaagctgggtgggcacaccttgggcatagtcgccaccgaaacgttcgccatcgggacggccacggcgagcctcgccttcgggtgcgtcgtggcgagcgacatcgacaccatggacgggacttcgggtttcatcgggctagggaggacgccacggtcgctcgtcgcgcagatgaagctcaccaagttctcgtactgcctctcgccacgcggcaccgggaagagcagccggctgttcctcggctcctccgccaaactggccggcggcgagagcacctcgacggcgccgttcatcaagacctcgcccgacgatgacagccaccactactacctgctcagcctggacgccattagagccggcaacacgacgatcgccacggctcagagcggcggcatcctcgtgatgcacaccgtctcgccgttcagcctcctggtcgacagcgcgtacagggccttcaagaaggcggtgacggaggccgtcggcggcgcggccgcgccgccgatggcgacgccgccgcagccgttcgacctctgcttcaagaaggcggcggggttcagccgcgccaccgccccggacctggtgttcacgttccagggcgccgccgcgttgacggtgccgccggcgaagtacctgatcgacgtcggcgaggagaaggacacggcgtgtgcggcgatcctgagcatggcgcggctgaacaggacggggttggagggggtgagcgtcctgggaagcttgcagcaggagaacgtccacttcctctacgatctcaagaaggagacgctctccttcgaacctgcggattgcagctcactcccctgatcgatcaatggcggctactgctgcttcttgctggaagctttgctgttcaagcttaattccattccatgtttgtgttgtgtgcgcgtgtgtgtggctgtgtgcaggtgtgcaatgttcatagataagataacgcagccatggcgcgcgcccaggcggcatgagctgcagcatgctttgctttactctccagtgtgggtagcgtagctagttctacttcctgaatctataggctatacgtgcttgtgtaagaacgagatcctcttgtcgaactccattcatccttaaggaaatatccctcgtttttgcatggtgtttcaattattagcaactttttctaaaagaaaaatagtaagatagatcaatatgtgatatataactccaaattcaacttatatatatagaaacaaagataatttggctcacctgattcgggatataggtgcgcagaggcgaactcaaaacaaaaattatcgggggtccaatacgtactaattatcttttttttacttatatactagttatcatcatataatttagttagaattgaatagtttacccggggttcgaggacaccaggaaaatgtacctaggatcgccactgggtgcgctgaaaatgagaggttgtcatttttaacaacatgtataaaatgagagtatgtccttccacttttgatcctctgcagtatgtagtactgcaatccacatgtgagctctacttgctcaaagtcccacatgtcactggctcctattacaagagcaattatatagaggagttgagttcgcttgtgtccagattgatatatcagtcttatgttaatttaaatattattcagttgtgatgtgtgggctttgatttcaaaattgaatcttcgttccatgtctaatggtttatgaatactcttgcgttacatcttcccaacactgttggcctttgtcagcatagatcgttctacctgtgccaactgaacacaagtcaggaaaaattgtcatgaagtctcatgactctcactctcatgtgcacaagccatcaacttcaaactttcagagtcaataggtaaataaacatacagctactctcagacgataccttttgcttcaactcgaagtttgccggcagtgatctgcagaacattccgacgctgatttcgggaagtctgttttcaggtttgaggatataggattaataacggttatacagattttgggtaactgtttatttctgtctttaggttggtttccatcaattccattataaataatgtatataaacatatgctaaacagattgctcattcagttatcctgttcaaatagtactaaaataattaaatcattttccccaattcgtatatgctactattagtttctcttattcctatggagcaatcgtcatgatgtagattggtcatgatatggcaaacctgctccactatagatgaagtctaatatttactccctcgctccaaaataaattaacctacacatcacagtgctacgaatctgcgtggcgaagacaaaaggaaacttagctgcaaagttgccgcgttgctgaacacaataattccacgtgaaggctcaagtcaatcatccatttcattgtcatttcatttttgcccactagatatgaacatctcccatccctagtgtggcagaagccagagttgtagacactgtttccatgcattatcttcgttttaaaagaagaagatctcgctgtctctatctcatacggagtataccaaaatgtccaaaacgattaggcgctgacatcaatttatctagctacgttacagtgtcaaactgtcaacatcttaattactcctggttatgcttatgcatgcaccaatcagctgcatctactgtccttatatctctactattataaaaattaaaaatatttttgccggcgctttgatatatcatctgtgtatgagtcggttttcaaattcgttcacttttgaaaatacatatccgtatttgagtcgtttattaagttcgtttgcttatggaaatatagaagagtcgtataagaaatctctttaaaaaatctcgcatgctaacttgagatgatttgactctaattacaactcataattttaagtgaattctcacagtaaattttaccttaattaaaccgtataacaataataagattaaaataactttcacccgttgttacgcatatgtatttttctagttaaaaaaacgagatttgaaggaagggatgttctctgtccccatataaacccaagttacccctcgacttcgatcactaatccttcctctcgaaagttgaagcatgcatcagtcataatcagttaatcacgacaattagctcgctgattgataattaaccgtaattataatcatggcaagtctagtctcaacgctgctgttgatgtgcttgatccctctgacgcgcgcgcacgaactccggcgaggtctggagctcgccgacgacgcgacgacggcgcggccaggaggcgtgaccgtgcccgtccacttctcgcaagcgttctacgtggtgaacctcaccatcggcacgccgccgcagcccgtgtcggcgatcatcgacatcggcggggagctcgtctggacgcagtgcgcgcagcactgccgccgctgcttcaagcaggacctgcccctgttcgacacgaacgcgtcgtccacgttccggccggagccgtgcggcgccgccgtgtgcgagtccatcccgacgcgcagctgcgccggggacggcggcggcgcgtgcgggtacgaggcgtccacctcgttcgggcgcaccgtcgggaggatcggcaccgacgccgtcgccatcgggacggcggccacggcgaggctcgccttcgggtgcgccgtggcgagcgagatggacaccatgtggggatcctccgggtccgtcgggctagggaggacgaacctgtcgctcgccgcgcagatgaacgccacggcgttctcctactgccgggcgccgcccgacaccgggaacagca

SEQ ID NO: 66904 - DNA, 1971 bp, Oryza sativa
catctaggttctaggaggttgttacatgcacaattttattggatcaaactactgaccgcaccatcccacgttccgattctggctccatctctctactacttaaaaaatccgtagtggtggtattgattcctgacatagcagacgcgtctgacagacacgcgtaatctcaaccatccaattgccatatccaacggcgtcaatcgtccatctcctatccatcacgcgatcactcctctccccatcacgcgctcgctcctctctcggatcgatctcctccccacgcccactcctccttcccccacgccgcgtccttcgctctcctccctgtgtcgcctccttgccccgccgtctcgtcgcctcctcaccagccatgcccgccggcctcctctccagacctgcaatcgccgccgccctctccaatctcctccgcgcctccacctcgcatcggattgatcctccaccttcgccctcctccctgcgtcgcctcctcacctcgccgccgcatcgcctcctcagcagccacggccgccggcctactctccagacgctccctcgctgccgccctcgcaaatctcctccgcgcgctctcatccctcccctaaccatcaccggccgcctccccttccaacctcccctagccatccgcccgtcgccccctgcccaccgaagacggatttcaggtaatgtgcctcaaaccctttcaggtaatgtgcctaaagctttacgaagcccgccggccgccggtctgattatctcgatgggcgtactgaaaattctgaattagttgtcttggatgtgtagttagcgttagtgaggtggaggctttgttcgagctgttcaagagcattaatggttctgtgatcgacgatgggcttatcaataaggtgatcatctaactgtagcttgttgtggaattacaaaattaaaccttgccacattcgaatgtatatctccacatagaaaattaaagcttgtggtggatgcctttttctgtgaatcgttttgctatgcgggcaattctattcattcatatttgaagtgagcatggatctgtgtattatgtgtttgccttctaaattgtttaactttctgtgtaccaatatatgattttttttcctcaaagtttaataggaagatcttgttcccgatataaaccatctggctggacagatactatcacaatataacaacacaatgatagctcaaagtttgagtcactttcttcctgcaatgttgttccttttataagggagttaaacagtttagaagaatatgggtcagaattatgttattattgatctgtttctgttgtttgctattgtaccacctatgcatgattaagtaccatcctattctgttaatgtacagtcaattgtgtattttttatgtaacaattgagtccatgtacttgtgagaaagataattttctggttgaaattgatggctgagtgtacataacatgcctcactgccagtggctactatttcagcgaaaaatagagcattttaagaaagaaaatgcagatgcaacacttttgtagtctagattagagtaaaatctacatgcatgcatgcaccttttgtagttatttgcaagttaatgtgtcggggttagattttacctgcgatttgtgtaaatgaatgtcggttcatcacttcatctttaagaaacatatgctgtcccggggaaagatgaaatggaaatattgtggtctactgttcagtttggataaaaatatggtggtctactgttcagtttggataaaaatatggtggtctactgtttagtttgaaaaaaaaatgttcttttcataatttattattgaaacctactgatattataaaggggcaattgcaaatttacccctattataaattgtacaaaaagctgattctgacatctaccttttgaattattattggtcattctgaatataggagtagatcttctgaattccaagagggatctttg

SEQ ID NO: 66905 - DNA, 35762 bp, Oryza sativa
  unsure (1)..(35762): unsure at all n locations
gctcctttctcttgctcacctaccctcctgctctgtcccccctcaccatcaaagagtcaaggagggcgctgccaatatcagatctggagatacctagggcctttccatcattggatccgcttgagccatgtcagtgatgaggtgatggatcgcactagcccccgtggcctccacctcggtgtcatgccgttggggaggatgccgatcgatgcgaatcctcctcccacgctactgttagtggtgatggaggggaaacaaatgaaggtgctagatctgaagtttcgattgacaatcgacgtggtgctgcagacattggctgcttgttgacattgtgcgcaggtatgtcgtgtgtgcggcatatcaccatggcttagctggtacctacaagtaccaggcacggtacctgtggtaatgtggtatcatggttgatacctacacagggctggtacctgtggtatcatggttgatacctacaggtactagacctggtgccaatggtatcatggttgatacctacaggtttcagatctggtacctgtggtatcatggttgatacctacaggtttcagacctggtacctatggtatcatggttgatgtctcgggtaccagctgatacctataggtgctaaccgataacccataggtactaagtacgaggtatcaaggtatcgggagagaacgtacgttgttgcctcttggctgggtggtgagccatctaccaccagcgttttgtctcgtcttctccttccattcctttcactatcaccatcctttttcttctcaatgtggtgttgatacaagggtcatcatgctattgcagggaccaactttgtcacctaatccactattagtgtcgtgtccttgttctagcgcctcacgcgtgctctttcaccggctgtggcgtgagcgtgtagggcggtgctaaatcgtggactcatgagtggataaagctgaggcggagctgacatcatcaatataaagtatcttgtttggacgggataccgtaccctagcacacctcttactgnggggggtgtgcctctactcccctcccccccgctctatccattccaaccgcgcacagtattattgggcctggcttggagcttatgggcctctagatatgattacaactggcccatagctttcctgtgcaattggtgtgcatcttcgtatatgtagataggggcatgctgccgctccccccccatatatatatatatatatgtatcgaatacatataactagatatatactctcaatttgaaaattttgaaaaaattgggcgaatttgtgtattgccccatatgagtgtcctatatatatatatgtaatatatatatatatatatatatatatatatatatatatatatatatatatatatatatatatatatatatatatataactggtgctacatggagtatgggctccaagattcaaattgagtatatacccaatttgaatgagtatgaaatttttttaaatgtttagatatgaacattaacttctttactaacaagtttgaactgagtttgaactttttttttgttagattttggttctaggtatataacatccaaacatataattcgttaggtatataataatgaattgtgaaataaagttgagtttgagttgttttgttgttaggtatttgtatgaatcgaattcatacaaatgaatttgagtttgagttgttttgataccatggtgcccgggcaccatggtgccccatatgggtattatatatatagtagttttgacgaagtcgcggctgacatgagcctgacgaatggcgtgagagctcctcgccctctgcagcatcatcgacgcccctccatcggctgcggtgaagaggatggtacgcctcgccatgaagaccccggtgcaacgcctggccaaggccaaacgaagcatctccttgggcagcaaggccatggcgcgccatggccttgctgcggttgctcgaaggcgcgcgctcgtggcggcggctagggtttaggctcgagggggaggagagcaacgaggaaaaaagagatatcccgtccgtatatatatgggtgccaacttcacgggccagactgggccgtctgtatcttctgtcttcgactgggccgcttttcccagcaaattcccctcgtttcctaaaaggaataagttcactttgactcccttaactagtgacaaaatctgattcataaccttgaaccacaactattaaaagggtgtaacttgactccctcgacggtcttagagagtgattttgcttatgtggcgcctaggtggcggtgttgaccttgtcttagttacacgtggcgttgatgtggcgcttatgtgtcattaaaattaaaaatatatgtgtgggacccatttgtcatcttctctcattcccttcttcctcatccctctctcttccttctccctctcttgtgcttcaatagggaaattttatgctaagctaacgaccttaaccaggtatgagcagggaccggatcgacggcggcggcggcgggttacgaccaccaccaagccgataaggaggaggacgacgactacggttgtgactacctctttaggtcatccgttgcgacaaggatgatctcatctcgcggttcatggacgtcgccatgtgcgacagtcgagacgctgccactatcacctcaactcttgacgacagcctcaacgaagtcgttggcctttacttcgcggccgctgcggagaaactcatccgcccgtccttcgtgaggctgagtggccaccgtcctagacgctgatcgccgccccttgttcgactgcagcccggtgagagctcgccaccatccaccgctgctactaccctcgtcctcctgctgccgtgagcctccatgaggctgagccaccaccgtcctccttggctctgtcgtcctagccgcacgaccgcgacccttggttctgctgtgtcctagtggaagctcgcctccaaccgccgccgctccgctattccttctgctgccattgatctggtccccgctcccccacgtactccctccatcccaaaaaacacaacctaggatgggatgggacatattcatattctagtacaacgtatctggacatagatacgttatactagattatgtcccatcccatcctaggttgtgttttttttaggacggagggagtaggtctgaaggggaagagaaaggggatagaaaaatgaggagagaggagggaagaggaagaaaggaaggagagaggattatatgtgggccccacatgttagtgtgtcccacaatattttgtagtgtgaatgataaatgtgtcacacatatatattttagttctaatgtcatataatcgctacatcaatgccacgtagaacaatgaccaggtcaacaccatcacataggcaccacgtcagcgaaaccatcctccaaaactaccgagagagttatattgcaccgattttaacaattgaggcgtcaacatattcggtattgtggtttaggaatatgaattagatttggccacaagttaagagagtcgaagtgaacttattccttcctaaaataaaacgatcgtcgatttgtatggtttataccttttgctcaagcatcatctacatacagaagtattttttttcttttttttcctttaagttcagtatagtatagtgttgattcagcgttcagttgcatcatttcatttcgctttaccagttaagattgtcgatgcctgttctgcaaatattgagcaaacagtgaaacaaacgccatatttaccatcccacgttctgaggaacgccaacaatacatggaaaagttgctagtacaaatcaaacatcttgcacatattagacgtgcagtgatatactaacaggataattatgcctttgattccacagtagccaaaatggcgagcaccagcaaattaaaaggcagtaaaataaaagagaaaatagtgtgagtagttaaagtggtcctccaagttttatccgagactcagtttaatccttgatgttttaatctatccatattagttcttcaggttttcattttagttcaaacttatccttagacccacttagaagccatatggctaaacataaccaacaactctcttgataaatgacacttatatcccccatttacatatataagagaaaaaattacatgcaatgggtttttttatagataatacatagtaatttatgtaaagcaaaaataaattatgtacttgcaagtgtatatgatagctattgtttaagttttatgtgcacatattgaaataatgggaattacatatgcaatgttgtttattcatcttgattttctctttttctagtgtatacttgtatacaaattaagggcaaaagggacattttctaatataaatattgactagaaatagtcatatagaatattatgttgggccaagatgattttaagccaaaataaatacttaggggatatatgtggacaaaataaaatatagagaaccaaattgtgcctccagtgaaaattgaggactaatctagctattcacccaaaataaaacccaacttttccagtcaaaatacagcagtatctgaaggcactaacattggctagagaacaaggccgtgtttagttccaaaataatttttcaatctttcaacttttccatcacatcaaaacttttctacacatataaactttcaattttttcgtcacgtcgttccaatttcaaccaaacttttttaattttaatgtgaaactaaacacagcccaagaaaattttgaaattgcaagtcaatctgctgcggagagcggggtcgtctcgcctgccatcctggtgtctagctctactggcatcgcgtttctggataagaggccatgtttaattccaaaaaaaaaacttcacgctgacacatcgaatatttgatacatacatgaagtatttaatataggaaaaaaatcaattatacatattgcgtgtaaattgcgagacgaatcttttaagtctaattgcgccatgatttgacaatgtgatgctacaataaatatatgctaatgacgaattaattaggcttaataaactcgtctcatagtttactggcagaatatgtaatttatttttgttattaaactacgtttaatattttaaatatgtatccgtatattcgatatgacaattaaacacgaaaattttctccaactaaacgaggtataaatacacagagcacaatctaccctatgccccttgattttgcttgacggaggtcgccagaatatgttaatgagatcttcaggaccctgttcaggaaaaaaaaaagttctcaactgcaggaaaaacaaagcttcctgtccatactcgaagactcatgaaatgatacatacccgtgcagcggttactacgaaattgaagagaataagggcctcatcgaatggctatatgcagaaaatttggcatattagcaaaataaaataatttgtgattaaaatttttacatttatgtttgtaacgacttaaatcataatattgtaaaagaaaactatgataaaaaaatcaaatataaatttaaaattaagtttaaaaaattaaattttgacattggtatatgttgattgggccaaaagatgagagccttacataggagccaatcaccagaaggaacagcagatcaaaagtaacacttgcaccctgcgaattggagaaacaagtcaaagaatgtatgaggttatttcaatgtgttgatatcttacggaagtccctttgaaatgaattatctcttactggtaagcaattcgtaaaggaatgcattagcagaatattataatatgaaacaagaagtcacaaagcagggcatatgctttccaaaataagcttaggtcctatttagaccctggcaaaatttttcgccttatcacatcaaatgttatgacacataaatagggtattaaatataaaaaaaaactaactaaacagattgcgtgtaaattatgaaatgaatcttttaagcctaattgttctatgatccgacaatgtggtgctacagtaaacatttgctaatgacgaattaattaggcttaataaattcgtctcaaagtttacaggcggattctataatttgatttgttattagtctacgtttaatactttaaatatgtatccgtatattcaatgtgacacgccaaaattttatacctatggatctaaatacagccttattagaccattccgttgtgagatttgattattctacccaaactgaacaaatgacacaaagcttacacgcttacctgatatgggcgacacttcggtgcatagtataatactaccggtagaactaatctgaaccctttatttttatttaaggataggctagcaaaagtgcccgtacgttgcaccgggaagcgcatatatcaaaaaaatatacaattaattaaaatacaaattcactgaaatatttggtatttttaagtaggtatgtgtataattaaataaatttacaagtaaagcaagtgtgagaaataaaatgacattgttaaatttaattttattaaattctcaatgattagttacgctctttgaaattttattagaattttcagagcttaattgctaattttaataatacaaacatcatttaataattatttaattggaaaaagaaagaaaatcctttcttttaggtttgcttagaaataaacacattcaataattgtaaatgcttctgaaggcccgagggacctaatatagacttatttccgtcccttgccggtcggcccacggccttatcaaaacccgaatccaaaaagcagagtcgccgcttcctcatccgcgactccggccaacggttgcgcttgtaggagtatatcgcgttcccttccgccgacggcgaaactctccggcgccccctctccttccgttcctcttcgcctcctccattaatcggcgtcaacccacttctccgccgtgtgtgcgtacgtgcaggagcgactgctgtggagagcgcgactccggccgctggcgttggatgcgcgcgcagtgccttccgcgtgcgcccgatttgcgtcggcagcgcccacttcggaggccgctctgacgaattccggcgccgccttcacgatccccgtccgcgtgcggccgagacctgcggcggcgccaacctcggaggccgattcgttccattcctgtgcaagtctcgtgcgcacgacgagtactgcgaagaacaacccttgccatcacatcctcaggtttgctgtccggttttttattgatttgccttatattcgtttaacattgtttacctgctaagataattgcaaggccaacagtgagttgcttgggattagctctgcatttttaggtgaaggaaatctgtgtttcatttgagaacaattaatcccaaactttggttgcagcatgtagcgatggtagttttatagtatattagttttggcagtctgatcacagtgtgtattgaaaatatttggttaaatttttcaccaattaacgttccatttttttttcacaaattcttattttcaacccaagttcatgttcgaatagcaatgtagtgtgagcataaatccttggtaatgagcagacatttgttttcttcttatgcacgaactgattcagtttctatgcttagatagctctgaaaagacctatatatgatcaattgtgatgtacactgggatattataccttgattcttttattaaccttatttaagaaactatatatgataaagatttagacaggggacactttgtgaaggatgcaatttcagtcatctcaagtattgagcttcagttgtgatgtatcctcaagccataaatgatgttactttgctaacagtatctgggggcggacgctccaggcagtgaagctgggactgggagcagccgccggcgaatgcttctccaagagcaccaagattcacagatcgtagtggttctggaaaaaaaaagtcctatatggcgaatgtctgaagctagtggttgatggaaaacaacagtcctatgtgtgaagctggtgagaatattcagagatgctcgtgtatagattattatcagttagtactctgtttgtgatctatttactccctccgtccaaaaaaaaaaactcaaccaaggaaaggagtgttttttgggatggatggagtattatgcaaggtaagggcttgtttagttggtgaaataaaaatttttggatgtcacatcagacgtttaaccagatgttggaaggggttttcggacacgaatgaaaaaactaatttcataactcgcctggaaaccgcgagatgaatcttttgagcctaattaaaccgttattagcacatgtgggttactatagcatttatagctaattatggactaattaggctcaaaagatttgtctcgtgatttacatgcaaactgtgcaattagttttttatctatatttaatgctctatacatgtgtccaaagattcggtgtgatgttttttacgaaaagtttttagggaactaaacatgtcctaaatggtatgatctgtaattgtaagcgagatgcttgttcatttccacgtttcggcttgcaaaatgagatagtgctgaacatgccctgtggactgtgtttgactgtgattgtcctgcacctgaaaatggtggaacctcccggaatatgcatatttttaactgtacgtggagttctcatatttacacgcccattctttagaacacaggttaataacggcaaggctgctacatgctcaaactgacagcggttgacagatctatcaatactacgtaataagatggctgcgatcctgttcgttcctcttgtcaaaatttgtgtactgcttactgtatcagtataaccaccagaaaagatggtttcatttaagaaacatgagctctgcactctacagctgaacatatcgattccatttaagagcaaggctaataatacaaccgacttgttggctataaggccattcctaacacaatgactaggatagtatccatagcattaaataaattatcacctaggatgaaaaatgatgtggcaagtgaataaatgaggaaagagaaggaaaccatgtcttgtatgagacatggtttctacacaacatccaatacatcatgtgagataagtagtattaaatttaagtatggaatagtggtgtttgtattggaagggtagtgtctagtactagttttttgatgatgtgaagtttatggaaaccatgtctagtgtcttggggttgggaatggcctaaggtttttttcagccttctcttagcccacacatataatagttagctatttacaattaatatatgaccacttatctctctcacagaaattcttggttcttgcgtccaagtcagttgtaagtttacagcccgctactcctctctctcctatcttctctcctccacctaagcatttagccgacatacagcctcctattatacttgttctaagaaactagcaacataggcggtggaatcgccgaggttaggggaggcggcttaggcgggaagggagggggacaggcgacggaagtgagttggaagcggttcgttttgggcggcggcaaaatccatcgacaaaagtggttgctagggttcatgagcgataaattacgattataccccgtgcatacttttttcttagataatactacccctccacgtttctactactgttaattatggtggtagtagaaataaacctcaaccatttgattaaagaaaaagtacgaattaaccccccagactattacgatagtatgaattatacccttaaaccacaaaaccagacattttataccctgaactatctatactagatgaataacccccttcgatccaatccaaagcagtattgtcctacgtggtatgcaagtggcaatctagttagcatttctttttaaaaaatggtggggccacctgtcatactctccgacctctctctcctcccctcttcctcccaatctctctctctctctctctcttcccctcttcctctcaatctctatgtcacagatgtggagcggcgagttggtggccggcgatgggcgtggcgggggcgcggcgagcgtgatggagaggtgggcgacgtccggcgggcggcggacgccgtcgccctcgcacaccaccgggagcagctccaactccacgcgcggtcgagctcctgctccacgcgcgccacgggcacggtggggcgcgaggcggcgttggcggcatcgtcgtcgcccacctccttgcgcggtcgagctccagctccacgcgtgcgctcgaggactccgtcttgaccacctccagcacgctctccagctccgccacgtcgcccagccgcgcccgccgccgccgcagccgcctccgcgtttctgggattctcagtccacatcatgaagaaagtctgttcactactagaattacattatccattaacttcttcagaataagaaaaaggtgaattgaaggagtaaatcagtgcaaatctgatgccaacaaaatggaaaaatattcagcaaacagtgcaacttttggattcaaatgtgcttttgtttgcacctccactgttctactgttatagagcttttttggctccttgcaaggtgaagctgtgtatcagctgcgtcaggctttcatacgaggagcctcctttctccatggctctgcgagctttctccccgtactccttcgccttcctcctctcgccggcgtgctcgccgccgtccatcagcgccatcaccgcccgcgcgacgtcaccccgggtgacaggtgaccgccatggcctcgtcgccgagcagcagcacgggcgtcgtcacgccgacgccgagcacgtcgacgacgagccgctcgttcaggaactggtcggagaagtgcggccacgccacgaccagcacgccatgggcgatggactctagcatcaagacctccagtggatttatgatgttgtactcgcgagcctgattctcgctgggtctcttctgttctgtagttctgtgaaggactatcaacatacaaatgcacaataatcctggaagctcaaaccggtttggtgaattatgcccatttaatcgacagagtgcatttttaattgcagattttgaccagtggtttgggtgccttaagttccatataactattgttcaatgataatggaaatgcttttaagtattatgtaagatcaagttaagcggtgtctttgtcagttattagttgcttgtgagtgaaactattattcatctaaactaaattatttctgtctgaatggatgcatgctttgtatggtaaaaaacgagcagggttattgagcgggtcttcctgctccttcaatttatttgtcatatgctgagaaatgttcttgttccatcctttatcttccgttgagaaatcatcttgtttcttctgttagaggatgaaaaatattatgtcaacaattttatttgttgattatatgttgacaatgctcttgttttttcattaatcttatttcttgtattcacaaatcctcttgtttcttcagttaaaaagattattaagaattatgtgcaacattgttcataaccatcgtatctcgtcctattgttaaaaaaagggttaattacagtcatgtcattataatttttacagttttgaaacatatcattactattcatctattcggaaccatgccactataacttcacagctattttaaatataggttaattggatccataccatcataaatttgttggtgttaaaaaatatcactactatttatatatttggagccatgccattacaatttcataacttttgaagatataccactacttacccattagatgtgtttataattttctttggaccaaattaccctcgtcttctttcttcatccctctttccctcccctctcaacctctatcctctgtctcactggcggcggaacgatggatggagcagggtgaagctcttggagcgcgacagcacggaaggcatccgccacctagctatgacgcgagaactttcttgtgctcgaagcagcaatagaggcagacacgcctaggaaactgttatcaaggatttttcttctgttttgtccctatgaatttacaggaacatttttggtctataagggtaggggagaggggcacgagagggataaaaagtttggattttgttcacatcgaataccagatttccaatccattccccccactttctcgagcaacagcaatcccgggtgattttcttggatttgtcccctttctcgtgttagcttggcatgagcaagagggagctcggggtgatggattgattgattcgcacctatttgtgccgctgttgctcgcctgcatcgtcctcagctacctactcgacgagaaccgaaggttcgatggttgcacgatttttttttcttttttttttgaaaacttgaacgagttcatcactgttgtgttgggtgttcccatggaaaaagagatggaaaggaagaagataggataatttggtaaaaaaaaatataaacacatccaatagataagtagtggtatatctccaatagttataaaattgtaatggcattgcttcaaatatgtgaacagtaatgatattttttaaaaccaacaaatttgtaatggcatggatccaattaaccctcttaatataccactacttaccttttcattgctttttctaaatcttttggaccatattacccctatcttctccattcatcccatactctcccacccacgttcatgttctccatggagctgcagctctaagcaaaagcagcggcggtggcagggcgccgagcaggtggcatcaagtatccaacattctaacctcgttgcatccatgaggaggacacggctcagagagcaaagaatttccccacgattttttttcctgtttattttttttgttttttctttgaattctttccttacgatttttgctcctgctctagttcttgtttgattaatttggtcaaatctttgtgatgatttttgctcctggtttttatggggttgctctttgattttttttttctcctggttgagttctttgatttgtcgggttaaatcttggtgaggagcgccgcacgggagagtttcctcaagatccagccttcccccctgttgaggttgtcagcaaggcagggactattgtcgccggtgagcttgtggacgacagaggaagttgagcttatggatggcgacaacgatggatggcaccagcccaatgctgtcgatcccatcccattcgtcactacctcgcctcaaggtccctacccctgcccgtcccgcccccatcctcgccacaggaggtggctgctcctcctaccgcccccatcctcgcgtcctggacgacggagttggccgggaggatatgtgcggcgttgttcaggtggtcgtggtctccagatccgccagaacttcattgttcgctgccatgccccatgccgtcgccggtggcctgaccacattgcttgctgctatgacctgagttgctgcttctaggaggataagggtggggagaagatgaacgggagagaggaagaagacaagggcacttcggtcaaaatatttgagaaaataccctgaaggggtaagtagtggcacatattgaaagcggtgaaattataatgtcatggttttaaatagttgaatagtaatggtatatatcaaaaccataaaagttgtaatggcatgtatccaattaaccattaaaaatatattttttttggttatttgatttttattacaaaatatcaccgtagcgtttagcacgagcatattactagtggatctataagttgaaatctggaagtaatagtccttgttttgtgtgtgtgtgtgtgtgtgtgtgttaaaaggtgaatgaaactaggagaagctatcagattctaggatgatgtctggataggggagatgccattaaaaactcaatttccttatatttatagcatctgttctgaccctaacagtattgtaaaacaaatgttgatagagggggaatgggagatcaatctgagaagaactctgggtcaaaatgaattggttgaatggatggagctgcaagagaggcttgctccaatccagttgacaacagaaaaagatagtatggtttggaagctgactcagtcaggacaatttaccacaaagtctccttacagagaaattgtttttgggggagtcaaagatgtttgatcttctgaatttaattcagaaccagaggggagttgaaaacaaaaccttgtggtattattttgctgcaggggcttaggcgatttggcttgtgagaaacgactgggtgttcaattgacttgtgaaaaatattgtatctttgccttataaagctttatcgtttgtgaaagtggaaaagcttgtcaccaattgagttaaggggcgagatagagagagcacagggattgttgtttgccagtatccgcgcgacagaaggttcaagttaggcctctttaatcgcatgattgagaaaacgtaggaataggaaaaacgtaggattttgataagaatgtaagtgtaaaacagaggattgcaaaacgcaggaaaaacacaggaatgaccgtttgattgaaacataggaaaaacacaggaattggatgagagatatagactcaaaggaaagttagcaagaggatgaaactctggctaaatttcctccaaaatccctttaggattgtccattttatagtaatttcaaaggattatatatgattcaattctttatttcaaagagtttcatagaaaattttcctatagaattgaaatcctctaaaatttctatgtttttcctccaaatcaaagggccttaatgtcgccgttctgatcaatcccctttctgacattgcttctcctttttggacttgtatgcttgctgttccctgtgctgtgccagcagcgttagtccttttttctgtctttctagactgtaagcgcttggcctgtatagctggtaatcccagcattctgttcgaactcttatgctttgttaaaaagctgggcttatgccttttctccaaaaaaacgatgagcatgtttgtttaacaatttatttagatttgttgcaaaggcacatgcacttcgctagtttcagagaaagaagacattgacaattcgaacatagacgaacaagagaattggttatgacagcaagcgaactcgctaaccattagcactagagaacacatcggtatcgttttcttaaaatatgaaaaaaaaaaaagaggaaaagataacatggtgatatttagcctccgcaccatggggatccacaccgttagataacttattcttcgaacgagcagggcccccatttcagaggtgagatataaaatggccctgagcgacgatgatgataccactcaaaataatggacacaggtaggacgtatcgattggccaagtttttcgtatcagcaccggacctgcagcccacaagatgaacttaatataagataaatataagttcaagcaaaaggtaaatagttcgtagagcctacttacaaggtaccattatctcgcgtctcagcacggaattgccgaagcagcctcagtatggctttgttctcctcggcacttttttcacacgagccattgtgaagatccatctgaagtagcagacggaacagctcgtctttcttctcctgcactagcgtctcaagacttgcaggatctatgttgttatgaaccttggcatctgcggcaggatttgggcaaggcaaacgatgctgaaaatacaaagaacaccgtgaattgcattatgaaaaggaaaccaaatagtaacacaaaacgcatgaggaaacaagtacagtggtaaaactggttggttggataagaagaagctttaaagtttgaacagtgtcaatgtcacttttacatcaagctttaggcagaatttggaaaacaatattgcgtgaaagtacatccaaatatgaacccataataattggaccaattgctggtaaaaatctatggccttcaacttttttcaagataatacatgctctatattatgagggagatttgacacaaatgtgaggtaaaagaaaaccgaattttcaactacatggtctaagggtctcatcggttaccaaagacttattataagccacaacggcttttattagtgataaaaaagtaattttttgtctaaaacatttacaatgtgttcttagcaacttaaaagccaatgctgaaaaagaaactatgttgaaaatatcttaaaatcaacttcaaattgagtttgaaaaattaaaaaaaaaagactttggttgaattctttttaggcctaccaatgggctaaaattgtcgataaagcataacaggttatggtcttgtggttacattgaattattggactggtcttgcccaacggactgtggagacctgtctaagagggacatcaatctattggagcaattttggttgtgtaactattgtagaagtgcctttgtaggctttactgaagccatgcagaaaacaaaatggaaaaatttacattgccgctacactaaatttacatacataaaaaaaaaaaagtggagcctacaggaaaaggggttaacttatagacattagccgaataaagatgcaaagaaaagttttgatacaaaaataattacatcggtgcatttaattaaggaaacctgagtatctcactataaaaaacaatataataaaagaaatgaatttaagtacatgtgctatgcattggaaaactgtaattaattaaagagaggttgatgctttactccagaaatcgatttattattgttggcaaggggtggttgaggagtagcggaggaactgaagtggcgggtatatgagatgtgaggcatctcgccacggataagcatgggcaacagcctccgctccgcctccaaagccggcgatgtgaccgccggatatacaacccgcggtcgctgtagtgcgcgaccgcagatcttccgcgccgcatagcgaagcgcagccatcgacaactacttcgctgacagtatatcggatcggagcggagcgtattttctcctcagaccagacctaatctctcgggaaggggctcccttctcgtcaaaatcgactcaacatatatagtatatacgagtacctaacaatcgaagatcggtattggaaataatcggaaacgggatcggtaggaagaatcggaaacggtttagggcacagttttaccttttctttatatacgaatccaatcgctctacaggcacctccccacctccgccttggcctttgtgtgttcccagcggaggcccttttatttatttagttttttttagtggctaacaccattcctgtccatggcggcggccgaaggtggacacagcacccccacggagaggagaggaaagggattatctcatctcagatgagagaggaggttcctatggagtactaaaagaaaagaggagcagcagctcgtgggcccagtaaagaccaaaatgttggcggaatcagcaacccgggaaagaaatacaagtccactatgactccctcggaatattggctgaatctcatcttttaccacaaaaccaaaaccatctcgctcggttgttttcgagaatggtttgttttttttttttgactgacgtgatgcccaaaaactttccgtaaaaacatcacatcaaatctttggacacatgtatgaagcactaaatatagataaaaaaactaattgcacagtaattagtctatgattagtcccgagacgaatcttttgagcctaattagtctatgattagccataagtgctacagtaactcacatgtgctaatgatggcttaattaggctcaaaagattcgtctcgcggtttccaggcgagttatgaaattagttttttcattcgtgtccaaaaacctcttccgacatccggtcaaacgtccgatgtgacaccaaaaaattttcatttcaccaacaaaacaggcccattaatatgggaacctacttctcctctgccaccttcccctctccgctttctgctcttccttctctctcctctccacaacggcctctgcttggggatgacactgtagggggcggagctttgtggcgcggtggagaagatgggacaatgggggatatcgtgatggcgctcttggcgaggcttagggcctgtttggagaacttaagattctgagaagcagctggttggtaaccatcttctgataatctaggggcctgttcactttgttgcaaaaaaaaaccttactaaattttggcattgccaaaattttggcatagttactaaaagtttggcaacttgccaaaattttggcatgatttcttatatagttagcaaaatttggcagcaaactaaatgtagccacttttttaacaactttaccaaaatttggtaaggttgaaaatagcatcaaagtgaacaggccctagaaaagttgggtttcccagcttctggcttgcttattttctggattctacaagtacagtttctcagaatctggaccaaaagctggactgtttaggggagcttctgatactgtgagaagttgcagcggctagaaactcctccaaacaggcccttaggctgtgttcgctactcctaggaacatatctccagcacacagaaaacggagcggtccattaacgtatgattaattaagtatttccttttttttcaaaaatagatcaatatgatttttaacaactttcgtatagatttttttaaaaaaaacgcatcgtttaatagtttgaaaagcgtgtacgtggaacacaagtgagatgggttgggaaacccatcctgccgaactaagcctaaggccgaggtactcatccttgaagaacatgccaaaggcgcttcatcgaggagagcgccaccctaagagcaagtataatagtgtgctataagtatactactttctccatttcaggttataatactttctagcattgcccatattcatataaatgttaatgaatctaggcacatgctaaaagtcttataacctgaaacggaggtagtacaaatttacgtggaggagagaggtaacaaaaaaaatcaagagtattggctctcatgcaagaactagcttaacacaagctctaaaacaaatacatgttgtttatgatagagaggaaaaaaaattgtagccaatctgatagctaatttattatatatgttggctttaagatgagctaatagtaggaagtgggctctactattatccttgctataaggctgagttcgtttctcaggttcctaaccctccatctcatttttcgcgcgcacgctttttaaactgctaaacatttttttaaaaaagtttctatacgaaggttgtttaaaaaatcatattgatctatttatgaaaaaaaaaaaggaaatgcttaattaatcacgcgctaatggactactccgtttttcccgtgtgcagggcatgggttccaaccgtgggaaacgaacacggcctaagtagggtaatggagaagaaatgagggtggaacaccgagagtgcaggaattaaatttaaaaaatatacctttatttttcataatttgtgtttatatatatgcatggagcggaattgcgaaaatatacctaacccacggtgcggcgatgcgggagcgacgcgtaaccgcagatcgaaggcgcgggaccagtggtcgtatcggtcacgcaggttggatgtgagggaccgacgtggtcccgcatattgcgcatgcggcatcggcgcacttccgctgggtagttcagcggcaccgcggtggtttgcgggaccgagcgacaccggctcggtcccgcggaatagatgtacgggacgggctgccacatattggaaacgcgggagcgctctccttcccggtaaaaccaaatccaatcactcctaaacttttgcaaacagttaaaactaatcaaccactcctatactttatgtccaatcactcctaaattttacacacagttaaagcaaataaacacagattcatgtgagttgggtgggaccccaccggtgcacgcgcgtggttgcgcagactggccaagcgggatcgacgcgctcccgcgcattgggactgtgggaccagtgcctactccctccgtcccaaaaaaaactcaattcttgtgtttttgtgttcaatgtttgactgtccgtcttatatgaaatatttttatgattagtattttcattgttgttagatgataaaacatgaataatactttatgcgtaacttatccttttaaaatttttttatttttttttaaataagacggatgatcaaacgttggacgcggaaacctacgaattgagttattttgggacggaggaagtatacatgaaaagagtgtgatcatgatctagagcagttaaaagaggtgcctatacatacgtggtagtgctttactgctgctgagataagatggttctaaattaatcaccgcaacagtccgtacaggactattattcaggtttattacagaggcacgagccatctgtcaacccaatgtgaagtgtcaattgtgcaactctttacaatgattaatagccctggacacaaattggcatatacgtgcaaccgaagcatcacagaataactgaattgttcagaagtataccgaagcatcggcttggtgccgcagattgaggctgcgggacgtctcggtcccgcgcctccgttctgcgcgatcggcggatcggcctggctgcccatagcacggaaccacctcggtgctgccgattggggctgcgggaccgtttcggtcccgcccgcatagccgcgccgtgggaccgactcggttccacacacccaattcgtgtgaccgagccgatcccacgcccccgctccacgcgaccgcgttcccgcgccaccaacctgcattaccaaatcgctctcgcgtttccagcgtgcggagaaggtatatttgtgccaaactttactgtccaggtatataaatgtaaattattgaaaaaaaaagtatattttcaaatttaattcaagagtgcagagcctcgatgacggtagaccatgcggagctaaccatcacgcgtggaggagataaggacatgggaatccacgggttctggttgatcaactaggggttctgggtgtggtcggtgtgcctaggagtgctcgggagccaagggcacgagtcaagtggtgattgtccgaggttgaagttggatgcaatattgagaggctgacatgtggtgcccacattgctttccacacgaacaagacatgttggctcttcacataggcaaaactgaaaatagttaaaaaaatatctatcttcagtggcaattttgtaaggtcccatttgaatgtgatggaatgatgaagattaagtgcgcacgcaaatgaataagttatttatacataattaattaagatttcattattaaaaacataaaaatggatttatttgatttttttatagttaagttttcgtgtaaaacatatcatttaacagtttgaaaaggaagccaagaaaaaaaattgtatcttgctggagtttagaatctaaaaagtacacgcggataattaccaaatgtagcagtggcaaatactagttaaattcctcgtgttaggtacgcaggcaggctagctaggtcggcctagcccactagggttagtgttgggccctaagagaaaaaagttttttggaaaagattttgctaacgattttgctaaacatcacgcgacagattacctgcagccgagaagcgacgactcgcgacgagcgaacactcgcgaaccagacacacccatcatcttattccacattaagcccagctataattgggctgggcataagcagatgtccaccatgttcgatagcagtgttcagattttacagttcgagcagttgcagaaaactctaagatttttttagtacaaagcacaacttcctgcctggctttagcttctttttgggactgaagtttgctgagctagcgctgcttccttcttaatctctttgttaattacttaatttcatgagaaagtgtagtgtagggcatcacatagtctaggaattggatttcaactctgcgtagtgggagtgccacaatgcaatgcaacctcaaactttgcttcattattatactatccatgcattttgaaactctgcacatcgtggaatttagtgcgcaagtctctgaaggccttctctgcatcttcatgcttcatcatgaaccactatatatatgctttggtggagtatattttaactagttagttaacatctggaactaactgaaagcgaagctgttaggagtagtttaatcttgatccacgtctacatgcacacagttgtgaataattcactattcttatcactgatagtggcgacggttgagtatcttatcatgaattcatgatcagactcaccagtcaccaatgcttgctagcttcaatgctttgcttgtggagatccatggagattttgatcgatcaattagcttttgatttgagaaaaaaaaaaagggctcatgtgtactcatgttattgcaactttacacgcgctggagctagaaatagtgatcaatcaatcaatcgacatctgcttcgatctgcgagagaaagtgcgtcatctgaagaaaagttgaaacttcgtggaggtttcaattagcttgcgcatcttgtggtccatgtgtgcaaacattttgtgagtagtggagatgataattacatgatagatacatttatatatatttattcagcctagctagctgaatgaatggccagaagaaataattaaaccgctaaaaaaagattaatgttaaatgagactaattaatatatttaatggactgtactacctaacgagaggggatatgatcagtctccacccttcagccacacaaccatagcatccaatgaactggtccctgaattgctttctgctgatacatccaaaatttctctcaagttgtcactgatattacgaactagattatctggggctaattataacatggtccactggtccatgcataattcttgtgcataatactgtagactgaatttagatccatttatatgatgatgatgattaatttctactaccattgccagtgctctcatatatatctcctgtccttctcttgtcactctcatatatgtgctctctgtcatacatccactcgattgcatgcactagtagtgttatttcagctagaagagtcaagcaactggacgaactgattgtaacaaaagggactggtcgatctacccatgttgtcaacacaacactactccagttgatagcactagcagcttgcatgcatgtgaaataatgccactgtatagtagctggcatatgcatatatacgcccctgcatcactaaaagctagctagtagctactctctccgtttcacaatgtaagtcattctatcatttcctatattcatattgatgttaatgaatctagacatatatatctatttaaattcattaacatcactatgaatatagaaaatgctagaatgacttacactgtgaaacggaggaagtacgagcctgcatatgcaatctagtacctcccgcaaaaactttattcctagctatgaatgaatttagacaaatatttaaccaattgtaaaatcagaaatgaatctttttgaaacagatgtagcaaatactaggagctagtatttatccagttgtatagtcgatcggaaatgatttcagacttcatcgtttcgcttattgacggaataagcgaaacggcatatttacaaataaaaaataatttataaataaaacttttatatatgtattcttagcaatctaaaaacaaagactaaaaaataaactacgatgaaaaacctcaaaattaactctaaatttaaatttaaaatttaaaattttaatttataagcataagtataaatcaaaagatgaggctagaagtattttgggggacagatcgagtagcagatatatataggtgcgaatgtactggccatttgcactgtactggtgatgcagtggattattttctcaaagatagatatcatgaaatcagggacaatcacttcgaaagctgcctcactatggtcttgtttagatctaaaaaattttcgccaaaaacatcacatcaaatatttgaacacatgtacgagacattaaatatggggaaaaaaccaattacacagtttgcatgtaaattgcgagaagaatcttttgagcctaattacgtcataatttaacaatgtgatgctacagtaaatatttgctaatgacgaattaattagacttaataaatttatctcgtagtttataggcggaatatataatttgttttgttattaatctacatttaatacttcaaatgtgtatccgtatcctttaaaaactttacactcaaaaaactaaaaaactaaagacaccctatacccatatactgcaccagtactgcaagcgcacacacgcagcatattactccctaacaaccctgcaccatcattaggtttttgttactttgtttagctctctgtttgtttgtgagtttgttgcgagactgttagtacacatgatatgatggcaaaacgcactagattaatctctgcttaattagtttgcatcatatatagctgtgaccccatgcatatatatctagatcccgggttgaaatttacagaacatgatcgagctagatgagctagcagcatgatccactatctttcttcttcatctacatgctgttgtgtttggatgtacatgtatgcatgcatgcatgtaggacgtttttagataatgatgcatgtaggggccagattgatttccattatctctcaaaaatctactagtacatgctgaaatgaattaaagttgtgtgtgaaacatggggggatgctgaggtcaagtcatggagaggacccatagtaaagaagagatgacgaatggaagaagaaaggtagctgcagagacgacatacgtacattgcatttgatagctaggcactggtgcagaagacatttgttgtgtgtgcttgtgtgtcattgatatgatacagtacactacttctagtcactactaggtggtatctagggcaggtagtggtggtttgtgcttttactccaaagttgcattgctgcattccactattctatagctgctgtttgtagtggtttacttgagcgcattatctcgtaaaaaaaatctcaaggttttactgcagagagagaacctgtagcagctaccacaattaattttaaacatgctagctgcttagtatgcttagtgaaatatactaaggctgttggtaattaagctacttctgggtcgttgacatgaaaaacgaggcatataggaattgggacaacagaaaaacgtctaagaatctttctgctagattcaaaggtggtggcttagtttgtttgaatttgaagtctcaccattttaattatttgatattagattcattcgtaatatttacgttttttttaattgtgacagcacacagcagacaacgcatagcgcaggactgtgaaaagtgaaccaggcaagacgtggcagtactatgcatactgtacaccaagtactccagctagcgtgcagtacagtggccgtgctgaccgtgcatgcatgcacaggctaaggctagtacagggatcagctggagtctggacgagcatgcaaaagagtgagacaacaagacaagatgatgcatctgtttgcagctgtagcaacagttgcaaccagtactgaggtattactccctcagtcccataatataaaggatattaagtttttgtttgaattatttaaccacctatcttatttaaaaaatttgtgcaaatataaaaaataaaaagttgtgcttaaagtgctttggataataaagtaagtcacaggaaaaaaaataattccaaaaaattttgaataagacaagtggtcaaacagtgcaagtaaaaactcaaaatttcttgcattatcgaacggagggagtagtagctgtgtggcagcgagtagctcacaaaatttaacaatttgacccttttacaaaaactatttttataaataaatcattaccaaaacttatttaaaaaatgactcttttattcagcaccaaatcatctggcgttgaacttagacacctcagcgccacgtcaactggcgctgaatgctgtgccaccgcggatgggaggctaagtcagtgtgccaacgcacattcatcgccatgctatttagcgctgatatgtctaagttcagcatcatacgatttggcgctgaaaaaaaaagatcatttttgaaataagttttggtagcggttcatttataaaaatagattttttttgcaaaggttccaattgtcaaaatttgtggcgagtagctagctgctttggttgcacgcatcgcattgcatggggagcagcgagtttggctgtgcgttggcacgtgaaatctatcggaccgtcaatggcaacaagaccacacatgcacaagacaccattgaattcaaagctgactaggaatacatcattttcggtccttgccattcatttgcatgcgtgcatatgcctcatccgttcatcgctattcacggcatataccctgttcgtttcaaaataaatattttctctattttaaaataaatatccctattaggtttatctattttaaaacgaacattgtatactgtagctatagcaccgacaatcttgtgacgacccgcgttgaatttttagtacatatatctgatattgagaatgaccatgtactagtatatatacaaatgtgtgtagtgtactgttccctctataaagaaaagttaggtgtatcacttttatcattaaaacaaaggagaaattaattcatcttgtgtataataaaaatcaagtagtctttgtatatatgaaactaatgggtatttatatgctttttgggttccaattaaatatttaatttatcttttcattatactaaatctcagatacatgaaactataaacatagctaacggataaaccaaaatataaaataagtttaatatttttggaacgtacgtagctgctccatgttgtccaaaacatgagtcaatcaatcaacacatgctgtacatacgcaacgtagggagggggaggcccttcccttgtcggatccacacacgcatatgcaaatgcatgcacttgtccattttgcagctttgactacttgtgtgtgtgtgtgtaatttgtttgaccgggtgttcagcagctggctgcatgcatggtatgcaggccggagatgtaccaacacgacgccatatattccgggttctcaggatctgcatccatctccagcaaataaagcaacatatagccaaaaggcacgtgctgtcgctgctcatatatgacgattattacttaattaaactgcctcttgcttactcctaagtattcacatacactggtggagaaaccatctttggtcggtcgcccgaaatccacaatagtctcggttccactaaaaaccgggactaaagatgatttttagtcccggttggtggctacagcgggcatatttgatctttagtctcggttggtgttaccaaccgggactaaaaatgatctttagtcccggttctaaatctgtcaggccttatcaggccccccgatatctttagtcccggttgataacaccaaccgggactaaagataggatatttagtcccggttggtgttaccaaccgggactaaagatcccagggatctttactcccggttgataatatcaaccgggaataaagcgtacgcaccagcccacgcacaagcgcatgcgtatatatatatatatatatatatatgcggtttgccgcttattttttctcatcacatcctccaataaccatgtaattgctccctccgttttatattataaatcgttttggacctttttttatcttaatcgaacttttttatatttaaataaatctatagaaaaatttagcaacgaccaaatcaatttaaatataatataaaatatattttaataatataattgttttgtgtcgaaaatattatatttttctataaactaagtcaaactttttaagtttgactggaaaaaaaatccatgataccagcgaaaatgacagtactctgtctcggagtcatcatgtgccatatctattgatatatttaagaccatgcatatatggccgattgatccaggtcaggtccaattcggtatgatacgatcgatcatctcttgatgatctgattaactcaatcaggggcaatatcgatcgatcgagcaagtggaacatgcagatgcagtgcaccaataatatcgacagcaacagcacctgactatttcttgtcctgtcgagatctgtaatccctcaattccttcgtctctgcatccggttaccctgtccgctagcttccggccggccggacctctctgtctatgtgggcccttgcacttggaaaaagaaaccacacaccgtcacaagtgttcagaaaaaggaaaggtccagcgccatggagcggcgaggctagaaattggtgctcaatttagcaaattaacctttgcatcgctttcgcacgctgtgtgtgttcgtttcagtgtcctgtctcctgtgcccggtcgtcgtctaagctagtactccctccatcccataatataaggaattttgagtttttacttacaacgtttgaccattcgtcttgttcaaaaaaaattttgaaattattatttattttatttgtgacttactttattatctacagtattttaagcacaacttttcgttttttatatttgaaaaaaaaattgaataagacgagtggtcaaacgttgcaatcaaaaactcaaaatcccttatactccctccgtttcgaaatgtttgacaccgttaactttttatcacatgtttgaccgatcgtcttattaaaaaatttaagtaattattaattcttttcctatcatttgattcattgttaaatatatttttatgtaggcatataattttacatatttcacaaaagtttttgaataagacgaatggtcaaacatatgctaaaaagtcaacggtgtcaaatattttgaaacggagggagtattatggaacggagggagtagctagttagctacaagagcttaatttgtactcccttcttccctaaatgtttgacaccgttgactttttaaacatatttgaccgttcgttttattcaaaaacttttgtgatatgtgtaaaactagatgtatacataaaagtatatttaacaataaatcaaatgatagaaaagaattaacaattacttaaattttttaataagacgaacggtcaaacattttttaaaaaaatcaacggcgtcaaacattttgagatgaaggtagtacaagctagccacagatcacgcgtcctaatcacgatcttgctggttaatttgacagcactagctaggacatgctgatctactttatattcaatcatggaggttcatcgaattgaatcgcaacaacaattttgtggtgaaaaagaaaacgtactttaagtttagtttatagatggattaattacatcgctgtacgatgcctatctacgctggaagtcaaaagatcagatttactctctaacattatttgataattggccattgaataatacacgttgagattcatgctgaccgttagagacaagcgccgagattcgtaccatgctgggaaacaaaaatcatgtgtgtgttcatatatctactgagctgccgcgggtttatatagttgcttataacttatgctattataattatatactacgtactagttatattgtaattatacttgatatttttaggatttttatgtcaatgttagttaggctatcccaagaaaaaaaatgataatattaagcatgactttatgttcgctcaatcgtgaatgcgtcaggcatcatggtgttcgacacaaactaatcaccgtccaattttagtggtgtgatttttcaaaacaaaagttgctttcccttttgatcccaatcaagccgttaacctgattggcactgcctgctcttttttttgccctttctgttagctggtaggcctctgatatggccgcatgcgcaaaaaggttcagatatactccctccatttcaaaatgtttgacaccgtttcactttttagtacgtgtttgaccatttgttttattgaaaaaattcaagtaattatttattcttttcatatcatttgattcattgttaaatatactttcatgtacacatatagttttacatatttcataaattttttttaataagacgaacggtcaaatatgtgctaaaaagtcaatggtgtcaaacattttgaaatggagggagtatttttcttagcatttttaaggctgtaaattaaaacaagctcggcccatccaatgtgtgatcatcagagtgagcatgcatttctgtcctcctcgattggccaccgtaccagcagcagtccatcatatacgtgcaacatatatatatatatatatatatatatatatatatatatatatatatatatattcccctcccttcccaaatataagtgccatctttgctaaaacataaacctttttaattaaattatttagtataaatattaaagttgaaaataaaaaaaagactttgacgacccatcccattaaacgaggatggttaagacaaaaaggtgattgatttacgaaatttaaatggaaactgattagtggaaaaagtggtattctgaacaatgctagacgtgaaaaactgcttatattttgatataaatttcaaatgctagacgtggtacattgtattttttaaaaaaataaagggagtatttccaggttgcttagtactccattcgtcctattttaagtgcaaccatgagattctatgtccaactttaaataattagtatttttaatgttataggatgatgaaacataaaacgtactttacgcgtgacttatgttttcaaatttttttcaaaaaatttaaataagacggacaatcaaaattaagcacgaaaaatcatggctgcacttaaaatgagacggagaaagtagagattacaatgaggagaaaagactatggtgtcgatcagtcgtccgtcattgattccgacattccgtgtgtttcattcgtcgagttgtcgtacagggtctagctagctgcatgtagaataagggctcactcggcttctacatgggaaaaaaaagaaagaggcgtgagctaagtgtttaggggatgtttagatcaaggggtgtaaagttttggcgtgtgtcacatcggctattatataggatattcgggaagtaataaaactaattgcataatccgacagtagacaacgagacgaatttattaattaagcctaattaatccatcattagcaaatattttctgtagcaccacattatcaaatcatggagcaattaggcttaaaagattcgtctcgcaaaggagtatttaatattttatgcagatattcaaacgttcgatgtgacatggtgtaaaatttttatgtgggaactaaacatggctttagtctgatacgaaattggtgtatataggaactcaatccaccagtccataggatttgatgttccaaatgccaatggtatgtatagaattacaatcctctatttttcctagggtgcaaattaaaggaggcctaaacgtacgtacgcaagcacggagggtggatatagtgatgtagacctgtaacgacgagtgcaacagatacgcatggttcgcacgcacgtacgcagccgatgatgaattcagggagggagagacaggagaagcacatacgcacgcatgaacatatcggccggtaaccaagacgtcgacatacacagagcacgtgcattacagataggcattaccgtcctaaaatataacaacttttaattagacgagacatataatctattttagcaggatatgttctgtccatcaaaaagttgctatatgagcactgcagtctgcaaaactaaaatggagctgaatttgtttgaaaactacaccctctactatattttctttagctcattttatttatcctaaataagttttttaagtaaccaatgtatttaagtttataaaagtgtaaaataattatattaggagtaaataaagtaagaaataattatagtgagatttgataaagtagagatatttttttttgtgttgtattgatatctgtaagataatgaaaaataaacttatttgaaacggagagagatggataaagtggtggggaggtgaaagaaatatagtgggaaaaataagaaagattcgcggagtgaaagcaaagcgaggcaaggcaagagggcggcgacaagacaagcaggggaattgaagaggagggaaggggagggacaggcggcggaccggcggtgaaaggcgaaagcgaaggtggtgggattctgtcctccccaaagggggaagaatatcatcatccatcgcaaaaaagccactttcccacaaaaataaaaaagcccactcacactcacgtccatcgtcgtccctaccctagctatgacatctctcatctcatcccatctcatctctctcatccccaggcccccacactatccatcatctactcgatcgtgtactcgtaacagcattgtattgtatgccaggttctcctaaattcgatccatcgctttctactctacgctcctaccatagtgctagtaggcaataaaatggcagtttcatgcaatatcatactccatgatcatcattcaggcaggcctagctagctcctgatcatctagcagtacacgttgcatgttccatcgccatcgatctcaacttgtcaacactcacacaaacacgcacatgtacacacaaaacaaacccacctcaccagtgcttgtagctatatatagcttgttgatcctgatattgctagcccacttaatctaattcagcccctgtcattttccaaccacgcacgcacgcagcttcagccactgacgccccaacttgcagcgcgtagcgtatgatcagcagcatatagctaggccaattcggtccgtacgatcaacgatcgatcgatgcatgtgtccgcgccatgcgtcgccgtgtacccaaaaccaaaagcgtacgtgcacgatcgtaaacgacgtcgtcctacacgacgtcgacggcgacatcgtgaccatcgggcggcggcagcggcgcgatgaggcgcttgcactcgtcgtcgtcgccttcggcggcggcggcgatcatctcgaggccggtgagcttcttggcgcggagggcctcgaggtgccagtcggtgcgccacacgacggcgaggaggaccagcgcgacgcaggcggcctgcgcggagaggaggccgtaccagaggccgccgaagccgacgcgggcgccgaacgccagggtgacggcgacgggggtgccgacgaggtagaaggagagcaggttgatgcgcgcgccgacggccggcctcgccgtgccgcgcagcacgccgcagcccgtggtctgcgggcagttgcccagctcgcacagccccaggatgggcatcgccgccgccgccagcctcaccaccgccgcctcccgcgtgaacagctccacccactcccggctgaacgccgccgtccacgccacgtgcaccaccccgatcaccaccgcgcaccccagcgccaccatcgccgccatcctcgccctcctcggcttccctccccccagttcattccccacctgcatcatcaccaatcaaacaaaattgaaagtttaattgaaattagaacgataaaagttgaaagtttatgcgtgtaggaaagtttcgatgtgataaaaaagttgaaagtttgaagaaaaagttgggaagtaaaccagatcaacattgcaactcctgattcaattctgcactgtacaacgcatgacaaattgacaattcacaaacagtggatgaacagcgacatcgcggtgtgcaaattctgtcttttctccgaacacctacagtgcagctgtgagcttcactggcacccagaggaagcactgttcgtgtgcactgtgctgacatgcacgagcaatgacaagaccaaccaccaatggccagaggaagaaacaaaccaaaaaaaaaaacccacaagctttgtcccgtttcgcatgcagtaaatagtgctactaaaatcgattctctgatagaaatggtatccggcaaccagcctttaaaagaagggggtgattctgtacaaaatcagcaaaaattcagaattttgtcgcttctctcgcttgctttgcccgttgattgatgtgtgtagggaagatgatgaacatgttcaagatttggttatatatccatgctataaaaaaaaagagagatgaatctgttgctacaatgttggtatctgttactactatacatcgaaaattcagtcttaggagtatctagctcatcaacacacacttagccacatgatttcgcgattgacgagtgtgtggcaggaagcaattaggataaacttgttgtgctaaggttgcacttatcttcttgtgccaagattgggacacaaatctgttcacgaagatatatatatctatcttgatagattcagtcgtttcgcttgtttgtatctgaacttgagctattctataagttcagataacagtgacaccagcaaacaagaaggaggattaaaaacatctagctcggcgcaaattatgctatatgcctagtactatatgatgatgttgcccagcactagctcataacaaactcgctcactgaattttctcgaaagtataacaaccctacccgttgacgaattaactccggcgatgtgaactcaaagcaaaatctcagcctgagctgttgacattcggattggcacgaatcaaaataaaagtggcaatgtgccaaatattcgtgtgtaaagatgttggcaagctgaccatggttgtggctttttagagcaaggttagtatagccaactactaactccaattcacctatagccatctaatagttaattcatacaatggttgcttactatattattagtatatggtttcactgttatacacacattgtcttttagagttcgtgctgcagctgacctaataatctgctattgtagctagaggattttagtttcgttttcacgaatcttgatgcaatacctttatttttttcccgttgggatgcagtgactgatatgagtgattagtgcaaattaagttggtgagtgatgagaggcgtacccgagtagagacacaggcggcgagcgccatgggcacggtgtacatgaggctcgtggtctggatgagcacgccggcggcgccgaccgcggcggcggggtccggcaggtacccggcgagcacggtgaccacctcgtaccaccaccactcgaggcagacgccgacgcagctgggcacggcgaggcggacgaggccggcgaggccgctcgccacggcggcggggcgcgcccagcccttccacgtggcgtcgcaggcgcgcgaccagcggatgtaggcgaggaggaagaggaccatgttggtgttggtgagcgcctgcgcggccgcgacgccgcgcacgccgaagccgaggccgaacacgaggagcacgttgagcgggacgtggagcgcgacggcgatggcggagcaggcggccatgggcttggtgatcccctgcgagcggaggtagacgcgcagcggctggagcacggcgctggcggcgaggtccgggagcgcgtaggcggcgtacgcggcggcggaggcggagatggtggggtcctggccgagcgcgacgaggatggggccgacgtgaagccagagcagcgcgatgggcagcgcggcgagggtgagcagcaggacggcgcgctgga

SEQ ID NO: 66906 - DNA, 9586 bp, Oryza sativa
agaattttggagaacaatattgtagagaatgtaacttagtgcgtagtacagaaatgcgaggttaacgtagttattgttttcatcaggcacaatgtcaaataaggtcacattccagatagttcacggtgaaggaaatattagatttggtctagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaacaaaaggttatttttgggaactaatgccgatggacagcactgctgcttggagacggtatgtggaaatggcttttgaacggtcatggcccctcattatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgaggggagagagtcggtataattgttaatgaaatggagagggaagattcggataatgagcaagcggaggacgacgcatcatttgatgaggaaggtgatgtaatggccactgattgggcaaatgaggacttctctggacttgctatatcagagggtgatcatgtaccctgggagtataaggagaacgaggtaattgagggtgctaggtatgctcataaggatgagatgaaggaggcagtgaagcattgggtagtttccttgcagagagagtttagggtggtcaagtcaacaaattatgtgtatgaagtgaggtgcatgaaggaagactgtctgtggcgtgtccatgcatataagggtaaatggaatgattattggaaagttagcattgtgaccgagcaccagtgctacttacaaggggtggagaagtatcaccgaaacatcacttcaacttttgtggcaagtgagatgtatagcagtgttgttggtaacattggctttgaaccaaaatcaattattagccacatcgagaacaaattcaagtacaccataagctatgcaaaggcctggagagccaaacaaaagattattgagataaggtatggcacatttgaagcttcttatgataatttgcctcgtctgttagccaccattgcccagaggaataataatacttactatgacctacatacatttacatcggctgatgattgaacaaagagtgtgctgcaaagagcctttttctcattgggtgcttgcatcaatgcttttgtgcattgtcgacctgttctatgcatagatggaacatttttgacaggtaaataccactggcagtggtacctgctcgggctaccactggcaggagccccagttggtcccgtggacggtgtttttggctggaaggaggatatcaccgtgcgcttcgagcacgtgatgcgccttccacacctaggaccgcccaacacccttcccccgtactctaccgtcgggcctagcaaggcttggttgctttagttcactgtaagtaaataacttgttattatcatacatgcttattttgcgatcaacagattgttttgtactaacatttcattcttaattgtaggcggatcttctccaccctgacgctgatgattactcggtctgacgctcccttgaggcgtacctgttgtggttgttcgggtgggtgatgttcactagcacccacgggcacgctgtggactgccggctggtccactacgcacggtccatcgcggatgctcagccacaggacatgccgcagtggagctggggttctgccatgctagcagccacgtaccgtgccctctgtgaggcgtgcacgaagaccgacgcgggagcgatcttcgctggttgccctatgttgcttcagctttgggcagccgagaggtttgccataggtcgaccagtggtggacagcgaaccctacggggttggtcgcaacgcgcagtggccagaggacggtcccacgatggggacttactggtgtcgacgtggggttagtgcaactttgctgcgtcataagtttatcagtcgtcttctttttttatcatcacataacatgtctaattccgatcatgtttattgcagcgtcgttacactcacgtccaggtgagacgaggttaccaggacttcgtgtttgagtttgactgtctccagccgagcgacgtcatctgggagccgtacacagaagaggccgtcgctgcgagagcaccgctaggactttcgtccttgtgcacacgtgaccaggcttactagctcaccatcctgccgatggtgttcgacattttcgtcgagcctcactgcccgcagcgtgtgatgagacagttcggactgaggcaggtgtttccgggcaacgtggagccgaccgtcctccctgccgacatctcgtgagttcggattgttcatttcaaaatttttatgctaattacttcatcgagccatataatttacctctcttcataggttgactcgacggggacagctagcaggcgcactttgggctccacgtgtacagcagtacgttgacgactgggtgttagctacagaggaggtgatcaatgagctcttcccacacacggaggagaactaccgtgactacctccgttggtaccttcctcgcactcgtgcgcgtgtgaccttcactccagacaccccagagccgcatgttgccgctgtcacggacgcgtatcccacgcaccgtgaccgagactacttcgtgggggtacgtcgaatttgtattagttcttacaattatttcatttatcttgtataatataggacaattactgaattttttatttccatcttgcataggccgatgcttcacgggatatcagtgccgatatcaccgctgtccaagtgaggttgaacagaggtttgcacttgactgacgttgagcagagggtgaccttcgaccggatgcaggagaagatgcgtgcggtcatgcgcgtcttctcctgttgcagcgctgtggacgtcgtacctccagctggtccggtacaaccacggcctcgcgcgcctaccgtcggagcaggacctcgacctacggcaccggtttcgcacggtacttctcagcccagaggtttcttaagttttgtttctgtttttgtatgaaaacatcaccccgtcgtaacttgatgttccatcctcgcaggacctcgtttgccttcgagcgcccctagcgtcggagcagtgcgtcctacagcaccggtttcgcacggtagtgctcagcccagaggttagttcatttttgtttcagcttttgcacgaatacgtcaccacttcttaactgcacgtttcatcatcgcaggacctcgtctgccttcgagcgcgttcgcaggcacgaccggcgcttccgcgagctccgcaggggcattcgccagcgcttccggcgcgttcgccacctcttcgggtgcgttcgccagctcttcctctcacggagcgtcgatccctcgcccacacggtactttaatttttattaatactattaaatacctgtatgaaactgatggtccttgtccagtaggatttccagccgggattttcggtactggtgcctcttcgtctcacgccggtaggtctggtcctactagccagttctacgatgatgacttgcacggtgcgcacgaccacgacatactaggctcctctcagcttggaggagctccagaggcgcacactcatgagcagccagaggtcacacctgtacaggtaggacgggttggtcgtgccataccaccggatcgactcacatactcccaggggcacgttagggcgcagggtaggagggacaggggtaagaggcctcgtcagtagtgttctacctcttcagtgcttatgtgaccgtttcttttgtcttacaaacttgtaaagcagtactacttttgcttttactactgcagtactacttgtgtttctctcgcctatatagttattttcattcatatggtgctagaacaacttatgctcacaacaacacactttcggcgcttcacggtagtgtcagatccactagcgcgcacagtccaccacagcacacatgaaaagcgccagctcgagtagttactatcaactttcggcgctgcctgctgacataaagtgaatcacacccgcgcgtgctcgtcttgtcacatctaatgaataatgtatctcattgagtgcacatatattgcactgaaaacgacgctatataattgacaagctgaaggcaacctcttcatatcttatttccaactagcacacaactaacgagaatggaagcgccattccttgagcgtctcaactggcgaagagcgatcctttcgctggttggtttccaccatggtgtgaccgtcctttgtgcgattgtggggatggatgcatactcaagtcttcccccatgatacaaactcggggcaggagattcttccaatgcacgaactttgatcaggtatgattcatctattcgaagttcaaatggataaaaaactaacttcttcgtacacaattgtaacatcttacgcagacatatcttccaatgtgcaacttcatcgagtgggtagacatggagaacccacaaaacgacggaacacgtgcatacccacgtagtgaaacaagatcggactacctaaggcggaaggatgagcatgaacgtcgaattgctgctgaggctttagaatggcaggtaaatcccctaggactctccacgtgccgtgagcgtccggagtgtcgttgtggtgaccgttgtcaggtcataaggtccgtaaggcaccgaactcgaggacaaaggtgtttcgtgtgtccaaacattgtcgacgatgatttcgtggtaattacaactattcttttcatcactcctcagtactatcattaacttaactatccccacaatggatgtacataggaggatgcaaggaaatgtcaatttgtacaatggattgacacagtcagagttacttccagtggcgggccgataacgcaacctgaaccgaccatatagttcattcatgctttgatggagtacgaacgttgggtggaaattgcaagcttagactggaggaacaatccattagggttacctaaatggtccgagcgttcaaagtgtgggtgcagagatcgctgctaggtggctacctcctttgcagaacaaacatttggaaggagatattttgtctgccccaatgtagacaacgatttcattgtatgtctaaccgtttccaaaatccgctatgatttgcacaaaatttctacccaaactgaataacattagtattttttcagggcaatccaacgatgtgtggatttactcgatggatcgacaatgtcactccatcatatcatggccaaaagataacagagtcagaaacacaagtagagtatcaacgattgaaggaccacgagaatgcaatgcatattgactgacctagaaggggccgataggttaccgcaggctagattcgtcgggatcgataaatttgtaccgtgtatcgatggcacttcttatctatcttatcattaaaatatttaattatggtggtgaatttttgtatgcgtaagactaaaaaaataataaaattgtatttcaccaatcttggagattttaatcttgtatagttttcaatacaaaagatttgataacaattttctatttataaaaatatctatttctcaaataaagcacaatgtaaaatcgccctcacccagggcggcaagggggccgcctgcaaaattccaggccccccgccgcctatttgcaggtggccccccgcacagtgtaaaatcgccctcccccagggcggcaagggggccgcctgcaaatttccatgcccttctcgccgcccatttgtaggcggccccccgcacagtgtaaaatcgccctagcggagggcagcaagggggccgcctgcaaatttccttgacggccgtcgcccgagagcgaacggccgtctgccacgtcacattcgccgccctctgggaaggcacccaaagggcggcgggcgagtacttctgtcaatttttgaaatagaaaattatttttgtaaaacttttaataaaaaaattaaaaataaaaaaaattatgtgttttgccggcgcgcactcttccgacaggcccacgtgactacgtaaagcccatgcaacaggcccacgtgacttcgtaaggcccatgcaactagcaggacgtgttttgattttctttttccatggatttctcaatcacacgcatgatttttttttcacaatttttttctcagcgtgaatttttttaatcacgtgcacacgaacgcatagtaaccaatccgtcaagataatgatgataattaagataagatttgtttttttaaagatttttttaagtaatagattgaagagaaatttatacgtgaagtcaaattctgaaaaatttcaatctagatttgaaaactttcaactcgaaatttgaatttttgaagtcaaaatttgaaaactttcaacttatcatctcggacttgaaaattttcaactcagatttgaaaattctcaactcgagatttgaaaactttcaactcggatttgaaaactttcaactagagatttgaaaactttcaactcgtatttgaaaactttcaactcgattttgaaaattttctactcgattttgaaaactttctactcgattttgaaaaactttcaactcacaattcaaaattttcatatcaaaactgaaaactttcatatcaaaattcaaaacttaaaattgaaaattttcatctcaaattggaaattttcatatcaaaattcaaaaatttcaacttgaattttgaattggaaactttttactcaaatttcgaaatctttccactacaatttagaactttcaactattttaaaagctgtaactaaattatgtatatatggtttttctttaaaataatgctaatgatgacaattaacgctaattacttaattagtgggtgagccttgcgtcgacacggaaaaagtgtgcgctacttctcctgctcgcgcgtctgtgcgaagtagacgcccccgtaatcatacagtggtttgaacatgatctcactggtctttgcgagaagactatgatcctttctaaattgctttaaatttgttttatgttgagacttctccatagccttgtttgataaagcttctaactcttagaatctcaattttttcaatagcggaacaagtggattttttttccagaaaaacacatgggaaggtagagttaccatttcctaacctccacaaccctaatacattttagagttggagctatttcatgtcctaaaattttaaatttgtataagaatgaaacatgttaatatataagatggatatcactctcttttcctaacctcataactccggattcgttccatatttgaagctctattaaacatccatggacatttcatccattgaacatgagaaaaatggtgatatatattatatcggtgcccatcattgctaaaaatgttattatatatataatgatgatgctctctctcgtggcccgatcttctgctaagggggataactctcgctttgatcgagtgcgatgtttgcgacgtggctaccaaccagaacaagtctaggacgctatacaatcgctacaccacgaacgatgtcgtaccaaccatgacgcgcggttgatgatccctgcaatgcaaacgagagaatactgcaagaacaagataagatgcaatctaaatattgcgaataggtgattaagcacaaaaaaaatagttgtgattgaagtggtagatttaatcgacccggcaaatcaacacaccaactattgggggctctgaatctatggtcgccgactaatcgagcgaggactagagagaaggtgaatagcacttggcaaaattcaactaaacaaagcccaattgtttttgaggatgtacaaagatatttatagagaaaaataaagctagggttaagtgctaattcgtggaggtggatggagacatttccgagatgggcctagtctattacaaggcccaaggcccaagttcggtttcagcaacaacactgtcttattttgacgattcccgttgactcagaatgaatttggatatgagtctggatgcgtttgaaaggtagaaagataagctttccatcaagtctaagatcacccaaatcggagttggtatgaaggcgctaggtccgtttgaagtcagtgctgtctccggaggccgaactggattccaaaactcattggactttaatatcttgtagatcctccattcatccgatgtattctttagcaatggtttatatttctcatgcttggttgtatacatatacttgatggtcacatcatataagccagatagattagtttggaacatgtgtgtagtttggcatgaaatgccaatattacacctcgagcttccttaaactcctccaaatggtgttttcgtaataccgtggaacctgaaactaattttctgataggcgacaaataaaatgatttttaaaattgtacatgtcaaaactttgaagatgttgataaatcatcgtctatttgtacaaagttgatatagaatcaaagcgaacaccctgtcgcccatggtggtggaagaattataaagggatcgactttcttatatcgaaagtctggcggtatacatgaagaagaatatgaaatttgaactaaaatcacaggatttaatttttaacagagaaccatattccaaacttcttatttttaaggaaaacccagacaattctttcgtgcaaaagcagcatccaataggggtatcccagcgatcaccccgcgctctcctccccctatagtccctcttctcccctttcctcctccccttcttctctttctacaccacaaaatttttaaaaaaacaaaaagttagaaaaatttatgtatagaaatactatatataaaaaaattgaattcaaattcaattttgaatcgggtatgtaaatttttgacttataaactttgggtctataaactttaggtgtataaactttatagaaatactacatatagataatatttgaattcaaattcaaatttgaatcagatataattcaaatttaaatttgaatcaggtatgtaaacttttgacttataaactttggatctataaactttaggtgtataaattttagatgtatagaaatactatatatagaaaatatttgaattcaaattcaaatttgaaacggatatataaactttaggtgtataaactttagatgtatagaaatactatatataaaaaaatatttgaattcaaattcaaatttgaatcggatatataaacttttgacttataaacttttggtctctaaactttagatgtgtaaacttgaggtgtataaactttaggtgcataaatttactaaaataggaaagtaatgcggtgccaaaaaaaggaaaccaggtggagggaggaagggggaggggatcgatcgctggcccccatctccagcgatcgatcgcccattaggatcgccgcactgtacacacctctccttccttccttcctcctcctcttcttctctt

SEQ ID NO: 66907 - DNA, 12218 bp, Oryza sativa
atttccaggtttggatcaatgatgattggggaactggtgattggcatttcagtgtgaaaaaaaatgatgtagaattttgagttcattcgtttggtattcgtgattggtcatggtggactagatatttttgagatttatgcttgttagacatggtgcatgacataaagtagttaaaataactaaaatgtcctgttgccatcaccgagtattgccattaggattgaaatagtctgtagaagaagaaacaaggaaaggaaaattttgttccatttgttggatgttctatggtgttacagacttggcatttcaaagcctcctctcactctccctctgggacatgtggttctctagtccttggaccaaggttaagtagtgctgttcaacctcttttctatgggctggagagaccctgcctgagtggctgctgttggggttttgagtgggttggctaaccggagatccctagttataacccctcgtgagaatactctcacctaatcgtagctaggattggattttttttgggacggagggggtatgttgcttcacttgtcaatagaatcttgctcagtagtcaggaccaatgacattttttcctagatttagtctggttgcagcagagtgttaacttcaagaagcttcagcccttctattgcctgcttcttgttgagcacctccaatgttgcattagtggtaggatgttacacatctaccatgagaacaataataaaaatactgatactgagatcctagatgcctggtagatgaacagcctgcagaatgcactagccccacttgttgactacttgcaaaaccagtctcaggattgatatttctcctttgcctttgtttttcttataaaatctcattttgtatgcctggtttctgatgtacttatgtcttgtggcagttccacatttaactatccaattaatttaagctgttttggaccaaaatatttgttgcggtgcttcttttggagtaattaattttatgtacacaactgcctatgaggattactcaaatcattatgcctatgaatagctcaagatggaatatggatttagctatctacacaatattttcaaccatctacaaattggagctgcttatgttcaatatgcttagtagttgttgaatatcatgtttttatggggtatatacacatgttgtgtgttgtgtcagtactgtcatacatgagttggatactttgatttattcatagctccatgtaatatgatggcatctgatttcttgtatttctctgtggttgtttgtcttttcgaaattcagctagttttttttaatcacatttgagatatcttgcagatgagaatgctgattgtacttttgtgcttgcagggacagtacaagacaagtcgcacaaaacagaaaatcttgtgatagtttaaatggcttcaaagcttcaagccttttggaaccatcctgctggccccaaaaccagtttgttatctctttgtgctactgtaacaatttgttggcaccactgtttatcttaggtctatgattattgtttctgatccgaaaataattattaccctgaaagcttgctacttcctgtagtcatgaaaacatgttcttttggacatgtctcagattctcaactcaaactttcaagactttaaacatcattatcttttcaaatattttgatcggatgcatgaaaatagtatttgtctagaaaagtacttacacaataccataagtttattgggttttaaaaatatattgcaatagaaatgagtggtgaaagttgaattatgtgactccttggataaccaaaaacacatgtcatcatgactggagggggagtacttcgcactgaagcatgggccagctcaagtggctcaatactttttttttttgcatttcaattttgtgtgatggttatctaccagatggtgcatttaacctgttatttgttgaccttcgttgtcgcagttcatttctgggctccgacatttaaatggggtattagtattgccaatgttgcagactttgctaagccacctgaaaagatatcctatccacagcaagttggtatgtttaggttacccaaatcactgtccttcagatatcagagccatactagtttgttatgcattattagtatatgtttatactgttgttgtggcatgcagctgttgcttgcactggagtcatttggtcacgctacagtatggttataacaccagtaagccctttgtacttatctatcaagagcaggtttaaactttgcattgtactgattctttggctacctcctttgcaaaatacccttaatttcaaatatgcagttgtatattcattcaaatagtcaggatatcaattcaggtccatctcattgctttgtattgctataatgttgcagaaaaactggaatctattcagtgttaacgttgcaatggccggcacaggcttgtatcagctttcccgtaaaataaggtatgtcaatatctaagccatttccccatttcattatttgacgacttctaagagcaagataatatggtttttgttgatctcctttgcaggaaagattacttttctgatcagaaggatgatgttgcatcattggaaggataatgatgactgacatgatgaaaacccggcccacaacctttgagcgatactcaactcactctgaattgcagagacgcgtcgttttctccaagacaggaacctgtcgtttgtttctatgtttctcttgcaccaatttatggatcgatctggaatgttacatcccaaaaaaaaaaatcaaataatctttttgacaatctctgcgaataaatgtgcaaatacatcaagtagtctctcctttatgtttctccgttgtttattcacatgttttgctaagaagctgttacagcgaacaatctttctgtttgctatctgaagttactacattgtaacctggctttcagctttcagattaccgtaccctgtctggtaatcgaatgattaaagtttgctgtgattttctgatgtgttgcactagcagcaagcctgaaaggcgtgtggaggttgaggctttaaatctttatagaaaaatatgaggtctctaggcatgagaccgtgcgcatttctaataaaataatggtgtaaatacgtcaattcatgtcagagtgttgctactattttttttcttctcgtaaaaacgaaagtgcatttcatcatgcgaagatgcaatacttttctagatagtttgaactgcccgtgcaaaactaggtgaaatccataaccaatacctgagaatttcaaagctccaaaagttgcagtataacacagtattaacggatcgtagtttccattttaactaattcaaactcaaaccaatgtatcaaccgaaatattcaaaccaaaaacatagcagacaaagaaaaccaaaattgttttttttcctagaacacgtaggagatctgtgtaccaaaatcgttttttttcctagaacacgtaggagatctgcgtatcattttattaagatagagaagaaaatgcgtacactgttagagaaagactctgacacccgcccactaaggatacaacagaataccacacacccaaaggaagaaaaaacacacaaactagtgcattaacagcccagccctaaagagatcacggagcctagcagctcctgctaggcaccaaatagcgccctcattagcgatggctcagaggacatcggccaagcatggggtagtgccattaaacacacagttgttcatgtgcttccaaatttaccaagctaccaaaatgattaaagagtttagccatttcttctcattagtaggtaaaccccttaccgttattgaccaccaattagtactcctagcagtaacctgggttggaaagctagagtaaccaagccgtttcaggaccaaacaccatacttgtcgagaaaacacaaaagtgattaggatgtgattaatagtttcctgagctatcacataatggacatgtaggcgggtgttgaagtcctcacttgtccaaccggtccgctgtccaacaactattattaattgccaaccatataaacaatttgaattccaaaggcgcccaactcttccaaattcttctccaaggtgcaaaccttaccgtcccaacaaagatggcctcatatgcagatttagaagtataaattcatgagtttgagagcttccaaacatgttgatctgggactcgaacttgtaagatcacccctttgaccaagtcccagatctaaagaaactccacaagaacctgaaccatcaatggtccgttaatatctgttacccattttttgttgtccaaggcttgtaccaccgtacaccgcctaacagtatttttggctatcaacttagtcaaattaggagctatctcactaacagttttcccttccagccatctatccatccaacacaaggtggattgtccatctcctatgcaagtctttaccgccatgctaaataactcacaagaaacacgaggcacctggactggtagaccgtgaagaaaaaaaatcgttcacccaaaaagaaattacaccccccgggtcgcccttacctttttttgcagattacaactaccccgcggtaaccgccaaaaccgcgtaaaattcacctccaaaaatttgaattcaaaaatcggcggttccgcggttctggcacggctaccgcgctgtttctggcgataaccacgatatttgcttgattatcgccggttgtgtagcagaacacatgaaattgaaaagacactggaaaatatttgaaaatacacttaaaatgtgtgtagaaattggagataattggaagaatatataggatacttacaaatctagcttttgtatgtgaaataaaaaaaattcggtatgacctttttctattttatggatttcgaagcaattcaacatttcgtagcataataattacaaattagcattacttgcacattactaccatattttacaggaacaacaaatgacccattatcattacaataaatgtatatcactaaacacgagcatatctactcacccaacaaataacatatcaactttacaaaaacattttctgcatcactagcaaaccatatttcacctattcaacaatctttacatctcaacaaacatcaatctttcacaatgtatttgacctaaacccgatatattttttctttttccaatttctaaactattttcagtttgccctcagatttgaatttttcttaccctattttttaaaaaattcttcactatctgccactacaaatcaagaactacatctatgatttttttcaattttttttagaattttcaatttgctcaaatttcatccaaaccatggcgcggaaaaacgttaccgcgccctagcaataagcgcggtaagcacacaataaggtacaaaacctccccaccgccggtgaagcaattgccaatctcctctctctccattcccctctccagactgatgactatgtggctatgtggagcatccgaggctaagctttgttgcgcttcctccaggttatggaacaggtataccatcaaataacttcgagaaacgtcggttggtggcattttgcaacggcaaaattcgatatccggagattgcttgtcagcttgaaggcgaagatcatctgcctatgctgctcagaatgtggacattcacctatacagaggagaatgaccattggtttgttgagttatgtgtcaatctgcatgagttgtgcaataatgggtgttcttcatgtggatttactcagcagatagtccccaaactaggaattatctatccttagaacccgacaattgtctatctattttgagcagacgatttgatgtgttcaccgcaatgctagtaggatgtgtgcattatctgaccgatgacaatgcacactacttttgcttatcttgcttcgtacaggcttggtcagcacttcctaaaggtatgtcaaaccacctagttatatctatacctatataaattaggcactcactcttgcttatcttgcttcgtacaggcttggtcaccacttcctaaaggtatgtcaaaccacctaattatatctatacctatataaattaggcactcatttcgagctcctacgttaagcaactagaaaattctagacattgatatgatcgatcgtattgttgtgaccatagatcatattaagagtccttgttaaataaatcatgcaattagaaatatccaaccgttgatttgttgattgtattatcatgtattcatgtatattatgtttagagttgttaaataattattgtaatttgaaatatccagctgttgatttgttgattgtattgtcatgtatatcgcttgtttctatttgttacattcttagtatcctttatccagttttatttatatattcatatgattgattcatcagcccattatatggtatgaagctgaaccacataaatttttaggatagccaggtatgaagctgaaccacataaattttcaggatgtcattggctatgtaaagtattcatcattcggatagtttcaacaattacttcatcggtttatgatttatgctaaaggttttgttgtcaaaagacaactgcgtcacgtcgaaagacgtggttcactcggtgagttgttggaatagtaaagcaatatattaattggtaaaaaattttgggattcccccattacatggccctagggggctatttatagtcttagtacatgctaatacccactagggtttagttaatacaggggaatttacatggttacccttatgatagggacattagcgtgggtattgttgacggtcgttacagacaaatttcgaccgtcaatataactaaaataatggagaattacctattcttacaatgcatatttgttttcaaataatacagttccacttgtacttggaaaataacatgttgcaggaatttatcaaataaaataaagagaaagtggagaaaacctcactcctaagcaagcaaatggataaggagggcccacatgacaggtgtaaccaccgaaaaccaccttaactgccacaaccgtcattgggacccacctgtcagccaccctgccaaacttaggggcctgctaggctggcccaggttcgatcgaacctagggttcagccgaaccctggcagctgcggctccggctagccttacacgtggataggacagtcaacgagccgatctcgagcgagctcgtctgcccaagcttgagccatgctcgagccaagcctattgcaccttcaagcttttaggcaagctcggttcgagctcggctaccaagctcggtcataagtagtataagatattttttagtgataatcccttgataagtataattattttctagttaatcacactaataaaagagtaaaaaatgattaaaataaatatattgtgctaacacatgctaatttattatgtaaatagatactaatatatatatatatatatatattagttaattaaatcaataaggtaaacaaacaatataaactatgcatagttaagctcggtagaagctcgagctcggctcggtaaagctcacgagcttttgctcaagctcgggtttggctcgtttggagctcgagccgagctcgaatcgagcctagaacgagccaagctcgagctacttgcgagcttcgagcttttttgacagccttacatgtggatgtccaggatcgcttgctaatgacggttacatgggtaaaatagaaatttcgcatgttagtaaccgtcgtagcgagcctataaaaggaggagctcattcactctctcaacacactcaagcaagctcaaattcctcttcatactttagtattattatcttagtgctaagtggagtagaatagaatagtattcggagtcttcggaagagttttggtatggctctagtagctcttgtattcttttctataatactttcgatattaatgaaatactcttctttatatacttttggtactttatatagtatgagtattgttcttattttatatctatgtcataccgactgtgtgggtagcctatcagagaggtgcaatggtccgggtttaatgtctgatttattagttgctctatgtcatgtgcacgggtgtagactgtagagtagtatttagtaatataagcatggtgcttagattattaaatatcattaattggacatatatgttgtgggacagtagaggtgggtcgctaatggtgacagttcagtataggtattcctccatgttagtatatattcctaagacaaattcctggggagggtactcctccgatttagcctcggttggacggccatgataggttgtcgtaaagaactcggcaaaccaaggtggtctctcgaagtaccatgagggcactgttaggggtattggccaaacaattgtatactagcatatataaattaggatttgagtgtatactagaagtataggaattgaatgcttcctaattcttcttccacttagttagaattactttattatgaggatttgattagctttgcttcgtgtcagtctacccctatatattaaacttaacccctgcttagactttgacaattacaagtaatatatgtttaaagtgcattagcaaagttcactcttattatcttcgcttgggattaaaaatacgataccttggaatacttctgtatgaaatgctacaatggtacattcgtgcacttgcagattacttctgtaaccataaatataccaggactatttctggcgccattgctgggaatcaatagttctagtaatgtcgttaagaaataccaacaagtatacaatgtctttcatattcatgggccctatggcgttcttcttgggccggcccattagtggtgaaaggcctccatgggctgcagggcctcccaagccataaatatactaggactatttctggcgccattgctgggaatcaatagttctagtaatgtcgttaagaaataccaacaagtatacaatgtctttcatattcatgggccctatggcgttcttcttgggccggcccattagtggtgaaaggcctccatgggctgcagggcctcccaagcccttagctgaaggcatcttctacttcgggcgaaggcctcttacttcgccttatggccttcacccttagtggtgattcggccggatggtgagcttgatggcgaatccttcggtcttcgtcgcctggcttcgctcaggtgcttcgccctatggtttcgccctaggatggtgagcttgtggcgaaccctttggtcttcgtcgctcggcttcgtccaagagcttcgacctaaggctttgccttaggcgcacccttggattcagccgacgcctgatgagtttggtggtttggtcgaaggccctcatgacatgcctccaacaggttttaactgtcatgcataagaggttaggcattggcattaactacattggaacttcaatgccttcatacgttctagttcccctttagtgaatacgatgagttttgaagctttaaaatagtcactagtcagtgatacaatattatggtatatcgtttggtacataagtagtttttggaatatttacaaaacttgaaattcaattaagtgttttttcaatgaatttgtttcaccgactttccatcatgaagatacttcaatccaagggacttgtccatccttgcaacctggcaattgtttatatattttgaggacatgcttgtgggatttgatgtgtccactgtgatcctagtaggatatgcgcgttatctgaccgataacaatgaacacaacttactttgtaccagcatggtcaccacttcctaaaggtacgccaaaccaccagtttatatctatacctatataaattagacactcgtttggagctcccatgttaattaacaaaaaaaatctagctgttgatatgattaatcatactgttgtgaccacagatcgtattaagagtccttgttaaataaatcatgcaattggaaaataactagccgttgatttgatgattgtattatcttttgtatatcgtgttaagagtccttaaataaatattgtaatttggaaagatacatggtgactagggattctaatttttttcttgcattgagagattaaaacatatgtggggtgtggtgtgactagctatgtatcaacaacaaaacaatttataaagagtttttatcgttaatgttcttttttttcagtcgtatttttgtatacaaggaatgtcattgctaaacgtgaaatttttgtcatagctataggactttgggtttcaaaattggttggaattcctagtctgacggtagcacacgctcctactactgcaacaagtttgatccccagcgccaacgagtatcaatgacctcactattgttttcaatatgaaggttatttcaagcttatcttacttgcaaaatattactattccaaaacctgcatgttgtgtagccatgaagtttggtccacaaatatgtaaacatggcatacaagagaaaacacaaaatgaaatgaaatacaagatttcatcttagcgatacatcatgccatatattcatattttggaagaataatgtaagataagccatctcagcaaagccttgccatgttgagaaccgtgaggatggattgtcagtatagaaaaccaaatactttatacaaaagttcgtgggcttgatatgtagttgtcaagtcgatattgactataccgctaagtttgttcgagttcaacaatttaccatcgatattgtctttttctataatataccagtgactttatcaattgttctacaatacgccattgagctggctcatcttttcaaaaataccaaaaatacccttagagacaaataagattaacaattgatttatcttattagaagtttcaaaaaaaatatgaaaatttttatgtggcctctttacacaacatggaagtttgtatacaagtttcaagttttttttctagtatatttattttctagaaaaataatattttttatgtggtatatgagagagaattttcttatatgagagataatagcgtaaaatatcttatgtagtgtatgaaagatgatttatgttaaaaaaacaataaaaaggtattttatatagcatataacatataagttatatatataaatgtaaaacttgaaacttctataaaaatttccatgttgtgtaaggatgtcacataaaatttttcatattttttgaaacttctaataatataaatcaattgttaacctgtatgcccataagggtattttgggtatttttgaaaagaaggttcagccctaatggcgtattgtagaacaattgataaactcaccggtatattatagaaatagaaaatgtcaatgctaaatcgttgaactcgaacaaactcagtgttatagaatagattctctctttgttttaaccaccttgttagtttggaaacatgcaaccactcgcttatttctctcagccgcatccctgaattattgaggcccctttcattttttctgaattatacgacacccttttgtttcttttatatagcttcatatgcatggttattagcttccaggtcctatactttatttagttaactctacatagcagtgccttggatgtgtccttcatgttttttagataagggaataatttcatcaaaatgaaaattggtggatgtccttgttgtgaaagaaacatatctttcctaatattgtacaatagtgcacattaattatgaattaaactagaatatcaattattacgacaaattatttattctaagctacacaatccacatcttctgctatcttacctctggttgctggtctattgttctgaacatgtattgcctatttgtcttgcatgttcataccatgtacttccacaaacagcttccatgtgttccttcctttactggatgtgttatttcttggctgtgatttacttttgatagtatgataggtcaaatagatttatttcacattgtttttcttgtttttcttatttgcacatccaattgccagatgtttctttctcaaagacaacaatttttgttgcccaaaagcttatgatggtacaaaattggcccaaacctaacgatgggccgctagcaagcgagcgagagtactcgttatctctatataaaatggtgcaaggagatgattatgaatttgtgaaaccctatcttgttttctgtgacatcccggcccaattaggatgagacctgtga

SEQ ID NO: 66908 - DNA, 3635 bp, Oryza sativa
aacgcgggacctcaacggtctgtagctccaaaacacgggactaacggtcccgcggctccaaaacacgccaccatggtagcaagtgattttttttaccgtgtcggtactgcttagtactgttttgacactatgtttgcactgtttggaactgttcacatgttggttcccggcagtaaaactgctggaactaacatgtgaacagtgtcaaacagtgtcaaatagtgtttcaatagtgccaaaaagtattaattcgatgtctaccgcggtggcgtgttttggagccgtgggaccacgatggtcccgtgttttggagctgccggaccgtcgcggtaccgcgggacgggtatattttcgcaaatccttcccatgaaggtatatagacgtaaattattgaaagaataagtatattcgcaaatttttttcgagatataagaaggttagagatcatatctcgatgcaacagaaagaactatcaatatgcttgtctccgcaatatactcagccatagagccggtccatatcaaccttgctgtaacctagtgtctctactcaatgtggactaaccttgtgacggggccaatgtctgcaaagatggtatttactagtatgtgtgtgatgtttctttgcttatcgatcttatgcacaactttgttgaaggtgtcctacatgatcctcgcgagggtgtctcctgtcactcactccgtgggcaactgtgttaagcgtgtcgtggtcatcgtaacatcggttttgttcttcaggactcctgtttctcctatcaactccctcggtaagtccgccatttcatcttgatctctatttctgacccattgatttcttccattgaagctcacacgttttgtatgacttccctctggtaggcactgccatcgcacttgccggagttttcctgtactcacaactgaagagactgaagcccaagcccaaggctgcgtaactgaagcatgcagttgccatcttattgtagcagtctttccaagatgaattgtcgtagcacacgtttggaaatttatagtgcatttagtgtagagggaagctgaacatgttcacgttgaagctaagtgtagtaggatcatgtatgtggtctaactcttacagttaaagcagggttttgaagtacatgagcagatttccgtgcgtgttgttgcaataaagtttcggcttcaattaatgcccatcaaaataattattattctagaacatcttaaatttcatgcaaacatcatctagaaaatataaagtatttcaaatcatcttcctcacattattttgttaacattgtaacatttaacatttctatgatatttaacatatatttatcaatgcattctgcaacaaagcgagggatattatatagtatatcacttgtttttgtgccattcgttaataccgaccgtgaacaaccatgtcactaagactacagtgattatgttagaattacacttcgagaggctccctcttatgtggattttgtggtgttttgttttggcctccacttatgtttaacattattttgcgttgatttttgtatggattcttttgagtcttgactgtctgtaagatgagaacaattgattattcataaatcagtcgttgtaatgattttcataattgataataataataatgcatccacataccaagggtatataaccatgaaaaagaagaataatgccaggtatcatcgtttcttctgttttttccccacattgctgagcaagtgaattcgatctctttggccactgcacaacccgtcaaccccttatcatcatttttaagaccttcaacttgtattcttgtccctcaaatattgagtcttcaatgtaatctttaatactccctccgtactcctaaaggaagtcgtttaggacagcgacacggtcttcaaaacataactttgacttcttttttcaataaaaatatttattgaaaagtgatatatgtatacttttatgaaattatttttcaagacaaatctattcatataatttttatattttcaaactcaataattcgagagttattcatgatttatattcccaaggtttgacttaaacattatcctaaacgacttcctttataagtatggagggagcatttttccttgccatcgggggccttcatctcttgcaattcaatggtgtttatagagagagattgttcatacactcgtatacccgtaaaatttaatcattgtttattaatgattgattgaatctgaatatgttgctatcattacttcattagtggcacgagaatattgtcacggctcgtccaatccttccggcgtctcgcctagattgatgtggatttgacgaactcgtaagaagatttcggtggaattttgggatagagaggaagaactcgagctgaggttggaggagaggtagttagttggaaatttgcttttctcttcttcgatagccagcccctgactcagaggtctgtatttatctagttacgacccaactgcctcagcctatatggtggcccgatacatccatctaatggcaacacaagtctaatacacaggccaagcctaacaatttcccttcccttaacaaccggcttgaccccaagctggtgcccttggaaaacgctgacgcagttgctgaagattttcttaggttgccagttcttccggaagccctgaccattgtaccagcccgaagcgtaccgcagcacaacctcgcttgattagttgttgacgcagtatcttctctgggcgacttccatctgcttcctccagacactgcacagggaggtcagaacaaacttgcgtacctggagcaacagctttcttgaggagagaaacatatacaactgggtgaatctggctctcctttggcaactccaagcggtatgctacctttcccactttatccagcactttgtagggtccaaaataccggaaattcagcttgtgacatgatctgcgcgccactgatagctgcacatacggttgaagcttgaggaacaccatgtctccaacctcaaaatgtctctctgagcggtgtttgttagcttgatgcttcattctttgctgagctctggtgagatgctagtgtaggagatcattcatgtgagccctatcttgtaaccaactgtggacatctggtacagtactttggccaagatctgtcaccccaaagtgatctgccttcctggcaaatagaacctcatagggagttttgcccaaagcactatggaatgaagtgttgtaccagtattgagcttgggataaccactgagaccacttagtgggacaagagtgaactgcacaccttaagtaagtttctaggcattggttcaatctttctgtctgcccattggtttgagggtggtaggacgaactcatatttagtttgacatcagccaatctaaacaattcttgccaaagtgcactggtgaatactctatccctatcagagatgatgattctaggcattccaaacacctcataaacatggcgcataaacagctgagccactgacaaagcagtaaatggatgtgtgagaggaataaacctggcaaatttagtgaacttgtcgattaccaccattattgtgtcaaatccccctaatctgggcaagccctcaatgaagtccatgctgatg

SEQ ID NO: 66909 - DNA, 84458 bp, Oryza sativa
cacctgtgacggtccgacgtttgcgagtccgtcacaggtgaggttacctgtgacggatgtttcttccgaaccgtcactgatgagttgattccagaaaaaaaataaatgataaatattggctagcctcaggaattgctagccatgccctctgaaaaacagaaacatcacaggtgccagtcaccccccctccatatcacatattccccaactgcccaacatcacagatgcatcacatatcacagatccatcacaaagcaacaatttacaacatcacatatgcaacaatttaatttattatagcacacaattcataccccatgaaagtcctcaaatgatttccaaaatttcttgtattctgttcgttgtgaacctccacaacctgtcaataagggaaaaaaaaggagaaaacagatgaatggtacaacataaatcgtagttgatcaaatgtgatgacaatttagtaaagtaccataaatattgcacatatgaaagtaaattacattgcactctataaaaacataattttttacatcgccagaaattataaaaacatcttttttacatcacaataaattatctagccaagttcatgagtctatttggcatgaaaacgtcctttcttgttcattatttctgcaagaataaaggcgcacacttcgcctctgatagcggggggggggggggttgatgggtgagatcttgaagccagctctacctttctgtttaataaataagaggttaattagcacgttttgaatagcaatgtagatattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagtttgttcttgccctccttgtgcctaccacccttttccacatataggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttatgtgcgcacatgatgtactccttgtcttgatgggcccataaacaccggttgacatagtcaaccacctcagtgaagctctgtcgtaaattaacctcattcaccatggatggatcaagaaacccaacctgattaccatggcgacgactctcgatccaacacaaccttaaaatatttacgtattagaactaatttaattaggagatatagtccagtcatatcacaagtatagaaggtatgcacttacaaggagtagcattttagaagaccagtgtctaacttccggatcctgaaaaggtcgaagaggtcatcaaaacctatagttatataggcaggcgatgataggaatggctggtggtcgtgatgtccaactatggatgactccctcattttccgcttggcattgcttagctccatgtattgcttatgtagctctcggcaagcaatacccatcacagctaacacattgtcctccaccaatggcatgcctagctcaaattgggctggcgccctcacgaccttccccgatttgctcaccggcatcgacgtcgcagccttgcccctttttggctccggcgccaactccccgaccttccccttgccgcgttcacgcttctggcccttgacaagtggtggggagctatcggcctttcttgtggtctttattggagccaagctttgagctatatctgccaagtccatatcagctccaccgggagaatgaggtactgacaatgccggtccacggggagcctcaattgatagcttagacttgggaggtgtaagctccgtcggtcgacttggacgaggagtcatcttcacaactatgtcttctttgggccattgtatgaacgtcttgcgcgcatcgcccaaagtcatgatttcatcatttgggggcacgggcagcggatagcctgaccaggtgtcctttactgtatcgatggacaccttggcatacccagctagcaggtctgcgccgtggaccttgtctgtaaccgagggcttgaaagccatgccctcagcgacttcaggagcgaaagttggatggactctcgctagtaggacacactgtgctgcgccctgcataaggtgaaagtttgaatttaatattggaatgtgtacatgtcttttattagatatggatcggataacaacaattacctcgatgtggtccactgcagctagtggtgcgatcgggagaccaggggccggcacctctgtggatgcacaactactcctatgctgtgacggactcgcgtcgtgttgtacacgaggagttggttgcacagcaggtgttgtgactcggggtatattcatgtcggcgaggaccttgttaaccctttcttccacccttgcattcatgctagcttctagttcttgaatgacctcaaccttaagttcggccttcaaacgagcgtccctctcttccttggagactttccgtttcctgtattgggagctgtactgagggagtccatgcttccagggcacatcgctactaattctccgagttcggccaggatgttctttggttccgagcgcctttgtgaggatgtcatcttcgcgcctcttcgacgcggactcaacctcgctttgtgaagcttgttcagcaaccaagcccaactagaaaagaagatagtcgtttatacgaacttgtactttatacgaacggaaattagttaggttaagtagtgaactcaccagttcctgatagacgacggcatcacttttgttctcaaatgtgacagagccgtccgggttgaccttaccccttgcccgcgcccagttgcgagctctttgttcagggatgtctgaaaacggggcagggacattcgctgctgcagcggctgcatcttcttgggcccatattgcctccttgccgatgtaccctgcggtgcccagccgatgcgggtgctcattccgctgttgcagtacgcgatgtgcctcgcttgattccctaaactcttgggtggtcttgagagagcagaattcctcccacaccgcttcggttatttgagggtattgatcgaacggcgtatgattgccgggcgggttgacaaactcggtgaagagctttgacttccaattcatccaagctttgcccatcttttggaatgccttccgcttgagcctatcctttgcttcggctggaaatgtgaaccatttctccattgccgtccaagctcgctctttctcggcttctgtgaccttcccgatatctttatggaggatcccgaagttctcacgtgccgctagcccgcagcagttagaccatcttccaatgacagtcctgggcgccgtgggcctaccactagcgtcaacctctcttataacttgcactgtggttggccatatattttgtgaccgcggatttctactagacctacttgcacttgtcccgcccgacatcgacgtatgttgttcctgcggcaattctgcagcacaaacagaaggcaatatttgctaaggggtgctagctaaaatttatgtggtcatgtggtgaaaatttatcctataaattaccatgaattttgggttgttggaccgccgttgtcgcgggatgaccttcggcaactgcctctgtggctgggtttgcttcttcctggatcctcgcaggtgttggggagggcgggtttgcgccgggcgttgacatggtttaactttcgcgaaaaagattataaatttcctaccattagactaaatagcattagatccaatgtaatacggggtatactatgaaagatatggcctcagttttgctgagaaatatgcatcaattacaatcatttgcatgaagggataaaaagaggaaatcagctactaggaggaaaaagcaacccaaagaaaatagaacaagtgtagttcatctgttcttatccataaaatagaacaagtgtagttcatatgttcttatccataaagaaaagagcaagtacaggaaattagagcagtagcaacagcatggccatataatagcagcaataagagcagtagcagggccatataacagcagtaggggtatatatgccacaggggcagcaacagcagggggagattcacataaacaacaacagcagggtggaaattcacataaacagcaacagcagagggaaattcacatagacagcaagggtatataaatcaacaagtgtagataatctgttcttatccataaagaaaagaacaggtatagatagaatgttattaagcaattcatccttggccatttaacaagaagtacaggggcaacaacagcagtggtatataaatcatgcatatattattgtagataaaaaaatgaacaagtgcagaaaatctgttcttatgcataaaaaaagagcaagtgcacaaaatctgttcttatgcataaaaaaagaacaagtgtagaggtatataaccactgaatcaatcatgcaaatttaaaaaacagcagcagcaagggtacagaatttgcatgattgacataaaacagcagcaggaggagtatatatgccacaggggtagcaacagcaggggcaaattaactaaaacaacatgtctagatatactcctcttatcaatccagaagaaaagagcaagtgcagaaaatctgttcttatgcataaaaaaagagcaagtgcacaaaatctgttcttatgcataaaaaaagaacaagtgtagaggtatataaccactctacactggccatttaataaggaacaagtgaacaagtgtaggggcaaaaaaatgaacaagtgtagataatctgttcttattgagcaattcatcactggccatttaacaaggaacacattgggcagcagaagcaggggcaaagatactccacaggggcagcaacaacataaaacaaggaacaggtgtattaacaagtagcccacaataacagcagtagcaggggtgtagataaaaaaggagacagtactactaacttcatgtaaacagcaattcatccattcaattcaagcaagtctagataataaaacagcccacaatcattgtggcagcagcagcaagggtatataaatcatgtatataaacaacaattcatacaattgacctattcatagacaaaaagggtatataaatcaacaagtttagataatctgcaaagcctccttaatcatcaaattatgacagaaaacaaaatgcatggagaattttggtgtctaggtcggttccgtccatggactacactggcctatccaccaaaattccccatgcattttgtattctgtgatggtttgataacctcggaactacattaaatctgcggccaatctatcaattcttcccttgtaactagatttcaaaccctacacctaataaaggtccttaattatcaaagaattatagaaaacaaaatgcattgaaaattttggtgtgtaggttggttccgtccgtggactacactgaccaaaccaccaaaattccccatgcattttgtattttgtgatggtttgataacccttaactagctagcttaataaactatttctagctagctaccctacctagctagaaacactattgccaatctatcaatccatcctttttcagctaaatgtaaacatgatccacaaaattcaataggtctagcaaaagggaacaaaacaacatatatagcagtacacactccatgaatggttatatgtccaaatggcacttaaatccacatccaagttgcaaactagctacacattcaagttttaactaacagttgcaaccataggcagcagcatgggcaaacatagacagcaaggggcaagtgtagataataaaacagcccacaataatttatgtggcagcaacagcaggggtatataaatcatgtatataaacaacaattcaactattcatagacaacaagggtatataaatcaataagtgtagataatctgttcttatccataaagaaaagaacatccactgcagcaaaattcatgctaagatcctctattgatgctaagattcactgcaccaaaatcatgtatataaaatctagcccctacattcatccaaaacatccacagacaacaaatcacatttaattcatctatacagcagcaccaataatcgaaacaacaaatcacatttcattcatctaaacaatgcaattcatccatcggaaaaaaggaggaatgggggagggtgacggcatacttggagaagcggcgtacttggagacggcggcgcaggccgtagtcgtcctggatcctggtggcggcggcggagaggacgaccggcggtggtcggggatcccggcgtcggggaggtcagggtcggggaggtcggggaagtcgatggacggacggcggagaggacgaccggcggcgagggcggcggtggaggcggcggcggagagggcggagatggcggcagagagggcagcggagatggcggcggagagggaggaggagaggttgaggcggcgacggtggagatggcggtggagaggacggcggagatggcggcagagagggcagcggagatggcggcggagagggcggaggagaggttgaggcggcgacggtggagatggcggtggagaggacggcggcggtcgagagagtgagtgaggaggcggcggtggagaaggaggcggcgagggcggcggagagggcggagatggcggcagagaggacggcggcgaggagggcggtggagaggtcgaggcggcggcgaggagggtctggatcgagagagagagaggcgaggcggcggtcgagagagtgagtgagtgagagtgggtgccggatctggatcgatctagaagatgtccaaccctaggtcaaccctagtcaaactcacctgtgacgggcgccaactatgtggccgtcacaggtgaggtcacctgtgacgggcgccaaccgtggagccgtcacaggtaagaccacctgtgacgggcccaacactctgggccgtcacaggtgaggtcacctgtgacggccctacagatagagcccgtcacatgtgagtttgcctagagcaattttattttattttatttcacttagttcttttattttccttaacatattttcacatacactacatatttttttatacttaattattttatttcactaacagtagtaattgcacttcattattatactactttaattattttatttccaatgcttatacttgcttaattattttatttcacttctagtgggtgcttcacttaattattttatttgactatttcataagcaatatactattgatcattgcgaacatattagagtcatacagataacagacatgtagacataaactacgtacataaattacaaaaataatccttcctcatggtcgacacgtgcatattgaacttcatcttcttcttcctcctcttctagaggtatttcttgacctatgccgtggacgtgctggttgtaatcatcctcgtctgcaatgttgtccaatccaacaattctccttttcccttcacgaacaacatgtagtttcttgttacacgggtcaactatgtagaacacttgaacaacttgtttggcgagaacgaacggttcatccttatacgcgttgttagccaagttgacagtggtgaaaccttcattgtcaacttttacattgcgaagatcgacccatcgacaacgaaacaacgggactttgaacttcaagtaatctagctccaatatttgctcaactttaccatagtattgatcacgacgaccaccgtcactagcagcctcgatgcgtaacccactgttctgcactgtgcatttgctgtcttgctttaccgtgtgaaaggtgtatccatttatgtcatatccttgccaggtggtggcactccattcaggaccctgtgacaaccactgaagtgtttcactagacaagttctgcaacctggcaattcggttcttcagccactcgttgaaagaagacatgtccttattcctgacccaactctctgatcggcctgggttctcttgtcggataactgcaaggtgttcgtcaacgtacggcaccacctcagtcatatgctgtagtaccgtgaaatgagctttatcgtacaccttccgatccaacctaatagtctttcttccaacagtaccaacaccgtcaagcctcccttcgtgatgagatcgtggtaatccaattgaagatgtttctgacatgtagtccacacaaaattcgatggcctcttcggtggtgtaactctcgatgatactcccctcggggtgtgaacggttccgtacataacccttaaggatcccaggtacctttcgcaaggatacatctgcgtcatgaatgctggaccacagcactttgtttgcctcacaaggtgcaccggaagatgttccattatgtcaaagaaagttggaggaaagtacatctcaagatgacatagggttctcacaagttctgcctgtagttcatctagtccctcgggatcaatgatcttctggccgattgcatggaagaaggaacacaaccgctggatcgtgtgtcgcaccttaggaggcaaaatattccttattgcaacgggcaacagctgtgtgataagaacgtggcaatcatgcgacttcattccaaccaacttaagatcttgcagtgaaacgagcctactgattcttgatgagtaaccagatggaacctttataccactcaaacatgttagcaaatcaatcttctcttctttcgagagagtgtagcaggctggaggaaggtaaaccctgccggattccgtggttatgggatgtagctccgaccgaacacccatatcttccagatctcgtcgggcgttgagaccatcctttgtagtacctgggttaagcagtaatcccattaaactctcgcatacattcttctcgacatgcatcaaatctatgcagtggcgaacttcaagatccttccagtatggtagtctccaaaatattgacttttttttccacatgctcctctcttttgtcttttgtttttccacatgctcctctgttttttccttcgatgtgctcttctcttttcgctttccaactttcctcttttttccaaactcgttggttattcccatcactaagttgtgcacctctgtccctgttagctctgtcgggggtccggctgtatctctgtgtccattgaaattctttctcatattcctatacgggtgataccttgggagaaatctcctgtgacccatgtagaccgtcttgtgtgaatgcttcaaccatttgcttcttgtttccttcatacactccgaacacgcccatttccctttcacagtttggccagaaaggttgccaagggccggataatcgttgatggtacaaaacagcatcgcatggaggttgaaatactcttgtgcatatgcgtcccatgttcgtgtgccctcattccatagcctttcgaagtcatcgattatcggttcaaggaacacatcgatatcgttgccaggttgtctcggtccttgaatgagcatggcaagcataatgtactttcttttgaaacacaaccagggaggaaggttatagttaacaagcagaactggccatgtactgtgacgactgctcaaatcaccaaaaggattaatgccgtccgtacacattgcgaaacgcatgtttcttgggtcatctgagaattcctggtaaatcctatcgattgtcctccactgtactgaatctgctgggtgcctcagcatagtatcgactttccgttcttcggcatgccagcgcacaagcttagcttgttccttgttcgcaaacattctcttcatgcgctccgcaattgggagataccacaccacctttactgggcctcccctctttgacttacttccttcaccttcactctttgctcgtttgtatcttgatgtcccacagatagggcagacatccaagtcagcgtattccttgtaatacaaaatgcagtcgttcggacatgcatgaattcttctgacctccaggcccaacggacataatacttgcttcgcttcatatgtcgtctgaggtaaattgttcccctctggcaacagatcctttaacagctcaaggagttctgtaaaactcttgtccgaccagccattactagccttaagcttcatgagttccaacacgcatgacaacttgctgtgcttcgacttgcatccatcatacaacggcatctggcaatcttccaccaacttactaaacttctcataatctctgtcgttgtcctctgcgtcttcaatgtcatgcaacattgtagatagacattgagtgtccaaatctatggtctctccacctaaaggagaaggtacgaacatgccttctcgagctgcggcggtgttctctacatcctgatccaacacttcttcagctgcgacatcaggcacctcttgctctccatgcttggtccagcaggtatatttcttcatgaatccattcattatcaaatgagcatgcacttcatccttgtcttcgatcatctgttcattcttacagtccctacatgggcacaacatgtgcatgctcatcctactttttctgtcattatccgcaaatgtgacaaattcagtgaccccctctctatactcggtagacgaacgatgcgcatagtacatccatctacgatccatctgaaatcaacaacatacgaagaaaaataaatgatgatcgatatattgagaatgaatggagaataatgtgttttttaccttgaattttagcaaaaaatcgccccccttgccctcccaaccgatttgtgaacagtacaatggtcgggatggaaagcagttggcagtttgggggtatttatagacccaacacacctcaaacgggttagataaaaaaagcccgtcaaaggtattgctcatacctttgacgggcttctattcaacggcccgtcactggtatccgctcacctgtgacgggccagaaatgaaagccgtcacaggtggcggcccatcacctctgacggcttctaatgtatcggcccgtcacaggtgaggggataccagtgacgggttggaagcaaaactcgtcactggtatacctctgacgggttttcctttcggcccgtcacaggtgaggggatacctgtgacggtccgcggccggatggctcaccggtgacgttatctcgactgacccgtcagaggtaatggtcactagtgaccaaatcgtttgcccgtcacaggtatcccgacagaggtgtgaggatctggcgtagtgtatggcgtctacgagtcgtcgtcgtcgtcggggtcggcacgcagcttcacgaggcttgggtggtgcatgaccgagtacggcctcgacgacgacgccactgacggagcagacaagcaggtgctctgcaaggtctaccgctcgccgcgcgcggtctgcgcggaggcgcgcacggcggcggcaaagtgctccggctccaagaggaaggcggacgacggcgtggatcacccggaggcgccgccgcccagcgcgcggccgcggcaagaggaggccgggagcgagcacgacgagcagtcatcggagctcctgccggagttggacctggacgcgctgctgtcggcgccgatggacgagaacctggagagcacgttcagcacggccgccacggaacaatacatgaggtatctgttgaacgacgagcctttgccgtgggctccgacgacggagcttgtcgacggcggcggcggcggcggagacgagttcatccagacggcgaacggaccttgcatggatggcgaggtcttcacgcgcctggctgccggagaaacgctcgacgacattcttggctcgacgagttcttgattgatctctattgtcagcggctgttcctctagcactagtagtgtagttctttcgatcgaatccgatcgaagtaggtttagttagagagattcatggattaggtatttgtttgatccgtgaatagacactgagctgcatgaagatatgcattgctcgatcgatcgatctgtaatttgatgagaagagttgaattgattctttctgtaaagcgtgatgatgtagtgcccttttgtgaagtgaactaatgaaattcatcttcatcagaggttcggagtgttttttttttctttttgatcgaattgaagcagaggttatgcatatgcgttgcttgtttcctcgatcgatctgtaattaatgaagagagttgaatcgatacttttctgtaaagtctgatgtaattctctttttttgctgctgtaagaaattataatacgaatgtttttcttcgcttcagatgtcctacatgctcacatgcatgcacgctggctttctcggtgttcatcatgatgagcccaccttatattgggccgtgtcggcccacctagatccgtatcggccctattttcggtgatccgggttcatgatgggccaattccgtaacgtgtagtgggctcatctcacagaaagccctgtgacggtgtgtacctatctcgctcgtcgccgtcgttggggtcgcgagaccgcggcggcggcgggcggcgaggggccgccggcgccgaggcatccgcgaccgcgaggcgggggatggcgcgcggcgacgacggcgagcggctgcctgtcgctgttggcgtgcttccatggcagcagcagcagcaacaacaacctacggtttctgtttctcccccaaattccaaggcatatcctctcccttatatttgagttcgccatcgtaggaatttcttcagtagttcagttccaaccgaagtgcttgtcttttttttttaatctctaattgtctcatgtgcaattgcatggaagagtagggagagtcttgctatggaattggatggtattttccagcgctctagatggataggcaacatgaatttccctaggatttggtttactgtgacctccgtacggatatccttaaaaccaactgtccttttagttttagaccttttgtatgcttatgtagtgatgtggttccattgatcaacgccttcttttgcaagttagtatgttcataaatccacacagcatgtacacactagacagctttgatactgcattgaccagagttggatttggtagtcgttgtcacaattgggcattagattcaaacagatcttctacctgctcacacagagactaactcttgtctcatactgcaacagaagtcaaacataactttagttgtacatgatgatgtgtttcgttctggtggactacaatatgttcaaccaaaaagaaaggaaatttgtctccaccacaagtcttacatgtcgtcaagagagtggcgaagagtcttaaaagcatcccaagatcatctgcaaattcccccatggctagcttggttgacccggcaaggttgcagaaattgttttcttttccttcttttaatgaatgggagaacttctgctctggtcgatattggttatccacatttccattcctctcagaggatgtatactatataatattgggtaccttcttgtttcccatcttatgggttcaacaaaagaaactataatagctagcatgcagctggttttgctatcgatcatagcatccactgtcatgttggtggcatctggagcacctcctcccactgctgctagtcttgctccctgccccaaaacatgtggagaagtgaacatctggtatccttatggtatcgggcctggttgctttcggcagggctttgagcttacttgcgacaccaccagcaaacctttgaagctcttcttgggaaacactatgactcaggtgattagcctctatccttcaggaactgtccttgcctctatcatgtacactatccccatgattcatggagttgacacctacaacttgtcatgggactctcctgggaggaatctcaacgttgagacctacaattacttggcgttcctcggttgtgggatcggggtttacctgttccatccagatactggtaaccttgtgggtcattgcacgatcaagtgtgcctccatggaggaaatgcacatggcaaccgaaggagggatttgcaatggcatgggttgctgcactgtcacattcccggtgttatttcgaggttttagagtgaccattgttaagagtaacgagacaataccgcagcccttcaacaatatcaccatcaaggctttcttaaccttccgtccttacatttttagcattgcggatctcctgtccaataagataaatgcaagcaccattggtgcttccatggcatacctctcgactgtcatcgcagatgaaccaaattgtccaacagctcggttggataataagacacaatttgcctgtggcagtaacaattgcatagatgtggcaaatggaggttattcttgtgcttgcccaggaaattctgatgatggcaatccctaccttcttgatgattgcaaacaaggtacctacgcaactctagctcctctctgaacagatgttcctttctttattgattgttaattcactacatattttttgtggtcatatatgtttcttaactggaacagagtttaaccctaccccgaaaaagaattgttctagatcatgtggtagcacaaatattcctttcccgtttgggcttgagccaggctgttttgctaagaggagatttcaactgagttgtgcatcaaatcgcactcttattggaagaccacctgcaaaatatgaagtgacaaatatatcattagatgaaggactcctttatgttaacaagctttcagaatttgaagatgccaacacaaagtatttatcagtatactatggtggttctggatattttggccaacaattaatttatggtttggaaaagtctgatttatctgaagagtatggtgtttggaagtggtctgtgaccaatttgacgtgtgaagatgcaaaaagcaaaagtgcatatgcatgtgttagcacaaacagcgagtgtcttgatgttacacatgggaagctatatattggttatcgttgcaagtgctctcttggatttgaaggaaatccttatgtccaaaatggatgtacaggtacacattcctaatgtatctagtgcattcgattttcttgtatgtggcaggagcatggagatatggaatatctgaagagagtgatatgttatccaatgattttcatagtgtggaagttgtagttaatgtgcatttaattgaaaacaaaagcatataggagccatcaagagtttgatatattaaagttcacatttttagttttctgtttgcagatattgatgaatgctctataccaaactattgtaatgggacatgttataactttaaaggaagctatagttgttgtcctcatggtatgtcttatgatcgagtaagaaggcagtgcacttccaataagaggcaaaatattgttttgggtatgtcaggtttttatttattgtttgctgtatgcatgcactccaattgttgaaaatgttatcaaacccctcaaagaataacttttcaattgctgcaattactcctgtaggacttgccattgggattagcagtggttttggagttctagctcttacattaattgcagctatattattcaaaaggtggaagagaagcactcggaagaaaattcgaagggcatacttccgaaaaaacaaaggccttctcttggagcagctgatctcatccagtaacaatgttactcctaacacaagaatattttctttggaagatttagagaaagcaaccaacaactttgacccaacacgtatccttggatatggaggccatggtactgtttacaaggggattttatccgatcaacgagtggttgccataaagaggtccaaaattgtggagcagagtgagattgaccaatttgttaatgaggttgccatcctttcccagattattcatcgtaatgtggtgaaactttttggttgttgccttgaatctgaggtgcctcttctagtgtatgaattcatttctaatggcacacttcatggtcttcttcatggtgatctgagcaccaattgtttgttgacatgggatgatcgaatgaggattgctctagaggctgcaggggcacttgcttatctccattcctctgctgcaatgccaatcttccatagagatgtgaaatcaactaatatactcttggatggtaccttcactactaaggtttcagatttcggtgcttctaggtccatttccattgatcaaactcgcgtagttacaatagtacaggggacatttgggtacttagatccagaatatttctatacaagccaattaaccgagaagagtgatgtttatagtttcggtgtgatacttgttgaactcctaacaaggaagaagccaatttttctcaactgtcttggtgaacagaaaaatttgtgccactgttttcttcaaagcctaagagataaaacaacaatggatatactggattctcaagttgtagaggaagctagccatagagagattgatgaaatggcctcagttgcagagatgtgcttaaagactaaaggagcaaagagacctaaaatgaaagaagtggagataagactgcaactcctaagagctgcaagatcaagggcatacaaggaagacttacaaaggagcagcgaaataaagccgttattaactccgaagtacaaatgtacttccctgaacagcaccaagaatgttgaaatgggccttgttgctaatccagaatctcaggttgtctctaggtgctataccatggagagagagatgatgtactcttcacagtttcctcgctgattgtatttgtttcgacccttgtaatgatttatttatttttcgcttatttttgtagactgtacaaaatgaatggcacagaccaatcgatttctctgtatgcagcagctctatctatttttgtggagtggttagttgcaacagctctatcaacgttttctctgtatgcatttgtgtgtgttgacccagcaagaaaaaatctaagtaaaatttgaaaccacagcagcaacagcacgataggtcgatatgtccgagtggttaaggagacagactcgaaatctgttgggctttgcctgcgcaggttcgaatcctgctgtcgacgcttttttttttttgtgctttcttttgttgtacattttttattttcccttccagccgtgtctatttttccccttatttgttcattcacttttttttttcagctgcgtctctttcttgatcgtgcaatctatagacattttgttaagacctttaataacatttttataatctaatgttagtgcacatagttagttagtggtacagtgcctctcagcctacaacaaaatgctgccatttgttagtcattgctaaagtgcttatgagcaccgtttatattactcaatccatgcaggtagacgtcatctgaacccattaaacatatacttccttagttttttttaaatagatatcgccgttgacttctaaacacatatttgaccattcatctcattcaaatttcatgcttaaaataatttaagtgataaaacaactaacaaccaaataaattataatacgtgatttttttaataagacgaatagccaaacgtgtgacaacatgttacaacaagttaatggcatcatctattaaaaaaacagaggttatactgtacaataaatgtgcatttgtaaccagaaaaataattcactggtaggactaaaataaatacggagtatgtggccaagggtggaggtagagtatctcagggggggtgcccaggaacccagtcaagaaattttttagctataccttactcattttaaccatgtgtgcaccccctaaatacaaacttaggcacccatgtcagcttaaattcgatttaaagtagagtatattaaacaagtggtacccctctacatttcgttttagatccgcgcccatgtggctatatttaggccctgtttgggggagcttctctcagctacagcttttcccaaaagctgcttctgctagaagctgccccaaacagtccacagcttctgagaatctgtagttacagattctgaaaaatgaactaagaagccagaagctggagaaactgggtttcagagcttttccagattctcagaagctggctaccaaacagctgcttctcagaatctaaagctcctcaaatagacccttatatttacttgtgaaatagtaaactggaactattgtggaatccaatggcaatcaaatctaagtttcatgcctatgttcattgaagcaaaaaggaatttttcccaagtctttttcattgaggttgttgcgatagtattgtggaacatctggagaagaagaaatgattatattttcaacaacataacacccactttcaattcctagaaatctcttttccgtaaagattttaccctacttttgcatagggttagagctcaggacagaccaccctggaaatcatggctagataatctgtaatttgttcttttaagttctattttcttttcttttctccctcttagaactttttgggattgtaaatatcttttattgacaatgcatttcaataggagcatctcctgctggtttttcgtaaaaaaaaaaaaaacgggggggggggggggggggggcgcagaagtaaggccggcccggcctactctctcggtcggcccatctcattccaaccaaagcgctgcggcgaggcgaggggaggcgaccaacccttctccgcttcttcccccaccttcctctcctcctccgccgttcgcgtctcctctccttcctcccccacctccgtctcgcgaaaccctcctcccctccccccatggcggagtcgcccgagaacgccgccccggccgcggctccggccccagcgcccgcgcccaccccggccccgccgccgccgccgtcatctccgcccaccaagtcggggatcccgccgcggtacgacctggacgccaagtgggacgcctgcctcgacatctccatccgccgcgtcgcctactccaccctgggtggcaccttcgcgggcctcctcctcttccgtaaggagtttcccccctcccaaactcgcccttgccttcccattgcgtgcgatttcgtgagatctggttgcggcgcgctcgttgttccggcattggcctagggttggcgccgttgctctcgttttaccgttccgatcggcctactctgatgagggattggctaattagggttacatccaagtataatgcacgttatgtaggaactggttgctttatattccgagtaattttttttcatgcaatatcatgtgattaggtgtcgcatttagcgtggatgagttttttgtgtgccacaatgattctgggatttgacatgtgcagatgaaaattccttggtcttagtttactgtatgacattgagagcgaaataagtacaaacaagcagaatgtgaggatgcctgaatcacgtatcgatatccttgtttcattgtgggggctatgcctggattgcttgtaaggctttggtgaacatttattacaacattgtgtttctttcgtatgggcagcttccatgtgtggtagcttgtttacgagaagtttttgttaaatggtattggttttcagcacgtcacggtttagatcccttctaattcatgtttagccattgatagtattagttctcatactgcctagaatatgtttgaaatgtgatcagtggtgaactggtggtcctccttagggggatcaatcgtagtaacttttgtgtgccaagtgctgaggttttgtatgatttgtggtctggtactaatccttaatcttggagtgttgactgtgctttatgtgatcaacacttagcattttagcttgatgtctctccagttattttttcctaatggtgatgagcacacattatagcatgcatgtttaggatcttttcctaggtgaacctcaaatgctcaatctcaaatatgaagggcttcacatgatatctattctgaagtcattattagttattaagttttcctgtatcttttttttttaattttttcttgcattcagcacggatttgacatccagatactctttaaacaatggaacacgtttgctgagatctccttttacatcttgagtactttagctatgacaatttaccatcttgacaatacaactaacaatacgttctctttgaaccttcttgaattactattcatcatattttatcctgaatttgttagaaatggcatatgtccaaaaaaaatgcaaagggagtagttctgccttaaaataccagtgaatagacattcattaaagtactaataaatttagttcttttctccaacaagagttggatgaagattaagattttcgtggcacgctttttaaactgttaaacggtgtgtttcgtgcgaaaactttctatatgaaagttgctctaaaatatcatattaatctatttttcaagtttgtaataattaaagctcaatcaatcatatgttaataccacctcgttttgcgtaaaaaacttcatctccatcttcattttcaggagaaaagaacaccaccatattttgaccagtattattttatacaggtagcccaactactcgctgggcatcagttgcgctcggagctggtgtggggataggagctgcgtacactgaatgttcatacttattcaatggtgctcctccaaagtggtcacccaaagtttcgaccgttccttctgctcattctgaagtaagtgttttctcattttccctgaacttatatatatctgtttgttgactagtcaaactttaccatcagtaaatcaactgcatccttttactgttcttttttagcttttacttgacctcaccatatttttatcctggttgtatgtggtacagttatcaactcttggtgtttctggaaaagaaatgtacttaatattagaccagaataggttattggtgaaatttatttgccactttaactttataacacatagcaggcactacatgtttgctactgcttgttgcatatttatgaatgcatgggttgagcttcttactatcagcgattgtccaaaggctaggaattaggtacatgctgacagtgatcaaacaaaaaatagagcacacgtttcatgtggttggtagtaatttaccaacttccaaacacgtttaggccactccttgtgtttccatagcaagccccccttttctatatctgggattttttcttaattcagcatttgtcaaaatttgtatagatgatctcatggcagtcatgttttggtcagtttgggattagattgtttttgaaaacactctcaggtgtgtggaaggatagagttatcgtttgttgaagccactgattttcaacagtccatgggaaaaatgttgtgttggtgtccttttgggtgaagtgaaagtattgaaaaccctctgcagaagttataatggctgtcatgaatctagtacttacaggatgcgtgtagcaagttttgttcattgtgaaatgacattggtgattatcttttaacgtatctaattcaaaattatcattttgaatgttcattaatttccttatcttctatatttaatcagggggaagacaagtaaacgctgtttggttggatcggtccatcttgatggaggttttttggagtgttgttgaactagctatctcatcatcttgtctgatatcgccaattctggtctactctttaagtatcgcctcaaagttagcaagagcctgctgattttcctttacactatgcaaaactattccaattgtggtcggatgacccatgggccatggctgcgtacctcaaatgatggttttgtgactggcaaataatatgttcatcatgcgaacttgttgcagcgtgcacattagtatatactttgttactgtcccccttttgatgattggtttgtttccaatcctgagcaagtccaatttctgaacaaaatcgagtgtaaacttttccatgcaaaaatgattttaacgttcactttgcacgtttccccgtgagtacatttcgtgtggatctgaaatttggccggtggtctcatcgagaacgggcgttaagattatactccctccatcctccggtccttaatacaagggattttgatattttgcctgtactgtttgacaactcatcttattcaaaaactttgtgcaaatataaaaaatgaaaagttgtgtttaaagaactttggataataaagtaaatcacaaataaaataaataataattctaaatttttttaataagacgaatgatcaaatagtgtaagcaaaatgttaaaatcctttatattaagggacggagggagtacaagatgactgcaaccctttttcttttacgaaagtttcattaagctatttaggcgaataaaaacgtcttttatgaaactttcattaaactattttagacgagtctatataaacgggtgtgaactttcaaaattaggcaaaggctgtgtttagatccaaagtttggatccaaacttcagtcatttttcatcacatcaatctatcatacacacacaacttttcagtcatattatctccaatttcaataaaaatttaaactttgcgctgaactaaacacaaccaaatttaaagacgcccaaaacgggatgctgacagtgaagcaactgtctctgcgaaccgacgcgtccatggcaacgcgaaacacctgaccgttgttcggccatggcaaatccaaaaatggattaaccgtcgccaaccccacctcgtccgtttattcttcttcttgtttcggcttccgcctccgtcccgcgcgcgcgtgcccccgcccgcgccgccatctctctccttcctcctgtattgttacgcaagccatccgagccaagcaggagaagaggaagaggaagaggaagaggaagagcatgcccccctgcgcggcatggggaaaagctccgccgacttgtccgcctcctcggagtcggccgtgctcctgcacggcgacctcgacatttggataaccgaggccaagtgcctccccaacatggacatcatgtcggagcggatgcgccgcttcttcaccggctacggcgcctgcggctcctcgtgcggcggcaccggcgacaacgcgcgccgggccggcggcggcgtcaggcccaagaagatcatcaccagcgacccctacgtctccgtctgcctcgccggcgccaccgtcgcgcagacgcgggtcatccccaactccgagaaccccaggtgggaggagcgcttccgcgtcgaggtcgcccacgccgtctccaggctcgagttccacgtcaaggacaacgacgtcttcggcgcgcagctcatcggcgtcgcctccctccccgtcgacaggatcctctccggcgcccccgccgagggctggttccccatcgacggccactgcagcagcaaccccatgcggccgccgccggagctccgcctctccgtccagtacaggcccatcgacgacaaccccctctacaggggcggcgccggcgccgtccccaacgcctacttccctctccgccgaggtggcggcgtcaccctctaccaggacgcccacgtcgccgacggcggcctcccggccatccagatcgccggcggaagggcgtacgagcacggccgatgctgggaggacatctgccactccatcgtggaggcgcaccacctcgtgtacatggtcggatggtccatctaccaccccgtcaagctcgtcagggagcccacccgggcgctccccggcgagacgccatcgacgctcggcgagcttctcaagaaaagggctcgcgagggcgtccgcatcgtcatcttgctctgggacgacaagacgtcgcatgacaagttccttctcaaacggtagtatatctatctatcatcttttttatatcctttcttcttcttcttcttcagttgtactctctgatgaattgatatcgtcaaactcacaagaattcggaaatgatattgtgagaaataattcaggttgaatgcaggatggtgtcatgcatacacacgacgaggagaccaaaaagtttttcaggcattcaggtgttcactgtgtgctggttcctcgctatgccagcactaagcttagcattttcaagcagcaggtcagaaatctttgtctgatatagcgctataatttaactgcctcattagttattactagtacatgaacataagtatagtaattacttgttattgaatataatacctactagtacacactatccaattatgcctgcttttacaaatcacatacaagtaggttctcactagttcatgttctgttgcttatctgcatttgtcaggatgaatagtcctgatgttctttctgagtctgagaaagctacactaaatattcatgcagcaaactcatgccttaccatttgttcatttgcctgttaatagttcataaaaaacctttcgatgatgcttgctaatgtaatatttctcttctccaggtagtgggaactttatttacacatcatcagaaatgtgtgcttgttgatacacaagctactgggaacaaccgcaaaatcactgctttcattggtggtctagacttgtgcgacggcagatacgatacacctgaacataggcttttcaaagatcttgataccgctttcaacaaggacttccataatcctacatttcctgtaagttctccagttcataagctgttatcagatcatggagttccttcatagatgtttacacaaattcatgtgaattgctaaatatctccataaaatgtattggcagcacgttgtacaatctgacttttctataaaatatatcttctctatctgataagaatatgaacgccgaggatcctttctcctgatctacaggttaattcatatggaccaagacagccatggcatgatttacactgcaagattgagggccctgctgcctttgatatactgacaaactttgaacagcggtggagaaaagcaaccaaatggaaggtcaatcttaagaaagttgcaagttggcatcatgacacgctgataaaaataaaccggatgtcctggattgttaccccagctgcagatgaggctaatgcacatgtttgtgaagaaaaggacccagaaaattggcatgtgcaggtataagactttgttttagtcttacatgaactacagtaacatcttagatggtacttcctcatacttattttggtgctcggctaggtgttcaggtcaattgattcaggttctgtaaaggggttcccaaaaattgttcaggaggcagagtctcaggttagtgtcctttgccatgcaccacagcaccagctaaaagtgcatctttcaacaattgtttagttattttcccttttcttctgcagaatcttgtctgtgcaaagaatctaaagatcgacaaaagcatacacagtgcatatgtcaaagcaatcaggtctgcgcagcacttcatatacattgagaaccagtatttcattgggtcatcgttcttatggtcctcacataaaagcgcaggtaaatctgtcttcagttctgctttaggtgaagcttatgaaatgccatttcactacaaatttctttgcttggcaaccaacagttaacatcttgtagttgtagacttgatcagcctaacaatcacatacatgtttatgctatgacttgcgaacagcaattggattgttcagatgcacgatggcaaacgacacattagaacctgaaaatggcataagagatagtaggattagtgtttcagtacctgtcaggctgtttgttactcacatttggtaatgactacaagggcattctgcattcatattacgattggaatgctctggtgagatcaggtgctgataacttaatacctgtggagctggccttgaagattgcaagcaagatcaaggcaaatgagcagttcgcggtgtacattgtcctaccaatgtggcctgaaggcatcccaaccgcggcaccgatgcagcaaatcctcttttggcaggtctgcaggcatttattcatgcaaataactactacctccgtttcaggttataagactttctaacattgcccacattcatatagatgttaatgaatctaggcacacattaacaaatgaatctagacacattcatttgtgcctagattcattaacatctatatgaatgtggacaatactagaaagtcttataatataaaacggaggaagtacaaattaattaagatactgatgttttgatctggtattcttttgaagagccaaacaatgtctatgatgtacaagatcatagcggacgctctgcagatgcagggattggttgaagctcaccctcaagattatctgaatttctactgcctcggcaagcgcgaggtcgccgccggtgacagcatgtcccagacgagcttatgcaatgacaactccactctggtacagtacagcagcaggatactactccgtagtccgtagtaggtaaatgtattactactacgtgtggtgaaatactcgtggctgatcattgttgcaaattaacaatcatgcatccagcgctcggcacagaagctccggagattcatgatctatgtgcactcgaaagggatggtggtggacgacgagtacgtcatcatcggatcggccaacatcaaccagaggtccatggaaggctgcagggacaccgagatcgccatgggcgcctaccagccacactacaagtggtctgctgatcacggccaaggccctcctcgtggacaggtacagttcatccaaagagcttcattacgatcgatgacgagagagagagagatgtgtgtttgcattgcagatgtagagaaacgaggattttcttgctaactccacaaggtgttgaactagccaacctaggttcaaaagcctcaccccttttaattatttgatattaggtagggttcactctatcggttttagcccatttgatcggagttcaccgaaatcccgaaatttcggaaattttggtccgaaattttgaacaaaatttagttgaatttgaacaaatattaccaaaattcacgaaaaaaattaaaaaaatttagccgaagtaatatcgtatcggaggggaccaaaatgaccgaaatttcggttcgaaatttccaactctgatattaggttattcactaatattcacttttttttgcattgcaggtgtacgggtacaggatgtcgctgtgggcggagcaccttggggcggtggaggagtgcttcgggcggccggagacgggggagtgcgtgaggcgggtgagggagatggcggaggagaactggagggcgtacgtgtcgccggagatggaggagacgaaggggcacctgatgtgttacccgttgaaggtggacaaggacggccgcgtccgctctctccccggccacgactgcttccccgacgtcggcggcaaggtcctcggcactcaaacctcgctccccaatgccctcaccacctagtacctgtaccatatcccgcgtgaatatgaatatgaatgaatgccactgttttgtattttcatgtgcactgcaaccaagcaattttttttttccgcaaaagcgcaaaaaaattatatatcaatatattagaagaagagagcagagtttaagatagacaacacaaacggtcgtcagaaagccgttgccaaggttgaggaaagaaagaacaaggggtagagcatttttataacattgcttcaaaatatagagacacgcatgctgcacatctaaaacgcactagagcagaattcacaacaaactataatttactttaaagataaaattggttatatagtccttagagtgtgataggacgatgaagccatgggtgcatgatcatacttatgaatagcagggtttaaatccaaattcttcgaatattatgattctatttttccaagtagagatttactagtattaatctttgtgagtgtatgagtgtgatgtgcgcacatgtcggcacaagcatgcttattgtaatatgtttccaaatacgaatcgaggacatgttggtagtttccattcctttgagcgtgcgttaaaggatacatttgcaggtatatataagtgtgatgtgtgagctcgtgccatccatattataattgaaaataaatacttatccctttgataattaggataaacttacaggaattaacaaatagacccactatattttagtattttctattttcgatgctttacagcctcattgtttggcttatgcttatacttataagttaaaatttaaattttcaacattgaatttggagttaattttggaggtttttcatcgtagtttatatttcagcctttaccttttatcgctaagaacacgtatataaaagttttatttataaattattttttttctaaatatgccgagtccttggtggccccgtgcttattgcttaaacccagccacccacccaggccaaaacctcgcggtcgcggcgaggcatccgtcagctcagctcgatgctgccgcggaggagacgacgccttctccgacgatctcccctccaatccaatccaacccaaatcatccctcctcccctctcgccgccgcccgccgccaagcccagccccagccgcccgcctcctggagccgtcggcgtacggccgcctcctcctggccgcgtcgaggacccgcgcgctggcgctgggcaagctcctccactcccacatgctccgcgccgcctacaggccgggcctcttcctgcgcaacaacctccttgccctctactgccgctgcggcgacatgcgccacgcccgcctcctgttcgacggaatgccgcgcagggacgccgtctcgtggaacacgctcatcgccggctactccggcctgggctcttgccgcctggccctcgacgcgttccgggacgctcgggccagcggggatggtgtggataggttcacgttcgccgcggcgcttgcctcgtgcgcccgcgtgggggactggagggacgggcgggtggtgcacgggctggccgtggtgagcgggcttgcacggaccgcgttcctgaccaattcggtcattgacatgtatgccaaatgtgggatgattgatgaggtgaggctgctgttcgatcgagccgaggaacggggcgaggcttcttggaacctgctgttgtcagcgtacgtgaggatggggtggccagaggtggcagtgaatgtgcttgtttggatgcaccggtcgggggtgaagctggacagttttgctttgggtggcatcctcaaggcttgctctgagctaggtgattcagaggatgttcggaggatgctgcacagttgtgtggttaaggttggtttggacttggatgtgttcgtcgggagtgcaatggtggacatgtacgcgaagaatgggggattggaggaggcgatcaaggtatttgattgcatccctaatcaaaatgtggtagtttacaatgccatgatagcaggatttgctcggttgggtaatgacccgtgccctgagattagaatcgaagcagtcacgcttttttcaaacatgctcaagaagaggataaaaccgtcaaagtttacgtttaagagtgtgcttgaagtgtgcaatttgaccaatgcagtgcgatgtggtaggcagatacatgcccatgtcatactcagtgggcttcaaggtgacgagtttattgcaagtgtgctgattaacttgtactcaaaagcacggtgtgtaaatgacagtctgagatgcttcgatatgaccgttaaagaagatgtcttcatatggacatccatgattacagcatttgtgcagaacgagcactttgagaaggcactatacttgtttagggagcttctctacaccagaaaagggacagatcaattcaccatatcaagtgtgatgagtgcctgtgctgctctttctgtaccaacaacctgtaagcagatacactgtcatgcagtcaaaactggtcttgatcaatttactgtctctggcaattcccagattgctatgtacaggaatataggtgatcttaaggcttcaaaacagacatttgagcagatttcatgtctggacactttctcatggtccgctatgatcctgagctatgcggttcatggctatgaaagcaaggccctagagctctttgagaaaatgaagaatcttggtgtcatgatgaatgagagtgcttctcttgctgctcttattgcttgcagccatcaggggctgggagatgaaggtctcaggtatttcattttctgaaactgcaactttctctctttattatttttcctttattctttctcacgttcttgattgactttctcctgcctcttttactgagcaatttatacgtaatagcaagggagagatgctattctggtaatcttcagaagggcaatgatggcatagatggcagaaagcagtccttgaaaaagcatgccagctatacccagtcagtttagaccatgcattcttttttttttttttgaacgaactggcaagctgccaatttcattgaacagagaaggagtaaaactgtacatgcgccacgcgcaaagggaaaaaaaaaacagattcaaggcctttggcaggtgtttcactcccgccagaacccatgtttagaccatgcattcatttaagacaaatacaaaatttacctgtatggtagatacgttcacacttaaccttacccttaccctcaagatcataaatcaactgtgcatattgcctgcattgtggcatgcattcagtttcttgtgttaactctagctaaggatatcctgtgttatgcctttttgaactgtcaatgtcgagggattggtaaagatcatcagacttgaagtgacactgccaatgccggtcccaagcccggatgtaaaaggtggagggtttgagtttcatatactttttctacacaaaataatgttgtagccttgaagcattactgagtatagatggctggagtagaacttaagtataggatgctaactgcatcaaggtactaaacgggtacattcattggaaacattccatttctggtacctaatcacatttcttaagtcttggtcactgttaatcatgggtttttcttttgtaacccaggtactacgagaacacgataccagatgatggcttttccctggatgtgaaactcaaagcgtgcatggttgacctccttggccgtgttggcaagatagctgacgctgaagatttcataatgagttctggatcagaaaatgacccgatactttggcatgcactattgcgtgcttgcagagtccatggggacaaagaaagatgtacaaaaattggagagaaactgatggaacttgagccgttttctgctagttcatatgtcatgttgtataacttatacatggatgctggaaaaatctcattggctatgaggacgagaggcctaatgagagagcgaggcatcagtaacgaagctggaattagttggaccgactttggaggatccattcataatttcattgatggagataactcctgttcacataacacaattcacacaaccttggaggagttgttggtcagggtgaaacagaagactgagcatggtggaacaaacatttgggagttagaattccaaagcagaaagcttagtgagagctcaatcagcagacatggtgaattattggcagtggcttttgggttgacaactttgccatctgttgctcctgtaagagttatgaagaatcagaggatatcctgggaaagccacgaaactctgaagttgctatcagaaggtgaaaatagggaaataactgtcagggatccaactcattttcatcattttactcgaggctcatgctcttgtagaggctactggtaattgaagttgatgcctcatcttgagagtaggagacttacaagggtgagaacatttttaaggtgagctttctactggcagatcatggagttttggacgcaagcaaaccaagccagatgattcagttgtggtcaggataagactaaagtcaattcaactgaagttgcattgttacagcttgtggctgtgcttcatggttaatagcatcacggctcgagatttttactctgatgaaaccaagaaaggagataaagtgcttacttccctgttagttgcatcattttgactagcacacctcaaaggttcttatgcagtattttgtagtctcatgctaggttatacagaattttttcacacaatctagcagtagagtttcctcgttagggactaattgatcactactttagaagcattcacataattagttcaaattgcatcaattttgaactaattgtgataattagttcaagatatgtgataattatcacaattatgtgataattagttcaagatatcattcctctcagcacacaaattgcgatgataaagaaaataaacctagtgctatgccaagaagctcaagcctgtaaatagacacttgttgaacagatatggacaataatatagttaccgttctttgtagattaattgctttgtttgtaattttgcagggaagattaatacttaatcagggcaacatgaagtcatcatatatcatgcagtaaaaataggagaccacaatcgaatgctttattattgagaaaaatggatggtatcatgtttatctattttagctgaatctatttaaccataattaatcagtatgtgttagtagaagtctttatatcgttatgcatcaacatatcatgagattattaagtaatagctgagtacaccggcctaaccatacttaacatatcatgagactatcgggtaatggacaaactcatgtttaactatggtagagaaaaaaaagtaaattataatttgtactatatttttttaaaaaagttttcatattatgtcatcctttaccattctttacatttcaatttggagaaagaatgaacggtggtgactgtgcgtggagcggcgattagtgattgctggtgctatgaggagtttgttgtcgacacaatctctagccgagtttgttaatatttttctaatacatggaccaccactagaaatatgtgctacttaaaaaggggcttttaactatttgccacttttagatttggcaattaactatttgccacacctatctcaatgacatgtgggtccacatgtgtctatgacatgtgggtccagtggcaaatagttaattgccacatataaaagtggcatatagttcaatagtatatagttcaatagtatctcgcttaaaaaaagcgtagtggtgatcttaaatcctcgcctaggcagactcgcggagtgtgaactgttggatcgcgaaatccaacgcctcgatagcctttcttttcttttcctcgcgctctccccctcaaaccccccgatccccctatccgcctcacgccgccgcataccctctcggtcgctcccccgcctcaaccgccgccgcatcccctccaacgccgtcgctctacgccgcagcagcggcctgcgctccatcgacggcgtgactccgcgcgacggctggagaaggcgaggtcgggccgacgctccacgccgccgctgcccgcagccccgtcggcgccgtcgctccatcgccgtcccgacctcgaaggtgaaccggcttcgagtccctcgcgccgccaccgatcccaggactcctcgaccctaccagcgaacaaggtaagagtgctgctcgatcccgttcctgtacaggaggaggcatacgaggcagggtatggtagatgcataataatggctttagaaatctcctgtgctgactaaatccccattgttcattattaaccattgttcactgtacatgtatatctgtgatgcaaaactctaatccaaaatctgaagtccttagtggtttactgtacctgacaagcaaacatctcaaattgctactgttaatgtatgctactgaaaattctggagaaaaaatcgcaagtacttttactgatgctaatgtatgctactgttaagctgttatttgatgctactaaaatatgtaacatatggacatgaatgttcttgtatgtaaaatgtgtattacctgattaatatgactgcttccaaggctgacaccatcttaattagaatatttgattatgagaaaacccttacaatttattgtctattctgttcttgagagttaaaaaaatctttcaatacatttcagtagttttcctctattgttcttcaaagttacataaatctttcatatcttacctatttcagtacgtgcaccatgtttttgtcttcattttctgtagtacagtctactcatccactttgctggtagcttttgcatgtcatgatccccacagcatgatgtacggttttcagttatagacgtcggttgtgatatgaggaactaaattgcaaccaaacagtgattttccagagttgcggttaagttctgaacaagtcctcagttaaattggaaacattcctttgttttccttcatgtctaaaacctgaactgaacagagatgagaagactactgcatcccttccaaacataatttctcatgtttgttattcgatggttttttaattatggcagctaaaatcaagattatgtatcttgggtagtctgatacattaaaaaggatcgatgcaatatatttttaatgaatatctgcagagaaattggataaacctttctcactctgctttttgttttcaggctacactttgatcatctcttaattttcttcaattcaatctctcttaaggttgttcaagttcagtatcatgccatctacctctccagtataatatacttcttggtaagttctgctgactgcatatgctgccatgttttctcttcataataacaacagatatattttgtagttttgaaaaccacattctgaacattagtgcaagttcagtttttaattttatgtttcaagtttaagttcagaaatccacattcttgctatgtatcttacctatttcagtacacacaccatgtttttttcttcattttctgcagtacagtctattcatctactttgctggttgcttttgcatgccatgatccccacatcatgatgtacgattttcatttttagatgctggttttggtgtgaggaactaaatttaacattgatcagaacaatttgtatgcaaattatgcaacaaaaattagcatatatttgatacatgtctttaatgtaccgtattttatcatttaaattaagcttctatcattggatttaaaatgtagcatacagtcactcgagatgattttcatttttttaatatatcatgagtttttatgatggctggatgactgttacattgtatatttgatacatataatcattgtctgttcggagtgggatccacttaacgttatgtgtacttaaaaaaaattaggaacttattgttcatgtattcgtactattgtccagctatagaagaagatacatatatgtcatgcttgaactttcttttcaagtattttttattaagcaaattatctgcttatcacttagcttttatggcattagctcaaattttagtcacgtgggatcatgagtgattaaaacatgtgatcttaaattgatatatatttttcctgttgcaacgcacaagcacccaactagttgagataaaaggtggagtagttgtaacgccccgattttcgttcgggattaaaaatcatttaataatacactttctagaaatttaataaaagttaaatcaatttaatcaagtgaactattgagggaattaaaaatttccttttaaaaatcattggccgagaatattttgtaatattctttggccctaaatattctctaaaattttctcgtgaagtttcggagctcaagaagtaattttaaaagtcacaaagttcattaaactcatttaaataaaaagaaaaaccaaattaaaatcctctcctctcctttgggctcggcccaagcctctccttcccctcccgcggcccgcgcgccgtcgccgctcccgtcgcctccttcggcctgcttctcttccccccccccccctcatgggccgttggcccatttgcctcctctcccttgaaagtccacaaaaccccccagctcttctctctctggccgacatgtgggacccgaggccccacatgtcagctccttccccttcctccagcctgggccggcaactgccgaagccgccattgttgccccacgccgctgccaaaaccgccgcctcccacctcgcgcgcgcacgtccgaccgtagtctagtatcttccccttcccatcccttggcgtaaatgcgtaacggcttgtttggcaaccctaaaatctgccgtctcggctcctccgctccttgcgccatctcgcggctgaacaggggaggtggcgagcagagcaggggaggggaggggatcctgcaggtgagcatcctctttctcagaattcatctctctcccaccgggactagttttgtctggaatttgcttgcgttcgttcggtaaccctagcttctcttctagatctggaagaagctcttctcttaatttcagagcctccttaaccttaatacaagtaacaacagtttgttgtttgttcccccaaaatcaactgaacccccatgtcccaagttcgatccacccctgcctgaaaggagttgataaacttgatgagtctagtggcgatatgtggaatagactcggatgaggtattgttgtagatgcatagcttcttctggtgttccgatgtgaattttagcgatgcgatgtgatgagggaggatttttgttagcagccatgattttcttccctcgtggtacatctttatttgtccatttgcagtaccagttaaagcatggaatctaaaatattataccaactgaagtatggttgcagtttagcattaaatttagctagtcatatagtagtatatgttagctctcatttgatcgccatttttgtctctgaccctccaccaggtcaccagtaacatgccatttgatttcaccatattgtcatatactccttcctttagaaaatattataatcaagtattcccttttccttttttttcttttttgcttttgcttgtcagatagcatgttatctattactgtgctccctaaatctgtgatttttttctccagtgacattggcacttaaaaactgtttcttggagttcataacagtggtcatatagcaatgattgatgatgaggctgactttggcaacatcactgatgccacagaagggcaggcagctgcaaagttccgtccgaaggcacgggccaagccccgtaagacatctttgccatccagatccctggcacctcatcctactgtggaatcaacagatgaaaatgtggaaacattaaataaagatagcacctcacaagaacagtctgttgataaaaaagcagcatcattaggatgccatggtagtgagacagatggtaatgcttgtgcttctggcggtatacttgacacaccttctgaagatgtggtgacagtatccctggggcttgtgaataatcctgatgtggcattggattcttcaacagttttcgcttcttctgcacataaagtttcccaaaatgaagagaataatgatgatgtatctcatgtggctacacacaaagaaaacatggtggtttcagatacccaagcaccaccgacctgttgcagtgccaggacaattgatgatttggctgactttgaaggattgtgtgatgatactcatgttgaggaagaaagagttgcaaaattccagccgaagtttcgggtgaaaaccagcaaggccgcatcgaaatctcagaggactaaccaaaaggcaggagtctccactgtagatgtgctctcccaaaacaaagaagatggtaaagatcaggcaggatgcaatgacaagcagctgcactctcctactagacatcaagaaagtgtacagatctcatattctcaagcacacctgggaactcataacagtacaatcgatgacgttgctaactctgatagtattatggaagaaccagctcaagaggaaatggctgcaaaattccaacctagactgcgaccaaaggctggtggagcttcacctggggttgctgagactattgatgctgcttgtgtagctactccagagtttggggtttcctctgtagatgtggtttcccaagatacggaagaagatagccatagagaaggcctcagtgatgattcatgccaaaaatatatagatgaagaggctattacaacttcaggcactgggccaccacaggttagtggatatttcgttgttcagaaaaaaaaaatggtactgctatttcaaataaagactatggctccatgctctgacttttgattgtttttaggatttggatgatactgttgatttagactcgcatgctgaaatggtaaatccacatcctgatggtagtccgttgatcattgaagagctctcaggtgtgcttattttacgtatagatcttctcccttttttttttttcaaacttgtgatgtttcttgtagtccaaaaaaaaattcctgtgatatttttaagcatgttgaaagaagtccttaactaaatgagcctcaagttaagcttaattggaacctatgcttgttactatgtgaatattccatgctgaactcatgtttgagctggcttcaatcatatataataacttttactagtttttctgtacttcttttaagaagctaacatatttcttttacagcgggaactactgttaaatttcaaccttatgttcgaaggaaaaaaggcaaaggaaaatcagtatcttttgttccaccaaatgtttctcatgcgcatgctcctacagacaccaattttgagacaagcaactctagccatttctgtaaagatatagcaactggtgaaagtttaagcaacttgccccagcaagcatctgaaaaggtaattgcatgctgaaattcacacttctggttggagtgtgtactggcatgatatacttgattgagtctctttgcctaaacattgcaattctcttctcttaagctgtccgtttttatcagatctgtattagtggcgaacatcatccagatgatcaagaatgtaatgacccagagaatcaataccatgagggggagccatatgatcatgttattgaacaagagccagaaagggatgccagagaaacaggaacatcaatgaaattacgaaacaggagaaaattacaaaaagatgggatacctgagcataccgctgatgatatcatggatgaagactttggtgaacctccatctgacgaacaagataatgatagtggtgatgagtacaccgctagaggcaagcagaagggcaggagaaaatcaagggagaaaaatattaacaaagaaccttcgagaggtaccaagcgcacctcgggggattccactatagaggaatcacagaagcagaagcttcagaaaaataaaagtaaagcatcttcagggggtcagaagaaaacatcaaaagattcatcggtggaacaacctgagaagaagcttacacaccgaattcgtcgaaagagaatggaaggtagctggctcaaatagtaaaacatcaatttcatacaacatgaggtcttaactcatttatttttgtccactttttttagaagtcaagactttactagaaacacctgatcacgagatagatcgcatgaagctaagtgtgacacatcttagactgttacaggaggcgaaagaacgtattaaggcgagttttgtcgtgccacatttattagttctgtttattgaacatttttgtgctgttgatatccaatttgctttttgcttctatagggcaaagaaattccatcaggaccatcgtcctctaatcataggtatggcacaaaattttagtttagtattattatgcataaatattttctctatgcaaaccagttatgtaggaagagtaggattcaaggatatatgtgtacatattgtagtaccatcccttattaaactagagatactttggcaaaactatcacaaaactacaattttaccattgatttttccacaacactacagatttaaggcatagtttgcaaaggctacagatttagcaataacttaatcgcaaagctacttaacaaatcccttaaggataacgatgatatgaaggaaccactagaatctcttgcttttatgttatgtgctaaatttgttgtttgcaatattgtggcttaaagatgtaggtttgcagttcaacaccttgaatctgtagttttgtgatagttttggcttaaacacagcaaaataaccactcactggtactgttatgggttgtgcgaactttttttcctttctttcttttttttttttttggaaaaaggtccaaataaacttaaacactctgaactattgaatcatgtattgagcaccctctgacttttgggtttgattcaaataacctcctgaggggttttgcctatataataagttgactcaaggtgcaatgactcagtgattttaacatgttggcaagctgcttataccactaacagaataataagaaaaatataccaggagcaaggatgatgcttcatctttgctcaggtcattttttaagctatatatgtttattttatgtttccttgtttgtgtagtggtttcacgtgtgctataacatgacaaatactacagtcagcacgccatgcaggcaaaaccacttgggggttgtttggatcaaacgggaacgttcaggggtaatcgcttaaggtgttagacaggactctcaggttcagtggggtatttggacgttttccttttcttttggtcatgtaaacttttcttgtggagagtctttcctgtttcagacaagttatttccaatatcaaattgatgctgctattgttagcttcatcatctaaattgtttgctattgttagcttcatcatctaaattgtttgctgcaatttgatggtctgctatacagcttcacttgctatctttcagtgatatgtacatacctgatgcaattcttattttagattgaccgcaatcttttttgtggcacttctaataattgtttcattcaattcaatttatttgactattgaacctcttaaagtttcaacagtctcatttgtcttctaacaaaaattctcagtgtcttttatttagacattgttttctttgtaaagcgcaagccattggagcactcttgtttaataatgtctcgaatatatgttcatggggaagttaatcgtccacacgaactacagcttttagctgaaaatgatttaggcgattcaacttatctgaccctatcatgatcttggtttgtcttaccacagcacctcccaatttggagatatggatgatgagtataacgaacaagacaactgggacaacgacaggactgagaatcatgtggtcgaaaatacaaccaaacttaattaccattcatacatgaacagacaaacacgagccaaatggtccaaatctgaaacggacaagttttacgaggtatttgataaatcaaccattttgattgctatttttcattttttattttataccaattttaaaaagatatttttattcctgcgtatttattggtgttacataaatttgtattttcatatttgttctgttcagggtcttcaacaatttggtagcgattttgcaatgatacagcatctcttccctgataagagccgtaatcaggtgcgacaaaaatttaaagctgaggagaaaaaacatccaatgcaagttcatgatgccataatgcatcgctcgagaggtgagattgttctatagaaaataccagcccatatttttgagttgtgatctagattaacttaatccttatgctttacatctgtgcacagataatttgtattttaaagaagtaatcaaaaagctcaacatcgaagatgtccagccagatatcaacaatacacatgaacaggagggtacatcaaatgaagaggaccctggaaataaggtttgttttgaaactagcgtataattttcttatatcaagttcattttattaatcttgtttcttgttttctgtgtattaagaatataccgggtggattaattaatgaggaggaagaaaatggtttagattggtcagataaagagctggacatgcacagatctgaggtcgaagagaaggagcacgtttctacaaatgatgatgatgatgatgatcttggtgatgtttttgattggtactaacgtgattaccatgcgaacattactgacgacctcatgattctatcaatatcatgggcctcttgaaaatttatattctggtgctatgacctttgggctctggaaggccatattctgcatcgaaaataattttgctgacaggattctccagatggcgatgaaagcagtacagttccaaaggctgaagaactgtatttttttttttttggtttgctgcttatttctagtttagttgaaacttagaaccataattctagtgcttagcaacacagggatctcaatatttgttgcttgaatcctagtttcgtagattacttgcagagtagtaatgtatatattgctccatcatcatttgatatatctgtcatttttttttctgtctgctctttcaatattctattctatcaatggcgctggctcggctgccccctcacgtcgtcgtcatattgatctgctcacgtcgccccgaccctacatcggcaaatccgagctcctcttcgatccccttctgctcgtctttcaccaccagcgccggtagctgctcgccaccctaacctcccgctgtgctatcccaacctcctccgtgcacggtgtttgtgattaggagtaaatgcctaattcttttttagaattttcatgatatttgctaattaatatgctcatcatcttcaacacgaaatgtttaactcgcacaatgacaacaaaaaggtgtcgtggtgtagttggttatcacgtcagtctaacacactgaaggtctccggttcgaacccgggcgacgccatcataattttactcattttttccacttcaatcttcaatgcatttactacatttttctgttcacttcattagttcaatctatttattttttccacttcaatgcatttactacatttttccatcataattttactcattttttccacttcaatgcatttactacatttttctgttcacttcattagttcaatctatttactatattgctttttatcttttctttttcacttcaatgtatttactacatttttctgttcacttcattagttcaatctatttactatattgctttttatcttttctttttcacttcaatgtatttactacatttttttcacttcaatagttcaatctatttactatgcaacaatgtaagcataaaactggccaataaaaaaaaactagatatgtagcaattctgatatcgtttgccctgaagatggcatcagtgtacatgatcttattcctggtagattcatgctactacataacagtattatatctacattcatgcactccaatatccatggtttattggcttaattcagcgtgatcagccagtgccatggcttcactcagcagctcttgccatagttgagctcttcaggttgggcagcatcttggatgttgagccagtggcaatcctggaacgcgcacctgcccgaggcttgcagcgtctcgccgacgtctcggggctccaggaagtatggcgtccacgacggcgtgccgtcctcgaacgagttgtgcgtgagccgccggatgttggacccgtcgatgtcgacggtgaagatctcgccgtatggctggtaatggtgagggttggagaccggctcggcggagacggcggcgtagtcggaggtgaagacgaggctcttggagtccgggctgaaccatgggtggttggtccggccgctgccgccgctgtgcaccacccgccgcagcccggtgccattggggtgcaccatgtagatggcgaagctgccgctccccggggcatggcggtcggaggcgaaggcgatccactcgccgtcgggtgaccagttgcacatcgtgtccgaccatggcccctccgtcagccgccggatgccgccggcctcgccgtcctcggcgtcgatgatgtacaggttcttgttcccggatctccccgaccggaacaccacccacttcccgtccggcgacggcgacgggaacgcgttgttctcgcctcccacggtcagcttcttcatcgagatggttgactcgtcgtcgtcgtcgccgagggagatggccaccacgtccacctccgtggtctcgctggcgaaatccggcccgatgctggtgtataccacgcctttcctcttccagtcccacgacgtcgagaaggcgttcccggagaagatcttgcggcgaccaccggagccgtcggagttcaccacgtacatccccggcagcccgacgaacgcgatcttcttgccgtcgtgcgagaaggaggggaacgagccgtcgatcctgaagagcgagaacgtgtccggtgaccctgggctcttgatgttctccagcagcagcggcgagtcgccgttccctctcccccggcaccggtggtacccgacgcgcgcgccgtccggcgagatgaatgggttgaagtggtgcacgcgcggtgccacgggcctggtcacctcgaagtaggcgttcttgccgtcgctgctcacgtcgatcacctcgatgtggcggtagtcggagcccgcccgccgtgtcgccaccgccacgagccccggcgcgccgggcgacgcggccggcgtgaaggcgtggaaccccggcggggtgattcgctccacggacgccgcttcgaccccgtcgccggtgacggagatctcggcgcggtagacgccgtaccaaccgtcgctgtcccggcggtggaagaagacggtggtctcgtcggcccagctcggccagccgccgtcacggatggcgagcgaccggcgcgacccgtcggcggtgcggaagacgtagatgtcagtgcgcaggtcctcgacctcgccgctccaaccggcggcgccgggcgacgcggcggccgtccactcgcccgagggcgacacggcggggctgaagtccgcaacgccaagcggcgtgaggcggcgcgtgcggccggtggacagctcggtggagtacacggcggcccagctgctgcgcggctccgcggcggggacggcggtggagacgtagacgaggcgggagccgtcgggggtgagcgacggccggtccttgagcgcgattggctcccatgggaggagcggcgagatcgtcgccgccgccgaagacgacgacgacgacgccgactcgagcgcctcgcggcgggaggagggaaccggggagaggtagaggttgagggagccgttgcgctcggagacgaagaggatggaatcggaggcgggggcgaagttgccgttgtagttgacggagacgccatcggtgaggcggagctcggcggcggcggcggggttatggggggagggcgcgagggggagggagaagatgtcgaactcgtagcggctgcggccgagggtggtgaagacgatggtgccgccgctggccgacgccgccggcgccgccggcgaggcgagcagcgcggcggcgaggagcgcggcgagcaaaggagtggccatggtcgtcggactgaagcgggctacaggttgttggatttggggatttttttgcctatttttcgcggcttccgttggtgatgggctgatggcacaaacaacttttttttttcttttttttttttgttgttgttgatggctttcaacatgataaaggtccacagaaaaatcgaaccatttctcacgaatcatatgtaaaaaaaattctgtgaatttttatcccattgtttgccgcgtgattttttgcactggttcctggacggttgggtgtcctgctcaggaagaaagacctggtaggtggtagcaacacacccacccaatctctactagacgcacactcgagtactcgacttgtctatgaccatctccgtcgtctgctgcttaaaaaaatatataatatatttataaatataagcacatatataaagtcttatgaataatataaaacttaagctgttaagctacgtttattttattatagcataatagtatgatacaacctttgtgataggacgcaagtcgttctactttttcggtaagaaagcgtaattttatcctgagaaagaacgcacttgttttctacagccatatgagtaggttgcaatatacactggtcgaatgaaggcaatacgccattttgtttggtaggttggggtgtgaaaacgtttgtcgtcatgggccacccccacgaaagatcatccagacgtttccatggccggaggggacatagtacattgaacacctactgctttttggttgagtaattttgagctggtttaatgtttttcttttctgaaatactcctaaaaaggagagagataaatgttactaacgtgtgttattgtggtcactggtggggaaagatgtcgaacttttgcttccggaagcggaatataatcggcacagtaaaacgtgatactgaactactcgaaacggcccaagtattcaatgggccgaatgcttaacatgagcagggaataagttcatttgaggtcccttaacttgtcaacgaatccgattttcgtccctcaaccggaaaaccagacacaacgagtccctcaactatcaaaaccagtgcagattaggtccctcggcggttttgagggcggttttggctgacgtggcgcctacgtggctaatttgactcggtctttatatgacgtggcgcttacgtggcaattcgagccggaaaaataataaaatcctcggggcccacgtggccccacatgtcagtatcacaaataaaataataaaaaaaatagtgggacccacgtgggccccatatgtcagtccaactcaccctcctcttcttcctcctctctccccatctcccctcttcatctatctctcctctcctctcctctctctcggggacggagaggcagcggcacgcggtggccggctgccggcgggagaggaggaagcggcgcagccaggcgcggcgtgcggaggcggtttggcgcgatggcgcggcaccggcaatgaaggggaagaaggcgaagggagctccatgggcggcggtgggtttggggaagggctggcggcggcggggatggtggtgagatcagcgcggggtggaacagggaggtcggcgcggcgtcaacagcagcggccgggcgcggcggctcggcagtgcgcggccaggaggtggcgtagggggaggaatcggggcggcgccgggcagaggagggagggaaggggagcttcacggggcggcggtggattgggaaggccggcatggtggtgtggagaagaggaggccgacggctgtggggatggagaggatggccagcgaaggtggggatggagaggatggaccggcgtggtggggaagggcgccacgaggagaggctaccgcgggcgacgccggcgccgctgtgctcggctgagcgtcggccgactccgcgtggcggtgggaatggagaggtgcgccgaccttctccccaccgttccatggcgcgccatcgcctcacgggccgccgaaggcggaggagctcgggcgccgcccggtgacgctgcgtggggcggcggcggccgccgcgtccattggcgtcagcggcggaagggacgaggccctgcgcggctgcggcccgcgaggcgatggcgctgggcacgctcctccgcccgcgaggcgatgacctgaacgccgcggagggagggggccgtggcggtggcggtggcggtggccggaacagatcgacccgggcgataaaaggggatcggcgataacagggagtcgccgaggatgccgaggtcgacgtcgacgtcgtccgcggcggagggcggtcgccactccctctcccgctggccgccgtcagctgcgcacctctccctccgtccgtcgccatcaagtccccgcccatggctctcggccatcgccggcctccctgcgtcctccctccctgcccgcctcgccggtctttgcgcgttgctccctcctctcttgccgccggccgcgcgtcgccgcgcgccgttgtcttctgtggcgcctggagagagcagagatagggagatgaagagagggaggtggggagagaggaggaagaagagggggtgagttggactgacatgtgggacccacgtgggtcccactatttttttattattttctatgtgagactgacatgtgggtcccatgggtcgaattgctacgtaagcgccacgtcggacaaagaccgagtcaaattagccacgtaggcgccacgtcagccaaaaccgctctcaaaaccgccgagggacctaatctgcaccggttttaatagttgagggacccgttgtgtctggttttccgatcgagggacgaaaatcgaattcggtgtaaagttaagggacctcagattaacttattccacatgagcagagatatgggctgagtttctgcccttctctactcaattgcaggtgggcagtgtttgaattttttttatttataattttttttattaaaagttttacaaaaataattttccattttgaaaattaacggaaatagtcgcctaccgccctctgggagggcgatttttaaaaatcgccctcccagagggcggcgaaaatgacgtggcagacggccgttcgctctcgggcgacggccgtcaacgaaatttgcaggcggcccccttgccgccctccgctagggcgattttgcactgtgcggggggccgcctgcaaatgggcggcgagggggcatggaattttgcaggcggcccccttgccgccctgggggagggcgattttgtactgtgctctatattttttttatataaatatcaatagttatcaaatctttttatattgaaaactatacaagattaaaatctccaagactggtaaaatacaattttattatttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattctagattacgtattaccaattaataggcttccattttcgtgtgtggtgtggtagtgggaaagaagatatgaagaggttgccttcagattgtcaattatatagcgtcgttttcactgcaatatatgtgaactcaatgagatacattattcattagatgtgacaagacgatcacgcgtgggcgtgattcactttatgtcaacaggcagcgccgaaagttgatagtgataactcgagctgccgcttttcatgtgtgctgttgtggactgtgcgcgctactggatatggcactaccgtgaagcgccgaaagtgtgttgttgtgagcataagttgttcaagcaccatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccggcgtgagacgaagaggccccagtaccgaagatcccggctgcaaatcctgctggacaaggaccatcagtttcgtacaggtatttaacagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcatacgaggtcctgcgatgaggaaacgtgcagttaaaacatggtgacacattcgtgcaaaagctgaaacaaaaatgaactaatatctgggctgaactgtaccgtgcgaaaccggtgctataggtcgcactgctccgaagctaggggcgctcgaagacaaacgaggtcctgctccgacggtaggaccgcgaggccgtgggtgtaccggaccagctggaggtacgacgtccacggcgctgcgacaggagaagacgcgcatgaccgcacgcatcttctcctgcatccggtcgaaggtcgacctctgctcaacgtcctccgcttgctcattatccgaatcttccctctccatttcatcaacaattataccgactctctccccctcatccgccatgcccatggcctgctcctcccttggttgattttcctcattttgcatcgatggtccaacaacatcccctgcattgctaggaccctccacatcttcggtttgcattgaaacatttgtatctttctcttgtaccgacacaaatataacgaggggccatgaccgttcaaaagccatttccacataccgtctccaagcagcagtgctgtccatcggcattagttcccaaaaataaccttctattgcacgactcactacaacagatactgacattgtgtagacttcttggtctattctaaatcctctcaacaaccaactataaattgactcaaatgttctctccgcaggcctatcgatgcccttagatgtcattacaaaatctgacagatcaacaccatctggaccaaatctaatatttccttcaccgtgaactatctgaaatgtgaccttacttgacattgtgcctgatgaaaacaataactgcgttaacctcgcactacgccctaagttacattctctacaatattgttctctaaatttctaaaagtaggttacattctccagatcaaactaaactacatcttacaattaacactactgtctatgtctcaattcatactattatattctatgctctggatctacacatatgtgctgtgtgctacagatctgctaaaatatatggaactaaaactaaaacgcaacatatgtactcaaacgtaatatattagtacaaatgcaaaagatgtatgggagcatacctgtgatgaagtgagcgaaccagcagggcttcgccgctccccttctgctgccctcccctctctctctctttcgtttttttggatttttagtgaatataatgaaatttcacaggggaggggctgggctttataggggggaggcaaaaatcgccctcccccagggcggcaagggggccgcctgcaaattccatgccccctcgccgcccatttgcaggcggccccccgcacagtagaaaatcgccctcgcggagggcggcaagggggccgcctgcaaatttcgttgacggccgtcgcccgagagcgaacggccgtctgccacgtcattttcgccgccctctgggagggcgatttttaaaaatcgccctcccaaagggcggtaggcgactatttccgttaattttcaaaatggaaaattatttttgtaaaacttttaataaaaaaaattataaataaaaaaaattcggcagtgtttgctatgatgcggcccagtggagtaagcaagagatatcttagtgggctctccttcagtccttcccggcctttcatgggctcccgtcccgttagtgcgagatggaccgagttctaatcggtgggctttcctactgctcgtgggcctaaaacgacaagagggagagagcggtacgatgcggagtcgaccaatattttcagtgtattgtaggggggcgcctagctcgcgcatacgcgcttccccacctaaccacctatattagtattatattagtattagttaacactacttaacactaataacagtaattaggaaagattttagagatttttttgagatatttttactaacagattgaaaatttttcaagttagattaagaaactttcgatttaagatttaaattttaaagtcaaattttgaagatatttaactcagatttaaaaactttcaactcagattcgaaaactttcaagtacagatttgaaagttttgaaaagtttcaactcgagatttgaaaacttttaactcgattcgaaaactttcaagtccagatttgaaacttttgaaactttcaacttgagatttgaaaactttcaactcgagatttcaaaactttcaactcgattcgaaaactttcaagtccagatttgaaaattttgaaactttcaacttgagatttgaaaattttcatgtctaaatttgaaaattttaaagttaaaatttaaaaattactagtaaaccaaccactagtaaaaatatgaagctaatctaaactaattatatttttttcttttatccgtacgacaggaacaatatacggcgaaaaaaaagaaacagcggcgtaaaaaaaagaaaaaaaagagagaagcgcaaaagcatgcgcgtgcatgggcctcgtgggccggcgtgcgcgccagcaacgcgcgcgcggattagcctttccgacgcatgaatctgaacttatgctactaccacgaatttagatatagctcatgttcagattcatcgtattaagatatatcttatattctactagatttatttttacggggatattctactttattgttatattataagacggagcgagtattttagattgcattatcgccgtgtgatgacaaatcagggcgttgctcatgtcgactataggaggaccaacacaaccgcacatcaaaaagatcgaccggctagctactgctccctcatgcatgttttttttcaacgcttggaacctacaaactgcctctcttgtggcattgacgtgctaccttatgatagaatattaatttcattgatcaatattggcaaggattaaaatgcattatagggtagcttcgtcttcccatgtactcctttttgtttaaaaatatactccgtaataattttggctagattcatatccaatatttgtatatgtatatgctcgctcgaaaaaggcaaaaagcacgcacacgcgaaaaggtatagacctgcacgtgatgtccagcgagaagcgatcgaattagcgcacgtatgtacgtacgtatacacatacgctggcctgtctttctcctgtctgtcttatactacctactccctccgtcccagaaaaaggcaaaccctgggtttacgtgtccaactttgactgtccgtcttatataaattttttttataattcgtatttttattattgttagatgataaaacatgatcaatattttatgcgtgacttgtctttttaatttttttcataatttttttaaataagacggacggtcaaatattaggcacggaaaccagagtttatcttttttttgacagagggagtacctaccagcctgcacaatcgaaccgtagatgcgtacatatatacgtgtattgtcctggatactatatatactagtgtgcgtatatgtaggcaggccagagaccagagcaggtgcacatcatataatagtacactcatctttagcttcatacagtatttgccaaaacgacaaaaccacacattccgacattatattccacctagtttagtagctcgatacactttattctgttatgttctatactattttgcaaacaatatgtgtttgttagcatatatagatggatacatgttaattattccacttaacaatgtgtgtgtgtgagagagagagagaggggtagcgtactagatgttgtaatcaagttagttggttaaccacttaacaactcaatagatcgccatacacatacccatcgtcacgatcgaattagttggtgtaaatcaatcgatcgatcgaccgagtgagatatatgcatgcatgatgttgaattgttgacgactaccgatcgatcgaccggccaaatgattaattattttctgtgcctatatatctgtctggttgtttttctttaattttactgcattatatgtgtcactctctgcagatcgagctctctagctacacgttacatcctgcaaccgctctccaactaacacactacacctgcatgctgatgctgggttaataattttggcttcttgtcgattactaaatcttaattagtgaccatcgatcacttctaaatcaagcagctatatatctagctacattggattaatattttcgaatgatccatctcacgaatgtacgcccagtgacgaccatgtctattgattttaaaaataataataatagaaactttcattgaattagaataactacatcaagtttaatcacgagtttggtattatatatactgatactacccatcgtttcacttattcaggaaataaaccaaacagcatatttgcaaatggaatataatttatgaataaaacttttatatacgtgcgtgttcttaactagtataaaaaaaaaggatgaaaaataattttcgatgataaaaacctcaaattaactttaaatttaaagttgaaaattcaaattttgttcaaggaaagttccggccgccaagcagaactgaccgacctcctacttgccggctgaaaatttgactttgtacttctcttctatgaccaataattgattaaagagtgagagaaaataaaatggcatactgttccattcaactgggaattaattgtgcagcgattagttgacaggaaaatgacctggcagcacagccatggatgcttaagcttgcatttttaattaattaatgttgcggcatgcatgaagcagctagcgatggatcacgatcacatcgatcgttttgatctactcatcgtggcaacataatggacaggtttttgcttcatctgctgttgctcgaaacttcacaaaaaagagaggtaaaaaggttattcagaaagtgaaaaaagtgacataaagcagagtggaaggaaggtgcagaccgtgttctttacagaagaataattgtaaaggaaaaagtatgaggtaattaagtcacttgacagtgaaattaggagaaatcagcaactagctagctagcatccagctgtacttaacctagatttagctagacctttatatccttttgctttaacagtagatcattaaaagaactccaattgataagttaattctagaagagattttagctttgcgtgatcgatcgatcgatcgatggagagtatagtagattagtagttggtggtcatgcgtgatgcatatatacttgtctgcacatgcttgcccagttgcccctgttcgaatttcatttcatattcgcctctcatcaactgtaaataattcagaagctggttgttcaaaccgtataataatatattctcccaactaattgcacgtatgcgtgctcacgagctgaacaatacgttactgctcagtccatccccttcacagaatggagttgtattttttttattttttttagataatggagaatggagttgtataggactcctaattagtaattaacatatactcctatacatttgttaatttaattatagcaagttgagttatgtttgcatgtgtgtgaactgctcctaactaatcagaccatgttaagctctgcatatgcatatttggtctagcaattagtactcaacatttactacttgagcacgtggaattatgtcatctccatccattccatcactgaggaacaagtcgtgcgttgagcatgcgtttgcactgttgaccgtgctagcttcatgaaatgtctgctaattttttgttaatcagatactaatttttattcctctgaacccaaactataccaaatatggtcatcatttaattagcagaagtacagaaatgaaatgatcagccgctggatctatcgatctcaagctcaatcgttcttaggtctgcacttgtaaagaatcaagaaaggtactattactaccgaactttttcagtaccactccagcgtatgtagacaggaagagtttaattaattaattgattagtcatgtaccatcacccttaatcataaagttgtcagctttacatctgctaagcctagaattatactgaaatgatggaggtttagctttctactcacgtggttaatcatgttgcagcagcagttttctcctcatcttttaatttctggaaggattacgacagtgaaccggacttgttctacaggcctgcagcgatagctctaggattactgattgaggttaggtcggtgaggtgaaccatcatatatccatcgaatacattaattattcagttgattaatctctggtcaaatctgaggatttatttaagactcgagcatatctactgacaaacaagtgaaagaatacatgtatggtatcccaataaaaaataatgcatgtcagggacgatatataatccaaggcagatagctaccggctctttttatttttcttgggtgagattcagaagcatgaagccgtgaactacggtgtctgtctgaacttctgaacagaattcgatccagacgatggagaatcacaattgggaatgattcttgttcttccaaaaggtaaatgaagtgtgaaccttcagaagaataatccaggtcaagttttcctacgagaggagtctgaaactgtgaaaaaaatcaaagcaatcgagaacaaagcagagcagtagaggcagctcgatgctgacgtgcgtgtgtgccaagtaccaacacaaatccaacaggcaaaaagcttcagcctccaggattacaaacacagcaccaaataatgcatatatttttgcattgttcatctctcctgacctcacattggaataagactggattatagtgaggacaaaattaattaaactatcaagcaagggtccactgaatcgacatctttgtatcgttgatgacaggtacatgtattgtgcatttgtgcattgacatggacacgttcagtggagtagtttcacttctccacgttttttactcgtcagcgaacccaggaagaagaagatgaagaacatgctgaccaagctgaccaccaaagtgtgtacacacgtagcatgatgtgtactgcattgattgcatttttcagagctttttttacagctctatttcacagtgtatttggacacatgataattgataaagaatataggagcatttctaacataaaataaatatactataaaaatatatccaacggtggatttaataagtttaattttgtgttgttaattgttgtgtgtttttcaatgaacttgatcgaacctttaaaaattaacttaagacaagccaaaaaaacgctttataatactactactcctactatggaacagagggaataatacattagagttcctatgtcccttctgctgtagtaaaagctgttgcacagatttgggattagttaggtgaaggtgataatgcatttctgtttggtggtggtactaccactaaatacatgaacaagggaagtacagacaatacacatttgctacaattataatcctcctcctactctacagatataatcctgcaatttgctccacatgagatgcgtggagactatacagctaattaagtgccattgcatgatctgctcaggtgaccaactacagctaattgctgcaccttggtttgcaacaactcaggactgcacgaaatgctgtgggctctctcgtataatactgcacattcacaccgacagacaacaggaccagctgctgctactgtactaaatcctgcaaagacgtttttgcaacttaattactccgtgccgtactaattagttttgctatgaaaaaggtgcagcgtagttaacacaactaacctatctcatacgccaatagatttcagatcagcatgagtattttatttagattctaatctgacttactgactacttgctgaaacttgatcaacacaattgtcagccacaagaattgttttgggagcaaacaactttttttcttactatttcatacaggcagtagcattatctatctatttaattatttatttgatcaagcatttcgttggatgagtactttgaaagtctgaaggagtaggagcctaggacgaccgttgtaagcaatttgctccataaatactcgatgcttgattaatgtgacggatgtgcgtgtgcgcaattaacgctaagcttgtacgcaacaattaaacaatcttccttccaagctcgaaacctcactgattgagaactactgctactgttccattagctaattaatacgcatgttaagtgcaccctattagctaattaactgtgcattacccactcgcagacaacacattttatttcctttcgggcgagtaaaacatgccgtgtgtttgtgtgtgttaccattaattatgtagctaaatccacaggccaacaattttctgcttgtcttcatctggtctttaatttgaccttttgttcatatttcaatataggttcacaacttcacatatacgactgtcgtctgattcgtacgtttaaggtcaggccgggtcctaaaagtcatcatctctagaaggaatatgtttttttaaaaaaattaatttgtttgttttgttttatgtaattgtttcgcttgataaaaaaatatgtctttgttgctaagacaatggctgaaacaagtatcttgattaatccagtataaatatgcaatggataatcaccactggacaatccttttgaccagttttggctctttgcagtgttggtcattgggttatcaaatcatgacttgcaagttaaggcttgtcatcacctcatgattctttaactaatgcatgaaagtattatttgttccagaaggttgaatcaaatgtcacctaatgagtacgcctgcagaacaagacaattaggatttgggacaggaaagtatggtcaatacgtttctgacagtttcgtggtagctgaaaaatgcaacaagattaattgaaacagtgaatgtgcatgctaccttaacagctaggagaccagcgatgcagcaagtgaccttgatgctcagttccaacagacaatcatccattaaacaaagccagaactactaattggaagacccagcatagacctgcagcgactcttaattctccccattagtttgggacttggataagtagctgtcagatctgacctaattaatggatggaaaaaggtttggtcatctgacctcccaacagattgaataattggttcctaattgcagtcatatatcttgattcttgcatggagtagtttcattcatgttacttcttccaaaatagaaagagcacagaagaaaatgcaactgcattactggaaaaatcatgtactgtactagtctctcaggcatgtgaagtttggaaaatgaataactaatcatactataatcaacaaagtttaggccacgtttaaaacagatttttacgtgatattgaggcagattatttacatgataaacacaataaatcgaaattttaataaatgaattccacaataatatactccctccgtcccaaaataagtgcagttttaacattgtttatgctcaacgtttaatcgttcgtcttatttgaaaaacaattatgattagtatttttattgttattagatgataatacatgaatagtactttatgtgtgactaatatttttaattttttttataaaatttttaaataagacaagacggtcaaaacactagacatggatatctatggctgcatttattttgagacggaggtagtatgtaatcttttaaaaaattactctcgtttaaaaaaagtccaattcatagtacgtttagtaaataaaaaatcggagaaaaaagggtcagattgcatcagagatcacagtatcgtcgtcacagtgactaaatgcagcagcagtcacagatgactagactaaatcaaagattaacagtagcagcagagtaaagagaggctttttttccttggaatcttccccctcactcctcgcaaatcccacgcgccttttcttcccacgtgcatctgtcagtgacacattactactaccacaactgcctcccaaaaaaagagagaaaaaaaagatgaactaatattcggagaataacctgtaaagaaaagagagagagaaaaaaaaagaaatggaaaaggaggcaggcgaattgctcaacggaagtacggtgaaagaaagagaagagcggttgccatcgccagccacagcagccgcggctactataatggtgggagagacaaactagagagagaaagaaaccaccaccgccccaagaagagagagagaggacgcgacggttgccaggaggaggcagccaacggcgctcgaggcaagaaacgacgcggccatggtgggcttgccttgggagtcgtgacgcgctgtgtttgctgccgttgagagatgaaggtagtatccaagaagcatcatcagcaaggaggagggacgacgacgatggaggagggcgccatggacggcgctggcggaggagtggcggaggaagggtgctccggggaggagagggagggagtcgccgacgtcgctgttggcggcggcggcggcgagggggagcgggaggggaggacgctggtggtgggcgtgcgggcggacgccgcgagccggacgctgctcacgtggacgttcatcaatgtcgccgcccccggcgaccgcatcgtcgccgtccacgtcgtgctcgcctccgcgcccgtggccgccgccaccaccgccgtcgacttcgacaccatgctcgccgtctacgagggcttctgcaatctcaagcaggtctagctccctctcccctcccttctctcgccctcgacttgccagtttgctcgccactttctaccaaccatgtccatccttctcttctgcttcatcttttttcttctcaattgtttggttgatttcaatctctcctttatttttggctgtttttgaaggattagatttttagcccatatccttacaatttttcacccatcctgcataaattatcccagttgcaacaaatattcagagagtggtttccgctaacttttgcagtaatgcgatttttttacctttatttatggctttccttctgcaattcacatacttcccgctcgttcccctctgcaaatcgcagtattttcgcagtaattgactgcttcagcaagctaactttggggtcttgtgttgtgcagatcaatctaaagctcaagatttgcaaggactcctcggtccgcaaggcgctagttcgtgaggccaacctgtttggggcatccaaggttatcgtcggcatcgccaagaagaagcgcgggatttcgtaagtgacattcgatccgcatccgctatcaaatctcatcaacttttatttttcacccaatgatgatatgattgatggccaactttcgttttttttgggggggattcgtcaggtccctgcactccgtcgccaaatactgctccaagaagctgccggccaagtgcgcggtgctcgccgtggacagcggcaagatcgtgttcaggagagaatccaatgtccactcaggcaaggtctccgcggagattcctggatgtggtgataatgagttgtattgcgaggtgccgttcctagcccgtcagtgtaaagaggaacctttacctttacatgaaccacccagagatggtggtggtagtgcgggcgaggaagaagaagagcacgatgttggcacaaaggagaccgagccggtgaatgccgtctccggtgaacagcagccttccggtgtggatcctgctgagttgtctccggatcaggttcagggtgatgttgatccatctgacaagggtgaagagtcgactgccgaccagaaagatgagatttctgagcttccgggtgagggtgctagtgttttgtactgtgtgttaccagagaggaatggccattcagctgcaagcacgtccagtcggcaatccaatgattcgaccgagccaccgactgaagggaatggggagctgtactgtattttgcccccaagaaatgatcattcaggcaggagtagcggtgattctagccgttcaactgcgagtcggaaacacgatgattctgccagtctgtctgctgaaggagatggtgaactgtactgccgattgccaaggactggccattcaggtagaagttctgggggatcaaagcgttccttcggtgcaaaaggtttgattaggcgcagcagtagtttctccagtgatattcaaaaggatgtctcagtttgcacgactacaactgaacagacttcgtccatggtatctacagaagctgaggattcaccaaagaacgctgcacgtgatgtcgatacaccctccagctctccaatgtctctaagaaggatgatagagggaaggcccgaccgctgtcgacttcgaaggaggatcttcaatcatcaaagaagctcatcttttgaatgggccaaaatttccatggttcagtgggcaatgaggcttccaagccgttatacttcagttgcagacaacaaatcatttaaatcagatgcaagtccaaggttgaattgtgattccgaatgtgaatccacttcagctgttgacacagaatctatgttttcgttctctttatatgatatatcatggcctccaaatgaagtggaatcgcttcaagagaagtactcttcaacgtgtaggctgtttacctatgaagagctgaaacttgctacgtcaaacttctcaccaggtaatgtcatttgggatgtgcattactttgattcacaggctttttggcaaagttgtctgctgattttcttttacaccaatgcagatatgttaattggaaagggaggaacaagccaagtttacaaggcacaactatttgatggcacattatcagctgtaaagattctgaaaccttcagttgatgcaatacaagagtttgttacagaggtggagattgcaaccagcttgcaacatgacaatattgtttcactaagaggattcagttctgataactacagtcttgtgttggtatatgattacatgctccagggaagcttagacaaagcacttcatggtaatccttaaaatgaaatactttgcatatttattccctgaccttattgatagctcatctcttactttgtgattgactggttgtaactgctcttcaggcaagcatgacagcaaggatagccttagctgggagaagagaaacaaaatagcaattggcatagcaaaggcacttgaatatctacatcatggaagtgtcacccaatctgtgattcatggagatgttaagtcttcgaatatcctcctctcagaggattttcaggcacaggtaaataaccataagagatttgcaaatactgaaatacctgaagcaattatagttttttcttcatacagtaaatatttttttcagatcaaagcaagtgctttaatgcgttagcagtgacgaattacattgagtatttggtagccttactagttaattttgattctgcttatgacatcatctcttttgaaatttccagctttgtgattttgggttggcaaagcaagtctcagcttcaaccccccacctaacatgtactgacatcacgggaacgtttgggtaagtaccatctctatgctatttttaccagctattgctacttttatcaagtgtgaaatgcctaagcaaactactcctgtgacagatacttggctcccgagtatttttcgcacgggaaggtcaatgagaagattgatgtctatgcatttggagttgtaattctggagattatttcaggaagaagacctattagaacaggatgttcaaagggtcaggaaagcctagttggatgggtgagtgatccttaaccccctatatgcctggctggcttgctctgagcagtaacatgccctgagccaagaacaaaatggtagttgcacgttcagtcactgttggaattaaagctgtctaggaccattgctgcattttttttgctctgttgaccacacaatcactcctgcacgagcgagttattaattattttttctttttgctaattctttgttgacggattcaggcaaagccattactatcaagtggggaaattaaacaattggttgatccattcttgggaaatgattatgactgtgatgaaatggagaggatgactctcgcagcttcgctgtgcacaaggacatcttctcattcccgacccgaaatgtcacaggtaagaacctgaacaaattacatgtacaaatacttaaaaagtcttgatgattgacctcaacttgctatgttctggcaacacagatgttgaaactgcttgaaggagacgacgagacgatccactgggcaagaacccaggtcaccgcgagcttcgacggatcggacgaggaggctgtggcggctcctgactcaaacatgcagtcacacctgaacctcgcgttgctgggcgtggaggatgacaccctctcgcactgcagcactgaacagaccatggacacttcagctgacgggtactggagccggtcatcgagcttcgactaacctcctgcttttttcttaaccaccatttgttctgattttgagccatgtgaatggggagctgtgtgtatagagtctctcaattctcataactttgctgctgctgttgtgtcgattggttggaatggtgaatgcaaattgaaaggaagtggatgatatgcacattcggatggcagatgtagtagcttaggaattgtggtagatctaaccctgctggcctttggccctacttggtaggagtatgtatcactgatgggcttcatggtgcatcaagatttgattcttttccaagttgcttttgttttgcttttcctctcagatgccatgccatgacaggctgcctgtctcagatgctcatctaacaccaccatttgatgaagaacatactacacatactgtatgtgtgaattggccagccacaccattagtagtaggtttctctctcactgagacatatgatgtaactgatcttgtcagctactgtacagcaaagatctggtttgcagttccaggtgtaaatgtaacatggcatgacgaaacgccgttcttgatgtactgttctcagtacaggaatggctgggccagttcagacaaaaccagagtctcatgaatacaggactgacaccgcatgctccctaccggagctctcttcgcatcaacacatgtgagccttgtctctctgtcaaactctgaagtttcaggacacctccaatacaaaggatgctactggggtaaacctaacacttgcaaattttgcatcattcagatatgactagcctgtggcccgtacgttgcaacggaaaacaaattgagtttctaacttattaaatcaattaataagcacttataagtaatactatgatttctttttattaaacaagtagatgattttaaaattcgggggaactaatagtatagagaggatttgttgaaacgtggtgcaatagtatagatcgtgggggtcagatatttctagtaggagtgctgtgaaaatggacatcatcaaactgagaagagtgttacaagatcatttgggcctcagttcactgggcggttggataacaattgggcctagctatttgcccatcatcaactgcaactgatctggcccaacctagtaaccggcccatgtcctctcaacaagacctccaaaaacaaagtcctcaggaagacaaaaacactagttcatatgattccagatagatatgttccggagtgatctctaggagaagcagcaaataatatgctattacctgttagtatcatgtatgatgtatccatttatttattattaagagttggtgcctagtattcctactatctaagataataagtatgctccagcgaacttgatctgagttatcggagcgatgacatttggagcacaagacaacaagcaaggcagcttgaaatatattcattactactacataaatatactgaatggcaccatcaaacagcttgttcctcgctggattgatcaactgatagcttcctatttgtcctcctctgcatcatgctcgtcattttgcagctaagtcctcacaaaaaagagagaggaactttccatcaaacagcccgtttggagactaaattgcaactctacagaacagttattatcggttgatcgggaatgaaccatatttacccattttaattgttacttcgtcctaaaatataatataagagatgctgtgcacgtaattatatgagaaaatctcttatattttaaaacagaggtaatatttagggctgattataatatatacaatgctaaactaaattttatataggatgagagttagaaacaataccatgttttactgaaacgatgctcggacggttggttgggaatttccgtcaccgttttaatcccgatcgtatatgttcaaatctgcgtatgcatcgaccgatccgcacattaattgtgattgtgtggacattctcaattctgactgccaaaatcacgcagcaccactacagtgaaccttctacttgactacttttatacatgcatggttgctaattgcatggtccgatctgtaagcagctagctgtaaacacgatcgttttatttattcaagagcgattagtgattaccagtactgctaatcactctcatcgactgtactgatgctgtcaacagccactgcaattaattttctcgctggtaattaacttgcatgtgcacgtcgcttgcctgtaaaaaatttccaagaaagcgaggtgccatgtgcaaataatggctttcgctgcacataaaaacgcaagaattaaacgtcgagtgatcaagctctggttggtgacgccaatggcgttggacgagtcgttcaagaggccgggcaccatcccgttcaagtgggagctccagccaggcgtcccgaagcagcaaccacaccacggcggcggcggcgccgccgtcggaagtagcagtgcatcttcttctccggcgccggcgccggcggcagcatcgacgctgctgctcccgccgaggctcctcgcgcctcctcctgcagccgcggcgtcccatggcggctgcgacacgggggcgaacattctcgcttcgacgacgacgccgtcgccttcgtcgtcgtctcaccggcggtccatgtctgcgcggttcacggcatcgctggtgctgccgttcacgcggccgcggcggggacggtcagccaattcaaaggacgaggacgacatagccttcacggtgctctatggcgacaagattgtgtaaatattcatactccctttatcccaaaatgtttgacgccgttgacttttttaaaaatatttgactgttcgtcttatttaaaaaaatttaaataataattaattcttttcctatcatttgatttattgttaaatatacttttatatatacatatagttttacatatttcacaaaagtttttgaataagacaaatggttaaacatactttaaaaagtcaacagcgtcaaacatttagggaagtaaggaatattttgggtctattttcaaaataaattttattaaaggtcgatttgtcagaatttcggctgttttgatgtatatatgtgctttacgtgtctaaattcatagaatagagagtactaaagtaagcactgagcactgaggcatcatttccttcatttcggtttcgaaaggaggttggaaagagacaattggagcattatgcatttaattacaaactctacactgcgtaattgccagagttaaatgagtgtgtagtgtactgtgacaataattgaacttttaaattgcagcactaaatagatcatattagtcattgctttggtgacgctgatgaatcagtagaacatagataatcctcagcacaacatggtagcatggcaatctgtttcaacacagattttcctaccttccccctctccccgcactggcatggtgttttgctaacacggctaagcgcctgaagagttggagtgaccgtcacatcggcagcgtccgtctccaactgcagatggcgaaggagaacgtcttccggtttgacgtcgcgcaagagaaccggtctctctccccctggagacttggttgcagcgggatttgaaactgaagtgccttgggctagcttgcctcgctcgagcccgctagcgttcgcgtctgatctggctcaaggagggtgacagaaacaccatgtttttccacctgcacgctagagcccgaaggcggaagaacttcatcacacgtcttcaagatggggaccaacttgccgtctcccacgatgagcttcaggagcttgcctcttctcactttggcgctatcttggggacgtctgttgagcgcgatttcgcccttgacctccactcccttggtctctgccctgcgcatcttggggggctggacaaccctttctcggaggaggaggtttgggcggtggtcaaggccttaccttctgacaaggcgcccggtccggatgggttcacgggccggttctacaagacttgctggtcggtgatcaagccagaggtcatggcggctctcaactccctctttctcgctaacggtcgggggttctcctccctcaatgataccctcatctcccttctgccaaagaaggacgaggctgttgacgtcaaggatttccgaccgattagccccatccacagctttgggaagttgttctccaagatcccggcttcccgtctctctcctcaccttggcgagcttgtggcgcccaatcagagtgcctcgtcaaaggccgatccctttcatgacaacttccgctatgttcagctcgcggccagggctctccacgccaagcatatcccccgcctccttcttaaggtggacatcgccaaggcttttgacacggtcagctggcagtttctacttgagatgctcgcccacctggggttcagtcagcgctggcgtgattggattttcctcattcttggtgcctcctcttcccgggtgctgatcaatggggtgccggggccttgtttcccggtcttcggcagggagatcctctctctcccatgctcttcattctggtcatggatgtgctcaatacgatgctccgcaaagcctccgagtcaggcgggttccttccgctcaacgaccatgcctccctctacgctgatgacttggttctcttcctctccccggttcgtcaggatctcgaattcatccagggtatcctctctatctttggtgcagcatccgggcttcgcactaactttgccaagtgttcggttactctgatccgctgttcggcggaggacctggacctggtgcagtcctgctttccccgctcaatctcagattttccctaatcctatctcggcattccgttgtccattcgcaaattgccgaaggcggccctgcaacctcttgtggacaaagtttcccatcgtcttccgccctggaagggacaactcaccactctggttagccgctctgtgctggtccagtctgttctctcctccattccggtccatgtgtctatggtgatcggtcttcccgcctggatgatcaaggccattaacaagaagcgccgcgccttcttgtggacgggtacagactcggctcatggagggtagtgccgggtgtcttggacgaatgtctgtcgtcccaaagctttcggtgggttaggaattcctgacctgaagttggcagggtttgccctgtgagttcgttggctttggctccaacactcagggaatccttactgggacggcctgaaagccccagccgagcgagccgtcactgacatgtttcaggcgtccaccttcttcgtgccgggtgatggtgagtcgattctcttctggtctgaccaatggatcggtggccgctctgttgcctccttggctccagatctcctcttcgttgtgcccccgcgtctgcgtggttcgcgcacggtttcttctggcctggcgaacaacgcttggatttctgacatccgcggggccctcactgtcccgggcatctcccagtttcttcttgtctaggacgcggtgcttcacttccaactttcaccgggtgtcggggatctgttgacgtaaaaatacgaggcctgggggatctacttaactccagtgcaggtccaaaactcgccttcgggtatgctagcgtgccagttgatttgatcctgcaatcaacaagaaacaaagacaaagaaaccgcggttaaatccataaacgatagccgatcggctaggtgccgatgacatatcatttatctttgagccgatgtcacatatgcatcgatcggcagtcataaataagtaaggaagaactaaatctactcgatcggctgtagatattaacaatatataatccccgtgtcgatatatacataaatcaagtgattgggatagattggtcgccatgccgagacaatataaatcacttagatcaaaatatatattaacaacaagactatatacgttcatagcatagccgatcagatagatctagcatgtatcggctaatattccgatacaactctatactaggatatcaaagcaaataggatatattaaacaaaggcctaatatacttaaatgcaacaagatcttaatataaatggcagatttaacatatcagcgaagcatatagagtaaatatagttaaatcaggtaagatcggctgaaaccccgatactaccctaatcggcaaccaagaagcaggctagagattgagattctaatcacgacttataagatcaaactcaactgatgcagctataagtatgaaaagaatgacaatatctagacaatcaagccattggaagtttcatagagtggtggatatcctatataatctaagtcaacatcgatatctaacctaatcggctgccctcttccgacagatgttagccgattataggttagatagcgatattgccggagattatgtaagatatatgataactcgacaaattacataaacaagattagagtatcataaagatggaagcactaatcccgagaacgcaagccaccataacaagttttacctcttgttgaagatcgaaaccgatgcagctcaacccgaaagcaagaactcgtcgaaacaagacgaaagtaaaaagggtggcgatgcgccgagattgtattgaacgtgtgttaatttgattacatggggctcggggtctatttatacccgagaattacaaaacatgtccatatcaaacacgactcttatctctaacaaactctaagataccataagtatttgcggcaaacttttgcccacacttatctctaaggaaattacataaaatatcctaattaatagatacaattgccttcttaggactctatccatgtgcggcaatcatcacgaagtgcatcaacctaaaccgacaacgtatgccatgtcatgctgtcagatttggctcaatcggctaacccatctgaccgaactctgccgatttcagtcgtagccgattcagattctagctgatccttactctgtttccggaatgatttcaatcttgattccttctcgatttcttcctcatctctgatccctggattagcaaatttggtcgttaacaggatcgtcttgtctggcgttggacgagtgaccagcgctactcggcgcattcggcgtaccaggcgttcttccttggccagcactcctttgcttgtgtcgatcttctcttgaacgcgaaaggccctgctaaatgcaaattcttcctctggtttgcattccagcagcgctgttggatggctgatctcctccaaaagcgtagcatcgatagccactcgacctgccccttttgcgctcaagagctcgagacagcgaaccacatcctcctcgactacgttttcgctcgtcaggtctggttacgggtgctgtcgcctcctggctggaatgccctctcgccccccgtggcagctggctccaggactggtggccatcttccaaggctggtttacctgatcacctccgtgccagcttcgactccctggtcctcctggtcttgtggcagctatggaaggaacataactccggggtgtttgactctgcgctctcttcggtctcagtggtcctagagtccatcctgtcggagggccggttgtggtcgttagcgggcgttgcttcctttagggacttgttgggagtgtagcatgactctgccccctcccgttgtttagagtagcgttcaagtttttctttttcttttttctcttcgttgttttttgactttgcgttttttccccttccttggcataagccggtctggccaattgcagtgtgtaacaaaaactctattcctctaatatattgacgtgcaatctttttgcgtgttcgcgaaaaaaaatcaacataaagaaaaactgatctgaagataagtcagccaacacattgttggtaacaaataaaatcacaaacgataagcctagatgcctggataggcagcaccagtggcaggtgaggtcttcaaaatagcaattggcatagcaaaggcacttgaatatctacataatggaagtatcacccaatctgtgattcatggagatgttaagtcttcgaatatcctcctctcagaggattttcaggcacaggtaaataatcacaagagatttgcaaatactgaaatacctgaagcaatctcagtacagtaaatatttattttcagatcaaagcaagtgtcttaatgcgttagcagtgacgaattgcattgagtatttggtagccttactagttaattttgattctgcttatgacatcatctcttttgaaatttccagctttgtgattttgggttggcaaagcaagtgtcagcttcaactccccgcctaacatgtactgacatcacgggaacttttgggtaagtaccatctctatgctatttttacctgctattgctacttttgtcaagtgtgaaatgcctaagcaaactactccagtgacagatacttggctcccgagtatttttcgcacgggaaggtcaatgagaaaattgatgtctatgcatttggagttgtaattctggttctggagattatttcaggaagaagacatattagaacaggatgtgcaaagggtcaggaaagcctggttggatgggtgagtgatccttaaccccatatatgcctagctggcttgctctgagcagtaacatgccctgagccaagaacaaaatggtagttgcacgttcacgcactgttggaattttttgctgcattttttgctctgttgaccacacaagcactcttgcacgagcaagttattaattattttttctttttgctaattctatgttgacggtttcaggcaaagccattactatcaagtggggaaattaaacaattggttgatccattcttgggaaatgattatgactgtgacgaaatggagaggatgatgttggattaggcctccattctttagctgatgactgactcttgcagccttgctatgcacaaggacatcttctcattcccgaccggaaatgtcacaggtaagaacctgaacaaattacatgtgcaaaatacttaaaaaatgtcttgatgattgacctcaacttgctatgttctggcaacacagattttgaaactgcttgaaggagatgacgaaacgatccactgaccactgggcaaggtcccacgtcaccgcgagcttcgacggatcagacgaggaggctgtggcggctcctgactcaaacatgcagtcacacctgaacctcgcgttgctgggcgtggaggatgacaccctctcgcactgcagcactgaacagaccatggacacttcagctgacgggtactggagccggtcatcgagcttcgactaacctcctgctacttttttcttaaccaccatttgtgatttgttctgattttgagccatgtgaatgggagctgtgtatagagtctctcaattctcatacctttgctactgctgttgttgtgtcgattggttggaatggtgaatggaaagaaagtggattggaggatgatatgcacattcagatggcagaaggcagatgtagtagcttaggaattgtggtagatctaaccctactggcctttggccctacttggtatgtagcactgatgggcttcatggtgcatcaagatttgttttgcagccaaatgaacagactcggcacactattttcgcaaataatttattacttgctgaaaaatccaaaaggtgaggatttgatgtggaaaagaaaaggcaagtttataaatttggctgcaaaagtacaaagtttgtattccaaatggtttactatttttgcagccaaactcgaaatgaagcttagcaatactgcaagtttagatttcatagagtaaatggtttactatttattttgagggatgatggtttactcaggcaccagtaatacaaagtttgtgaattgtgaaggaaatccaagaagaatagggattagggaacttgtctatcccctcaaccagtccctccctgtccctcgtcctattacccaaatgaacatcaccatagttgatacatagttgagaggtgagaacttgtgcgaatggaaatgttggtagttccatactaaagtacagatcaaaatccccattgcatcagttgcatgccaaagatcgatggcggtacttaaaccctaataatcctcctcgagcagactgaatcaccagacaagagagcgataatccactaaaattgccagtttagtagataactgcaagctaggaacggagcacggctacaagaagcaaaatcgatgaagaaaccaagagagcaggcctaaacctagggtggttatgggtagagaagaagaggaaaagggatgaacggtcttggaggcgtcggcgaggacggcggaggtgtccactccgtcgaggttcacgttggtggaacacgttgaggcaaggcatctttccttctccgattccgaatccctcgtcatcgtttccctcctcttaattcctgctgcagaaaaactaacctacggtatcccgtccgggggagtggggacgggatacataatgagctctcatcgtccttatccgtccgcatccttttccaccttactcaatccccaatctccctgtcgcttttctagttgcccatacgcctctcatccaccaccgctcttctccttcctctcctcttcttccggcaccgcccttctccttcctcccctcttcttccttacttggctggaagcctgaaaataggttgtgctcctttctcttgctcacctaccctcctgctctgtcccccctcaccatcaaagagtcaaggagggcgctgccaatatcagatctggagatacctagggcctttccatcattggatccgcttgagccatgtcagtgatgaggtgatggatcgcactagcccccgtggcctccacctcggtgtcatgccgttggggaggatgccgatcgatgcgaatcctcctcccacgctactgttagtggtgatggaggggaaacaaatgaaggtgctagatctgaagtttcgattgacaatcgacgtggtgctgcagacattggctgcttgttgacattgtgcgcaggtatgtcgtgtgtgcggcatatcaccatggcttagctggtacctacaagtaccaggcacggtacctgtggtaatgtggtatcatggttgatacctacacagggctggtacctgtggtatcatggttgatacctacaggtactagacctggtgccaatggtatcatggttgatacctacaggtttcagatctggtacctgtggtatcatggttgatacctacaggtttcagacctggtacctatggtatcatggttgatgtctcgggtaccagctgatacctataggtgctaaccgataacccataggtactaagtacgaggtatcaaggtatcgggagagaacgtacgttgttgcctcttggctgggtggtgagccatctaccaccagcgttttgtctcgtcttctcccttccattcctttcactatcaccatcctttttcttctcaatgtggtgttgatacaagggtcatcatgctattgcagggaccaactttgtcacctaatccactattagtgtcgtgtccttctcctagcgcctcacgcgtgctcttccaccggctgtggcgtgagcgtgtagggcggtgctaagtcgtggactcatgagtggataaagctgaggcggagctgacatcatcaatataaagtatcttgtttggacgggataccgtaccctagcagacctcttactgctgctgctgtgcctctactcccctcccctccgctctatccattccaaccgcgcacagtattattgggcctggcttggagcttattgggcctctagctatgattacaactggcccatagctttcctgtgcaattggtctgcatcttcgtatatgttgatgctggcatgctgccgatccttaccaatatatatatatatatatatatatatatatatatatatatatatatatatatatatatatatatatatatatatatatatgaatcgaatacatataactagatatatactcacaatttgaaaattttgaaaaaattgggcgaatttgtgtattgccccatatgagtgtcctatatatatatatgtaatatatatatatatatatatatatatataactggtgctacatggagtatgggctccaagattcaaattgagtatatacccaatttgaatgagtatgaaatttttttaaatgtttagatatgaacattaacttctttactaacaagtttgaactgagtttgaactttttttttgttagattttggttctaggtatataacatccaaacatataattcgttaggtatataataatgaattgtgaaataaagttgagtttgagttgttttgttgttaggtatttgtatgaatcgaattcatacaaatgaatttgagtttgagttgttttgataccatggtgcccgggcaccatggtgccccatatgggtattatatatatagtagttttgacgaagtcgcggctgacatgagcctgacgaatggcgtgagagctcctcgccctctgcagcatcatcgacgcccctccatcggctgcggtgaagaggatggtacgcctcgccatgaagaccccggtgcaacgcctggccaaggccaaacgaagcatctccttgggcagcaaggccatggcgcgccatggccttgctgcggttgctcgaaggcgcgcgctcgtggcggcggctagggtttaggctcgagggggaggagagcaacgaggaaaaaagagatatcccgtccgtatatatatgggtgccaacttcacgggccagactgggccgtctgtatcttctgtcttcgactgggccgcttttcccagcaaattcccctcgtttcctaaaaggaataagttcactttgactcccttaactagtgacaaaatctgattcataaccttgaaccacaactattaaaagggtgtaacttgactccctcgacggtcttagagagtgattttgcttatgtggcgcctaggtggcggtgttgaccttgtcttagttacacgtggcgttgatgtggcgcttatgtgtcattaaaattaaaaatatatgtgtgggacccatttgtcatcttctctcattcccttcttcctcatccctctctcttccttctccctctcttgtgcttcaatagggaaattttatgctaagctaacgaccttaaccaggtatgagcagggaccggatcgacggcggcggcggcgggttacgaccaccaccaagccgataaggaggaggacgacgactacggttgtgactacctctttaggtcatccgttgcgacaaggatgatctcatctcgcggttcatggacgtcgccatgtgcgacagtcgagacgctgccactatcacctcaactcttgacgacagcctcaacgaagtcgttggcctttacttcgcggccgctgcggagaaactcatccgcccgtccttcgtgaggctgagtggccaccgtcctagacgctgatcgccgccccttgttcgactgcagcccggtgagagctcgccaccatccaccgctgctactaccctcgtcctcctgctgccgtgagcctccatgaggctgagccaccaccgtcctccttggctctgtcgtcctagccgcacgaccgcgacccttggttctgctgtgtcctagtggaagctcgcctccaaccgccgccgctccgctattccttctgctgccattgatctggtccccgctcccccacgtactccctccatcccaaaaaacacaacctaggatgggatgggacatattcatattctagtacaacgtatctggacatagatacgttatactagattatgtcccatcccatcctaggttgtgttttttttaggacggagggagtaggtctgaaggggaagagaaaggggatagaaaaatgaggagagaggagggaagaggaagaaaggaaggagagaggattatatgtgggccccacatgttagtgtgtcccacaatattttgtagtgtgaatgataaatgtgtcacacatatatattttagttctaatgtcatataatcgctacatcaatgccacgtagaacaatgaccaggtcaacaccatcacataggcaccacgtcagcgaaaccatcctccaaaactaccgagagagttatattgcaccgattttaacaattgaggcgtcaacatattcggtattgtggtttaggaatatgaattagatttggccacaagttaagagagtcgaagtgaacttattccttcctaaaataaaacgatcgtcgatttgtatggtttataccttttgctcaagcatcatctacatacagaagtattttttttcttttttttcctttaagttcagtatagtatagtgttgattcagcgttcagttgcatcatttcatttcgctttaccagttaagattgtcgatgcctgttctgcaaatattgagcaaacagtgaaacaaacgccatatttaccatcccacgttctgaggaacgccaacaatacatggaaaagttgctagtacaaatcaaacatcttgcacatattagacgtgcagtgatatactaacaggataattatgcctttgattccacagtagccaaaatggcgagcaccagcaaattaaaaggcagtaaaataaaagagaaaatagtgtgagtagttaaagtggtcctccaagttttatccgagactcagtttaatccttgatgttttaatctatccatattagttcttcaggttttcattttagttcaaacttatccttagacccacttagaagccatatggctaaacataaccaacaactctcttgataaatgacacttatatcccccatttacatatataagagaaaaaattacatgcaatgggtttttttatagataatacatagtaatttatgtaaagcaaaaataaattatgtacttgcaagtgtatatgatagctattgtttaagttttatgtgcacatattgaaataatgggaattacatatgcaatgttgtttattcatcttgattttctctttttctagtgtatacttgtatacaaattaagggcaaaagggacattttctaatataaatattgactagaaatagtcatatagaatattatgttgggccaagatgattttaagccaaaataaatacttaggggatatatgtggacaaaataaaatatagagaaccaaattgtgcctccagtgaaaattgaggactaatctagctattcacccaaaataaaacccaacttttccagtcaaaatacagcagtatctgaaggcactaacattggctagagaacaaggccgtgtttagttccaaaataatttttcaatctttcaacttttccatcacatcaaaacttttctacacatataaactttcaattttttcgtcacgtcgttccaatttcaaccaaacttttttaattttaatgtgaaactaaacacagcccaagaaaattttgaaattgcaagtcaatctgctgcggagagcggggtcgtctcgcctgccatcctggtgtctagctctactggcatcgcgtttctggataagaggccatgtttaattccaaaaaaaaaacttcacgctgacacatcgaatatttgatacatacatgaagtatttaatataggaaaaaaatcaattatacatattgcgtgtaaattgcgagacgaatcttttaagtctaattgcgccatgatttgacaatgtgatgctacaataaatatatgctaatgacgaattaattaggcttaataaactcgtctcatagtttactggcagaatatgtaatttatttttgttattaaactacgtttaatattttaaatatgtatccgtatattcgatatgacaattaaacacgaaaattttctccaactaaacgaggtataaatacacagagcacaatctaccctatgccccttgattttgcttgacggaggtcgccagaatatgttaatgagatcttcaggaccctgttcaggaaaaaaaaaagttctcaactgcaggaaaaacaaagcttcctgtccatactcgaagactcatgaaatgatacatacccgtgcagcggttactacgaaattgaagagaataagggcctcatcgaatggctatatgcagaaaatttggcatattagcaaaataaaataatttgtgattaaaatttttacatttatgtttgtaacgacttaaatcataatattgtaaaagaaaactatgataaaaaaatcaaatataaatttaaaattaagtttaaaaaattaaattttgacattggtatatgttgattgggccaaaagatgagagccttacataggagccaatcaccagaaggaacagcagatcaaaagtaacacttgcaccctgcgaattggagaaacaagtcaaagaatgtatgaggttatttcaatgtgttgatatcttacggaagtccctttgaaatgaattatctcttactggtaagcaattcgtaaaggaatgcattagcagaatattataatatgaaacaagaagtcacaaagcagggcatatgctttccaaaataagcttaggtcctatttagaccctggcaaaatttttcgccttatcacatcaaatgttatgacacataaatagggtattaaatataaaaaaaaactaactaaacagattgcgtgtaaattatgaaatgaatcttttaagcctaattgttctatgatccgacaatgtggtgctacagtaaacatttgctaatgacgaattaattaggcttaataaattcgtctcaaagtttacaggcggattctataatttgatttgttattagtctacgtttaatactttaaatatgtatccgtatattcaatgtgacacgccaaaattttatacctatggatctaaatacagccttattagaccattccgttgtgagatttgattattctacccaaactgaacaaatgacacaaagcttacacgcttacctgatatgggcgacacttcggtgcatagtataatactaccggtagaactaatctgaaccctttatttttatttaaggataggctagcaaaagtgcccgtacgttgcaccgggaagcgcatatatcaaaaaaatatacaattaattaaaatacaaattcactgaaatatttggtatttttaagtaggtatgtgtataattaaataaatttacaagtaaagcaagtgtgagaaataaaatgacattgttaaatttaattttattaaattctcaatgattagttacgctctttgaaattttattagaattttcagagcttaattgctaattttaataatacaaacatcatttaataattatttaattggaaaaagaaagaaaatcctttcttttaggtttgcttagaaataaacacattcaataattgtaaatgcttctgaaggcccgagggacctaatatagacttatttccgtcccttgccggtcggcccacggccttatcaaaacccgaatccaaaaagcagagtcgccgcttcctcatccgcgactccggccaacggttgcgcttgtaggagtatatcgcgttcccttccgccgacggcgaaactctccggcgccccctctccttccgttcctcttcgcctcctccattaatcggcgtcaacccacttctccgccgtgtgtgcgtacgtgcaggagcgactgctgtggagagcgcgactccggccgctggcgttggatgcgcgcgcagtgccttccgcgtgcgcccgatttgcgtcggcagcgcccacttcggaggccgctctgacgaattccggcgccgccttcacgatccccgtccgcgtgcggccgagacctgcggcggcgccaacctcggaggccgattcgttccattcctgtgcaagtctcgtgcgcacgacgagtactgcgaagaacaacccttgccatcacatcctcaggtttgctgtccggttttttattgatttgccttatattcgtttaacattgtttacctgctaagataattgcaaggccaacagtgagttgcttgggattagctctgcatttttaggtgaaggaaatctgtgtttcatttgagaacaattaatcccaaactttggttgcagcatgtagcgatggtagttttatagtatattagttttggcagtctgatcacagtgtgtattgaaaatatttggttaaatttttcaccaattaacgttccatttttttttcacaaattcttattttcaacccaagttcatgttcgaatagcaatgtagtgtgagcataaatccttggtaatgagcagacatttgttttcttcttatgcacgaactgattcagtttctatgcttagatagctctgaaaagacctatatatgatcaattgtgatgtacactgggatattataccttgattcttttattaaccttatttaagaaactatatatgataaagatttagacaggggacactttgtgaaggatgcaatttcagtcatctcaagtattgagcttcagttgtgatgtatcctcaagccataaatgatgttactttgctaacagtatctgggggcggacgctccaggcagtgaagctgggactgggagcagccgccggcgaatgcttctccaagagcaccaagattcacagatcgtagtggttctggaaaaaaaaagtcctatatggcgaatgtctgaagctagtggttgatggaaaacaacagtcctatgtgtgaagctggtgagaatattcagagatgctcgtgtatagattattatcagttagtactctgtttgtgatctatttactccctccgtccaaaaaaaaaaactcaaccaaggaaaggagtgttttttgggatggatggagtattatgcaaggtaagggcttgtttagttggtgaaataaaaatttttggatgtcacatcagacgtttaaccagatgttggaaggggttttcggacacgaatgaaaaaactaatttcataactcgcctggaaaccgcgagatgaatcttttgagcctaattaaaccgttattagcacatgtgggttactatagcatttatagctaattatggactaattaggctcaaaagatttgtctcgtgatttacatgcaaactgtgcaattagttttttatctatatttaatgctctatacatgtgtccaaagattcggtgtgatgttttttacgaaaagtttttagggaactaaacatgtcctaaatggtatgatctgtaattgtaagcgagatgcttgttcatttccacgtttcggcttgcaaaatgagatagtgctgaacatgccctgtggactgtgtttgactgtgattgtcctgcacctgaaaatggtggaacctcccggaatatgcatatttttaactgtacgtggagttctcatatttacacgcccattctttagaacacaggttaataacggcaaggctgctacatgctcaaactgacagcggttgacagatctatcaatactacgtaataagatggctgcgatcctgttcgttcctcttgtcaaaatttgtgtactgcttactgtatcagtataaccaccagaaaagatggtttcatttaagaaacatgagctctgcactctacagctgaacatatcgattccatttaagagcaaggctaataatacaaccgacttgttggctataaggccattcctaacacaatgactaggatagtatccatagcattaaataaattatcacctaggatgaaaaatgatgtggcaagtgaataaatgaggaaagagaaggaaaccatgtcttgtatgagacatggtttctacacaacatccaatacatcatgtgagataagtagtattaaatttaagtatggaatagtggtgtttgtattggaagggtagtgtctagtactagttttttgatgatgtgaagtttatggaaaccatgtctagtgtcttggggttgggaatggcctaaggtttttttcagccttctcttagcccacacatataatagttagctatttacaattaatatatgaccac

SEQ ID NO: 66910 - DNA, 3455 bp, Oryza sativa
cccaagaggaagggggggggaaaggacttttagggattttctttttataaaacctttttaactttgtttatttcttctcaattattatttgtgctctgaaaattccactaaaatttgagggctccttttagaccaaggagaatttaacaaaaattctccgggccacattcgaatttttcttatacgtattttaatgtttgccaatttcttttcgaattttaattaattctattattccttttagaagatgatttttattttgggatgaatttatcaggacgtgacagggaccgagcgcagcccccagtcccgcagggggtccagccgcactccgtcgtcccgggggcggaccgtgaccttttcttccccgatccccgcgagtatggagccgctcctgcaggtgctcgcccccgccgactccaccgtccgggaggggctcaacgcccaagttcaagccctggcggacgagcgagcagccctggaggcagaatgggcgcagctcacggcggaccgtgcgcgggtggatgagggacgccgcgccgtggatggcctggtggagacggggcgcaaaatgtgccaagcccggctggcggagatccaggcgtgcgaggagacgctggactcggtcatgcgggagacggaggaggagcggtaggcggcgctcatcgcctcgagcgccttagaggaggcgctaggcaacatccgcctgtagtacgaagcctacgccaagcacctggcgaaaagggctgaggatgcccgcggggtcctcgacgctgccgcggcccaagagcggcgggcataggaggttgacacctcgctgcgggcccgggaggtggcgcttgaggccgagcgcacccgctccgcgcaggagttctgtcacgaccggaaataacccaacgggcgttccttacgtgcgtgcattattccttgtcccaggaggcaaggtacaccaaaagttgatacaattcagagtttaacaaacggaagcgtaaatagataatttattacatgggcagcgaaggcccagcacacacaaagacaaacgagaaacagcggaagactagggcgacgaccacaggcacttgacggcaggcacgagctagacaccaaagccttcatcttccagaggctcctcttctgggtttgggaaaaattgagcaagactgagtacaaccaccgtactcaacaagacacacccacaagtgcagaataaatgcaagggagtacaagggagttatactataaagggttagggttgcagtaaacagcatttaaagatatttagttgctcaaagctattttgtaaccacgattctagaactatacattattatttatcaaggccgtgaacccacacgaacctgccttaacccaaggcctacgatgattcagaccgaactggcaacccgaccctgggtcccagctcgtcccaagccaacccaggccaaccattccacattttagttgttaagcatgttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagttttcaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgccctggagatgtccatcgacccccgacttcgtccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccctgagcccagcctaaaaccattttggggattttgaatagagggggcggtgtgaatccaattccacaatactccaacaattccaaagtgtccaggtgatatgaatatcccaaagtctagagttgtaaaaccgcctaatgttacctaatcaattagcgaagcatctacctaaaatcatactagtggtaccatgagtagagtgtccactagttggggttttgtttattctagggtgaacaaggaaataataacaataacaataataaggtcataacaaaggtaaataggcatggctagataaaacagtgataacgcgggaatttaaataaagcgataatgcaataattttaaagcaacataattttataaactgggattcaatatgttcaaagatgatgtgacttgccttgctcgctttcccaaacgtcggcttcaacttccacgaagagcggatcttccgaagctgcagcgtctacacgaccaacggaaaagaaaagtcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatttcttcatttaaattttaatttaaaatggatttattgcgtcagccgaggggagagggcgcgcagaccgggtccacgggagtggggcccacgcggcagcctcacggtccacggtggaccgggtgcacccggctcacaccggccggcgccgtgggtcccatgcgtcagccgcacccgagggcgcgggcggctgacggccgggccccacatggcagccgcgggacgcgcccgaaggcggccacgccggcacagccgacgggaggcggcgcgcccgcgcccctatggtcgccggcggcggccataggcacggcggagcggcggccgagagaggggagggaagggggaaacgaatcggcggtccacggctcaccccgggtcgacggcgacgacgggaacggcgaccggagcggaggaaggcggcggcgcggcacgggtcgacggggacggcggcgttccggcggtcggcgaccgaaacggagaggtggacgaggtcggcgaggttgcggcgaacccgaagaaggcgacgccgaagcgggagaaggtccggggcgacgacggcggcggaccggagctcggcggtgacggcggagagagagagcgacggcgcgagctcgattccggcggagagagagagcggcgagggtcggaaacggcggagggaggcacggggagtgtttatatagggttgggagggggagagagcggccggatgagggggaaacggctgcggaagatccggccgccattgatgcgccggcgagatttagggggaaagatcccgaacgaatccgagggagagagag

SEQ ID NO: 66911 - DNA, 3890 bp, Oryza sativa
tcataacaatttattcttggtaagtattaaggctggcccaatcagatcagtttattcttgattccatgttaacaagctggcccaattaaccattgatcaatattttttttggaagataaacttcatttaataatgccatgaattggagaaggatgagaaaacaaattactagacaatattcagtggtattatttgggatgaaatgttttaggctaatatatttttatttacattccccttttctaccctctaagtaaataactgaaaatagacgtcttagcttcttttcgattctcagaaatttcgctaatttgagcaagttcagcagatcgccatgcataaccccgcagatcagagatctcatgtgtccatatcctgttgtttccggtcgacatccttggttcatcattacctcaattgaaggtaaaagcagtttcttctctcttttttccctgttttccttgagtggttgatatgagaagataatatttttcctgttttttttttgcatgtgctggaatttagaataaaaacaattgctctcgttcatcacaaatctttatctattaagatatcatggttcagaatttatcgtggtttggttgttagaggggtttcagactgttactccgttagccattctaacgggatagaagcactacaatgttgtgtagttgcctggagaacatgacctaaaattgataaaatgatgacaaaatgaaggacatttcctttatccagaccatcatccctttatctgaataactctggtttttttaatttttttaatccattcttgacatttggtatggtttgtggagttgttcagataacagctcaaatctggactctgctcttcttttttttaaaaaaaaaaatgtaataagtttgaagttctgatgttatatccccaatccatgcatgctgtgttgctttcatcactaggcatcctagcatcatggattgagtaactacaattttggttgcggcaagtatttctgaaataacctattaccctgaatagggtttatctgtacaatttagttaggtagcaaagatacagaatgcaatctactactactaacttgaaggcctgcacttcttaacctctacatttttggatctgcaaatcttgcactaatttgcctaaggacactcaaacaacattataatttgctgcacaacaccatggacattaaatttgaatactattataagaatggtatcttgaatattttgtagtattgaaaaccacattctgaacattagttcaagttcagaaatccgcattcttgcaatgtatcttacctatttcagtacatgcaccatgtgtttttttcttcattttctgcagtacagtctactcatctactttgctggtagcttttgcatgtcattatccccacatcatgatgtatgattttcagttttaggtgccagttttggtgtgaagaactaaattgaaaccgaacaatgattttccacagttgcggttaacttctaaacaagttagttctgcaatggataacaatggtggcggttcagcaccaatatcgtccaaaagatcatgtcattgtttcatccatccagccatggtaatatccattgctcaattgatatatttttgcttcctaattttacgtacactcttcctttaggtctttttgtggatataactaatgtgattaatgccaagttgacaaataagcatgccgcggttatccaaagtgaaatcaatgttccaaaagaccgtgagaactatcaacagatcaacaagaactctacatctaagattcagagagcctcaactattggatttggtatcatacttatattggctttcttttttttttaatatatgagatatttgttttaggctaacatcagcattctgattttgtggtgcaggcaatgaaaataacgcttctgtcattaggcatgtgcggctaccatgtacagacaaagccgaattgtcgtacggtacacccaacatgcatgaagatgttactaatctcagtacggctgaactaaaaaggaagcgtgctagagagaggtacgcatcattgacaaaagagctaaaggaagatggaaacaagaagagacgtgattccagaaagcggaggaaggatgaatcaataggtttttataaattaacacatctattgttatcaaaatttggactttttgaacacaacaccttattattattgaattaattcaactctttcagatcattgatctcaagattccacgaccaaaatggctactcctgtgtcctcaactgtttcaggttgatgtgtaatatggtaacatgtagaaatttgttaggtgtttcgtaccaaatacgttctaatctgtttggatatgagcagccccgcttggagatattacaaatgtacgtgctgacagattgcttctgatagtttaacaaattttcactcaatttcttttcacttaataaaattacccgttgcaatgcacgggcaccttactagttttctacgaaaacagaactgaaaaactaagctatatgaccggttctgaaacaaccaagtcgtttttttgactaactcactggggggagagattccccacctgaattgtcatttcataatagggagaatatagttctgttacactagattgagagattgaagacaggaggagaaaatttgtttccacacatctattacagttctatcctgcaccactagcaattctgcccaaagacctgcttcgctaacagcacgataaagggaagcagctaaagaaggttgaagccctctgaaaaccacatcatgcctgtgattccacagcacccagaagcaaagtaggtagaatacatggaagtgtttggccggcagaagctgcgatggacttagccgataaaaaagtcgaaggtcttggattgagggatgaattccaatacttagtccagaaccttacagcaaaaggacaagagaagcataaatggtttgccgtctcgtccgcacagttgcaaatcgcgcaagttgctgactgaacaatctttttcttcaatagatttgactttgtggacagtctatttcggatcagcatccaagcgaaaagttttaccttcaacggtgctttgcatgcccagataatcttccaatttggtgagataaactctgccgggaattttgcctcatatatctgcttggaagtaagaatgccagaacgatcattttgcctgatgtcaggttcctcattcagaaagcaagctgcaagcatattctctaaattatgaagatcagcttgggctgcttgcgatagtcttggtaccaaaaacgataagattcccctgctaagcacttctttgacatttgcatgaccgcttgttgagtgcgagtagagtgccgggaataggtttgcaagttgctgaatacctagccaacggtcatgccagaaagaagtcctcgagccatctgcccatctccaacctttactctcgtcagattttgaagggcaggtaagagtttttgcatagagttccagtgctggcccagaggtaaggttttcatcaaagattgcccatcaaattctctccagatccagtctgcccaagatgattccgcagaatccaaagctaacaaactgaatgaaaaacatgtgacaaatgcgcaagattacatcattttcctcctttgctatacgtgcataggaggccatctgcctacaagaccagccggccggtgttcgagcgggccagagtcccgccgccaccaccgacgcagccactcggactcggccaacggcacgccgtcctccgccatcatcatctctaccgaacccgcgaacgcgccagggagcctcctcctcctcgggctccgtctcggtggctcgtctcctctctccaacgaaccggtagc

SEQ ID NO: 66912 - DNA, 2667 bp, Oryza sativa
tatatatatatatatatatatatatatatatacctcatatggggcaccatggtatcaaatgcaaaaaatcactcaaattttttaaaattttcaaattatgagtatatacctagttataataattcgattcatacctatacctatcaacaaaacaactcaaatttaactttatttcacaatccatgattacatacctaactaaatatatgtatggatgctatatacctagaatcaaaatctaacaaaaacaagttcaaattcagttcaaacttgctttgaactagttagtaaagtggttaatgttaatacctaagtaattgaaaaagattcatactcatttgaattgggtatatactcaatttcaacaatggtgcccgggcaccatggagcaccaaacaaatttactatatttcaccgtatattttcccaagtaacgcagctagctaggcagcatgtgtgtgctgcgacatgctttgctttgctctccgagtgtcaacgcattttccttcgtgaacctgcgtgcttgtatcctagggtgatatgtcagttctatgttagtgcaacaaataatatatttagtcgtgatctggacttgatttaattccatcgatcattcacttgatcatttcacttgatcaagtgaattcacttgatcatttccatatgtaatatgttttatctccttcctcttattagtgatggtaaaattaattgctctattaacatatggttacaactttagaagcagattgctcattcagttatcctgctaaaccacagttccaaaattaaatcattttctccagctcgcagctagtattggtaagaggtgaaaatggtgcgaatattttccaaccacccgcccgactcgaagctagcgagaggaatatggaagaaaaaatagaatatccgatactatccaagttcgaatccaaatccgttagaaagtatgggttaggatacggaaagacatgtatccgcccgtatgttctataatataaaatatgtatgaaaatctattataaatgtacctataaacatgataaaagattgttaatccctattttacgagatctcacatgtaatattatatattttttctcttgatgtatctcttttaatactttaattaatttattatatttaatatttatgaattagatatataaatagatatccgtttccgaatccggttcgaaggaaataatagataagcgatatgttatacggtaatacccgtactcggctccgaacttaaaaaaaataggttaggatatgggaatgtcataacccgaccgtacccgtccgttttcacatactagtttctcctgttcctatgggagcaatcttcattatgcaggctgctcatgagatggcaaacctgctccattatagattaaggtatgcgttacactttgaatatagcccattctgctcctgattggaatttgtattttgtaatcttgccttgataaagtccttggtgtgaaattatgctatctttagcttatttttactttactgacgcagattccacatgcacaatgataggtgggaaatacatgggagcaaattaagatggtattttgatgttcttcaaaagagaagggtaggtggggagtgaggagagataggtgtgtgggttagggtttatagatgcaacttttcagttaaaaaattaacagatgtttcacacattttcagttaactgatgaatatctagtcccaactttataagtcgtttggtgtaaattatacaatatcacaactctttgtatattatgacaacaacactctctcaccccctaacacaatggcttggcaacaaccatggcatgtcaagaagccgctattacttttagaaacatagtactaacgcatatgctatgctcttttacacgcgcttgcgttcatccttacgaacgaacacacgtacactctatacatatgagaactcctgatatgcaatttcggtaatttcgaaccccaccagcaaggcaatatctcagccaaaattttttgtatttctctctttttttgtgtgaatttgatcaaaatttattcaggtttagtcaaattatgttaaaatttcatataattttggtgcgaaaatcccaaaattttagaaattttggtgctaccgaaattttgaggaaaatcaaaactaaaactttagatacgctgaaccgatatatcttaagatggtaagtgtcacaccctgaagttcttctcccaagcctaaattaattaataaatggcctcgagaaattacctgtgtaaaagcaagagagaaaccctaattaaattaatgaaaataatcatcggaaatggcatgcggaattttccttgagttctccatgtcaaaatatgctaacaagatttttagtggaattttcagagctctaaaaataattttaaccaattaaaaatgagcacaagcattatttaaatccctggaaattctttttcccctcccttctcctaatgggccgccggcccattctttctcccttcccctccccgctgggccggccgaaggccacggcccagctgagccgcgcacctcctctctctcccggggtcgccgacaggtagggcccacctgtcgggcccgtccccaacctccagccggaggaggaggttggcctccccaaccactgcccccgc

SEQ ID NO: 66913 - DNA, 14368 bp, Oryza sativa
ttccctagcatctgcgtggccgccgccggtggtggtggcggcggcgcacacacttcgtttggtcgccggcgagtccctgcggccgtcgtcgaagctcttggggggctcgacggggagcgacacgtactgcagtcgggggctctcgtcgaacgggttgcagagcatgatgccacggtgcaggtcgacccagcacagccgccggtcgccgacggggacgaccatgtcggtttcccacgctgacagctcagcgccctagccgccgctgtcgtcgcggtggatgatcggtgcccgcttgaggctccactcgccggagcggaggaggaggagtttggcctcgttcggcggcatgtcgtcgtcgctccccttggtgatgagctccgccaccacgagctcgtcgtcgccacggcgcaggatgccggtggcacgtacatccatgtctggatttggctcgtcctgctctgtcgcatcgacatagttgtgaggcagcagcgtcaacgacggcggccgcgcggcgtcgccggcgttgtagacgaagtaatcaagtaatcgagcgcgtcgtcggcgttatgctcgtcgtagtattccatcttgatgagcacggagtcgccgtgggcagcggcgacaaacatggaggcatctagatctttttgctccaagtcgaagaacatccgcgacgccgccggtggcggctcgaggcagaacgagacgcggacgcacgggccgccggagaaggtgcaggcgctcgccgccgtcttggggtcgccggtgtagccggcggcggagtgcttcctcaagctcctcacgttgtgacctttgtgctcaagcatcacccaccgcgggtaactgccgccgccggcggtggccatcaacgtcgccggtgattagttgcttgcgccttgcggttggctctagttatcggagttatataaaagatcgtaacagatgaatgtatgtctgtgttttctgttaagatttaacagggtataaataaccgtcacgtttatcgttagagatcctatcgtgtcatcaaaaacactctagcccgaatttactgttaattgtgtcgattttttttttttgtgtgggttgtggaggacttttattttcttttttttatccaatccccaatgaattttattatgaaaactaacgatccaaacacctatttagagcacaaatttgctacatatctatcttgtgattttttaaaaacgattttttcacctttggcttttgccgtacagatttgattttggaccgatcaaatatgttaggttaaatacattgccgttgagtgatttatcatatattaatctattttttgattttttttaacaaaaatcataacccatttgaatgatatgcaaataacgagaggatattccctcgagattagaatccactctcctcactcattcatattgttgccgtcagtttctcaaaaaaaaaaaaaattgttgccgtcaggctataaatggccaaaaggcccgaggcccgatggcccaacccatggcacggcattttggcccggcccaagcacggcacggcccgacggaggtcgagccgtgctagcccggcctgaccaccgagccgtgcctgggcccctccaccggcacgttgggccggcccggcacgatgggccggcagctaggcccaatacacaaaaaataggggagtaaaaatagacatattatattccatggatgaaagaatagggatctaaaatagacttttttttatctatacatatgtcagccgaagaggagggacggaaatagacttattttagctatgcatatgtcagaccaaagaggagggacggaaaatagacttattttagctataaatatgaaatagcccaaagaggagggaagaaaattagacttattttaaaaaaggaacgatgggccacccatgccttcaggccggcatggcacgtcgggccgtgcctgggcgggaggtgcatcccatgggctggcacgaagtgcctatcgggccgtgccggcccgatggcttctgggccgtgcccagccgtgcctgggcagggctgtgccaggcgggccctttggccatctatacatcaggctatccgcaccacattggtttcactgtaaaaaaaaatagcgattgaatgtaattatagtatttctgttggcgtctttttggctaacagtagtagtgaagttcccactccgcgtcggtcggccgccatgaggttttccgaagctttgactacaaggaacttatctatctccttctcaaacttgatcgccgtttttgggagaacaaaaggacaaactttttccatttttttctctctgggccggcttcaaatggccttttcttggcatagataaacactttatgtcctacttccctacaaaatctatttccttatgctcccttctgcattccgtgaaactcatctaatgatttgcggtgttaacggagttaccaatcacctcgatccaaaattagtgtttcgaaaatgttttcaaaagtctccgaaacaaacccatcaatcctttgaagccgacatactcgcatgtaaccacccattgtagttttccccctcccctgggaagacaaaagtaaagttgaaggttagggtttccttcctaatactaaatctttgcttgtggattaggtctagttgcgctaagtttcgctgctacttctctaattatcgattatagagcttgcagtcatgttccgaatatgtgacttccaaaagatatagtttatttattggaatgatgcatctcagtactgccgaaactagtgcttgtgcctatcgacatcgtggttctgtgggagtcggttcacaccgatttcctgtggcgcaccctctccggtgtcattgttaggtggtgctaaggcagggtgtggcaataaacctgatgagtggatcagcttgtgtcttttttctttttttttttgaaaaaaaaattacctgcttgagtttgtagctgacacggcaatatccttgagataacaaaactacaaaaaaatatgtctactagaaattaccatacgttacgtttaactccaggagatatctctcgtgctggcaaaatacattagctagatggtggtatatgccattacagaaaacaataaaaatgcagtgtaatatattccttcgtactaaaatatatggcacctatattttaaataaaaattaaattctaaacctttgatcgatgtacatgtttagtttttcagagaaagaggtaattaaagcctctccgtttccattagagaacaaaactacagagttcaaacgaaacatcaaaagttttacggcgccaggacgttcctctcatctaatttatgctaaaaatgatgccatccccagttcccaccactagcacaaatacaagagcaggcacttaaccacattgcatcgatctaaaggaacaataaaacaaaagcaaatttcatgaaatttaaggagatgaagacatgtagtccagcagcaatttcatgcacacacttttgcccctttttcttgcaaatttagatcaagtacagtcttcataaaactcgagagagatgtttgctcagcacatcagagccttggagttcagcttcagcccccatccatgttgtgggttgggttgtgcatgcggagcagatggaacaagcctggctattcttcacttcaatcagcagccatttcttcctgagacccattggcagcaccaagagagacctgaatcggcgtccactgccatcgttaataagaaggctatacgcctcgagcaaatcgtcacatcccaaatcaggtatctcttcaagagcagccaagatctcctcaggagaagccatctctgacacattggtggacagttcatgtgatttcttactgatgacggcagtcgtcgtcgtcgtcgtcgctgcagctgcaggtagtacgtcgacgacgatggctgccggctttgttgaatcgctgctgcatgaagtgaggaggtaaccggagatctcgctgggaatgcaccgtaaacatggcgaagactgatttttgtaggcaaagactgatggcagcgtcttgttcgtcgtgtcaagcatgatcttccaaaatttctctttcacgcagtaatcgtggtcgtaaaccaggaagcagatgatgtgagagtcgcgtgtactcacgacggggtagtacggtcttttgtgtggtgggatgccggcgtcggcgtggagggagagggaccagagctcggtggcgtcgacgatggcgtccatggtccatgtcatgtcgctcgtcctcagtgtccaggtgttgatgacgaaggcggagctggaatggtcgcaggtggtgacgccggggcctccgcagcagcagcgggggaagatgtcgacgaacttgagcgtgtcgccgccgccgccgccgccgttggtggcgcagacggttcgatctttcatcaggcaaagccgagggttgcggccgcggcgccgccgctctcgtactcgtagtaacggtagccgtagtcgtcgtcgtcgaattcaccggcggggggctcgacgggaagtgacacgtaccgcggccggagaggctcatcgtcgtcgaacatgtcgcagaggatgatgccgcgatacaggtcgacccagcacagccgccggtcgccgacggggacgaccatgtcggtcttccaatggaatagctcgtcgccttgccgtcgtcgtggatgatctccgccggcgtgacgctccactcgccggaacgaaacacgaggagctcggcgtccactccgtcgtcgccctccgtcacggtgagcttcgacaccacaaggtcgttgtcgccgcagcggcggcggcggcggcgcaggaggccggttctagcgtcgtccagccggttcggcgtcctgtcactcaacccgtagtgaacccagtgaattgggagcagcgacaacgatggcgggtcaccggcggcggcatcgccggcgctgtagacgaagtgatagaggccgtactcgccgccgcggcgcgcttcgtttttatagtgcatctggaggagcacggagtcgcggtgggcggcgacgacgcacaccaggggccctcctccttcgtcgtggctcggggaggaggtgtaccacatgcgcgacgacgccgggggcgcctcgcggcacagggagaggcggacgacatggccggcggagttgcggcagctcgcctcggtctcggcgcagctgccgccggcggcggagcaggggttggaggagtcgtcccggtctccctgatcatcgctacctttcttgtgcttgcgtcggacgtcgcgctcgagtaaagcccaccgtgggtcgtagcagccgacgcgtcggagagtcgccggcgtcggttgggtttccatggtcggcggcgatggcggcggcgactggtggaagcttagggtgacacaaaatctgaggccatatataatggacagtaatcttctttaaattgcaaatataacctcgtgtatgacttgcagatcatcaatgaaaaaaaactactaattgctgacttaattacggatcgatattatggggggaaataatctgaataatagggagaaggatcagctggatcgtaagctgatcttgcagaaacagaaatgccctcacaaatagtgtaaacgagctaatcacggatagtccggccgtcaattagtttctctagcttgtcagcaaagatcagctaatcacgttcacagatgaggcccggctcagactcggctttgcggtttacgagtacaagttttttaaaaaaacgacacgacacctataaattagtttgttataatgttggtttatcttaaagaaaatactactccatccgtcctaaaatataagtatttttggattctaacacgatctccgagatgctattttggtcaacgatatataaaagtaagacgttttgaataaaaagagttgcatgttattatagtttgtgtaatgataaatctagctagtaacatcaattttacatggttgatctttttttctttctattaatagtcaaagttaaaactgtttgacttgtcactatgttaaaaatgcttatattttgggacggatggaatatatgtttttatggaggaccagcacatattgatacttatatataaggaaactactctaaactctcgatgggatattctctcgttgtttacatcactcaaatggttatgagaaaaattgaaaaaatatattaatatgcggtatatcactccataaacatgcaagttcaaattaattttttacatattgcaacaaaatgcaaattaaactacagctagtcaaatttgcttttttttctttgcgatatgtaaaagttaaattttaatttgtatttttttggagtgatatatcatatattgatacatcttcttaattttttttcctaaatatttaagtgacatgcaaataacgaggggacattccctcaaaagtttaaaatccagtctccttataggtgccctttttttacctttagccttctatggatgtttggatggatgggaaaagctccatatggattgtttttaaattaatcgggacatatgcgccacatgttatggattagggcatccacaatgtggtgtaaaagtagtacataagcaatataatattccattcagccacctattaccattgtgcaactagtccatatagaaaaaatagcaaaagatacccatatgcatatggactacccatatgaaataaattatattatctatctcctctctcttctcctaatgataccttgtatctgtatacgttatggagattgccataaggataaactatttatgcgggtcccatctatatggatcactttaccatatacattggtgatgcccttagagatttgctcaagtcaaaaaaaaagtatctcaaggtgccggtacctcatggtaccaaatcgtttatgatcattgaaaaaaaaaacctaaagtacccaagcaattgtacaattaagcacaatccgactgttaagcagtaagcacatgtatactatcaataccaaagcaagtttacaacaaagtatttcatgcattttgcaagtctgtcatgcaaccacagcagacagcgcaatcttcgcacgtctgaatttccatcaacaaccaagtcttcctcaggctcatcggaagccccaaaagagatttgaatcggcggccattatcatgacaaagcatgctataagctcttagcaaatcatgacgagacaactccggtatctcttccagggcagcaaagatctcatcaggagaagctactgatcctgacactctgaaatgtttagcaccagatgactcacatgaaattcgcactgaatcaccgatgatggcatcatgtgttggcgccttgtcgatgatcacagctggctctgacatcgctccgccattgctgcagcttccattggaggaagtgaagtagctggagaccttgctaggaaggaaattgcgtccatggctgcaggagatcgctgacaagagtgtcttgctccttgtgtcgaagaggatcatccatgtttctttgatgcggcaatatctcccctcggattctcgctcatccaccatgaagctgatgaggtggggatcgtctatgctcacgatggggtgttctggaatggcgtgtgggaggccggcgtaggcgtgggatgaccagagctcgctggcgtcgaccatggcgtccatggtccaggccatgtcgccgctgccgtcgtctaccctgagtatccaggtcttgatgatgaaggcaccggtagaatggccgcagtaggtcgggccggggcggccgcagcagcagcgggggatgacgtcgatgaacttcagcgcggcgccgccgccggtgacgcagacgcttcgctctgcgatgacgtatttccgcgtgtggtcgtcgtagtcgtcgtcgtcgtcgttggattcatcggtgagggcctcggggggaagtggcacgaaccgcagctgcggattctggtcgaacacgtcgtcgacgtcgcagaggatgatgccgcggtacaggtcggcccagcacatccgccgctcgccgacggggacggccatgtcggtgatccacgacggcagcttctcggctctaccgtcgaagtggacgaccggcgcccgtgtgacggtccactcgccggagcggagaacgaggagctcggcctcctccagctcgtcgccctcctccatcacggcgagatccaccaccaccatgtcgtcttcgccgcggcgcaggaggccggtggtcctttcatccagatcgtggcgcggccgccaggtttcactctcttcttcatccgcgtcggtggtgacgtaggcagggagcagcgacagcgacggcggccgtggcgggtctgggcggcggagccggcgttgtagacgaagtagtcgagcacgccgtcgtcgccgtaccggtatccttctccttggtaactcaaccggacgagccggagtcgccatgggcagccacgacggccaggctggcgccccgccccccgccgatgcgcgggaagaagtcgaagcatacgcgcgacgacgccggtggcgcgtcgaggcagagggagacgaggacgtggtggccgccggaggagaagacggaggccgcctcggtcttggcgtccggtgtggagaagggcgggaaggagtcgtcgcgctcgtagccctggtactcgccgtagcggcagagtatcacccaccgtgggtagccgccggcgccggcgccgccgttgccgccttggtccgccgtccgttgggtttccatgggccgccggtgagaggccggaacaaacgatttgatctgtctcgtaacgtaagcggagagatcggttcctcggtttacgaaaaaaaagaagaaggtgtttgactatatagaagagtttgattatgaaacaaactaatgaatcgtataataggaatccgcctcgttgtacgtactcctacatgtctttcataagagcaatttaaattttctttttatttaggattaaataatttgaattctttccccttgccttaattgacctgttctccggtggccgacggtagagcactctaagaggggaaattgaaattttttttagcaagatagatttatatggaacatatcattagtaagttattctaccaatataagacacgacccgaaaagaaaagagaagcaaagtaaatatattctaaggacgagcataataatttggtcgtgactttgggctgacacaacatggtctaagtcttattgggccataagtgaagcccgtgagcgggcatggctgccaaccgcagccttggtcgtgcttaggctgggtcatgcccaggcggcctatttagtcctctataacctcaacagaccagccaagccaccctcttcccttgttatcctctctttttctctctgacagttcatccaaaacgtcacattccttctatggatttacgctaatctaatataaaaggcaccatttaataaatgaatcattaaatagcaccaattaaaaatgggacaagtgcatgcatgcccttacttcgaaccccaaatgttgttttatcctactttttagggtttacaattttgccccatctttttgaaaacgaacccaccgtttgccctcacttttaaggccgttagttgggtcccacagttttgggttaaaaaatacaaatacaaatagaaaattttcttttctatttgtatttagaactacgggcatatatttagaactgtttttctctcttattcaaccaaaaataaatattttaatgggtacgatatccatgtgcccatgtacatgcttatttgaaaataatttaatttgcataaaaaacaaattctcaaaaatttggttaaatttggaaatttcggttgacataattgcttgctggggggcgaaatttcgaaccgaaattgacaacccttgaatttagacacgaggctatgtccaaatttacgtctaaaagtaaatttattttgggatggggatagtagtagactattagagtactagagtcctcttcttaacaagcagcaatagtacaataattcagaacaatcaaacagctggaaacactagtatttcatacattttgtagctctgctctgcatgcacaccaaacagaacgagcttcactggccttgatttccatcaacagccatggcttcctcagggtcattgggagccctaaaagagatttgaatcgacggccaccattgtcagaacaaagcaagctatacgctctgagcaaatcatcacgagacaactccggtatctattccagtgcagcaaagatctcatcaggggaagccactcctgacactctgatcagatgtttgccaccagcagatgactcggaagaagatcgcaccgactcatcgatgacagtatcatgatcaaccacatgtggctctgatgatgtcgcagcattgctacaataacttggatcatcaaaagtgaagtagctggagatcttgctaggaagagtgagctgtcacaccccaatctggcaccaccgtacaacggcacctgacaggagcgtgtcgtaggaaaacggcgtgaaccgcgtcctacgaaaccgcgatctcagtaccagtcctaggacatagcgctggtacccacggtgacaaacatgaatcattgcaaatccttataattaatagaggacttatttaccttaacttaggttgcagctcagacagcctgagaatgcaaccggcgacacggacaaggcaaacaccaacaacagcagcagcagcagaaccaaccaacggactaacaccaaacgccacaggcaacggcagggaactaggacgaaaccctaatcttcacttcacttcaacttcatctttggagctggcagaactatatttatatagagagcaagggtgagtacttacgtactcagcaagccaggggaacttaggtggttaatgcaagcttcaagggaaggctgttattttgcaaacagttttgttttcaagttttcaacaatctaagtgtgtgctttccacaaccagagcgagacaagtctcagctcggtcgggaggtgagaagtaacaaatttatttatcaagatttgcacaactcctagagttggcttcaaatttggttttcccaaaccaaaccaattttccaaacttcccgataatagtggtccccaaacgaccaatcacttccagggactcccggtcccgctgtcccccggacagctaaatgcttcccaagcattaggtttcccaaaccttaacaccttttcataaaacagggtaaaacaaaaactacgctaaggaatcaactcacatccgcccatgaccatgggcacgactgttcgaacagtttgataacctctgcagagggggtacactttacccacacgacgttactaacctgggtcacccagcctgtgcagaacagccacgtctggcgactttgaggctttcacgacaaggcatttctaaagccgacacagggtttccatatgccaacgagaggggtcccaaaccaacaacaggttaggtcccagaccatacttgtcacgccccgaactagtaccgaccggaactagcccgtgacgctccaaattaacctgttaatcgataccagtcccaggaaacagtgctggtatcacaggaagacggattatcacagcaacagaggtctctttattatagagtagaggtacagtcatgttgggctgcggacagatcccgagctcacaactgcattacaaaagggaaacggaagccaggacttggaccaaacaacacaggcgcgacttgggaactaggccgaaaccctaaaactcatcgtagccggcttgctcctggaagaactcctcatcagtaggatccgcttcatcttcttcagcaactgggggggattatttatatagagcaagggtgagtacgggagtactcagcaagccatgggaaataagtgtttaatgcaggcttcaaggaaaggctgttatttttgcaattgattttatttgaactcttttctaaaaacaactaagtgagtgcttctcaaacgacacggatgagacagtgcgtctcgtccggtcggagtatgtgcaatgtatcagtctttagaattgttcaagattggcacccggccaacaactttcaaacggccacccgggccaacaactttcaaacggccacctgggcctagctgatcccatcagcagcagatttttcaaacatcgaacccctttcaacaacagcaatctcacaaggcagtagtcaaacaaaactacgctaggaatcacctcacatccgcccatgaccgtgggcacggctgttcgaacagtttgttaacctctgtagagggggtacactttacccacacgacattactaacccggatcacccagcccgtggggatcagccacgtcgggagacctccaagctttcatgacaaggcatttcgaaagccgacacaggtttaccatatgccgacgagaggggtcccagaccaacaacaggttaggtcccagaccatactgtgccaggaagcccaggggtcctccccgacaccaccccggtgaatccacatgtctctcggcatcaaggctcccctgataagctagttactcagccaggggtgtcccattccacccatgtggtcatacttgtcttatgtttggatgaaattccaaggaaacggtccttaagtgcgagagcgggaaaccgtacacccggtacgtcccccggtccgcggttttggaaattcatttagttcgcaagcaccgacccaggtgtcgggttttccaagtcttttgtaaaacccaagttttacccaagaagtttttcagattttaagtttgaaggcgtccgtcgatactcgcacagggtgcacgaatatcgagacgcaactagatggttacaaggggacacgatataacaattatcaaaggaaggatcaaatgcaacaaattaggtaggtccgccaatctgccttgcagacgggacaacagattaagtgcgatcctatcaatgcataatatttttcaagcaacataactaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggtgaaaataaagccctattaatgacctctaagcgtgccattagatagatctcgagatttgagaaattttggaagttgaacggagtcaaacggatttacggttgggaagatattgaatttctaagattattggatttttggtctaaaggaaaaggatttaattaaatcctttttggaaaagaaaaagaaaagtaaagaaaagagggagggaatatagactttcctcgggcggctagggcgcggcccaagggaaatggagcggaccggccgagctaaatgggccggccggcccaaggcggcccaagacgcgcgcgcgcgggagggaggagagagagaaccggtggaccgggctcaccgtgcgcggtcccgggtgggacccgcttgtcggtgacacggctcaccgtgcggagcgagcacgcggcgtacgcgcgcgggcaggggagggacgcggtgcatgcgcgtggttcgcggtggacgcggatgcggcgggcccacgcgcagcctcacggctcgcggtggaacgcgcgcatggggaggggctgaccggggtcggctcgacccggtcttggccgagctggcgccgacgtggcgcctacgtggctgccacgcgggccggcaggaggtagacgacgacaccggccggaacggacggcggacgacagcggcgagcggtggagcgaaccacggcgatacaggcgaaagcgagcacaccgggtggttgcacgagacgaggggagacgagccaacggctcggattcgccggagggagcttgacggcggcgaatcgcggcggcggcaaccggcggcgggagaagggggaaacggcgacgaggtcacgaggggccaattcccggtggtgagagcatctacgtggctacgggaatccgttgctagcgtcggattgggcggagctacgccgagcgaggccggcgacgagtgggtgctacggagctcgggcggcgacggcggcgagtacacggcgagcgacggcaacggtcggggcggcgccggctagctacggggaggctactcgtgctactacccgagtctaaggggaggagatggaacgaggagggagaacgggaagatgcactaccgtgcgggcaggcgcagtgacgagaggctgacggcgcgggagtaatctctccggcctcgggccggggaagaggaggaagacgagcgcccggagtccccttccgcgtccacgaacgcaccggctcctccgaca

SEQ ID NO: 66914 - DNA, 3116 bp, Oryza sativa
gccgccgctctccactgccagccgctcgccaccgctgcgccggtgccgcgccgctgcgcgccatggccgccgggccggcttgagccaagcccgtgcgcaccggccgcgcgcacccgccgccgttcgatctacccgagggtagatcggggccgtccgcctcgccgcccacgtggctgccgcgtggccgccacgtcggcgccacgtggtagaccctcctccctggtcccgtgggtttggtccaccatgagccggcaccccgagccactgccatgtggggcccgcatgtcggcgccgcccctctctctccagggttaatttttgcgcaataaatcatttaagggttttctgtttatagtaaaaacacagtgaatcttctaaaattcatagaaaattcatctgtgctccgtttaagcccattcaagtctcagtaaatcaagaaaaatgcaaataacccattaaaatggttttgttctctgtttctgtagtctcatagcctgtttgtattgtttactttgtatgtcgtttagattccggctctcccgatgctccggtgtactttgagatagtcgccgaggttccaccagcagcagagtaaggcaagtcatgcttgtcacttgaacatgttgatcctatattgcaaatgctctatcgttttcctttaaatactgcattgtttttcaatgttaccatgggatatttatctactgtctcagccatgttatttattacctcgttcctttgttatcttggggttataacatgattagacgttggattaggaattgcttagccatgcttagctcaactagcacacaatggaggaatcacattaatgcatagacttcaggttctagtattgttgttggtttagtgccaccactctggtgatggttaattaaaatatattaaatggtgggctgtgggtgcatggtattgatggtcgcatccatggcagttaaggaccgattcgcgggaaaccctggaagaattcctcgtacttaccacaagccagcgtgggcaacggctgggcttgtagtgtagctttcctctagctgacgcatccaggcaagggtgagcgtgatggagttcggatgggccctgcgacggcctatgcggctttcggattcacctaagcacgagaggggactgcccactgccttgcgaggagtgggggtgaaacctgaggtgtggtgtgtttggttagagggggttatgcgaagggtcctgtcacggcctctttccggtatgtcatggtggcatgttggcgcacgggaacgtgtcgtggggttgtgtcttgtgggtacagttgtacacctttgatcagagtaaaactattcgaatagccgtgcccgcagttataggcggtcaaccagattcaccgtgattagtctcaccctaatttagtctgatggaattgattagttcaggtggatggttgggcctgttgcaacgtggtgtagcgttggacagtggatggttaatattgattaattattacaaatgttttactgccttcaactactgtttataaatgccgctttgtgcaaatgaaccactctagctatcatttggttatatcctgcatcataccctccgttccggtatgacttgctgagtacaatgggtagtactcagttttgctctacttttccccaaccccagagtttgagtatgcgtcagatggtggctattccgaggagtaggcttcgtccgtgccgttgaggatgcctgtggagtggtgttcccgctgcaatccaagtcaaggcttagctccagttatcttttatatttccgctgcatttatgtaagacttttataatgtttgtaagacgtggatctgtatgtcaactttgttgtttgtttaccctggctgatcctggacagggattttaatgcacattctgcttggaattctattcggaaatttatgggcgcgacagtaattaagtcaccatgactaccttcgttattgaatggggtatcgcctattacatttactacctgcataaggtagaaaaccgttgctacactactgtcaaacaccatggcctgcgacgtggctaaaaggtttagttagaaagaaaaagtatattagaggttataaatttctattaagaacgtacctaagacagcttcacctatggagccaacccaaagtagccacgttgctgacgactcaagtcaagtggatcatcaattccactgtataatttcttcattcaattcgacgaacacacgtctctatcttgcatataccgagaggtccaaaacgatgaggcgttgacatcatcagttaatgacttaattcggtcacattatatatagtgtcaacatcttgcactagcacataaacaattttttgagatggtcacgaaaatcaaattttcacgtacgaacgcttaagccggccgtctacgacaataaaaaatcaaaccccaccccaaaaccctagatccgccgccatctggtcgccgttgtcactcgaaaccctagcctgctgcttccgcccaagttatcgtcgttgaggtcgttgtcgttgcgggggagggcggctgtcgccggatcggcgcgggggagagccgtcgccggatccgtgcggggaatggtcgccgcccacccgagccctccatcactggagcttgcgccggattcgtgcgggagagcatgggggagggtggagggggccgctgtgcgccatcacctacgcccgccgctagtacccgttgttggtagggaggagatgggagaggaggagcgggagtgggaatggggagagagaggaagggagaatataaaaagagttgtaagaggagggattttcgcatatgggtcacttaagtaactgtattaaaaatggggtcgattttttagatgcggaccccttctaaaccgcttgcaacctatggaggtgctcgtccagaaaaaataagtgttaattagtttgtcctggttatgcatgcagccaatcagctgcatcaattgtccctatataagcctaccttacctctcgacatcgatcataatcacgaacactaatcagccttcctcttgaaacagcaattataatcacgatcattagctcgctgattgataactaacagtggtcctaatcatgg

SEQ ID NO: 66915 - DNA, 2423 bp, Oryza sativa
atgagccaatattacccgatacaattggacgggataaaagccggcgacgcggcaatcgcgctgccgccgagcggcaacaccgtccttgtccagaccttggcgccgatgagcttcctggtggacagtgcgtaccaggccctcaagaaggaggtgacgaaggccgtcggcgctgcgccgacggcgacgccgttgcagcctttcgacctttgcttcccgaaggcggggctcagcaacgccagcgcgccggacctggtgttcacgttccagcagggcgccgccgcgttgacggttccgccgccgaagtacctgatcgacgtcggcgaggagaagggcacggtgtgcatggcgatcctgagcacgtcgtggctgaacacgacggcgttggacgagaacctcaacatcctgggtagcttgcagcaggagaacacgcacttcctcttggatctggagaagaagacgctctccttcgaacctgcagactgcagctcacttatctcctaatcgatggcttcttgatggaagctgttcttgccttagcagcttagctagctttgctattcaagcttccatatttgtgtcattgtgtgtgtgtgtgtgtgcaagtgtgcgtgttcatagataacgcagccaggcgcccaggtggcatgagctgcagcatacttttctttgctctccagtgtgggtagcgtcgatctaccattttctacttcctgaatctatagtataggctatacgtgcttgtgttggaacgagatcctctgtaatactgagactgacatgtggccccagttacgcaaggcccacatgtcagctgcttctattacaggggaaactattttgatccctcgagaagatgtccactcattatttgcatgccactaaatggttacgaaagaatttgaaaaaatttaagaagatgtattaacatatgatataacactaaaatatgtaagttcaaattcaacttctacatcttgtaacgaaaaaaacagtatataaacaatcagtattacagcttcttaaacagattgctcattcagttatctgctcaaacagttccaaaattattaaatcatttccctctatttgtatctgctattagtttctcttgttcctatggagcaatcgacaatcgtcattatactggctggtcatgagatggcaaacctgctccactatacatgaaggtataagttaatactatagccacagtattctcctcctaattggaatctactccgtaaacttgccttcatagactccatgatgtgaagttctgttctcttttgcttattttactttactacgccgattccacatgcacaaggataggtgggaaatagtgagtggattctatactctcgatggaacatcctctcgttatttgtatgtcatctaaatggttataaaaaaatctgaaaaaattcaacaagatatattaatatatgataaatcattccacacaaacattcaagttaaaatttaacttctgcatgttgcaacgaaaaacacaattaaatttgttttttttttgcaacttgtataagttcaacttgaccttacatgttcataaagtaagttatcacatattaatctatcttgttgaatatttttaaattcttttcataaccgtttggatgacatgcaagctcgagagtttttgtttcccgtgggaaatacactagagcaaagatggtgttttgatgttcttcaaggaaagaaatatacttcagttttcggtgtcctggggccaccagaattaggacttacaaaataaaataggagaaaagtcaattcgtaagcattgcatgcaccaaaccttttcatagcagctccaacttctaaatctaactttaggagtggagtttggcgtggagctatagagcggcccaacctgttccccccctctaattcttttttttttcgatcacttaagcttgctctgctccttttttaagacgatgtttaaattgtttggttgtcatctagcttcaaaagagatgaatcgggcatttaactttttgctactttataatcacgatcattagctcgatgattgatagctgacagtggccataaccatgggaaggctagtgacaacagtgctcgtgctgtgcttgatctatgtgacgacgcgcatggcggtgttccgcgggcacgacctccggcgaggtctagagcaagccatgcgcagccgcctcctcgccgacgcgacgccggcaggaggctcggccgtgcccatccactggtccagacacctctacaacgtggcgaacttcactatcggcacgccgccgcagcccgcgtcggcgatcatcgacgtcgccggtgagctcgtctggacgcagtgctcgccgtgcagccgctgcttcaagcaggaactgcccctgttaatcccgaacgcgtagtccaccttccggccg

SEQ ID NO: 66916 - DNA, 5944 bp, Oryza sativa
gttgaattacggcgccaaccactctggcgccccaaaaaggaccatttctgggataagttttttcaggggtctatttgcgaaataagttttttaaaaggaccaaaatgtgaaaaatccagcaaaagagagtgcaatagggtatcttatgaacttgctcagtttgctaaacggacggcacattacgcggtttggcgcgatcatgccccgtcctgtgttaagcatgtactgcaataagagtgtaatcctattacttaatcaataaagctatatgttcccgcaaaaaaaaaagagactcaaatgaataaggtactcattttgcaacataccgattcgatcgtcaaatccgcgccgctgcgccatctactcaccctcgacctgtcatcctccgccaccttcttcgactgcccagaggtagatctacagtagaagggagggtcggtgtcagatgatactgacaactttcgataaaatttatacgaaactgattatccctatattataatactataatctaaacataattaacatactatgaccattgataaacacgtttatatatgacagcagcaaatcgattttatcccccgcaccttttgccgctctttctccatgaccgatccgtcgttccggcgctaagcacatgcatctccccgtcttcctggacgacccccgccgcctcctctcctcctccgccgccgcctccgcctccgcccggaccctcgcccgcctccacgccctcctcatcgtctcctcctccgcctcccacaccctcatctcctcgctcgccgccgcctacgcccgcgctggcgacctcgccgccgcggagtccaccctcaccgcaaccgccgcctcatcctccatcgccgcgtggaacgccatcatcgccgcgcactcccgccgcggctccccggcatccgcgctccgcgtcttccgcgcgctcccgcccgccgcgcgccccgacagcaccaccttcacgctcgcgctctccgcgtgcgcgcgcctcggggaccttcgcggcggggagtccgtcagggaccgcgcgttcgacgccgggtacaaggacgacgtcttcgtctgctcgtcgctgctccacctctacgcgagatggggcgccatgggcgacgcggtcaaggtgttcgtccgaatgccgaggagggaccgcgtcacctggagcaccatggttgctggtttcgtgagtgctggacagccactggatgcgattcagatgtacaggaggatgagggaggatggtgtgaagggagatgaggtggtcatgattggggttatacaagcgtgcacagcagccagaaatgtccgaatgggagcttcagttcatgggcatctcttacggcatggaatgaggatggatgttgttactgcaacaagcctcgtggatatgtatgcaaagaatggactacttgatgtggcgtgccgagtttttggtctgatggtgcaccggaatgatgtctcatggagcgcgatgatctcaggttttgcacagaatgggcaatcggatgaggcacttcggttgttcagaaatatgcaggcttctggtattcagcctgactcaggagcacttgttagtgctctgctagcttgctcaaatattggattcttgaagctagggaggtcagtacatggtttcatcgtgaggaggtttgattttaattgtatcctcggtacagcagccattgatatgtactcaaaatgcggctccctagcaagtgcacagatgcttttcaacatgatcagtgatagagacttgatcttgtggaatgccatgattgcgtgttgtggtgctcatggacgaggccaggatgcgctcactttgttccaagaaatgaacgaaactggaatgagaccagatcatgccacatttgcttctcttttgtctgctctaagccattctggtcttgtggaggaagggaaactatggtttggtcgcatggttaatcacttcaagatcacacctgctgagaaacactatgtctgtctagttgatcttttagcacgttccggtcttgtggaagaagccagtgacctgctcacatcaatgaaagctgagccaaccgttgccatttgggttgctctactttcaggctgtctgaataacaagaagctggagcttggagaaagtatagcagacaatatccttgaattgcaacctgacgatgttggcgttcttgcgttggtctcaaatctctatgctgctacaaagaaatgggacaaagtcagacaagttagaaagctaatgaaagattctggaagcaagaagatgcctggctgtagctcaatagagatacgcggaacacgccacgtgttcgtgatggaagaccagagccatcctcagcgtgaagagatcgtaagtaaggtggcaaagcttgatttagagatgaggaagatgggctacattccgagaacagagtttgtgtaccacgatctggaggaggaagtgaaggaacagcagctcagctaccacagcgagaggctggccatcgccttcggtttgctgaacacaggcccaggaacaaggcttgtgatcataaagaacctcagggtctgtggtgattgccatgatgccatcaagtacatctcgaagatcgcggaccgggagatcgtagtgcgagacgccaaacgcttccaccatttcaaagacggagtctgctcctgcagagattactggtgatgaaggtagcagtttcatctgaattttgaccaccagcgagaccacccactatttacatagtacttaggtagcaaggcagcaagataagttcactgtaacccctattggctattgccgcttttgttgtgcaggctaccgagaaccagcatggcaagaggatgcgtgttgctgtatgtatacccaactgatccccctaggcggggaccatcagaagaagttcagccacgcaaggcggccacgtccgtccgtccgtcacgggggacccggcggcgtggtagtggtgcggtgcccgtcgccttcgccattcccggccgcgggcgtcatctgtcgcggcgaaaacgacccgggaggtggcggcaaaggcttttgcttcctacccgctggggcgcgcgcgtcgccgtgatcggtacgaatctcgcggggggaagtggtggtggcccagacagatcgtgataacgttggactttgcgcgcaggtcgcgttggttggagtggtttgcggtctaggacacttgcttttttccccagtaggatgatcacccaagaccgctgcactgcacctgccccatgtgggagcagcatccagcatggccagttcgcaacgctacaccggtaacaacaagcccttagaaaactatttggcagtttggtgtctggtgctgatgaagtggtgattggggcctcagattagtcttttctgtgtttaactactgtgcatatgacagggaggaagcaaaaaggtttcttcgccgttgacttattacgggtgtggccagaagaaattcggcgtttggtttgctgtgcatatgtgtgagccatggtagttacatgctgtttctgtttccactggtatagtggtattgcccgtttcggtcccaggtgagtctgaactctgaagaccattttatctttcacaagattctgtaataatctggttggtggatgaaggcagtgttttcataaaagattcattaatttcgtggtgggatttagtgtgtccagtgtaatcatacagggttcatctcactgtctgccaacctttgtgttctaatttgaaaagaaacgaattgatattaggttttttttttccttaacaaaaaagtaccgaattggttgtccatgggcgattggctggcgatatgctcagatacatcgttgtcccccttttcgtggggatagcaaatatcggttgtatgacttcctcaatccaaaatgtggtcctttcaaagatggaaaattaagggtggtacctcacacattcgactagtcatatgctggaatctcgtcatgtgtatataccatgaaacacatttctgatttgccatccacattagcttgatatccaatcagttcttgtggagatcacctatatctaggattggtaaagagctataatctaggaaatttgagatttgatttaaaatgggttgagctaatttttacatatttttcatataaaaatatatgagagtgacccatgagtcttgcccattactacccctacctacatcctcagtagaattagtataccaacaactattggtttgtcacggactcaattttgcgggctatccatgtagagattattcatatccatgtttgcccctaccttttgtgttgttaaatagtacatgaacatatttatcaattattattatattgtaggttacataaactttatttttgtttgtggcaacgaaacgcaccaaaaacagaagttaaaaccactagattatagaaatgcattaccaaaggtggaatttattacatatttattggtgttatttctacctgtggttggccctccttttatgttattgcacatgcaattgaatatcttgtcagtttaccatgtgcatttacaattggtgactatgagcagaggacatgacaggaaagcaaggccactagaactctccacttgaaaaactagaataaaacaaaacaatgtaaccttctgatcatcgaaggtaaatctatttgaattgtgcaccctagtgttgaaaatcatgcttgataatgcatcctaggcaatgggtcattcagcaagccggctgcagcggctgcgctctgtgcgttcagcactgttggtgctgagtgcggcacagccgtgaaactagcaactgaacatgtccaatactatagagaccatttaattgtagcaatggaatgtatttataagtatatatggatgtaacattattccctactatctccaataccacgtggccatggtactagtagaagtgatattggataaatctatcacaaccacatagcttttcctgttcaacatggtgttatctctactgagacaacgccatcccaatactagtctaacgtcatatgatattgagtctagtgatagacacggaccctgataccagcgctacgtcaccgttcagctagcaaagaattccattttgtttagaatactcacctaacataagtttcacctatagcctttaatcctcattactaatttacaattatgttattgaaagtaggttcacctatagttacaccaaatggaatcggcaaaaactaaaaaatgtcgcatcattttctcctcctttttctccatgtgaccaaagaagaaacacctttaagttgtataggctacctagccatcgataatgaggcattcatgctgacttcatcgatctatacgtgtgtgcgcataaggatgagtgtacgtgtgttataagcgtctgcgtttatattgtatttttaaatagacaaaatcgaaaaggaagacctttgaaatacaaaatacatgaactcgaaggggtgtaatgctaaaaagtatagaaccctccaccacgaagcggccacgctcgagacgagacgaggtgaccccttcccttctcttccgtgcgtccggaaagcttcggtaggacgcttagcttggccgtcatcattaaccttcccaacctcccccacgcggccgccatcaccaccaccacctcctcccccccacctcccctcctccgatccctttcgcccgctcaaccacccgtcggccggcgatgctccggccgccgacgccgacgcggcgcctcctccagagcgtcggcggtgggagcaaccccaaccgcatccctggcatcccgcccgccgatcccccctccggcggcgtcagctccgatgtcgtcgtcatcctcgccgcctcctctgcgccctcatctgcgtcgtcggcctcgccgccgtcgcccgctgcgcccgtaaccgccgcaacagcggcggagccggcgccggc

SEQ ID NO: 66917 - DNA, 1981 bp, Oryza sativa
cggcggggcggtttggagcggcgcgacgacacgggcggcaggcgcgggcaggcgcggcagaggctgacggcggcggcgaccaggcggtcggccaccacggcacgcgcgcgcgggaagcaacgggcgacgcggtggttcgagtggcgcggctcgggcacgcgcgctggctcgcggggccgagcggctgcgcggctgcaggcgcggcagggcagcggggccgggcggcgaccacgcagctctcgcgcacgcgcgggcagagcgagggaggggcgctcggcgcggcgcacgcgcatgagcgcgcggcgcgcgggcagagcggaagagggagggggagagagagagagagcgccggggagggaggaggagatgggccgagagagattcggcccatcgaacccgggggaggcaaaatagacttttgcggaggaatttgatttggaaggatttggattcggaattgatctcgacgatagatcggggatttgagatcttgagatggcacggacactagacatcaagcaaagaaacaaattttgcaattagggtttttaagagataattttcccgctaggcgccacgacggaacgggcgctacaatactgtgccaggaagcccgagggttctccccgacaccaccccgttgaatccacatgtctcttggcatcatggttcccctgattagctaataactcagccaggggcgtcccattacacccatgtggtcgcaatgttgtatggtcggatgtaattccgaaggaatcggtccttaaatgcgaccgcacaagtattccacccaggaatggccttgtgtcgcgagtttcatttttaaaactcattttctttcacaaggcaccgactcaggcatcgggttttccaaagcttttgtaaaccaagttttacccaagaagttactcaaattttaagttggaaggcgaccgtcgatactcgcacagagtgcacgaattatcgaggcgcaactagatggttacaagggaacatgatataataatttacaatagaagttcaaatataggctcaatattttcaaaggtggcttgccttgctcagggtcttcacgaagcttcacaaatcttcgagaattccgcttgaagaaaaatatccagtaaccgcaactaggcgcaaacaatcaaaaacctaaaaaaagaccaaataaaatatcctatttaggctaattaatagtgccattagatatatcacaatttaatggaattattggaagtggaacggaggcaatcggacgaacggatcaagggatatgaattttggaagtttaaatgaatttttctgaacaaggagatgatttgtcggaattttctggaatacgggaaatggtttatggaatttatagaaataatattctcaagaatattattgacatccactgacatgcgggctcgaggggacgaattattggaatctccggattaagacattctctagaatatctttgactcattgacacgtggggccagcaaacggtggggaggatagatggacttttgtgtaagagaagtgatttggtggagggaggaaacatagacttcggttcatgggtggctgcaaggaaatggcccatggcctggcgggagagagtgagagaggatatgggccggctggtaggccgagctcacgagcgggagagggaagaggcggctgaccgagtcaagcagggccgggtggctgaggtggtggccacgtggttgtagcgcccgttccgtcgtggcgcctagcgggaaaattatctcttaaaaaccctaattgcgaaatttgtttctttgcttgttgtctagtgtccgtgccatttcagatctcaaatccccgatccatcgtcgagttcaatcccgaatcccaatccttcccaaatcaattcctccgcaaaagtctattttgcctcccccgagttcgatgggccgaatctctctcggcccatctccccctccctccccggctatctctctct

SEQ ID NO: 66918 - DNA, 3599 bp, Oryza sativa
tccgagttcggcgagcgggaggaggtccgcgtgatgccgcagtgcggccatggcttccacgtcgcctgcgtcgacacctggctccgatccaactcctcctgcccctcctgccgccgccccatcgtcctcgacgacccctcgccgcccaagcgctgccgcaagtgcgaggccatagtcctcgaggccgtcgtcgccgcctcctcctcctcctcctcctccgccgccaccgccaccggcagcggcggaggcggcggcggtggcggtggccgattcttgccgtagtgtagggaggatggttgtgtccctgacgggtggggcccaggtcggtgtgggtagttgagctgctcctttccacccatggcccacatgtcagtagagagagagctcttgaaaaagttttcttcagaaaaagaaatggaaaggagaataattagaacttgtgaatgaattgtgattctttttttacacctttttgggttccttccagcttctgtcgggggcatgacatcacatacagtcgttgttgatgtaatctgtaaaaaaaaaattatatcagttatggttggggtaaaaaaaaaagatttttactagacctaagtgtcttgcaaattttagcaaactaatcccatctgaaattatatcagttatgcagcatgagagtaatgatacttcccagctgagcagatgcatgccacgtggaggcatccgcagccgttggatgcgagaagagggagcgtgtgaagtggagtagccgggtggtctgcctcaggggcgttaggtcagtgacaataatcatcagtcgccatgtgaccgtgaggtttttgtcttccattaattggaacaacatggaacaaagccatatatcatatcaaagcaactaacagcgcttaaacaaaagcgtacttagatcccaaacctactccatttttactaactaactatacgtgctagcctcacccaataattggcgatcaatttagaagtagaaattttggagacgtccagctcagctcaccggctcgagtgtagcttagcgatttttgtaaacacgacgtgtcaagcggccagctcagtccaaagtcactagtggcagtgggagtatagcaatatggcgacccgctgaaaattccgtgtctcccgcgcataattgcctgtccgcgccgggacggcgcggcgagcgtgcgtgtgacaagtcaccaaccgcagtactagcctcttctccggctgtctccatcgcggcgcgctctccaccgccacggcgccaacagattttcttagagcccaaaaaaactactatattaaatatttgttataaatattttttttaaaaaaaaaacacaatacaagcatagacgctaaaaacgcgtgtacactcatatatacgagcagacacgcacgtactacccgtatgagtacctttaagaaattaaatcaatatatcttgagattgacgaagttactgcggaagtctcgctataccactaagaatagttagccgtaaatatgataaaggaataattagccgtaaatatgatcatactagtttaccttagtcaaaaaaaaatcacatgtttactggttagaatcactggttagtagatgtactcaaggttaaaaaaccaaatcacacacaataatcggaccggatgggttttctaaaacttttaacttattgagaaactgaactgtttgtgttgtcaaattggcctaagaagtgtggtttgttttttttttttgttggttttgtgaagtgtaaaccatggctgtacctccacgaggccaccagacatgtgggtggcacgagcgagcgtgagggagagggaaagacgtgtgcataaataaataaatggcgtcgtcaacggccacctgccgctgcccgccgcacgaaaccgtggtggtccgccgcgacggcgatcaggcaatgacgctacctccagctgcgcggcggccgccaacctatggcttgcccatttcttgcgtatttaaaggtaggggtggacattcggtcagaccgaaaaattcggtctcggtcttcggtttttcggtcttcggtctttgaaaactcaggaccgaatttcatccaaaaaaaactcaggaccggtaaattctgtctcggtcttttcggtctcggtctcggtctcggtctgaccaaaattttcaggagtaagtttgaaatgaaaaattttgacagcacttcctctcttttgagacatttcttcacagatatatatcaaaaaatacaagataatatgcaagaataaatagcacagccgcacaattacaggtgtagtagtagtttatagtttatgctacctgctagtactggagtagtagcgtctttttgttgttgccaatctttattttttaagcaaccactacaaacatcgaccagcggttgttgccctcttggatcaggtacaaacagaacgtgatggagatgttctcttcgattcaatcaatcttcggttccaagacctgatctaaccaactgcaatgcagctttgcaagtggagctccagtactacaagagtttctgaagtctcagctctgaaccaatactcccaccgtccaaaaaaaaaagaaaaatatgaattttttttataattagtatttttattattgttagatgataaaacatgattaatactttataacttgtctttttaattttttttatatttttttaagataagacggatgatcaaacgttagacacgaaaatctagagtttttttttcttttggacggagggagtacaccagagtccaacacagtttctgttgctccagcttgtccccaaactgcacattgctgcatgctgaacccacagcttcccaccatcatgcatcgctttaatttataagctgccactagaactcgaagcttttctgctgggacagtagcttttgggttccactctgacagctaacaaaattgaaattttattcacaaagtacttctcctactcctgaactcctttacaagagtgggcacaattcttttcctgggtatatggaactcaaagcattacctttgctttgcttctccttttctcccctttcacctttcaccatttctttttaccctgtgagcttgggtttttagtacttgatgaaatccaagcatcaatgaaagatgttcagcagagaggaaaccaattcagaactagtactcggctatgctaatattcagaactcacaaccgagagaagaaaacaaactcaagagtaaggcaaaaccagtaacacaactgtgatagaccactagttacagggagaagaattccaaagaaacacaaatggaaaatgaccaaaccaaaaggaacagatgatctacatatcctaagctccaaaatccagtctacgacaggattcagcctcatgatgtacagccaaatcatctctttaggctcactgcattttgatctcttccaagattctttaacaaagcatccatcacaggtttaacccgcagcgcgatttggaagcaacaaaattaccaccagcaatctgattgatcacttgatccgagcaactagtcctccttggcctgctttgctccgacagagaagaactcggtgatgacttcaagaggcatgcc

SEQ ID NO: 66919 - DNA, 556 bp, Oryza sativa
catgaatggaatctgttgagcagcttgcacccaaatgcccatttataacgttggcgtgtaaatatggtgagcggaactctcccggtacctcacaatcctacaattgtttacaggatcaacaaacaaaaaaaaccaccgtacggtagaacacccacccaattgtgcatgttcttttaaccatcacagcaagcttacatgatctgtggatgcagaactgtttgttgcatggtttacttatacccagtcttgaaatgttgcaagtgattgggagagatcatcgtacgccgtccgatcaacgatgtgccacgcagattgtgcaggagttatccctgccatattgcaaattagtggccgtcgctcaagtaaatctgggccgcaacttctggacctgaaagtcctcatggcccaaagggcgtctgctcatacacacacaggcctgcatgtctctcctcctcagtaacaaatgaaaaaacattgttaattcatatttaatgggattttgcttggaaacctagctcaaacatttatttaactgatggtgagtatggtactatgg

SEQ ID NO: 66920 - DNA, 15857 bp, Oryza sativa
ccctgatgaaaatcactatgcatacgtggaggtcaaactacgtccttacatatatgactttgggagcttctcaacttttggaggattcactatgaacagcatgtgtaaagggtatgagagtggcttaatagtcactactggagaaatgatctttggtgggtcggacgatttccacaatagtcccagttccaaaaagaaccgggacaaaagaggtttattagtcccaatttattactccaacgggactaagagataccaaccgggagtaaagatcatctttagtcccggtttggcctctgatagggcatgtcaaacccctgttggggggctagggaactaaagatcgtctcatcaaccaagactaaagatattgcagatctttagtttcggttggtgttaccaacagggactaaagttgtacaactttatatactccttcttcctcctccagcctgagccattgctacaaaatgaagctttgagggagggaggtgctgccaaaatttttagcaattttttttggtgttaatatacaaatttgaggtctctaaaacattagcaacttcatcctcctctattttttgcttagcatttacatttagagctatttttttacacatttttccatctagaaaatgtgatggaagatgatgagagagaaagtatgtgtagggaatatagaatatagacaatttgtttatttcgaattttataaatactagtttgaataattacatataattattgtatgaatgtttaattttaaaactaagttaatttaaaattaaaataagtacaacatattaaatatttatttacaaatttaaatataattaaaacatgaataatatgtggtattattatataataatgattgtatgaagaattatattcaattattatatcattatttaatgagtttgtattccgtgaattttatatatttatgatttatatgcatttcatgtagatggatcggcaatggatgtacgtggaccagcggttgaaagagtttattggcggcgtgcattattttttgggtgtggccaatgataacaagcataatgttttataagctgtccatgcaacaagtgcaaaaaacaaaaggtgtattccactgcacgaagtattcattcccacctgtttcagtgggggttcatgcgtagctacaatttttggacctcgcacggagagttaggggttgcaatggaagaagatgaagtagaagatgagtaaattacggactaggctcaatacgggggatttgaagaaaacacaatgggcgaggccgaggtggatgttgaaggtaatgacggtgctgataaacttggtcaaatgttgcgggacgtacaggaggactgcgaaagtgaaaaggaggtgcagaaactggagcgcatgttagcgaaccacagaacatcgttgtacccaggttgtgagcggggccacaaaaagtgggtaccaccctggaattcttgcaatggaaggctaaaaacggtgtgagtgacaaggcattcgcgagttattgaaactcgtaaagaacattcttccagaggggaaaaaattgcccgaaacaatgtacgaagctaagaagacagtctgccctctaggtctggaagtacagaagatacacgcatgtccaaacgattgtatcctgtatcgcggtgaggagtacaagaacctggaagcatgccctatttgcaaagcactacgatacaagattagacgagatgatccaggtgaagttgatggacagccttcgaagaagagaattcctgctaaggtgatgtgatatttccttataataccaaggctgaagcggttcttcaggaacaaatcacatgctagaatgatgcggtggcacgcagaagaacgtaaacaagacgggatactgagacacccgccgacgggtcatagtggcgaaatatcgacagaacatttaaagacttcggcgaggatgcacgaaacgtgagattcggtttaagcacggatggaatgaatccgtttggagagatgagcagtggccatagcacttggccggtcaccatgtgcatctacaatctccccccttggctatgcatgaagcggaagtacatcatgatgccgattattatttaagacccgaagcaacctggtaacgacagtgaggtgtacctaagaccattcgttgaagatttgaaagtgctatggaggaaagagggtgtccccgtgtgggatgaggacaagcaggagtatattgaatcacttttttgttctaaattagatatgcatattaaatctctcgttgtttctccttcagtgtgcaaagcgggatcaggggactaacttgtgtggctactatgtatactagtatatgcactgcctagcacaccaaatcaggactggctaggacctagaagtacataaaattattcatccattaattattgctccattagcttattggtttcatatatataatcccatttttttcaaatgactgatgatttacatgatagagaacctcacccatgatgatttcataagggttgttcaacaacaaatgatgggattcatcaacaagcagattctcgctcccacaggagaattatataacgatggaaagcctattcatcaagccggtccttcttccgatctcacgaagtcgtagtatatgacaaaaacaaaaattacaaagtccgaaggaattgtcatacatgtatatatttatatatgcacacatgcatttacttttgtgtgtacttattttggtaatatatgtgtatatttacttaggtgcaaactcatattttgttaatatatgcatatggcctctacttacttaagtgcatatatgtgtatattatatgtatttctacatatgtatgcaaattgcatatatatgtgtaaaaacatatagtacacatatatgcacttaaataaatataggccatatttacttaagtgcatatacatatatgtgcatatacatatatatatgcatagatacatatagtgtacacatatatcactacaagaaatatgaccttctgtgacgaatttctcgtgacgtcggagctattcgtcattagcacatttcgttttatgacgattagtatgagatggggtggcttagtgacgaaaaaaagatgttcgttgttaataccaactagaaatcgtcataaagtattgggacatcatgaagaatattaatttgtcatatatttatataatgcattaaatatattaaaagttaaagcaatttaatcaagtgaattaatgaagaaactaaaattttcatataaaaatcatggccgaaaatatttttttaatatcctacgtgggctaaattatactctaaaattttccgtgaattttagaagctcaataactaattttaataccacaaagtttatttaacctattaaaataaatagaaaacaaattaaaatcactcacttggtccttgggcctttttcggcccaagtattactctctccctccctcaacccacagcctctctttccctcttgggccgacttccccttcccctcctcgctcttgggccgccagcccaaccccttttgcttctccctcaccgaaaagtctattttgcctctctcctttcaattcaaataatttttcgggtagtaaatgatttcagatgaaaacaatgtcaataacaaagttgtataacttatcaagatctataacttttgttttggtcattttgctatatgactttgttttaataatttgaatttgaatatcaaattatgacaacttcaaacaacattttcaagtactaaatgatttcaaatgaaaaatttattaacaacaaagttgtataactcattaatatctacaacattttatgtgtttgtgacgtaaatgaaacgtcacctatcataagatctcttgtagttatgtatatgtgtaatatatacatttttatattatgcatatatatgtatttaaacatatatatgcatatatgtataggcagcacacagcacaaccaaattaaaaaaaataaaaaaaatatctttagttccggttgataacaccaaccgggaagtggctgagccatctttagtcccggatggtgttactaatcgagactaaagatggagctttactcccgggtatttgaaccgagactaaagaccaccatctttagtcttggattctccctcctagttcgctacccgggagtaaagggggttgcgaaccgggagagatgaggagttctccagtagtgagtgttacactatgaacaacatgtgtaacttttggagcttctcaacttttttttggcttatgtgagatataggtatgactccactactaaatttaggatattaaatccaccgacttatgaatcatataagccaataagggccttatcggatggcatgaagctttggctgatcagctaaatctgccaaattcaattcagccaaagaaaaaccattgtttggcttattttgcttatatggctggtgaaggattttctatggctggtggtattgggatttttattttctgtgtatgttcactagagagtttccataattagccacgactgatgatccaactcccttgcgggtcccacttgtttggctgaaaagcctcagcccaagcctcagccaaacaagccatccgatgagaccctaagctaacttaaaacctaagctaataagtctaagcctaaataacgaggctttatatagttagcattgttacatttgtgattattgtacttgtgaaagtacatgagtattgattatatgtgtcgaggaatgatcctctctagcgggtgatcgtgagacaccccttttgtgagttcggccgggggaaagggcgcgttgataaggatcgtatgtccgcctagagtcttccgagaccgcgcgtgagagctgggattatacaggttcgggccgctacggagcgtaataccctactcctgtgtgtgggatttaggatggagtgttacaaaggttcctaaactccagggagaactctaactcttcttcccctggggctcaggctaactgagagtcgtcccctcctctcggtgaggaaggtcctccttttatagttcaaggggataccacatgcaccgcctctacctactccttcacgggagggggacccacaccgcctgggtcataccgccattcgtgccttcgcccggaagctaagcagccgtctgtccttgagtgggacccagcgtcgtcccccgcctgacacgagggacgcccttgtcattcccctttaaaagaatggagacttttggcggttcacctcacgtggagggagctcctgacggtacattgatgggatggagcataactgcccccactttgctgagcacagggtggaacgtgggggcaccgccgctcgtccgatcggatgtgaccggtcacagaccggtcacaatccggtcaatcgggcagtgctgcacgaccgccctcaccgcattaaatgtggcgagggacggttggggcaccgcgcattgatggcggtccagcttcgaccaccgccccactcactcccctgccacgtggcggccggatgagggcctcggggagaggcaacccgagggcccaaggggcgcgacgtggcatcccgaggccccctggctgcctcaacgtcgtccgaggtgcggggggagggcaaggctgcatggccgcgtggctggatgggaaggagacttccctacacttcgcatacccccgggaccatatcaccgacagtagcccctggaaccgcgtcggacagtggtcctctgagggcggtctagcgcggtgcctcatgacttcccgtgccatgactgtgggccccgcggggagtcaaaacggccgccgccggctggcccggctcgtgcatcagccatgatgacgacttgaccgctactaattgcgccactcacggtggtacttagggcgcgaaaatcgggggctctgccagaccacacccagaattatcactcgacgtcgcctcgactcccccgcttcttaggcaagcgatgggactaacggtgggcccgcctagccacaaccgtggtcatcgcacgccccgcgccgagtgcgccactggcaggcgcattaaatgcggggcgcgggattagtggggcggacgggacgagtgggcgcgagaaccgaggaggcaaccacagcggcgagaaacgaggaggcgggcgcgggcgaggcgtggataaaaaggaagagaggcagagagttcgtctccttcctttcgctgactccacactcgcatactcacaccttagcccccagcgcttctcttcctccatcgtgttccgtgcgccaaactcctcgccgattcccgccggctatcatggcccaagacgctggcaacgccgttctcccggcatcgcacattacggcggagaggcaccttagcctcatatgcaagatcatgccggaggatgccgccgtgagggcaggggagacgcggccgcggccgcggtacctggagcggtccgtgcacctcctgtcctttgccatggcggggttgatcccgccgctctctaggttcttctacgaggtcttggatttctacgagatccatgccttgcatctcgctcccaacgctgtgatgacgctggccatgttcgcgcacctgtgcgagatgttcgtcgaggtgcggccaacgttgtgactgttccagttcttcttcgtcccacagctgcagcaaggcgcggtggtgggaggatgctacttccagccccggccaggagtggcggggcagtacatcgagagtcacctccgcaagaagtgggaggactggaagaaggactagttctacaccgtgctgctggaccaccagcgcctccggccccccgctgatcctcccgaacgatctacaggctggctggcggtctcggagctgggcaaggagtacgacgcggtgcgggatcgcctcaggggcctgcgaagccggggcctaacgacggcgatggtgttcggcgactatttccgtcgtcgcatcacgcctctccaggagtggtcccgcggcacgtgggagtataccgggtacatcgaccccatgcgcacccaagtgggcgagcgctgggattggggcgaggaggacgcgaagacggtggttcggcgggtgctgggcctggacaccatcgaacaaatgctggttctggatgggatcctccctctctgcagtgaccccgaccgagggaatatcctggctgtgatgacggctgtcggcgctggtaggggtcggccccgccggggcgccgttggcggcggtggcagtgacggcgtaggtagcagcagtgtgaccgcgggtggcagtcggaccggcggctccggcaggggtggcagctccaggacgcctgatctgagccgtgggcccggggggactcggccgtcgacccgaaagggaagcggaagatgtctgagtctcagccgccctcccccccccacccccccgcacggagggggagccgagcaaacagtcgaccgatcaccaatgggccataaacgccccgccgcgcctgaggcagggcggaagaagaagcggctctagaagatagggcagacagagccgtgtcgggggagcttcgtcgagcctccgaagtggacgttcaaacgcccccttcgcaggtacggtcatcaatgcccggcccgatgctctccatccactttagcttcttgcttcttcctcttttttactttcttaacgcaactagggttctcctgtagcgagattccttcccaaggggcctcggcgttcgaacacccccaggggtcgaagcccgagcgaccgggacagccgggatctggctgatccggtgctgcggagcctttgcagccccccggcgtgcggcccgcgggccgcccgccgggtccagctccgagtccaccacggccgagaccgccccctcgagggaggagggggcgcaattcgccgtgggcgatagcggcaccgaagcacccatctggggcgatcccgagggtgcaacctacgaggagcgctgctcgggagcggagaccgaggcaggacgcggcccggaggtcgagacgggacgcgcaccgggggccgaggtggggcgtggcccggagaccgaggctgggcgcgggcctgagcctgaggccgaggctgaatcggctcgggggcccaaggcggagggcgacggcagcaaccgttctgctctgcacctggggcgccctccgggccggccacgcggaagggggactgtcgcgaccgggaaaattgccttttcccgaacgctagtgtattaatccccgtcccaggaaaagccggggtacaccatacaaacatgatataaaagacacatctttattatatcgataatatttacattattacaaaggcacttagggcctgacaatcaaaaataaacggcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcagatgcatgattaatgcaagggaggtacaagggaataataatatagggattaagttttgcagtaaacagcatttaaaagtcacttagttgcccaaagccattttgtaaagacgattctagagctacacagtgttattaaacaaggccgtgaaccctcacgaacctgccttaacccaaggcctacgatgatttggaccgaactggcaacccgacctgggttccagctcgtcccaagccaacccaggccaaccattccatattttagttgttgagcaaattttaagaattaaaacactgacttgggtacattgctcggcttgcccatatccgagggctcggctattcgaatagatttactctgatcagaggtgtacatctttacccacaagacacatctttactccgcattccatggccttggaacccgtcgtaaagatgtgacatagtttccaacccatcctagccttagacaagagtaccgacccaatcccacctacggccgggatacccgggacaggcaggcagaactgagcccctagcagcagggcaccaaccctctgccgtatgacatctcgactaccgggccgcagctcgtgtagccttcatttgccctggagaatgtccatcgacgcccgacttcatccatctccaatccgtgtacttttgtttacgactagactgagccacaaactaagccttacccattagacatgtggaagtacggtagtgctttgcaacagaggcccgagcttcatccttatagtggccggggtgctacttcccacaactggcatgcacccaaaccccaccgaaaacaggttttaggggttttgaaagaggaagagaggtgtatgtccaattccaccatcaaccaataattccatagtgtccaaatgatatgagacttcccaaagtctaaagttataaaaccacctaatgttgcctaattaaccagcgaagcatctacctaagttcatactagtggaaccataaatagagtactcactagttggggttttgtttaacctagggtgaacaaagtaataataacaataacaataataataaggtcataacaaaggtaaataggtatggctagataaaacagtgataacgcgggaatttaaataaagcggtaatgcaataatttaaatcaacataattttacaaactgggattcaatatgatcaaggatgatgtgacttgccttgctcactttcccaaacgccggcttcaacttccacgaagagcggatcttccgaagctgcagcgtctacacgaccaacggaaaagaaaaggcttttactctaataaactccatacaacaagcaggaacaaagcacaaaaatgggttctttacttcttaaggaaaaaattagagacttgaacggtccaattccgagttcaaatggccaagatatggccatttgaagtttatatgctctttaaatggatatttacgaatttcttcatttaattttcaattaaaaaatcctatttattgcgtcagccgagggagcgggcgcgcggaccgggtccacgggaagtggggcccacgcgtcagccccacggtccacggtggactgggcgcacgcggctggcggcggtcggcgccgtgggtcccgcgcgtcagccgcacccgcgggcgcgggcggctgacggccgggcccacttggcagccgcgagggcgcgcccgaaggcggcctcgccggcacggccgacgggagggggacgcgcccgcgccccgatggtcaccgccggcgaccaccggcgcggcggagcggcacccgagagagaggagggaagggggaaacgaacggagcggtccacggctcaccccgagacagcgaaggcggcggaaacgacggccggagcggaggaagacggcggcgcggttcgggatgacgagggcgacggtgctccggcggtcggcgggcgaaacgaaggggcggacggagtcggcgacgacgcggcgaagccgatggaggtggcgccgagtcgggaagaggtccggagcggcgacggcggcgaaccgaaggtcggcggcgacggcggagagagaggtgaacggcgcgagcacgaatccgacggcgagagcgagcggtgagcggcggaaacggaagagcggagcacgggcaacgtttttatagcgccgagagggggagagcgcggccggagaggaaggaaaccggcgcggagatctcggccgccattgaagacgccggcgacgattgcgggatgaatccggacgaatccgagggagagagagagaggggaaaacgggggaaacgggagagggaatcgcggggaataattccccccacttcaatgcgcgcggggacggcgggatgcggcggattcgcggcggcggcggcgctagggcacgggcgggcggcgggcgcggcgcgaggtcggggatgacaggtgggccccacccgtcagcgagggtggcgggcgggcccgcctgtcagcggcgcgcgcgcgggggaggagccgatgggccgcgggggaagagagagagagagggactgggccgagccggcccaagagggaagggggggggaaaggacttttagggattttctttttataaaacctttttaactttgtttatttcttctcaattattatttgtgctctgaaaattccactaaaatttgagggctccttttagaccaaggagaatttaacaaaaattctccgggccacattcgaatttttcttatacgtattttaatgtttgccaatttcttttcgaattttaattaattctattattccttttagaagatgatttttattttgggatgaatttatcaggacgtgacaaatccaccccccttacaagaatctcgtccccgagattcgaggaggctagcaagaagataggttgggcggtcttctcttcttgtctgacttcttccgttacgtcttgacaaacttccagcaaaacttcaccactcggaactgcttggcttgacctcctgttgcggatggaatcttctcttcacctgacttggaccagggtgcaccttttggctgactcagactaggttgcggtagtgcagtgatgcttccgttccagaacttcttatgattcatatcttcggagtcaacctcagacaagtcaccacttcatgtcatgcgtcaacactagcttgtcattactaggataccatgcttgtcatcataaggatatcaggcttggcgtttccttccagcttaccaccatacgctttagactatgatatcccgcttactacggatatcatgattgacaacttgccattaactgtctcatattggctttcctggtctccagtgctaggtacttctgctattcgatgccagggtcaaccattctaactataagttatgcttcccaagagaaccaatttatcccgcttgacatgctttgacgtcttcccgaatgactttgctgctggacttgttattgtctgatcgtggtcctgccagacctgaagcttcgttgttggaggtgattttaatctgacctctgtagactatcttcgatcatatcacttggttcataactgggaatagctcccacgaacaagcaacgcagattcactttctttatgttcagtttacttcccattattatcttcaggttgtcctcagttagcattcaacgtattcctttacacctttaaccttgatgtgttctttcccattggatcatctcccaagacatggcattacctggtaaccggtgcttgcacttttcactccgtgtagcatctgataccgagttgaagatttcactccttgccttcatagaaacatttttacctagatcatctcgcttacttaatgacaaggtgactgttgcggggcaattactatcaggggtcgtccttgagcgatgcagagcatgtttctgtttatcaatcacctttcggcctacttctttcatgctagagaacatctttgccaatctcttttatcaatcatctttcggcttatctctaacaggtggtattctttaatgtggattgcggacgcttctggggacgatgaggtcctttggcttgctgcctttcagtgaaaccttgatgtggtgcgtcaaaagctgcactgactaccttcagggaaatacattgcctgctatctgtatctataccactagggtttaattgccgatggtcatctttagtgcttcctcgagatggggagcatccaaattgttcttctgccacatcacctttgacctttttctgataccagataaactaattaccaaccatcgactattatgttctcaaatattgatgtctcctggatctccttaactgttggcaggtatatccgatcttatcaatgtagaggcatggcgggtacccttaggggtttcctccaacaatccttatcttgatctgtaaaaggcgtatccaaactcctatcctcaactactgtctcgttggctttttaacccaacacagtttaattgtttttcttttctatccacaggttggttattaactcgaggttagaatatagttcctctgacacgagaccctaggtctcctttgtcagtaaacaattatacacatgatcacatatccgcatctttcaaacgaatcctcagggaacttgtctgtattacacatttctcccttattacacgaatacaaggcactgccttaaacaaaaagggaaggtgcttatcatcggtacattgtatcctcaacatgaatcatctctaaacatagcaagctcactgtttacagacatgattatatttatgaattacatgattgctgcaaactttcgattacaccatgataagtagcgaactaaaaaccacaaacatggctgctcattttgattctggagagatatagctggcattgttctagtgactgcatccttgattggttctgtgatgatgtgacaggactgcataatgctatcattcacaggagaagcttccttctgattgctggttgaagcggatgacggtcttctgcttggtatcgccctccggaggttgattgcccttggctcggcctggagtaggtcggggagagacacaacttcttccatctacgacaattctttgctgaggctgtcggtgcagagaatggttgctatgatttattgtcgagtcaggtgcagcaggaggagcattggtgcattgtttctgctatgggttctgattaacacgaggccttacgggtacggcgtttgctccagtgaccacaatacgattggaatgtctgcttcgtgtaaattggcggtaatgtggaggtcgattttgccttggttggggacagtttttggagtaatgcccttcttcactgcagttgtaacaaacaataactttcttacactcgggttcttcatcttgtacttgatttctcagctgctgtattggaacttctaaaggtacaacgcagatactggcctctgtcttgtcagctggtggctggggctgaaattgagcattgacaccttgtggtagtgcactcattggagttggagctgttgcaacgcgggctataggactgcttcgggatgcatggatgacaattcgttgaggagcaagcttctgattgcagggagttgcgtggactgacgtgccggcagctatgtttctcggttttgggcacttgtcggcgaaatgacccattccttgacaattgaagcaacagatgtcttcccggactcggcattttcttttctcatttcgattcctctgtcctggcactggagttaggctgaaactggaatcttggcgaggatttgtgtttccttgatgcttctctccgttggaactggcgggttggttggccatcttcttcgttagcagaaaactgaatcgacaatcttttggtacatgatcagttccttctcaaaggaaacaagtgatcctgctcgttggacacctgtcgggtggatggtcttcctcacaatgaacgcatgtagaggcacacgagctggcaacatgaccgatttctccacaacgagagcatgccttaagttctattttattctggttaaaaccttggggaggcttcgcaccttcatcatctgaggagacttgatctgaatcttcactatcagacactctacctccattagctaaaagatgctctgtcaactgttgtgcacctcggaaggaatttcttctctgatgttttgtcattcctggtggaggccattctgtgctggtaatgatcatcttacggacttcatcttcggttcgcattggtgcttttcttttctgctgaggacagttccttgcatagtgcccttgctcatcacacctaaaacagatgatacttgcttcttttgagtcaacatgtggcatggcatgaggggccttctgggatgttggcggtgcgctgacttgtggtgtgagtgcttggactgcctccaactgcacttgaggttgcatctgactcgggttcaaagttggcatccgatgctgctgtagtatttctataagcaatttgttctggttaatcaggtgttggaccactgccgcacaactggtgtctggtgcttcattcactcgggagcttgaggtaccaatgtcctgacttctgaccttattgcctttctcattgtcagccatctgttgcaaaggtttggagagggagagagggaaaacaaaggggagagacagattagaaactaaggataggaccttaacagatctaagtcttttgctgttatgatgtatgttaggcttattctgcaagttgattaagcaaacaacctagcatggttacatcacaccccactgatgcaaaccacgcgctacacacacaagcaaggaaacacacgactaacgactctaccctagagggtggcttaggttctgcgacgggttctccaagatcttcactcctgcttcacagctggcttcactgcttcctccacttcactagcagatcctgcagtcttctggagcttcggcaaacaactgacgatgtcttcttcttcgcaaagctgaccatctagtactagttgaaaatccgaagaaagaaaagagtaaaccttttgcaaatagcattaggggaaggagaaaaagaggaactttcgcaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccatacaaacatgatataaaagacacatctttattatatcgataatatttacattattacaaaggcacttagggcctgacaatcaaaa

SEQ ID NO: 66921 - DNA, 13744 bp, Oryza sativa
tccaagggacggaggcagagcccctcctccctctggctcgtcgcccccgctcccctcctccttttcccaaagaggcaaggggcgagccccctttctctccctccttttcccctttttcctcccgccggcgtcatcctccctccgccctgtcgccgatttggccgctagccggagcgccagctcgctggcttgaccgtccaaagtcggttcccctctcccaaaccgacattgccatcctataaagcccaggcgccctccctcccttctcctctcgttgtcccatcgcctccactccattgttgctgcccctctgtttcgccgtcaccgttcgtcgttgcgcgtgtcagaggagccggcacgagcgaggacgcggaaggggactccgggcgcgccctctccttcctcttccccggcccgaggccagagagattactcccgcgccgttggcttctcgtcactgcgcccgcccgcacggtagtgcctccctccgttcttcctcctcgttccatctcctccccttagactcgagtagtagcacgagtagcctccccgtagctagccggcgccgccccgaccgttgccgtcgctcgccgtgtactcgccgccgtcgccgcccgagctcggaagcgcctctcgtcgccggcctccctcgatgcgtttcctcctaatccggaacaagggacggattcccgtagccgcgtagatgctctcgccaccgggaatcggcccctcgtgacctcgtcgccttttccctcttccctccccgccggttgccgccgccgcaatccgccgtcgacgcactccctccggcgaatccgagccgttggctcgtctcccctcgtcctgagcaaccacccggtgtgctcgctttcgcctgtatcgccgtggttcgctccgccgctcgccgctgtcgtccgccgtccgttccggccggcgtagtcgtcaacctcccgccggcccgcgtggcagccacgtaggcgccacgtaggcgccacgtcggcgccagctcggccaagaccgggtcgagccgaccccggtcagcccctccccgtgcgcgcgttccaccgcgagccgtgaggctgcgcgtaggcccgccgcatccgtgtccaccgcgaaccgcgcgcgtgcgccgcgtccctcccccgcccgcgcgcgtgcgccgcgtgctcgctccgcacggtgaaccgtgtcactgacaagcgggtcccacccgggaccacgcgtggtgagcctggtccaccggctctctctctcctcccctcccgcgcgcgcgtgcttgggccgccttgggccggccggcccatttagctcggccgaaccgctccatttctctcgggccgcgccctagccgcccgaggaaagtctaatttccctccctcttttattttcttttctttttttttcaaaaaggatttaattaaatccttttcctttagaccaaaaatccaataatcttagaaattcaatatcttcccaaccataaatccgtttgactccgttcaacttccaaaattcctcaaatctcgagatctatctaatgtcacgcttagaggtcattaatagggctttattttcgctgtttgttaagttgtcccgtttcgcgtgtagtttcggagcccgaagacccgcagtgcgaggatttcgaggatcaagctcaagatctcgagcaaggcaagccacctttgaacatctttagcctatatttgaacttaattatgttgcttgaaaaatattatgcattgataggatcgcacttaatctgtttgtcccgtctgcaaggcagattggtggacctacctagtttgttgcatttgacccttcctttgttaattgctataccatgttcccttgtaaccatctagttgcgcctcgatattcgtgcactctgtgcgagtaactccttgggtaaaacttgctttactaaagacttggaaaacccgacacctgggtcggtgcttgcgaactaaatgaatttccaaaaccgcggaccggggaatgtaccgggtgtacggttttctgctctcgcacctaaggaccgtttccttggaatttcatccgaatataagacaagtacgaccacatgggtggaatgggacacccctggctgagtaactagcttatcaggggagccttgatgccgggagacatgtggattcgccggggtggtgtcggggaggacccctgggcttcctggcacagtatggtctgggacctaacctgttgttggtctgggacccctctcgtcggcatatggtaaacctgtgtccgctttggaaatgccttgtcatgaaagcttggaggtctcccgacgtggctgatccccacgggctgggtgatccgggttagtaatgtcgtgtgggtaaattgtaccccctctgcagaggttaacaaactattcgaacagccgtgcccacggtcatgggcggatgtgaggtgattcctagcgtagttttgtttgactactgctttgcgaaattgctgttgtggaatgggttcgatgtttgaaaaacctgcagctgatgggatcagctaggcccgggtggccgtttgaaagttgttggcccgggtggccgtttggaagctgttagccgggtgccaaccttgaatcaattctaaagactgatacattgcacatactccgaccggacgagacgcactgtctcatccgtgtcgtttgagaagcactcacttagttgttttcagaaaagagttcaaataaaatcaattgcaaaaacaacagccttccttgaagcctgcattaaacacttatttcccatggcttgctgagtactcccgtactcacccttgctctatataaataatcacccccccagttggtgaagaagatgaagcggatcctgctgataaggagttcttccaggagcaagccggctacgatgagttttagggtttcggcctagttcccaagtcgcgcctgtgttgtttggcccaagtcttggcttccgtttcccttttgtaatgcagttgtgagctcaggatctgtccgcagcccaacatgactgtattcctactctataataaagagacctctgttgctgtgatattccgtcttcctgtgataccagcactgtttcctgggactggtatcgattaacaggttaatttggagcgtcacgggctagttccggtcggtactagttcggggcgtgacagtggtcgtcacgctggcaggagatagggggagaggaggagcgcgtccggagatcggacggctcacggcggcgcaacggcgccagcgagcggcagcgagccagagggaggggacggcgccggaggcaaaaggaggagaaggtgaactcattccacggctcggattagggcgccggggtcggagggggccggcgacggcgtccggcggcggcggcgggagcggcacggcgcgggcgcagaggccgaggctagcgactgcggcgacacttctgggaggtcccaggggtcacggggatggcggcggcgtcgggaatcaaagagaggagggaggccaacggcggtgcgcgaccgtgcgcacgacggcggtggaaaggacggcacggcgcaggagcaaaagaggaggccagcgggcggagcgacggttttggggtggctcaaggggactcaaggagggtggcggcgcaaggtacggcgagaggagagagaggccgacagcggcggaaaatagagccacggcgaggtgagcagctagaagatgtaggggaaggatttaggctcggggctcaccggcaagaggaaatgacgtcggcggcgattttgtggtgggagagggaaggccgacgggggagtgcggccgggatttccgaaggcggcggcgaatcgggaccaacgcggtatccggaaatatggggacagggcagggcggcacagacgggttttgcggtgaggtggcaacgaccgtcgttcggccaaggaaggagaaggacgcggcgaggatggaacgactcgacggcgagatgcctccggacatggagctcgacgcggcggccaggagttcccatggcggcagagcttcgccgcttgggggaaacgaagcaaggggaggaggaagcacggggtggtttttatagagggggtgtgggagcgtcaaggtcggttcgggggagcatgcgagctggcgctcggccggcgttcactggcgacgtcggcgttttcgtgggcggcacgaaacagcggatggcgcggatgcgttgggcagtggaggcggtggatcgtgcggtgggaatcgaaccgcgagcacgggctggcacggctcggcgtggtcaaggtggggcatggcgacctggcgcgcggcgtcaggggcactcgctaccatggcgctagatgccaagcggtggaggcaggacgtcggttcgggagagaaaaaagggaaaaggagggagaaaaggggagcttgctccatgccgctttgggaaaaaggtgaaggaggaagagagggcgagaccgagcgctggctctcgcccttggacgcatgcgcgcagagcagcggggccgagcggcagcgcgggcacgggcggcgtcgaggctaacgcggcggcgaccgagcgtcgagcgcgcgcgcgggggaaaccgacgggcgaaatcaaacggcggcggcggaaatcggcgctagggagaggagttcgacgagagagagagagagaggaaggagaggagagaggcgctgcttctctcgctcggcgcgtgcagagcacgtgcgtgcggggaggaggaggagcggccgagaggagacgatgggccggaaaagggaaaaacggcccaacgaccaagagggaggtgaaatagactttttcaagggaatttcttcaaggaatttgaggagcatttgacattggatttgaattcaaattggatatttgaactcaacaaaatatggagaagccaaggaggggattcaaagagcgaattcgatactttcggaaatgggaaggaatttcgatgaggcgtgattttcgatgtcgatgggtggttgaagttcaaagcgagaattgatattttagggatatatttgtatttggcagctcaaggattatttgagagggaatcaaaaggagaaatcaatgttcggggtgaaacaaaggaggtggcggtagaatacgatagataaagcgagggagacgaggagagggggacgcttggatgttagagctagctcaaggagggaatttgattggagaggttttagggttggagtctggttttggattccggaattaggcgatatctgtggttagggtttctacagtgaaatccgaatagaaggattcaaacttcgagattattttggaacggaaattttgaggaggtgatctttgatatcagggtattgagacaagagagggattttaaattgagatctatggcacaacttagactcaacactcaaagaactaaattttcgcaattaggatttttgtacattagctttttaacgccacgtgaaaagcggagcgttatatgagccaactatcgcggcagctgcagactgacaagagtttcttgctccttgtgtcgaacatgaccatccatgttctcttgatgtggcagtatcttcttcttcttccctcgaattctcgctcctgcaccatgaagcagatgagatggggatcgtccatgcttgcgacggggaatattggtttggcttgtgggaggccagcgcaggcatggagagaccagagctcggtggcgtcgaccatggcgtccatcgtccaaaccatgtcgtcgtcgtcgtccatcctgagtatccaggtcttgatgatgaaggcctccttggaattgtcgcagaaggttgtgccggggaggccgcagcaacagcgggagatgatgtagatgaacttgagcgcggcgccgccgtcggtggcacaaactcttcggtccgtaatggcgtaatcccgcttgtagccgtcgtcggtttcatcggtgagggcctcggggggaagtggcacgaaccgcagctgtggattctggtcgaacacgtcgtcgcagaggatgatgccgcggtacaggtcggcccagcacatccgccgctcgctgacggggatggccatgtcagtgatccacgacggcggcttgtcggctctaccgacgaagtgggcgaccggcgcccgcgtgacggtccactcgccggagcggagaacgaggagctcggcgtccccctcctcctccagcccgtggccctctagcacggcgagatccaccaccaccatgtcgtcgtcgccgcggcgtaggaggccggtggtcttctcatccagatggtgatgaatctgatgatggtggcgcggccaggtttcactctcttcttcatatgcttgccattcttcacattcttcatcgtccgctgctttggtgacgtaggcagggagcagcgacagcgatggcggctgtggcggccgggtcggcggcgacggcgccggcgttgtagacgaagtaatcgagcacgccgacatcgccgtacccgcgtcctccgtagctcaaccggacgagcacggagtcgccgtgggtagccacgacgatcaggctggcgccccggtggatgcgcgggaagcagtcgaaacatacgcgcgacgaagccggcggcgcatcgaggaagagtgagacacggacgaggtggccgccggaggagacggaggtcgtctcggtcttgtcgtccggggtggacaagggtggagaggagtcgtcgccgttgcggctgagtatcacacaccgtgggtagccggcgccggcggtgacgccggtccgccgtcggttgggtctccatgaccgtggcgatcgagaggatatcgatctcgatttgatcttcacgtacacggagatttgcttcgtccgttttttaatttttaaaacaaaaaacgcggttgggtcggactacaattggtatccacctccactactacacaaacctagataggtatcggttggaaacccgactaggtgccggatttttcaaccgacactaaaaaagtggcacagatgatagaaatcaaaggtgccggtttggaaccggcatctttgagatcctaaaaatcccaaaaaaaaaactggctcaatacatcggttcgaatcgcaacgccccccttcacccaacatttagttcatagaattaattggcttcaagaattcaaaaggaaaaagtacgaattacccccccccccccgaactatcgtggtcgaccgaattaccccctaaatccgaaaatcagacattgttcaccctcaacttctaatacccgacaaattacctcccctcggcccaatccagagcggttttgtcatacatggtgtacacaaacctacaattggtatccaactccactactacacaaacctagataggtgtcggttggaaacccaactaggtgccggataacctgaaaagtggcacagatgatagaaatcaaaggtgtcagttctaaaacggacacctttaagatcccaaaaatctaaaagaaaagtggatcaattcatcggcttgaatcgtggtgcccccctcacccaattttacccaacatttaattcatagaattaattggcttcaagaattcaaaaacatcgatccaagaacatcaacacaaatgcaaagcacaaagaagatggagaggatggacaacagcctccgtggagaggatggagctgcagatgagcaacacagctcatcagcaatgacaaagaagcggatcccgcagcacgttggaaggcgtcgtctgccgccgccaccactatcgctgcctgcctcctaccgccgcacgttgctgtcgtcatctcccctcccgccggatctggcggaggggagggcaccacccaaaacgctgtcgcctctcctcccgccgcaacacgccattgccgccgcctacctcctgtcgccacacgtagctgccgtcgcatctcctcccattggatttggcggagggggtggcgccgccagccactgccgcctctcctcccattgccgttgttgttgcgactaagagtgccgaaagagagagagaggggggaacctagagagagagagagagagccaagagagaagggtggatgaggaagagatgaggaggagaggatgcggtggatgagaaggtgtggtgcggttcggcttggctcgatttaagggtggcgttatttttaaaaaagccgatacctataatatattataagtgtcagtttttcatctatattatatgtggaatgtgccggtttattttttaaccgacgcctatagtaaatgtgttagtttttttgtgttttcagctcacagaggtggaagaagatgagttagcacaattagctaaaagaatagctacagtatggaaattgcaaacaattgttatttttttctcgttaattaatcataaaatatcctaaaataaaaactatattatacgagaattaagctgctcgatttagcgcaattaatcaaccaaacagcaatgcacacagtcacacacttaatgtactacaaaaagtatttcacacattttgcatgtctgctctacatgcacaacaaaccgaacaggcttcactagccttaatctccatcaacagccatggcttcctcagactcattgggagccccaaaagtgaactgagccggcggccattattgtcataacaaagcaagctatacgctctcagcaaatcatcacgagacaactccggtatctcttggagaagagccaaaatctccttaggagaattgaccttggaatttttggcagatgactcgcatgaagattgcaatgaatcattagcgatgatattattttttgttgccaccttatcatcgatgatcatcagtgccggctttgttacatcattgttgaaccccccatcatcagaagaattaaagcagtgagagaccgtgctaacaaagtaagcatatccataagacaattgaagcgagcttgactcatcgagacggcagactgacatcaatgttttgctgcttgtgtcgagcatgatgtaccacgattgcatttttcttccaatcttgtgttcttcgggcacttggaagcatatgatatcagggtcatccatgctcacgatggggaattgtggattgatgcgtgggacgccggcgtaggcgtcgagggaccagagctcggtggcgtcgaccatggcgtccatggtccaataagctgccatgtcatcatcgtcgccgtccatatgtagtgtccatgtgttgatgacgaagacaccgctggaatggtcgcactgcgttgcgccgcggcggccgcagcagcagcgcggggagacgtcgacgagcttcagcacggttccgccattggtgacgcagacccttctctttgacatctggcatctccgtcggtctcggtcgtcggcggggggctcaatggggagcgagaagtatcgcggccggagagtctcgtcgccgtcgtcgaacatgtcgcagaggatgatgccgcgacataggtcgacccagcacagccgccggtcgccgactgggacgaccatgtcggtttcccagaaggacagctcctcggccttgccgtcgtcgtggacgatcggcgcccgcacgacgctccactcgccggagcggagcacgaggagctcggcctccttcggcgcgtcagcttcacccccatccttcacgatgagatctgccaccaccagatcggcctcggcctcgccgcggcgcaggaggccggtggtcttctcatcaagatcgtgcggcaacggcgacggaagggtcgtctcttctccattgtagtaagccgggagatgcaccagcgacggcggccgaggcgggtcggcggcggcggcggcgcctgcgttgtagaggtacttatctatcgtgtccgtgtggtgctcgtacccttcttggtaactgaaggacacaagcacgagcagggagtcgccatgggcggcggcgacgctcatgtagggtggccctagtgccgggtcgacgggaacggagcaggtgtagcacacgcgcgacgccgccggcggcgccctgaggtctagggagacacgcacggtgtggccgccggaggagagcgtggccgcctcggtcttggcatccgcggcggcggagcagggatggttgacgtgtaggtattcggcttcacggtcgaggatcacccaccgtgggtagccggcgccggcgccacggccatccgtcggttgggtttccatggacaaggaggggctgaggaggatggatggatggatcggttctatcgttaagccggagagagttaattagaggacctgttggtccgtttataaaacacacaggaaagacgacggtgaatcggatacggatcgatcatacaatactactactctccctcgtacttactaccgtattccaaaattaaactaaccaagtactccctccgtcccataaaaaactaatctagtactgatgtgacacattctattactacgaatgtggagatacctttgtctaaatttattatactagaatgtatcacattcagttctagattcgttttttttatgacggagggagtatgttccaaaataaattaatctagacgtgttccgtacttttggaattcaaaacctgtacaagttggtttaggaattatcaactgatcacacggaaataagcgtctattgcttagtcatcaatttattcttatatagtgatgtcatactattattatactggtacttgtttgtaataagagttaacaagtagtaaaaagaaatatttaactcagaactttaatatatatgtctaatgtgtatgtcatgtgatcaaactcatccaacttatatacaaattagataaaaatcactatgcaaaacaaccttagggggttatatatataaatggtattataaagtttagagggctcaatatccgatttcaaagttcagggtgctagacagtcttccatccaaagttttgggggggggttatttagactttctcctaaaatgtataaaacctagtgacacagccgcagagctcggaatcctaattaaaacatctctaaatatttatttcatcatccgtctaccaattcgatcacatatattatacaattcgatcacatatattatattttggataatgggaagattgccattagtaaatgaaacaaaacctagcctccactaccagaaacctgaattttcattagtgcgtaggatttttatgagggataaaaaagaaccgacgaaaaattgaataaactttggcggatctgcaccataccgaaaaggattaaaccagggggcttaattaacaccgtcacgaaaaagaattaacatggtggtttcatttatatccgtggcgttgcacgaacctaacaatagcatcatttccttggcggtggtttccaccaagaaaataatcacgggtggctgaccaccaagaaaatttattttccttgtcgctctactcgtgagtgttttagcgtggcggcttgccgacacaaagtatatccctagcgttttttatagttttcatgacagttttccacactcacgaaaattatttgtgtttctgcctttctggcagatctgcttacatcaggatgcacacaatcaaaaaggaggaaaaaaaactcaagccaccggacaaaaacacaaagttgaaaacaacgcctttaagaaggaaccgtcgtcttgtgtttaattaagtataagcacgcccaggaaaaaaacatagattaattattgatcaaaagtacaattcatcacaatgaaataagttcaaccacgttgcatgtttgctgtgcaaagagagcagatagaacaatcttcactactcttgatttcgatcaatagccatttcttccttagacttaccgggaggcccaaaagcgatctaaatcggtgtcggccaatgtcatcgcaaagaatactatacgctcttagcatatcatcgcagtccaattcaggaacctcttctaacgccgccaagatctcctcaggagaagctactactccctttgacatctgagaatgtttggtagatgactcccgcgacgaggaagatcgcaatgaattactactgacgatacaacttactgccggcttgtcagtgacaatcagcggcctctttgcaacattgctacaagctccaatggaagtgaagtaatttgagatcttgctggggaaataagtgagccaagaatatggctgccacgacgtgtctgactcatcgtactggctcactgataatattttcttgctcctcatatcgaacatgaccctccactttcccctatcagaaaatgatatttccggttggtactcctcttgcaccacgaagaagacgaggcgcggatcatccatgatcatgagagggtattccggtctgacgcgcgggaggccatggccagtgtaggcgtcgagggaccagagctcggtggcgtcgaccatggcgtccatcacccatctcatatcgttcatctttagcgtccatgagctgatgacgaaggcgttgcgggcgttattgcatgtggtggcgcctagatcgccgcagcagcagcggggcgagacgtcgaggaatctcagctcgccgccgttgtcggagacccagaagcttcgcttctgccgcgggcacatccgcgggttgatggagtagtcgccgcggccgttgtcgaatttggcggcgggggcatcgacggggagggagacgtatcgcagctggggaatttcgtcgaacaggtcacatacgatgatgccgcgatacaggtcgacccagcagagcatcgtgtcgccgatggggacgacgaggtcggatttccagcgggacacctcctcggccttgccgtcgtcgtggacgacgggcggccgcgtgagggtccactcgccgtccgagcggagcaccaggagctcctccggcgtcccgccgtcctcctccttcgcgatgagctccgccaccaccacgagatcgccgtcgtcgccgtcgccgcggcggtgcaagatgccggtggtcttgacacccagatcgcggacccaccgcttgggggccgcccaacgccgatacccacgaccacgataagtttcttctccaccatcatcttccttatcttcttcatcatcatcctcttccttttgcaatgtctaccagtaagtcgggagcagcgacaacgacggcggccgtggcgggtcaacggcggtggcggcggcgccggcgttgtagaggaagtagtcgaccccgatgtcgttgtcgtaggcgcgccctttccgatattgcatccggaggagcagggagtcgcggtggacggcgacgacacgcatcgaggggaaccgtctatcgcctccgcggctgccgcttgggacgcaacggaagcgtaggcgtgacaccgccggcggcgccttgaggaggaaggagacgccgacgtgatttccggcggaggagcgggaggccgcctcggtctcggtgtcggtgaccttgctagcggcgtcggcggtgaagcaggagttagggtcgtcgccgccctcgtcctcgtcctcgagaggaacgtgttcggcgaggatgacccactgagggtagccgccgcctcccgccggcgatgggccgccggaattattaggaagcgtcgccgccgtcggttgagcctccatgggcgcgcggcggcgagatgatcggcggagaaagatggatgtggtaatccgtatttacactggttggtttggtgtggggcccacggagtttatgtagacggggcttcgttttggattaatttacgaacttactatacttgagtttgactaggaatcgaaaaacagat

SEQ ID NO: 66922 - DNA, 947 bp, Oryza sativa
ctaatggttaactagtggtcaactaacgaaatgagtatagaagggatcaaataataaaactcagggcaatccaagggatggtataaaatttaggggcatagaaatggttgagtgaaaacttatggacacacaaggaatttgcccataaactaaatattagagagttgacaagtgattttgaaatgttctctaagaaatgctgatgattttttttttgcatcaattagtgagagctagcactagatattgagatgaaaaagagggaggaaggtaaatatctgtcgccctttcatatctactccctatgttaaaaaagacttaaatcctaggaatgaatctagatagatatgtgtctaggcttatccctaggatttgagttttattttggacagagggagtaaccagcagcatccaaccacgaccacaaccacagagcagattaaccagagcaaccaaggaacccttccaagcaattacatccaagagctccctgaccagagagagatggaaaatgtacagctaagggcctccccaccaaggtaggagagagagaagaacctgtgaaccggaggaaactgaccatgactccatgagagcagagctagcaagcagctggcagaggtcaagaacaccagcacgagtcggccggatcgtcagtaacaggaagcaaaccctgcactcaagtcattggcagtaacaaggtgaattccacactcccaaatcccaggcagtaaacaaacacacacatgcccagatagttttctttgtcatctcattctgcaagatttttttttctaaaaaaaggaccatctggatatgtttgtgttttctggatttctgaatatttaacattagataatggttgcatgcttgaggctacgcctatgtgccaaacttccaaatcaaagaaacatgatgcttttttgaaaggttttagttagttttca

SEQ ID NO: 66923 - DNA, 3457 bp, Oryza sativa
ttcgtaatgctccgagttgattacctttattattgtttttagtcaattccataatttatcctgattaaattaaatttttagatagactcacatttttatccctacaacagatttacttataatgttgtactaacaacttacttctattttatgctaagttacttttatgatttatgtaaattactttcagattttattgaacttactttcacaaatgtatttacttgaaaatattctctacactgcttatgaatttactccacagtctctcactacaacttagtcataatatacttacttctaatgttatagagagttctattgcataactaacttacttttacaatttaaatgaattatttttaaattaataatatgtttgaatataaaaataaatttaataaagcctaaaagtaatttacatatattatggaagtaacttaaaacaaaaagaaagtaactttgtcacgacattaaaagtaaatctattatgaaggtaaaaacatgagtctatatagaaattaaatttaattagcacaaattatgttattaactaaaaatgattataaaataaacaactcacaacattatgaatgtatgagaagtaatttagtaaaatcaaaaagtaacttatacatatataataaaagtaatttacaacatagatatttcttttataaaaatatagtcacataagatcttgttctaaagatttaattgcaacgaacgtaatggtgtaattcaagagaaaattctataagaagaaaaaaatgcatgcaattttaggtgtactagtagcaactaggtatgagattgggatagctggttatgacaatccagcgcacggcctcgttgtagacacgtcctagaaataatgcggctccatcacgtttaacttttccacattatttttgtatatagtccaagataatgactacaaaatgttgccttgagacgtactccctttgtcccacaaaaattccaaccctagcttcccaaggtggatataagaggagagacaaaggaccaaaatggccctaattaatagcaaagttatattgatgagcgggtatatgaggggtattgaagagataaagcttctcgatttacagattgatggtaggtaggaaggtagaagctggtttattttaggacaaatttcaaacactaaaagttggtttattttgggacggaaggagtactgtaatatggtagcccacgagcagcattttaaatcgattgatacgacatttagctatcagtctctcatacaattaatagtgggctgtattgattaacagcaattacattgcatatgacaacaaatagctagttcttgcttgaacaatttgtacctggagatagtggggagatagcaggtatagttggagatttaaaaccttgctcatgaatgagctagtgtaatgctaaaagaactattaggtgataggcgttgtgtggagattgtaaagcaatacggggagactagcggacggtttcccacctataccgttggagtattttcgctggcggtgatcgtgtgtggccgccaaaaaaaatgttgacgtaatgaaaaatcgatattgtagtagtgaaggaacacagttcagcagaaccaacgcaatccaacagttaatttaaatcaaatatttcaatcaatcatgatgtaagtcatttgttgtacttgtacatgtagagtaaatgttttgataagccttgatttctatcatcaaccatttcttccttagacccattgggagcccgagaagagacctaaataggcggccattgtcacggcaaagaatgatatacgctttcagcaaatcatcacaagcatgatcgggaatcgcttcgagcgccaccaagatctcctcgggagaagctatccttgacacctgcagatgtttggcagatgactccggtgacaaaaattgcgactgattaccgttgatttcagttgtaattgttgatggcttgctgacgacctactggtggctttgtaacaccattgttgctactatggtttgtgtataaagtggagatcttgcaaggaatgtaagtgtgtccataagatggcttttgttggtaaacatcattatcatatcggcatactgacagcaatgtcttgtccttcgtgttcatcatgatcttccatatcgtcacgttgacgtagaaaagcagatgacgtcagagtcgtctatgccgacgataggtgctctggggtgatacgtgggatgctggcgtaggcgtcgagggaccagagcttggtggcgtcgacaatggcgtccatggtccactccatgccgtcgtcgtcgtcgttcatccttagcgtccatgtgttgatgacgaaggcgttgctagaatggttgcacagggtggtagcatgcggctgccatcgtcgccggtggttgtagggtttcgatgagtggcggcgagaggctgacttgtgctcagggctcgacggaactctgattttaattacgccttattcggatatataggacaggaccgaaatgcttacatgcatctcgcccgaaattttcggttttttacatttttttgaatttgctcatattttattcaaatttattcaaaaatcagtcaaaatttcaaaaaaattcgcacgaaaaaaatccaaaatttcgattctttcacccacctgcggcagaaatcttagtttcaaaatttcaaaccttgggtacagtacctcgagatacttttggctggaccggagcaaatctcttgtttatttgttcctctcctcccccacctctttaatctctgatttgttcataatgtttcgtcccttgcatttgcatttgcattttgttgtataattactgtctgaaatagttgtatgaatccgattgtgtataacccctcaaaatgtacatatatgtgtattagcaacaaggatggaaatttcggaagaattttgcccctctcctgcaagcaaatattttgagcaaactttttggatttttttcaaatttgtgaatttggtcataatttattcaaattcaataaaatttattaaaatttcaaaaaaaatcattcgaaatatctaaaaaaatttcccgaaatttcagaattggtgcccaccgaaattttttgcctttccaagaggaaaacccagtttagaaatggattgtcatgcgtctctgaaaatgtttgcatctcttgaattatatctgtaataattgctatgtaattatatagtcgtgagatgtcaatctcatgtttttctttgacgttttccggccagtcggagagtcaggcggtggcgcggtagtggtaggggatcgggcttgcggtggcagaatgcttgaagggaacgggaggagaggagttaggattaagggctttgcacgaatcttaaagcatatctaacagtccaaaattcgaaagatgagatgtgggattttttatcaatagactagtaatcatgcacgtgcaa

SEQ ID NO: 66924 - DNA, 2542 bp, Oryza sativa
ttcgacatatgcaaatgcaaaacacatgcatgaccattcattcattcccctgctatgcatgctagctaagctaatataagcagttcatatcagcagctttaatttaagccttggctgcacgcagtctctcggacgtccattctaccgatcaacgacccagattcacggctacataatggacggcgttttgttcaactagctccctcgtcttaaaatataacaacgtattattacactatacttcctccgtttcacaatgtaagtcattctagcatttttcatattcatattcatgttaatgaatctatataaatatatatgtctagatacattaacatcaatataaaggtaggaaatactagaatgacttacattgtgaaacggagggagtatgtgatataactagtgctatgagtctgttctgattcagtatagattcgtagcactaagatatacttcctccgtcacaaaaaataagcaattttagttataaatctaggcaactgtgtgtccagatttatagtcaaaagtagctatattttggaacggatgtagtatttccatattgcccccactgagtcatactacgacagcatgaacagttcgtgttgcactaatctagacctttgatctctgttcgaatccaacgtttagcagtgctactgctgcttaaattgcagtgaatactatataggagtatgaccttagcaaatccgaatcttggcaagctggtactagcaaatgtaaagcatttccctccaaaatttctccaatgtccctgcctgccacttcgtgcaacagatgctatatccatgttaccatatgtatgtgcatgcatgcagtactactgcatttgaacccaggtggttttgcatttactgaattggatatatattggtgcaattcagatagagagagagatgtggcaaatttctacttcatccgttttaaaatatactaccttcatactcgtaaaggaagtcgtttaggacagcgacacggtctccaaaacacaactttgacttcttatttctataaaaaatattcatcgaaaagtgatatatgtatacttttatgaaagtatttttcaagacaaatatattcatatattttttatatttttaaactcaacaacttgagagttattcataatttatattcctaaggtttgacttaaacattgtcctaaacgacttcctttacgagtacggagggagtaagaacttctagcacttaaattttgtccacaataatataaaaatttctagcactatagtactatttatcccttctcattcaattttctttttccgatcaaacccacagttaaccttcgacacacatcaattcctcatttattgaggagcagtaaaatcttttcttctcaacccccaaacctgcatatgttttgagacgaaggtagtagtaattcttagctagctacttgtgtgtacgaatatatatatttcttgctttgaggaaggaccctgtctcacttttgtaggtaagagaagagatggctttgttgattgtgagcaaagtagctgtggagtacagcctttgattgtaccaatcagtcacgtttcaacaatcgccagtatgggttgcactttctgtccaaaaaaaataaatcatgaggataaatctggagagagatatatatatatatatacactatagatggggtgcgttgtattaaaacacaacccacccccaccccgctcccccacatatttcttgtagtactgatagtaaaatgattaatgtatgaatatgcatttaccctatagtaatgttgttacttcccgcacatattagccattttctttacacctgctttgtacggttataccccgaatttttaggatctgggaacgggcggccaagggagcggcatcggcgtcctccagcggcaggcagcgggagaacggcgaaatcggccagcgacgggtggaaaggagtcgccgccgcagccgccggaggtcggagccgaggggaggtgggcggacaacaacgagcgacgcctcgagggtatctttcctcttcttgttcttcttggtcctcttcttttccggcgtggccccggccggaaccccaaacgggggcgcgtctcattctccgtccgcgcgtccgctgcggcggcgccggcggcagggtgtgatgccgcgggggatggggatggaggcggccgccgtgccggaggagctgcggcgcaaacgctctgacggcaagtagtggcgatgctttcccatctcctgcaaactcgtgttctcatttactcagatcctgtctggaaaggagggcggcgacgagcagctgtagcccctcacccagttgtcggctcgtcacagccccacacggtggccggggagaaagaggattgtggaggctgatgtccaagagagagggctgcctgccttctggatccgaaggcccatcttctccccagccgatgacgccatgccggcctcctcatttgattgaggcatcctcatcatcagccaaagcagcttgcacaaggcagcgaagttcagatggtatg

SEQ ID NO: 66925 - DNA, 1605 bp, Oryza sativa
attagccagcagttttctgcaattttgaattagttcaacagaatcactagttcagtcagccacgcgattagcagatatggtactagtttctgaaattttgtagttcatttgagcattgttgatcgggtaacaatttttctgaaattccctggttcagtagagcagcacaaatgaatttccttttatccttcactgaatcagttagccatatgattttgattttgagatatgaatatacaggtttgtgatctttttcgatgtactacatactaattacaaggacgtttccattcttaattttctttcatttcttaatactttatataatgttgaggctcttattgctattcttcttgtatctacgtatttgcccaacagtgcttcgatcgggtcatggtgtgctccacttcgcagtaacatatatgtgttcctgaggtatgtgaaacaataaactgtttcataattttttatactaacaaaaataacttagttcttgcatatgtggtgttactgtcatatatctttaatgagtggggaaaaaaatcaaggtgaaagactgaaacaatgcctataatattccaaattcacattgctttgcattcagctgtgcctcattatattcttcatgtatagaccactgttatgctaaatcttgatggatcttggacttgatatctggaataatcctgttattttcaagtttgtatattttcaataggtgcagtgtgggatactgtagttgaggcacgggttgatggcatgttgatgagccaatcctgctgctccaattgacagcttcaaggggtacatcaagaagaggatttttattaaaatgtgctaattttttgatgtcctgaaagtgactaacagtgatctctacatgctaggcactttctattttattggcttctaatctgtgtcatttagagtcatactgaatgtaaatcgagacttctcgttgaaaccacctattggagacactggtaaggacacacgagcagggccataaagattattatgcggcatggcacaggactagcagcagcgtcggcaaggaggtgactgagtctggtgccggccatatccatcattgttggtggtgttgtaattttttatttgtttttgtgcattctacaaatgtatcacattgcgtgtgtgatcagacagccgttgtaattctaaatccgttcaaacatttgtcggatgtgcataaatgttttgctcctgcagtctaagagtaatttatttactcaaggaaggtggatgaagaaaagcacaaagtaatttatttactgagagaagactggactaatatatgttgctatatcaaaagtttttacttctaacttgagtgtagtttatttagtgatagaacattggagcaaaattttaatgtaaggagtaatctaacagaagggctaagaactacctgtgataagggatgagaatctatttactaagtaataaatttactaagataaggagtgagaactacctgtgagtaatccatttatactaacacagtgaaacaactgagagtaaaatatttactgagaaaatgacgtgggaagaaaaatcaggtgtgagataagggttgagaactac

SEQ ID NO: 66926 - DNA, 5205 bp, Oryza sativa
ttcctgcagccccgcgttgtaatcggctaattagcttcaactaaaaagcccgatgcgagctattcccccatcggttatctaaagaagaaagctattctcccacatgcaagtgagaataccgtcatggccacgccgcatcgggcaaaatcgacaagcgagcaagacagggccatgtccaatcggttaaagctacgggacacatatgggatacagtggacgtgtaccatcgctcagcgcatgcagcagcagccggagcagccggccgattgacggcagattgaggcgctagtatactactactaggtgctgggaacctgtccgtgtcacgcatcacaagtctcgtctcgcagcgccacgcaatagccaccagactgacaaccggagacggaatatgcgtcaggccgtgcatccatcgtgaatagggaaaagggggcggaaaggagcacagtgaacagattgtcggctcccggaggaccatggccagccacagcgatcacatactccctccacaaaaattaaaaaaaaaacttgttttctgtatctaacgttttgaccgttcgtcttatttaaaaaaattattaaaaaaattaaaaagacaagtcacgtataaaatattaatcatgttttatcatctaacaataataaaaatataaattataaacaaaattcatataagacggacagtcaaaattggacacgaaaacccatagtttatcttttttaggatggagggagtagatcagtaacatgggacaacgccccagtttcgagtgaactaccaaagcaatgtagggctggattaatttgaggcctaaattagacttaccaaaattaatcatgtcaaaacttaccaaaatttaacattgacaaaatttagtaaggcttatttagaccacaaaacaaaccaaaccaaccagtcatatcccaaagcctttgattactgattaggtgctacgacgatgaaaacaacacgttcatacgcaactgcacatccctcgaagcctcaaactagcccttgagctactactaataagccacgaaaaaaaatagcaaagtaaaaataattatggatatcttttttctccgtgttttgggacaaacaaaatagggatagatggagaataggtttctcaagctcaatgcctaacggtgattattaatagagttattatctcatttctcattgataatagccgagcagtaaataggaaagttacaagcatattcttaaaaacggaaacccgaggataatcccaaacttcacattttgaggccattaaggttagttgttccttctattcacgatcagagtaaattaattagctcacggccagtagtatattcacttagtgtaagttagaagtatacaagagtgtatactccacccgatttactgtactctcaatccactcatatgtttttcttcccgattcatctgacactcattcccacaagttatatagtttttctatcatcggtttgtaacccccccagagtcactattttctcccagtccctgatagtccccccccaaaaatctctgtagtcagtcccggtgtcatcaaccgggactaaagagagggtagcggcagtccatcagctggtccttgtttcttttttattttctcccgaatcgagtggtatgcatatcatcaaatcaaaccccaaatccacatcacaactccacagcacgattcacagattcaccacaaattcattcacaatatccattcacatattcattcacaacatcacaaatatattcacaatattgattcaaaggttcattgacaacatcgagtcacatactcattcacaacatcacagattcattcacaatatcgattcatagattcattcacagatcaaaacatccaaaccacaaattaaaaaaaatcaaaaaaaaatcgactcaccggccggcctcccatcccgccgccggccggccacccatctcaccgcttcccctccggccggatctgggggaggggagggcgaggccgccggtgaccggcctccatcccgccggcccgcgccgggccgccgccggccgtcctccatcccgccgcttcccctccggccggatctggaggaggggagggcgaggctgccggcgaccggcctccatcccgccggcccacgccgggccgccgccggccgtcctccatcctgctggcccgcgcccggccgccatcccgccgccgccggccggccgccgccagccccaacccgtgcctggcccccaccagcccgcgcccggccgcctccatcctgccaccgccggccggccaccgccagcccgcgcccgtcccccatcccgccgtcgtcggctgcctctgcaagaggaagagggggaggggaggaggagagggggtgagagaagaggaaggggagaggatggagataaggaaggaaaagaaaaagatataaggatgggagatagagagagagagggggggctacgcatgcgcttgtgcgtgggctggtgcgtacgctttattcccggttgatattatcaaccgggagtaaagatccctgggatctttagtcccagttgaccaaccgggactaaagatcctatctttagtcccagttggtgttatcaaccgggactaaagatatcggggggcctgacaaggcctgacagatttagaaccgggactaaagatcatttttagtcccggttggtacaccaaccgagactaaagatcaaatatgcccgctgtagccaccaaccgggactaaagatcatctttagtcccggtttttagtggaaccgagactattgtggatttcgggcgaccgaccaaagatggtttctccaccagtgatatattcgtataatactcctttatttttcatattcctgtattttcttagtcttacgtttcaaaggtaccatataagtatacgctgaaaagtagactacgataaaaacaacctaatcctaaaatcaactttataattaagtgttaaatcttttgttggctgattagctatgaacggatgagagtgcagatccattcatcagttgcacttgaagcatgaggccgggtccggattggacgtgcgctcgtgtgtgaaggtgatcgtgcatgcgagggcccaatcgaaacaaactgactatcctggaattgcgatttgtgggtgcgcggttgcatcggcagctggcggcctggcgatatatcgatcatcatcagggcgggttagcacatgatcgaggcatctcgttgctcccaattatatgcgtgaagctccttttaggaacacaaacaggagcctagatatacaagatatccaatgcggcaaaagctcttgctcttttctgtgtagaccggttacttgattagggaggtcgtaatagtcaaaagagggattagttggcaccagcttgttttggtacaagtttatcctagtttagtaacgactcgccaaatcaggagggaagggcatcgaccccctcgtgctctctagttctcattgacacaggaagctagattccaccaacttaggttattgttttatcggaattgctaaatatttgttgacatatttttatggctaaatctttcactttctaaaccgttggatgtgtcctaaattcatactaacagtttaatacgcatcaagatatgtacttttaggaagaaaaacaaaatcatatttaggaatcgatcatgtgacctcatgggatgaaggcgtgactgccccattgggctactatatttttatgatctagattaaacttacatcttacttatactataattacatgcgagtttatatatgtaattatagtacaaatatagtgtaattatgaaaattacatatgtaattatagtataaatatagtgtaattataaaaaatatattgtaattatgttacaattacatttgacagatttttgggctaatttttagtcgaatgttgtatagatagtcccttgttttatttgagctataaggacgcgtgcttggttgatagtttaacaacacgtacatatataggccatatagtaatgcagccgtggtgatgcatcgcagcttgtccctccaaaaagtccacgaatcccctggatgcgtacaatgcatgtggcgaatggcgatccatctgatctgtaatgttctgcatacttctcaatcatcacacgtacaccaaccacgcaaatcgatctgataaaaaatatactcctactcgtaagatccgctcagtggcattctgcacacgtacggctactttaagctagggctacagttaattaggtatggatgtttgtcccctgcaggctgcagcatctgcattactgcttgaacgtcgagctgcgtgttatcgtcccgtccaagcagcacatgcgcacagtgattcagtgtgcgatactgggtgtgagctgggtggcgcctgtccggtataactttgccgatgcgattgtcctcgtagcgtagcacattccttcatcttctgaacatgttttgtacaaatgcgaaccgtacactacctatcagccttccgatattaattgctgccatgcaattcacctatcagccctaagggcagtagcagcgcgtcttgagattttaccgaacctcacccgtcaactagataaaaactatataagcaacatacttcacgatgcaaagttaccttatagtggatcccaccggtaccgtatttttcccttttcatctcccaatctctctcctcttgttcttttctcacgggaatccgaggccgatttccggctcggcccaggcggctccggcgccaggcagcacggcggtcgagtagcaacagcgtcaggcggccgggcgacctgagcggtgacggcgtcgggcagcccgagtgacggggcggtcaagcggcgacggtgccgagtggatctagctgctccacgacgccctccttctttgctaaactccttcacggccgtgcgagctcgggggatctggcagcgagcccgatgaagctagcaacatcctcacctcccttagccccctcccatcctcctcttcttcggcggctgtcgagcatgaaccttgacggagcggatgaagctacctcaccagacgatagcaccgccgagcttgccagatccgccggctctagccttgggcgtcggcggcagtagctagaccgtcgccatcttccctttctcccttttcatcatctggcacgcgtaaagtttaggcagctctgacaaacactga

SEQ ID NO: 66927 - DNA, 14323 bp, Oryza sativa
  unsure (1)..(14323): unsure at all n locations
aagaactctgaatcaaatctaacatagtttcttctcgaattttagcaaggattgttgttttctttaagaaaagtattactgatcttctgtaaaataatgcgatgtgtttatttgttatccttactaatgcatgtgtgtttaatatgtgcttacacatgaacgtctcctgtcttgtatagatgatactcggtacattttcatacattttcaatcatgccttgatctaatcatgctttttacttatttttcttttcaggttgaagttgcattgtctggcaccggtgtaaaagatgaaggtgctgaatcangtacaaatggtaacgggctgaaagtcttgcttcatggatgatcaaacaaggtatgaatcttacaaaagaacanagaggagagaccagtaactcatcaaatctagatgaaaaacagaagtcaaggatgagaaaaaacaggactcaaaagaagatgagaagagtttacaggtcagtttgggaatgaacataaaatctgattttactttaagatttatttttctgttcagagatacttatgttattcttttattgggtaggatgaatacataaaggcttattatgaggccttaagaaaaagacaggacgaagaagaagcgaaaaggaagatacagcaggaaggggatacatttgcttctgcgtctcattctgaacggcaggtgggcatgaaatccaaacgagaggatgatgatgagggtgttgaatgggaagaagagcaacctgcaggtaaatttatgattgtaacaacagtaaattgatcttttaggcaatgtatcatatgcacacagtcatcttggtgtactcatgcactcaatccagaccctccaatctctatccaaaggataagaatgaagagtggtactttttcacaaaaccgcccacaccaccctagtaagtttgcatataacccctagttttattctctcctcttccgtctatgtccaggttcaggcttctcctttctatctttctttcttcccaaatctgtctttgaaacggtgaaacctcctccttcctcttcgcccctcttagtgcggcaccgacggcatctcaaatacagcccacgctctttgatccttctgtttccctttgtccatgttcttctctttctcgtcctaacattaagttaatcctaatcctacaaattaatttctatctctctcacagcagtggaatcagtcgcggcattgccattgcctcttagtttgtagctagctatatatggcacatacgagagaggccgatccgttgatgccacggtgccattcttcgactaatacttatagtcttccatatagcaaaaagcaagcccgtgattagcagcattgtctccctttcttttgggtttgagaggtgattgaagcatctttcctattaattgaatgcaacagctttagtttggcttggtcaagcgtgtacttgcttagaggatttgaatcgttgtggaagccacacgaagcgggaggagacaacgcagatagatctgggaagaagctttggacctggacatgaaaagagagaaaagaacaaaggggttatgtgcaaacttaccagagtggagcgtgcggttttgtgaaaaaacaccacttttcgttcttatccttaggattgaaattgaagggtccagattgagtgagtgcatgagtttactaggatgactgtgcacataggatacgttgccttggatcttaattctatgtttatcaaagctgcaacattgaactgacttaatatttctgactattcacttattcgctgatataatagattaatagccatatcatgactcatcttagtaagactgccataatttcttgcaatgttgatgtgttaacacaattttatatatgcatgtgttgggtgggtgggtttggggcatcctatccatatggcctttcatcttggcatatgcttttggaatatttcgatggaagttcatacgctacatatttcttatccttgatgtgtctgcttttgattatatgctttagacatttgaagatgtccttttatcaagtattatgtctaattttttgaactaatgcagggaatacagctgagacatacaaactggcagatttgaatgttgaagcccaagaatctggtgatgaagaagatgaaattgactgggaagagggttaaaaggcagtcacaaattcgttaaagtagttcaatttcattccaggaattggatgatgagcaatatcaccaactgaacaagaagccaagaaaaaggcatgaaaagcattgccaccaaagaattagtttgtatggtttgtttgaccaagggaacttttcggaagtgaagcgttttccttttaatagcgaaaacatttcccaaccccaggcggcattttctccccaagatccttaaaaagctaccatactgtaaagtattatgctattgacatcttcaagggccatgtgggtggaatttattgtcgcaaaatcagctctgttttcagtgaatgatcttttttttttttatgttgtgagactgtacgctatggccataaacatgccatttttcagatgttcttgccatgacctgtatattatgatggctatgcgctagattaaatttctgagattaatgaattgatttactccaagattaataatatcaatggtagtttgcctacttgtcagcatgcaggtaactcgatgaacgaatggatgtagctagtatgctgcaccgaaatctcgtgcccaaactgacgtttgttttgtaggattgacacgagagcagtcagtaattaagcacgtaaacgctaaaacgcattaataatattcatccgttccgttcagttgttagctgttatcgatcagctctcttttacctacttaagctagtttaattactgtagttaataacacccaggtacttgacaccatacatatatacattggatcaacacaccacacgatcgagcacaccaacggcggcggcagaacaccaccaccgccggcggccatgatctccggtagcatcgacgtcctcgccgtcgccttcgccgtggcagcggtgatcgtcgtcccggtgcccgtggcggcagcggcggcgccggcgagactggacacgtacctggtgcggatggtgaaccggatggagaggaagatggagttcgactgcgacgagtggcccgacgattttgagctgagggcgaatggcggcgacatgaacgtcacctacgagaccgccgaccgccccggctacgactacctcacccccagggtctcctgcatatggtcgtaagtagatgctctccatctgtcataaaataaaataatgtagttagattattgacagaaataatgtagttagattatttaaattcgtagtagtataatgtgtaactagatttgtttatttattttaaaatggagatagtattagatatagacacggctactccaacttacattaattacttgatcgatcattacaataaaatcttttgagggacgatccgtggttcttcgaaagtaattgatgttggtagagtgctatattattttatatctcttcatggttttcgggatgtcacttagtttggccaaaagttttatttatgttatgaaagtagtatttttaacttaaaatccaaattatggtttctaactataactccaaatctatttcagattcaaatctctaccaaacaatcttatttaagatttcgtttggcacaactctagatcttaaattcacactgaatttagaccttataagttaaattaaattgatttaaattttatattccttctgaagtaaaaacaaaatgattcattcaaatattatcaatatactcatatattcaaatcggtgaatttacgaagctaaaaatattactatatttatctacaaagttaatcaaaccttatttctatatttattttctatatttatgaacaaacttagtcgaaccaagaatagttggatctaaaacgacggagggagtatcatgtgactcgcagatacgaggggaactacatgagcagcgtgataatctgggacgaggagaaatggccggagaagaaggcgtgcctggtggggggcggcaggagatgcgagctggtgttcgagaacaaggaggaggtgctggtggtgacgacgtcttcgccggcggcgccggggacggggtcgtcgaggagggtgctgggcgacctggccgtgaaggactgcagcacgcactggtacggccacctccttccctggggcgccggctgcacctaccccagccacgaccacgcctacgccggcgccgtccacagcacctggaccgccgccgccatggccagcacgatcggccactgatccatcgcggcaaaaaaaaaaaaatgttgcaagaagatgatcgatcaccaggaggaaatatatgcagagctggattggtttgaggcctaaattacgcttaccaatatttggcaattttaatagtgtttagtgtctatttgttttgaagccaaattttggcatgcctaagaaaataggccatttcatagtgagcttagactattttggcttcaatccaaacacaattttgccttaccaaaattagtcataccaaaacttgccaaattttggtattgacaaaatttgataaggcctatttagaccacaaaccaaaccaacccgtaaatctctctagctatctctcacgcagatcacgaaatttcacggaacccccgatcgatagtagtaggtataataatggatcaagttgttgtgtaaaacataggggattttaatttggtacgtgacgtatgacgatctctattatactatggctttagaatttcacaagtttcgtccctgccggcagaaagaacaagtatctagtgtgttggtttttccttgctttctctggcacgttctgataaaaaaaaacatcatatcaaaacaaggaggataggcaagtaaaaggttttttgcgaatttatggtttactttgatcaggttcattactccaccccgagatcatcatagtagtcgccggcgccactgccaccaccaccaccagtccgccaaggtttacaaaacaatacggttatcatggttatcacgtgcggtaacattctcagtttttaaaaccacagtaaaccttgtagtaaccgtcttaccgtggatcggtaaccgcacccaaaaacggtttggtgaaccctagctgccgcctactcgctcccgtcccctccacctcagccaccggagaagatggggcgccggggggggggggagagatgaggatagggagtgggagtggagtgatgtgaggtggagcaaaggagaggagaagagaagttagaatctacaaagtgccaacattgttcaggaggctaaagtgctactgtctggagagcgagaagttagaatcaacagtctcccgtagtcaaaactgtgtaagccatttcttgacaaataagtctagagttgattcagtttatggtttttggatgggtgagagttgtaattttatctcgtaacttgtttgcgaggacgctagttttgagtaatatattttccccttccccgcaaaaaaaagggagaggagaagagaaaaaaaaaaggtgcatgtgagcggagaggaggagaacgagaaaaaggtgaaagaaaagtagtgtgtggccggtgcaggaacgcgtggggtccacttgctcttcacattgctccataagtggttcgctttgcaataatgcacgtattatcgttgacgggtctcttaatagatcatctgtgaaaatagttttttcatgtggtccttgagccatttccggggaacgatttttacatgcagaagtagttttggtccacctatgatttgcaatttgaaggatcttgtccggaaaaagacaattttgtagttgtgttagttcaatgggatcgagctaactttggagcatacaatttagatatacagttgccattagaggcgatttttagcgtactaattatggtagtagctaggtctcgatacaaaattgcaaacagcttcctggcatatcctcgggctcattttaagtatccgttaaattatccagtttaattcatagcactcaatattttactaataaaaactgcgtggaatcactcctatcttgttttaaatgtacgatgctaataacatttggacatgacgtttgaccattcgcattattctatttgtcctctattagtccctgagtcaacatacttaattaggacagataaattttgctataggacactacgatgacttcgtggttttagctctagaacacatcaaaagttaatctttaggggaagacgctctcaaaatgtgattatttgctgatggacaccgtagacattaaaatattaattttcggttgataggagagataaacatcgtgaaatgtaaaaaaaatgccccttgacccacttgtcatattctcacatttcactccctctcacactccggccacaatacctcctccgctcactgccgatgaccaccaaggccttccctcctcacctcctccgtctccgccatggcggtgcgagtcggctcccttatgcacgcggccgctggcatggcatgctccctcgcccgactccccggcgcgtgctaaggggcaagggcgaggcgctgagtgtcgtacacatgtcgtcggctccgggggcctctgcctcccgccatggcaccacaagtgatggagtcagaggtggttgcacgagcgctcgtgttgctagtggaggcgcacctgggcggccgcgctgctattcacctcgacagtcttgctgttgctgctcatctgctctgtcgccaagagccgtcggccctaataagctaccttcgagcagagaagatggaaacaaagaacggcgccaacgaggtggggaggagagcggctcctgctgggcgagggggagggagaacggcgtcgaccggtgggtgaggggagggagtagctggctaaggggatcatattgaataagagagatggaaaggggtaatttggtcactgcgtgtcaaaaatgtgagtttgctctcgtctagttagcactaaaacataaaataaatgggctcggtgttcactggcaaataatcaagattatagtggctttcctcaaaagtgacttcgtgtgttgtctcacagctaaaatcacaaagtcgtaatatcctatagcaaagtttaccattattagtaggcaaattttgatagaggacaatgtgacttcgtggtttttgctctaggacacgtcaaaagtcaatctttgggggaatgcactatcaaaatgtggttatttgctgatggttaccgcggaggactactgggcggagcatgcaattcataggccagagttagcagcgtcggctgatgcacccatgtttcgagttggtgcgtcgacggcgtggcaggaggcttcgcccgcggatctgccacccttgcgtcctccaggccgccacctcgatgctagctcctctgctgcgtcgatgctgggaagggaggaaggagaggaagagaaatgaggggcaatttggtcactcgcgtaaatgtttaggcccactttcgcctcgtcggcacaaatacactattttaatcggtgcagtgtccgttggcaaataactatgtttagagagtgcttttctccaaaagtgagtttgtgcggtgtactacagctaaaaccacgaagtcgcggatgtctttgtagcaaaatttgcctaggatttatcccctattagtaaaaaaagggacagatacgatcatgaaaaatatgtcgtcagcccatcaccaaaaacgtaatttaatagaggtatgaaagttatcatcgagatttattgtactacctccatctcataatacttgttgttctagattgtttagcatgtatcaaggttaggaaaaaagattatagtaccccttattaaataatgtatattgcatgttggatgatagttgaggtagaataggccttttttgacaaattggtccttgtagaaaacttattttgaaactagtccctaccaaaaactagagagtcggctcagcgccaacaatatagctgacctgatgtggattcgaaccttggtgctagggtacacaagcaaatgaacatacaattgcaccacaagtacattgcttattaatcgccgtgcatcagtctaattagcgtgtacaaggagtcagcgccaaatgcattggcgctgaggccctgccacgtcgtgcctcgcccaccacgctggcacgatgttagcaccaaccgctttggcgctgatagtttttggcagggactaattttgaaataagttttctataaggatcaatttgtcaaaaaaaagggtagtataggatgaaatttgaattggaagtgggttatgtgttactgttttgagataacttttggatgctaggaagatcggtattgtgggatgaagtagtactacataggtattgtgtagattgatggcaatatcataggagtatcatctagattatagtagtatatatatcataaaggttgaccagactgtcctatgatgatgccataaatatatcatcacattttatagtggttcaattgatgtatcatgatatctatcgagaaggtatataaaggttgaccaggattgtactatgatgatgccataaatatatcgtcacattttatagttgttctatgagtaaaatacatggccggtccttaaacttgtggggcggtgtcagggttatggataccacatacctaatagtagtcgactaaatctcggcagaacccaccatataccatgtcttatacgggaacaaccttcggatataggaggagttccgcataaggaaggatatgaatagagttctacatggaaacgacaaggactactcggattgtatccatattgatctccctagttctacttggacaagggaacacctataggtataaatacaaggccccctaggaggagaggtgacacggaacaatagatcaagacaaaagatcaacaaacaagccaacacgccctccaaatatcaatatcagagattagcttagacaaaccctatccggtacctacgggggccggcaagaggggtcaagcactatctctgatctcgacgagttcgtgttcgaggaagaagactaccctgtcgtcgactacgagttggttatctagccgtcaagtcgactgacagccagatatgttatcccacatgttgtatttgtgtgatccagatgaataaagagcaacaccagtttcggccaacaggatgtagggttattacctgataattcaagagcccgaacttgtataaaaatcctcgtctccgtcttttttactacagtctcgcatatatcctagtaccaacgatccccatactatgcaaataccggaatcgcgacatcaaacgttgacaggcggtatcacttaagttcataaatttagaatatgcatgtttaggtctacgatctcgttttaatgtaccatcccggtctaatccgcggttgaccgcgtcttaccgccagcgcagtacatttgcatctgcccccctccacaaaacgtaggcattaatatcatccctaaacaccatcatgtgataaaacgatccataacaaagtagtcttcaaatgtgaaatatgcagtaccattgtgtggaattacagatagcgcagtagcaacctcagaggcttgatttaaaatgcagcaaataatgttgatcgaagatagctcaagtgcctttgattaaaacaacaggacaaaccacattgttgatgcagtagttgctcacacttctgtagaacattctgtagaacaaaaccaactcggaatttgaatcagaaaccaaaaaaagatgatttatattgcagggtctgtgtcaggttccagaaatcatctctcttgattaggctaggaataagaatagtatcaaacagtgatgtgtgttgtcgaagcgacaactgcatacgtcgaaagacatggttactcaatagtagtcggaaaagaagtgaagtgtattaaattgagaatttttcttggggcccccctattacatggccctatgagactatttatagccccattacaggttcttactactagggttttggttatacaggggaatttacatggttacccttatgaaagggacatttacatgggtacataatgtaattgaggttcatgggcccttgatgggccgctaggcgatcgtcggcccaatagcccctaggcttgatgggcctgaatagcttcttcggtcctcgcgggggcgaacttgctatggcgaagtcgtctcccttcggcatatactcttcgccctacatcttttgcccaagaggcctctggcccggcaaggtacccgcgcgattccccgcctctcgccgtccttgttccatagccttcgccatgggggggagggggggcttcgccctgactaaccttgacgtctcgggcttgaatccccactggtcgcgtggtttcggcaggttttgtcgaagggcctgatgccataccgccaacaatgtgattacatgacttttcaagcctggcaagcacatttttgacagaaacaaacacagtccttggttcaaattcaacccacgatacacaggtgctggttctctatctgctctaaagttgaagtccatcaccgccgcgccgacgatgtagccgccacgcgctggccctcatggagcccagcgacgctgcctctccggagccctaccacgccgatgcccctcgcggagcccagcgcctcgctgcctctcccggagtcatcgagatcgccctactcgctgctctctcccttggaagtggagaagaatgcaatggatttaggtttgcaacagtgcctacgttttgtggaggggaaggatgcaaatatactgcctgcgtggcaggcggtcagaggtggtcaaccgcggattgtaccgggatggtacattaaaacgagatcgtgaatctaaatgtacattttctaagtttatggaccggtcatgtattttactcttgttcaattgatgtatcatgttatttatctacaaggtattgccaagattttgtgggcaatatcatgggcatatcatccaagtttattttttttcctaaagctattcttaattgccagtattttttttatagcaaatccctttttatatcatattattctgatgtatccttgattttaaaattttagatattttcatggcagtacacactctctaaacattgttcttgccggcaaaagaattgtttcaactttcaactttatatttgtaacggtggaatgctctgcgcattgctgaagacgttggaacgatcgatgagcgtcttggccccgacgagccgttcgaagttcgccggcgagaagtacgccgagccccacgtcgaccgtgctcggctcaccgacgacgacggcgaggacacgttcccggcgagagcattggtgccgaggtcgaggtccacgtagttgacatacgcggcgcgcgggttcttggacacgtgcggcgccatgtacgcgtacagcgcccgcagccacgccatgcgcgcctcgccgccgccgccgccgccgccgccgtcgtcgccggcctcccacgtcacgccgtactggacgctgtacaggttgccggcgcggtgcgggaacggcgtgtcgccgctcccctcacgcgccatggcgccgccgtaggggtcgaggatcacgtaccccgccggctcgccggcgaggtaccggaggatcgccgccacggcgcccctcgcgatgggcgaccgcacgtagtccgacttgctcttggcgtagtgcttcgtcctggaggcgcggctggtcagctcctccgtcgagctcagcccggcgaacctcgccgccgactccacccagctcatctccgacatctccggctcggcgaggcccagctccgggaacctctcgctcagcaccgacatggccagctccttggaaccaagaaccagccctgtgaaggacaccgtcacgtttccatctcgtgatggcgacgacgagctggcgccgccgatggtgaggaagacggagaggtaaaactcgtcgggcagagctgagccgacgtactgccaccgatgcactagcccggcgatggcgtccaccgaaccggtccttttcggcgtgaacgccgtcaaggtgttcggaacctggacgagccggagcttccaggcgtagaccacgccccagccgccgccgccgccgccgcggatcgcccagaacacgttctcgcccatggagctccggtccaggaccctgccgtccgcgtcgacgaggatcgcgtccagcacgttgtcggcggcgagcttgaatttgcgcgacagcagcccgaacccgccgccggagatatgcccgcctgctccgacggtcgagcacgacccagccgggaacgcaagggaggacgacgacgacgcgacggcgtagtagatctcgccgagcgtcgcgccggactcaacccacgcggtggccgacgcggcgtcgacacgcaccctgttcatcctcgtgaggtcgatcaccacgaagcggacgcggtcggcgtcgtcgccgccgtcgccgacggtgtacgagaggccctcgtagctgtgcgcgccgctgcgcacgcggatgcgcagcgaggcgtggcgcgcgcacagcaccgcgctcgtgagctcgctccggccgcgcgggagcacgacggccgccggcctgggcaccgcgccggcggccgggagcgcgaaccggaggttctggatggagaagttgagcagcgcgtcgtaggccggcgacccggcgagggagaagttgcggacgccggtggcgaggaggcacgacggcagcgagcccgccgctgctctgtcgtcgcaatgctggccggcggcacacgcctgtcaacggtggcggccatgtcgaggacgaggagagcaaggtgaggaggagggcaagaagcagaatggtggtgttgcgcatggctgatctcactgctgtgctgtgcttaagcaaagaggaagtctatatataggaccttttttttattaacgatatacccccttcaattttattttaattaacgttttagacaataacacggtctacaaaatatacctttgaccttatttctctattataatatatataactagtatggtggcccgcgcagattgcgcggctagcatcattatattttctctcatataatagcatatatgttttcttattatattattaaaatatattacaatgacaacataattttaaattttgcaataactttacgaaactactaatgtgtaatattcatattgtattttatataagtgttagttattaattatttttaatatcaaattttagttatttgtaaattatatatatttctatatgaactctagacttgtcttttaatatttcttttttttaattctgaatttttattatttataattgtatttctatgtagactctaaactcatctttcaatattctttaatttttaaattttaatttcaaatttcagttacttctaaattgtattcctatattgactttaaactcttcttctcatgtttttcttaatttcgaattttagttatttataaattgtatttttatacggactctaaacactactttttattttattatgtttattccgaattttagttagttttaaattcctatatggaatctatactctacttctaatattccttattttttaattccgaatttctatttttttctgaattgtatttctatatggactctatactctacttctaatatttcttatttttaattctgaatttttgttatttcctaattgtatttctatatggactctatactctaattctaatattccttatttttattccaaatttcagttatttcctaattgtatttctatatggactctagtatcctcttctaatattccttattttttaattccgaatttcaactatttctaaattgtatttctatatggactctagtctcctcttctaatattccttattttttgattccgaatttcagctatttctaaattgtatttctatataaactcatctttcaatattctttattttttaatttcaaatttcagttacttctaaattgtattcctatatggactctatactttacttctaatattccttatttttaatttcgaatttcagttatttcctattgtatttctatatggactcttgtcttctcttttaatattcctttttttttaattcctaatttaactatttctaaattgtatttctatacggaccctagtctcctcttgtaatattcccttcttttaattccgaattgcagctatttctctattgtat

SEQ ID NO: 66928 - DNA, 1210 bp, Oryza sativa
ctgatcaaattcttcatagctccagtgtgtagttgatatgtgttgctcatatgtcatatcctgctgctcttctagttctggagaaaatctactggttgttaagatcattgaattctgcaatatcaaaaaacagtagttagtactgatttaaatgactaattagggaattgttacataagtattcataattttttattcttacatcaaatgctggtgtccgaagtagacttgtaaagctttcttgtcctccctgcatattcatagtttacatatcaattcatttattattttctcttttttttgtcaggtatataatgtaagttgatatgcttactgtttgttgctgtatggtgacagttggactatgaattatttggtgtatgaggttagtgtagctcaactgtccttcctgcacagttatatgtttattagtttataactgcatgtataaaatagttttatatgctacatctatgctttttgattagtgtacctgtcttgggtctaagtttagcaatgtgaattgatcatatagcatttgtcctccataattgacaacttctgatgcaattgttcctatggtattgcttaattctggtgaattgaagttttttcctacgtgttgtattttcctgcatcctgcattttgaaaaagataaagatcagaatattagatcagtgtatgttgcaattgttttgttggagcttgtcgacttggtagtttagaaacttagttagtacctaaatggggcattttgctgctgcttccttcaccctcttgcaaattgtagatattaggacttcttgcatatgccagcctccctgtaaaatttatataaatcattagagcatatgttagaatcaacaaacataattgtagttacctttatttattcttagagcaaaatttattcaaatatattttctgacctggagccatgttgatgtttcttttgcttccttcaatctgcattgcatcatttttgctctcctctgattgttgtctaattgtttctccttcttgtattgcttcacgacctgtgccatgggagaaatgaagtatatgaggtactgatttgttaaataggtatgtcttttgagaatcatttgtattttttagcatgtattgagctttaacagtatatgttcagtgtggcatttgcatgttttatgtcaaacatgaatatatttttcaaatacattgtggttg

SEQ ID NO: 66929 - DNA, 18503 bp, Oryza sativa
taagctccatggaaggaagaacattggtaggatgcattagctacctgctttatctgcatggatccaatgtcgccctggccgtcctcgaactcgaccagcagtgacagccagaagttcgtcgagccctcgtttacacggaaggctatgttcttcccgccgtacttgcacgcagtcctggtatatttgaacactgcactggtcagtttcgtcgaaaagaaacacaaaatttcggggttcgtactaactgttagttgaatggacggtacacgtggcatgcgacagcttttctatgatcaggtagactgatgaacggagaagcagcattggcaaaggaattatagacaagaggttaaatgccatttggatatctgttgctctgactgagttatatcaagcagagctgcagaggcatgtgtaactcagcagcaggcagatctaaataaggagctgagctagcacattcaactctggacgattttaattccctgtatgcgcgtaggcaaatcactgtgctagaaaaaaaatttcaggcaggggtccagtgaccatgcatttactttgcctgtggtctctcctaataacctactgtagatgcatagctaggggggaggttgtagatacacatcgtaacgggccaagtgttatggccgctgctcatctctccaaaaggattcatgccatccgtaagaatcgggttacgttgttgcatgctgctcaccttctgtagacgaccgacagctggcctcggtctcgcaggtggccgccggcgccggcgaccgccatcctgctgaatgcggcgccgctgaggtcgaagtgcgtgcggccgaaggcgcacagcccgccggggcactcgtcggtgacgatgaccgtgacggcgcggcgggagcagatgccgtggtcgaggcacttcaccttgtagcaggcgccgcagccctcgccgtccttgaacagcaccgggctcaccgaccccacccgcgccttcatcggcaccacgtccaccagcgatccatacccacacgccccgcctgaaaaatatgacaagaaaaacgttttgctttggttgaacccaacaaagaaattatcgccaatggcaatgccaaattgcactatactagattgtagcgtgcaagaactggacggacgccaactgtttggccgtaatcagtgatcacagagtcaagcatgtggttacagaggaaaaacagtagtagtactacaacggaaacagtcaagtcagagcatcaaagcttaattacagaacacagagcaacttgctgtaaacagggcgaatcagtggtggaggaatcacaggttgtactgttccgttgcggtacgacgacaaaactgtaggtagtctaatgcaagatgttgtgactgcaaagcgtaaatggcagtaaaaaaacttcacttgtactactgattcgctggattttactcgtaacaggagtactatatttaccagcagtgtcggtggagggacgagtgacgagcaattgagtgcatttatcgtgaatatctcagccgttggtaccgagtaaaaatcgcggggagttattggaagacctgacacggtcttgctggttgctgggctgaacgcactgaaagcctcgcagcacgaatcgtaaagcgccggagcgactcgatgattgacgcgagtacacggtgtgtagcgggggcccgccgaaattccttccggatctcacgcgatccgcggacgccggaggtcgcgccaaaaatgccgtaacgggcggaatcattgtccccgggaggagaatgatggaaaaactaagtgcatgttcacttcgatgtcaaaaaaaaaatcttactaaattgacaacttgctaaaattttagtaggattttttatatagttataaaaatttggcagcaaactaaatgtagctatttttttttataattttaccaaaatttgatttgactaaaaatggcataaagtgaacagccgcccgatgcaaatgtgacggatgcgaacacaataatcctcctacttattttacaggtatctattcctaattatcagctcagtgaaaaaaaaatgcgaggtacagtactactacgaaatacagtactgattcctgcgtatttgctcatatggtatatgcttccaattaaatgctacaggaaccagtatgctttggtactctctactgaactgtgaggagctgaaaatggagagacgagttcagagagtttaccggtgctgccgtcgccttcggcgtcgccgtaccacgtcgcggtcgccggccgccactccatgtcgaccgccgccgcagccgccgcggacttggacttcccgccgtcgaacaagaacgaggcggagatggggggcgcgagcagcagcaacagcagcagaacgcagagcgagaaggagcgcgaggaggcagccgccattgttgggtgtgggtgtggttcccctttcctccccttctcgcactccccctccactcgctagcactgcggctgcggctgcggctgcggcggcttggagttgggagagttggtaggcttcgttttggggagctttccccttttatggcttcgagaaatcccaagccccaatgcgcggcagagatcagaggaatgggtcgctctcgcttgggcgcttggctggctagctggctcttctgtacaaatggcaatgcagggtttagcgggcaggggggctctgggcgtgtgtagtgtaccacagtggtggcctgatttataatggaaagctggaaaagaaataaccggcgagctgcgaggtgtgcaagtgcaactgctgtgctgagacctctcgctccatatgggtgtgggtgtccagtgaccagtgtgtggatgggcagtggaagtgtggaagtggaaccccctgcccgcttgtgaagctagccgtgatgaatagccttgaccttttttcaggaagagaaccgtggagagagagaaggggccggggaaaggcactgatgactgagcttgtattattgcgtagctatactagaccgttcttttcttcccattactacagtgtgtttttctcgtgtaccactatcgttacaagcactgtaaaacaagcatggccgtggcttttctcgtcacgctttgtcgccccggacactccgggcagtgggcaggcaggcagcgggcagctcctctcgtctcgccccatgtgcgcgcgacgtgctgggtgaccgggtcgggcagaccgttgatgtgcgtgacccaccgtgcgtgctgcatcgggttcgcttgaccgttgccgttttcacgtcactactcaacggcacaacacgcgccacaggaagacagtaccagactagcagttgtatttttaacagtagttaggactggtttagtttgagagctaaattaggaatttcaatatttgttaattttaatagtgtttagtatctatttgatttgaagctaaattttagcatatataagaaaatagaccattttaatagtaaacttatacaattttgccttaccaaaattagttatgtcaaaatttactaaaatttagcattgacaaaatttgataagacctatttagactacaaaccaaaccaacccttacggccctcttttacaacgtgggagtgggatcgcggtgacaccgtatgtattcgcggccgtatttttagttggtcgttggcttttgcagccttttccctccggtgaacgtggaggcgaacgtgtccgactgttcgttggcgccagacagctcctcactccacaagaagtcaggaatgatctaccgaggctgagcactaagctcgctgttcgtgatgtgtaatctccgttgattttccgttgtctattcctccagcttagtacgcgtcaagcagggcttatttaagaacgagcgagaatctgtcattctgtctttgaagccgtcacgttctttgattttacggcacgaaacaaatgatctgcccaagaacgagcacctctcactctctgttaaacgatgatggagtacattgcgtgtcaaagcgtggaagcctaaagcggcgggaagggaaggaaggtacacagcctacgctgagtggtgatccagaaaaaaatagcagtagggtacttcctctcccatctacatatgataaaaaattttagtgggatcttcgtagaggctcttattatctttacattaatagtgggggctcgagactctgccgcccccaatgctggatccgcccaggtgaagcagatggatgcctttctggtctcgagtccaggctagcagagggtacaagtacaacagccaaggggtctgtctgttcatacgcaacgagagatccgatacaatcgcacttcttcgcttccgttctagggacgggtaaactagtgcaaagtgcggcagctgcatgcaactgcaagagagaatctcgatccttggtcaatgaccgggttggagaccgttccgaaaagctccaagagggagtgacagacgtcgcggcctccgtcgcacgtggaacaaagcaaaaggacacacgagaacctgtgctacaaggtgagagtatatacacggcccaaaagataaacaagacttcctgctggatcggcccattttcagagccttcggcccaccatagactccctgtcatccgcgaccagccaccagccgcgagccgccgcctcggctccgccgccttgctccgtgctccagtgctccgctcctcctcccttcgcccctacggctctcggcggtgatcctcacggcatcggcgcctttccatcgcctgcggctggccccgcggagcgcgggtagggcgctcggcagctcgctcgacgccgttgcgccgaccggtggtgccggctcgtcctcggcgccggcggcttgggctcccgcgcaccctccttcgtcggcacaacggcagaaaacgaagctacagaggtgaaatgaatccccagtccgctgttcttactattcgatttaccagctgttgattttttaatctatattgctgaacatgaacctgaatgtactgtctcttgtaaaatcagttctctgtttaccttgcgtttagcaggagtggacttgatacaaagacacacttattagtagtgaaaatgctatattgtgttttcacttatttaaataagttttgtgataaatcttactgtactaattggtctcccacccgtaaaccttgcagatacgttggttggtatcttggtgaattcagggtttattgctgattaggagaaattccttgttgaatatgtcagagactcacgagaaagataagcaatttgagaaagaaggagaagaaggggaagaggaagagtatgtcttgcttgagttggatgattgtctttattccgacgtgcaaccaaatgcttcatatgtgctctctgtaagttcatccttctccaaatcagtggcataatggaacagatggcatgttttgagtttacaatttttttttctctgaatgttagattttatagatgttagggcctggggtaatgtaatatctagagatggctctaaaatcaaacatcaaggaagaggttgcttatttcgcaaaagaaaaacaaagagcctggttgatatttgctgaagagaggaatgtgtatgggcatatagctggagtagtgagcttgatgctgattacctaatactccatccgtcccaaaatataagaacatagtatgggacatttcctagtactacgaatctggacaggttgatgttccatctggtactaggtttttatattttgggacggagggagtagaactcttgccattagtttgagaaagatttaaactaaaattcctaggaactaaatttcatggaagcgcaaaaggataaagattcataagtttcatttattttcagaaataggaactgaacttagttcagttggttgacttgaacttgggtgccttgtctattaaattgatactaagtttctccttaatatccatcacttgtttcatgtgtttttagcaaccttcgttggcatatatgttcagaattcttcaaagtcctttctgctggcaattggtattagtttcagctacaaactacatagagcttctagtgtgtgttatttagccgttcgattcccagcaatttagagactttgcacttttgtatcatgatttatggacgtgcaaacaccaatgttttcacatgctcatatctattttaaaatgtttgttcagttcatttatgtatacttaacaagtttggtcatgttttccagggtctggatacattgactcctaccttgatactaggtgatggcctgaaaatggtgagtactttattagtttagtttctcttttatcgcttgacttcttgtttgatcatgcccctgagatgtggagtatggacttgttgatagtgatcgagatcctttgtgccctagattcattacagccatacattgcctgtaagttcttgcgagtatgcactaatgtgtcatggttcaagctttacctgagattatactagaaaatcagcgcgcctgttggcgtgcttactatatgaccatcatgtgtttattttatatgcccattagtcaatggcacatacatatgttttagtgaaataagttgatttttttgaattttctacaggagcttcaaagaacctcttaatgtgttttagctttcaatgtaatctgtatcttataatattgtagtgaagtacttgaaaacagaacataatatttccttttttctaatgctacttttcctcatctatttattttttattagtgaccaaattaatgaacctgtaaaggagtaagatggaaaatacataaatatatatttagtgcataatcagatcactgagctagttgggtattgaaacaaccgatgaagaataagagagcagacttctatttcattctagttcagatttgagaaagttctagacttccctttcttaacctcttccctctgtttttggtgcagcacaaatgagtttttcatttctttttttttctattagtaattgcttgatttatctcagtttttatagtgccatgtggtccaatcacaatctggtaaaactgccggcttgagaataataagattcaaaaaatatactccttccatactcataaaggaagtcgtttaggacaatgtttaagtcaaaccttgggaatataaatcatgaataactctcaagattatatgaggtttgaaaatataaaaattatatgaatagatttgtcttgaaaaatactttcataaaagtatacatatatcacttttcaataaatatttttatagaaaaaagaagtcaaagttgtgttttggagaccgtgtctctgtcctaaacgacttcctttacgagtatggagagagtatatttcaatacctcctacacgatcaaaagttagaacatgtttaactcttgttattggaaactgtctatgaagtaatattcgttaggaaaacaggtaatactgtactcgtgtatcttagagtcctgacaggacaaggtggacatatgacacatttgaataccatacgttatttgttgtagcttcagtgacaacgtacaacaatcaatgcattagactaaaaatatcaggttgacgctgattgctttgcatctgctcaggagactcgattgggtttttttttcctctgctaactttgacttctaaaataattggtttgaagattagcggtctgtactttgggtttcaaattataaacctgtttgctcattgaaacactaaacctccttgctgagctagctgtccgttaatgattgtttaatgacagattggagaataccaagagactattggcacatgctatttgttctcagaaacaagtaagttcttttattcaaaccattacccccttttcttcttttttgtaaattaaccggccttagatgccattaactagtatattgatttgatacctgtgaagatgctgttgttgacatgatatttcctgaagattttagatggtagctttataatttatacacggtcctacttgcacctcgtgttctaaacccccattagtgaatcctctattaggatatggttgaatcaaaagaactttatatatatatatatatatgttttgaccttgtcatcaggcagtttaatcaatgtttattaggacctaggagccccttgttgcagatagtgtaaagaaaacttctctttcatctaatgctgtttttacagctaattcgttcaatgttctaatccctttttattgtcagatgctccaccaaaacccattcacggtgagatggcacctcctgaagaaaacaaggacaagcaagccagctgtagcaaggaagtgccatcaaaggaggtgaagcatctcgcaagcgttcagaagatcctcaaatttcgctctatcaatgcggatcatgagcagcgtagagcctacagggataatgagagagaaatttgaaacagaacttgtagcgttttttttttctcatcaccaacttgtacagtatttatgctcatctcactgtggtcctctaatattattctcatcttactgtgacgctgtctagcttggtttagcttggaaagttgcaatatatgcgaaactcttttgcctcactgtaaacatctgagaggcttaaaaaaatcgagcatcatggtggacaaaagagcgaggctgtttttctgtttcttaactcttataaaggagtttagggtgtgtttagttcacgtcaaaattagaagtttagttaaaattagaacaatgtgacagaaaagttgaaagtttatatgggtaggaaagttttgatgtgatggaaaaattaaaagtttaaagaaaaagttgagaaataaaccaggctttactgctgcatgctatccagcacttccctccaattcttttttaccctcgtcgtgcgcaacgaaacggatctgaactgaacctccacaaagtctttaaacatttcgatgcgaatctgcacccgtaccacttgcagcatagaaaatccatggccatggccgccgcgaacgtggagaagactctaaaataaacgtgaaagtccaggcatatgcattcgggctctccttcattacatctgaacgggtgcagagcgcgcagcgaagcaatgctgcagctgcttgccacaacatcaacgcccctttcccctgtcaagatgaggccggcggcggcggcaatggcgacgaagagcgagtaccggaggatggaggcggaggaggaggaggagctggacaaggaggagtgggcgcgcagggcggaggcgcagcgccgcaggcgtcggagcggcgggagatacgtcttcacctgcgcgctcttcgcgtcgctcaacgccatcctcctcggttacggtcagtctccctctcctgctcgatcgatctcacctcctccttgttcttctttctcctggctcctgccatgattccaagcttccaactccaagcttcagcagttcctcttaaaaaaaaagctttgcgtgatcgagttaaacgcttgaatcatgcgaaacttgtggcgacgcgaggacacgaacttccagatgggccaaaaaacttgccagttggttgcctggttacattccaagtgtgttgggagttttatttctcgtcggttaggtacgtgtacattgtacagtgtactgagatagttatatatatgcgagcatgctgtttgcaactttgcaaggaaatgtcggttgctacaaagtgttaggcagacgaataggagcctgtgatatgaatgatattgttgatgtagttacatggaactttctgtgatttttcgtcgtcgtactcaaggattgattagtccaaaccaccatgtctttgcttaaacttgtaggaaagtgacacctacaaattgtactatactactgttagttctgttgctgatttacacatttacaacagattttttaggtcaggttacaccaaattaaagaatttagaccacttccgagccatccatcttccacgataaaagaatcttaaacacaacccagatagttttttctacgctctaaatcactccattctccagtaacacatcactctcatggtcgatagaatagtcatatacggtaggagcgtccggacacgtagctcgtccaagtccagctcccgaatttttcctgtcaaaaccgagtggttgaccctgacaaaaccaacagaaatgttgatcaaaccatgaggaaatccacaaatttatttggagccctcgagcaacccacaagaaacgaagttggattcaccagaccgttccgagaaaaaaaacagggagttaacgttttgtcagtttcaattcgggaagtccaatttttggcaaaaaaaaaacaaaacaaaacggtttttattggttttgtaaaccctggttctccttctatactactctctcgttacataatataaagatttttagggttaaataaaataggtagaattaaataggggaaaattgttattgattgaaaagtggaggtatatgataaaattgaatggtggagggttgtgattggtttagaagagaatgttggtgaagaagtagttatattttggcacaaatcttaaggactagaagttattatattttgagatggagggagtagttgataccccgcgctttgctacatgatatgtagatgaatgcatcttatgtattacataactagtacatgtatatatgaaaatgatgtgaaaataataatttgacgttgtttgcatattatttaaaatactctacataataattactagtgagtgatgatgtgacacacttataaatattagggtgagtttgagagggggggggaagagaaaattaagatacgcaaaatgaggtgagccattagtacattattaattgagtataaactattttaaacttaaaaaatagattaatatgatttttttaagcaactttcatatagaaaatttttacaaaaaacacaccgtttagtagttcgggaagcgtgcgcgtggaaaacgaaactaactaactcacaaaactcctcctgccgaacgctccctagttttaggagttagtttatagtaatattaggattatgtacaagagaaaaatggtgaagggatcatcttgcaaatatttatagtacttgggatcagaatacacaaaacattagagaaatggaaatcctctctcctcctgtaggaaagggaacaggcaaccttcgagggcgaagcacatcgacatctcccacctttctcgcgcccccattggattgggggcgtccgccattgatgaccagctccgaatctagtacggcgaatcgcccgcggcaaggagcagcgtcgccgtcgcccgtggatcgccgggagcccggagggaggcggcgatggcgggcgcggaggccgccaatggcaggaacaagtacgcggttcttgatcccagcgacgagccggaggggcggaggaggccctcggcgtgggagcggaggagcaaggagcggttcgtgctcgcctgcgccatcttcgcctcgctcaacgccatcctcctcggctacggtgagttcttgcaatgccgttggcgtgcccccctccccgtccccggggatccgagcttacgaataagaacagcgcatttttcttgcaaattcgtgcgcccgtgagtggaaccgcagtttcgttccgacagtgatagcacttcgttaatcgtaaccgcttagagagcatgctttccgtacattcacgagaaaaagaaaatctttgatttatttctgaacgctatcaacgacgagagagagaggggaaagggggcaaagtcgcagttcttatgatttgatggaaatgttttgttatctatagttatctggaatctggatggtcctcatgcaggattctgtccttccttgctccaaaacgacgagcaaatcagcatctgaaataggacaactgagttattaaaattaaagattccaagggattgattccccgcagctgccaagatcttttataacccagtgctcatgttgtatctgcagatgttggtgtaatgagtggcgcaataatctacattcagaaagatcttcacattaccgaatttcaggaagaaatcctagttggttgcttgagtgtggtttcactcttgggaagtctgtcaggaggaagaacatctgatgcaattggcaggaaatggacaatggctcttggtgcaattgtcttccaggctggtgcagccataatgacgttcgccccttcattcaccgtgctcatgatcgggaggctccttgctggtgtgggcattggctttggtgccatggtatctgcagtctatatcgctgagatatcccctgcagctgcccgtgggactctcacatccctccctgagatctgtatcaatttagggatcctccttggttatgtttccaactatgctttctcgggcctttcagagcatatcaattggaggattatgcttggtgttggtatcctcccatctgtcttcattggatttgcactttttgtgatcccagaatcacccaggtggttgatgatggaaaagagagttccagaagccagggcagtattgctgcagataagtgagtctgaagctgaggttgaagaaaggattgctgagattgaggaagctgcaaatcttcttaaatcgacgaaatccgaggacaaggcagtgtggatggagctgttgaacccttctcctgctgttcgtcggatgctatatgctggctgtggtatccaaatgttccagcagatcacgggtattgatgctactgtctattacagcccaactattttcagagatgccgggatcaagtctgatcaggagcttcttgcagccacagtggctgttggttttactaagacagtgttcatattggttgcaattttcctcattgataaagttggacgcaaaccgcttctttatgttagcaccattggaatgactatgtgcttatttgtcttggggattgcactcacattgcaaaagcatgccatgggacttatttctccaagaattgggattgacctagcagtttttgcagtttgtggaaatgtggctttcttttcaattggcatgggtccaatatgttgggtcttgtcttcagagatatttcctttgagattacgagctcaagcatcggcactaggtcaagtaggtggtagagtgagcagtggtttggtttccatgtcatttctttccatggcccgtattatatcagtggcaggaatgttctttgtctttgcggttatctcgactgtctctgtggcctttgtgtatttctgcgtgccagaaacgaaagggaaaactctggagcagattgagatgatgtttgaaggtgggaaagaatggagagggagtgagatagagcttgaggatacacaacatttaatacagagcagcaagaagtctgtgtctctaggctgacactattagaaacaataaattcgaaatcattcgatgttcaatgatgaaccatacttatcctgcttccatcgcctacgggattctgaaattcaggtctgcaaaatgatcaggctgccttggactgctacggattttgagggcttaacacgagtatattaggtgtaggcgcaaaacagcatgtaaatgtctgctttacacaactacatcccaaaatgttacctgggaggacacagatgatgttgtatatggcggtatcttccacctaccaaaaaatatagttgttgaagttccttattccacagtttaattttaatagaggaagaggtgtgtgatttccaactgaatgaattctgtgtgattcttgatccagctttttgatttagtccttcatgatattgtagtactgtggctttgttggtctagtataaaaccttcaagaccatgccatgtctatagctttgcattgacgtgcagagttctgtaaataccagatttggatgattcattctgtcaaattaattatttactgaaagtgcactgtgactctgtgagtcaaagattagcatagcttcatatacatatttttttttttttgccgtgccgacaaaatcttacaagtgcaaagccactgttattttgtcattgcttacctgccaagtgaagatgtacattttgtctgacatcccacatattccaatctcgttatctctttgcatttgtgcaactattcatactttgcaaacatggaggaattgcagaacaagcagctgtctgagagtaaccttccaatcacactgccctcctccatttccaggctcctgctctccctgttccacagatggatgccaaagctctcacctttgatgctctcaaccttggccttcacccacctctcgcccttcctgtccttgggtgcaacgaacagcccgccgatcttgttccagtcgacggggtagaacgccgccggcggcagcaccgtcaggtcagcctccgcctccggcctccggcggcgacgccacctcgccgccaccctcgacacgaggtacggcccgttgtggccccacttgctgccgtcgaacttggcggcgaactcagcgatgaactcgcggagcagcgggtggccccggtcgaacaccatgacggcgttgttgaggcgcatccagtcgccggtggacgcgtccacggcctgcgcgccgatggcgttgcggaggtcggagaagggcctgagaacgacgacgtcggcgtcgaggtagacaccgccgtacttgtagagcagggcgaggcggaggaggttggagaggttctgcccgagcgggatgctgccggggctgacgtccccgcgctgcaccgcgcccagccacgcctccgccggcgtgccgttcaggaggtaggccatgtccggcgaggcggcggcgacgcggaggccgcggtcgaggaacgggccgagcctgtcgccgccgccgtcggagtccatggtgtcggaggcgatgaggaggcaggcgtcgcggtgcgacctgaagaggctctccacgacgaggagctcgcggcggccgaaccgcgcgagcggggagagccacgtcatgaaaaagcgccgcgtgcacggccgcggcgaggcgaagagctcgcccgcgcgcgccgcgaaccgccgcgtccggggagtctccctgagcagcagcttgaggaggctcttgttcctcttcgcggacgccttcttgttgctcttggcaggagaagcaggaggagccggcggcggaagaggaggtgtcggtgtcggtgtcgtcgtcgtcgtcggtgtcggcggcggcggcgacgatgcatggaaggctcgcagcgacttgtccatggatacatcaagtgtaggaggagcagcggccaccgtcgtcgtagccatcgtcgtggcattcggcctcgaagttggccgcgggaggagtgggcagagcaggaggctgaaggtggtgtgcgagaggaggaagacgagggagagaagcaggaggaggaaagggagggagagggagaggaggagcaatggcaatggcttccgcggcgtcggcggcggcgccatcgtcggaggaggaggagcaggcgccatggcgttcgccttggtggcaactggcgccatgtgcacgtacgtgcaccgggcgcctgcctcttggagccaagggattttctgcgtggacccttcgaagcaggggaagggagagcgcgctatcagcgtgtgccgctgcacaacacaagcacaatgctcgccgataggttaaaatttttctttaagcacacttgctagttttgtggcgttttgttttggagaggcactgcctgcctcagtggtgtcaatgtgtggtgtgctgtcatgcattctctccaatttaagtctagtgtatgcttttacttagtacggagtattaggatatctgtacatatatgagtctttttgtgtccacttccaacttccaagtttgatttgcgtttttccttaggtgcatcaagtttatttctgaagtgccttgcatgcatgttctgatgatgtaacaggctaaccgactaaacacttaaacagtatataaagtgaccactacttgatctcataaatcatggctaaatttttgatgcagtaaaggagagcaaatgagcaaattagaccatcatgatcctaccttacgtactgctaacttttacatccagtcagcttatgtatgatgtatcataacagacagcatattggatatatcagcattgagaaaacttcgcattcagatcggcacgcccatagcattcaggcagcacgaaatgtgcgatgtacgcagcttaattggattagataatcgacttgcatgtggcacgctataaaatttgacatggtatataaactgaaacagctaggagataagtcaaagcttggcgatgccaccgtgcgaggatctgaatagatccctctgaaaaatatcaggaactactttaagaaactactaatcgacttatattgctgggtgaattccttatagaaagtagaaactgtccctcgacttatagtgcaggacatattttgctagcctcaccattgcatcacagaaacgtagttggagtgaggtgcagtagttagatcaaggaattggcgtgacgggattatgagataaaggacaacaataaaaatttagacctgctattctccagaatttgcagtctttactacagcttgtaagttacaaactactccaattttcaccagaagaacctctctcggtgccatgagctacataaatttgttactcctatttgtgtttggatcagaatcttacacagtaagattaaatctgctgcacttaatcagaactttagacaacggagaaatgaaatatatgctaatcataaaccagataatggtagattggatatgcacacaatcatatgcaagatacaagcattagaaatatcattcgagttatccattcatctcttcaaagttttaaccgtaggttactctccatatctggaaatggatacattagtaaatttagcgaatgtgactcaaagttcataacctggaaacctagaatcaagggggttaatcatgtccagaaacaggtaagccattccaacttgtccttcaaacaaggaatacggctcatcaccactgtgcatgatgccatccgcaatcagttgtttagctcggtcaaggagaaagcaagcgaaagctttagcacggtagaggtgttccttctttttcgttaggcggaaaagtgctagaaatgtataggcgttcccacttactccatggcatattccaactcttttgagcagccctctattccaaacaacctctgccgcctctgcaattgcctcaaggaatcgttcttctgggaacacctggtaaggatatgacatagtatatgcagaatgtaacagattgccagaacgaaacatgcagccaaagcaggtggttgagatgagatgatctgagaatagaaaacaaacctgtgaagcctttgctaaggtgagggaaatgccaggagccccatggcaccagtgcacaaatcgatcatgcttatcctcctcagtaacagggtaattaccactagggaaccggttctgaatcatgtagcgcaaggttccctttacgcattccgtgtcatctttagtcaagtccatgtccagcaaaacatgcatgatcccagaaagtccatgagcagcaccccaatacttctcaccataccattcatacatcaatgggcagcctatcgtggacagtgttctaccatctctgataatatctctcatgacagtgtcctacaaatagttcaatagaatgatgatgatcatccatcgcatgtgcccagcgatcatccaacaagtatgaatggaagaatgacaaatgaaggcactaaagattgaactgtgtacttactgtagtggttggcggtatagtattatctccaaggtgcttgtttaggaaggtgcatgcccataggtatccagctcttccatatagaagctcatcaggtgatttactatgaattttgatctataccaggataatacatgttatgtcacatgaacatgggccatactaccatagataacatattgctttgtttagatggatgaactttcaagtgagtaaagagacatacttgggactaacattttttttctataaaacagtgcaaccgatcaaacgtaaaattgttattgcatactgtaataaaacagcagtaaaatttctatggttcagtgttgtttgatatgtggcttcttatttagaaacagcaatttcatttcttaggagctcaagccaagtcctgataattaatctatctattatattattaaaaaagctttgaaaggaggcaccacgttcgctgtgagggctagaaattctcacattaatcggagaaaaagaaaaaaaaaagaaaaggagagtccaagtagaaatacaatctaaaaatagctgaaattcggaattaaaaataagcaatattgaaagaagttttcatataagaacccaatacgagatttatcaaaattcaaaataaaaataaaatcaaatccaaaattagaaaaaggaaagaagagtccaagtagaaatacaatttaaaaatagctgaaattcggaattaaaaattagcaatattgaaagaagtt

SEQ ID NO: 66930 - DNA, 877 bp, Oryza sativa
  unsure (1)..(877): unsure at all n locations
aggataatatttacatcaatccacaaactctcatacgttcatcttaaattgcgcttgtttacttggggtttgtccggtgatgctttcacatgtctcacttctttaccatcaaattctatccatacatggtccctactattatacacaccataggttgatttttctactgcagagaatggcttaggattatgtgatttaacatcggcttaaccaaaagtataatgagcctgtcattgattatattaagagatttacggatgttagaaaccgatgttatagcttgaatataactgatagagatttggctggtcttgcttttaatggtttaattgctcctcttagagaaagactagatggccaactgtcacaccctgaaaattcaaaatatataaattgttgtttaaatggaatttttagaatttattttttaaaagtcttgaagagaagatctaattttaattaataaattccaatataaaatgggcccagataaaatttcattaaatactttgcttaattctataattcctagatttttctgggatttatttgagctaaggaagtatttttaataaatggaattacatttaagaaataatttaaattgaaaaaggttttaaaaagtcttcttttgggcccaaaacccttctctctctcctcggcccagtccggggagaaacaatcggttgataaaagtgaatcatctccaaaagaagacatggatatcaacatggtttgtatgttgcctatggagttttgtgctatggatgaagccgaggttgctcaactttcattaggtcctaaagatgcggtttttgagaagcccgatgaatcaaaccgtcatatgggtaccgagtggacatttcaaangcacact

SEQ ID NO: 66931 - DNA, 723 bp, Oryza sativa
  unsure (1)..(723): unsure at all n locations
cgtgattagataggcangtanantgcannnncncannnnanagganncccctannggnggcctgataccagccatcttcagcttatcagggtcaattggtcttgtaaatagcattactggctcctcaggatcccgcatttcaggaacctgttaaatcatgatccaaatataaacatgacaaataaaaaattagatgagttgccatgtgaacctaaattttagtttcactatccaacaactatctagagcaacagaaattgtgcctagcaagcccatcaatttctggctgttctttcagacaaatttgggaattaggggtgaaagaagtcaaaatagataggaaaatgctcaaaaggttttctgaaccatatttttatgagaattgaaaatggtaacaaatgaatatgatgaggaaaaaactgcgttcattacccccgtaggaacctattgttatacatcaatgcccttcgggttaaagaatgcaggtcctacttttcagcgtactactcgaatttctttgggtagtcaaataggacgtaatgttgaggcgtatgtcgatgacttggttgtaaaaacgcgcaaccaagagaccttactttcagatctagcggaaacttttgagaatctccgctccgcccgcataaaactgaaccccgataagtgtgtgtttggtgtacctgcgggtaagcttctcgggttcttggtctctgcccgaggcaatga

SEQ ID NO: 66932 - DNA, 526 bp, Oryza sativa
  unsure (1)..(526): unsure at all n locations
cgagagcatttgagtntacgtttgactatagggcgaattcgagctcggtacccatgtcggtgggttgcgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgtttgctaaataaaatgttttacaaccgcctttatgcaaatagccacaaacccctccttgtatccccttgcacgtccgcatcgttggtgtggcttgctgagtacggtggttgtactcagccttgctattattcccccttttcagaagtgtagtgcttctgagctgaagatggagttagaggaccaaggctcagaccccagttgagttttgcctgtggagtggagctgaagccccgct

SEQ ID NO: 66933 - DNA, 4233 bp, Oryza sativa
agggtgggtggggtttgtgaggggagtagtttaattataacgcaccctgggtgcggtttagcgcatccacacatatatatatatatatatatatatatatatatataaattcatttgcaaagatttgattttttagggacagagccaggtagcagtagaccagtagtaattttatgctcacagcatgcatgcacagggcaatgcatggatgcatatcatttcgacttacgcttgcacaggggaaaaagatgctgtctgtgccaacaaacagagagccccatcactctcgatctctctcagaatgcgtaacaagccaatggatgataaataaactgatgcagtacatgttgatcgatgaagtttcaattcgcccgtttttggattttatttggggagggatcgattatttttggattattcatggcacacattcagaggtatacgtatgatttctctaaaagctatgcttaggtgatgtcaggtttatgtacgtatatgataatatttaattcatccttaattatggccgagtttagttttaaaatttttctttaaacttctaacttttccatcacatcaaaactttcctacacacataaactttcaacttttccgtcacatcgtttcaatttaaaccaaacttccaattctgacgtgaactaaacacactctatattatatataaataataggtcatccatcggatccgcttttatctgcatatatatatttcatctaaaaagaacgggcgcccatctgatacgatttatattaaggatatatagaacagttctcactgcggatagacaccgtagcattacataattattaatactccttatgatctttttatttgatattaggagatctaactgaacttaattttcatggcgtcaaattaataaggtaaccgaagagtagtacttgttcggtgtatataaatacaaactgaaaagatcaaattatcttggttaaaaacagttgttgcttgtctttttttctctcactctctcgtcttccaggtgcatctttaactacaagtccacagatattagaaaaaaatagattacaggattataaaatagtcttcaagacaaatctacaaactacataccatttttttatatttttatttagatctaaatctctactattataaaaattaaagatattttttgccggtattttagtacatcatccgtgtatgagtcaatttaagttcgttcgcttttggaaatatatatccgtatttgagtgggtttttaagttagttcgcttttggaaatacatgagtctatataagaaatctatttaaaaaatctcgcatgctaacttgagatgaacgaattcctaactgcagctcatgattttctaaaaaaatatatatatccaaacgaattcccacagcgagtttcaccttaactaaaccatataaaaataataagattaaaattgccttcacccgttgcaacgcacgggtattttttctagcattttaaaagtcctcaagtcaaagtttaagtaggagctttgcgaaaaggtgaaatattcatgaccagaaaaatttaataattctctccattaaccttctacttttccttcattcaaaagctcattttattgtatttacttttcaaagctgatttggctcagaaaaaaatttaaaaggacccagagctagcaagctaggcgcatgcatggatgatgaggtttgacgaatccattggtcagagtcaacaaaagcatatgcatgtgcgtgcgtgggactttgatagcatgcagcacaaaaagaaataaaagcaaaggaaaggttcatgtagcaatggaaagatcaattgggatagcattcgatttcgaccaggcttcatcagattctccctgcctttagatttgatcttggagagacactctcaaagatgatcaaagggccgtacattggattgtgtgaaaagatgagatttatccgtgcatggcaactcgagtagtacaactacactctctgcagtgtagtagcctctgcatcaactagaacaattgtgtcattcagtatgcaaaattcctatctatatgcaccataacaaattatgatcctccaaccggtttttaatgtttaagtgtatggttaacttttaaacgtgggttttgactgttcgtcttattaaaaaattacgtagttattacttatttttgttgtgatttgttttgctattaaaaatactttaagcatgattggaacgtatgactaaaagtcaagaacaatctacatatattaaaaatcggaggcagtacaaatagacatcacatttttgcctgactacttgtataccgacaacattcaaagctctcatccatggcatattcttcacataatttgttactagttccttttggaatatgaagtcttttagaacctcgtggaaacgtgcccatactcttcaaagaggttctctatacatgtattttgtcttgcatataagatttctaacatcaagttcgatgaatatccaacatattggacatgcttatgtttgtagtgtaacccaccctcgtccttcacatctctctttccctagaactagctaccagtcataactataacaatctagtcttgtatgaccaattccctatgacgaatagggaaaatgtcatcgatctatgacggattcttaaaaaataataagtataccctcgcactacacatcttccgctaagttgatagggtatgttgctagctattattgctatcctccctatgttacttgacctctttcttcactgctagtctcctttgctaggctagtgccaatctacttgctattgtcctcttcctcgtaatccaatggttcttatgtatgtcctgactatctgcacttttaatctcacttgtcttcaacctaacaactctagtagcacgtgccatcactgatctcccacctggggtgcgccccaaccaggtggagaacgaccctttgcaccccttggtcgtcctcccgcccctataaataggtaggtaccccttcagggtttcttgagttttgtttagattaaagtttagctttgctactttgccgtgtaatcccgtgatcggttagatcgccggttaactcgttacggaaccccaacttatcatttgtattcaattcctatctgcaattcagattgcttttatcttgttcttgcttgtttctttgatttgcttgcaggaataaggttgatctgcaccggcaagatcaacaacccatggagaggtgtatcgatcgctaaggcgcaatacaacaacatctagtacggttgtagtcgggtcgtcaacgtttctcccaaatcgtagttatcatcaactcaccaaaagatcgggccaacaacaatcttgattgtctcaagtggagctcagggttcatcaggtggtatcagagctttcgttgctcggtgagtttttatctacctataatcagaaaattgccatacaaaaaaaatatatcatgtacctaaccatacttgtgccattgcattgtcgagtcgtagtttatttgttatttgttgagttttttatttgttgagttttctgttgcatcgtcgagtcgtagttgctggtcttagcatctagttcgtttagagtttcgagttctggtcacattttataccacagtcgttgtcgcccccgtgtctctgttgtcatcgggacctacgaaaatgaaatcggcttgctgccacggttctatttttgtagttttcagaagtttccgtcggttggttttggagttgttgagttgcaaataggaatctaggatttatgtcgtgtggttgccctctgttccgtggttctgtatatgctcttgcacggccgtgctgatgcgcgtgaggaagatggaaggtgtgcggaagatggaaggtagagattagattagtttggtttggttcgggaaggaaatagttgattggattggctgaagatcatatttccttttttttttatctcttgcatgcgcaccaaatccaaacacctgccgtatccttccaccccgcacccaccaccactgtgacagagtccgactccctccctctcctcttggtttcagtccacaccgtgagttgctatacatcttggtgaaaatttttggagtgtcggattggagatctcgtccatcgtcagttgccaattcccttaaacatatcatggagccagtggtggagctggctaccatgggcaatagcacaggctccgccagacgcatg

SEQ ID NO: 66934 - DNA, 705 bp, Oryza sativa
cccaaatgtatgttctagtatttctgttgcatggcttcagctgcctccctacctgcaagataaccgagtgatcgtttttctgctttaattgttgctgcctgcatggctgcatctttgtggtacgtagttcagggaaatcccatcagtggcacataatctcattgctttttttttctcacttactactatcttcgtattttaatgtatgacgccgttaactttttatccaacgtttgaccattcgttttattcaaaaaatttatataattatcatttattttactgtgacttgaatcgttatcaaatattctttaagcatgacataaatattttcatatttgcataaaaaatttgaataaaacaaatggttaaacgttggtcaaaaaatcagcgacgtcatacattaaaatacattaaaatacggagggagtactgcttagtgcattccatctcgccagctcccatgagctaatgtcaatcacttgctaaaactattactaattaaatttctaagtcatgtttatgctgctacacatgcatgtatctcaatatcttagagctagcgagagggcttcattttgttcattacgttaattgtcagacagaactagaaatatccgggactcctaattcctgatgagcagcactgctggcaataacaaacctttaacaaaaaaatgtcaaggtccagtatgtcagcatata

SEQ ID NO: 66935 - DNA, 32948 bp, Oryza sativa
aaacaagtaattgtgttgcttttggtcagagtcctctatatgctacttgttgcgtttcagaattttattggctgttattgaacaaccttctattacgagctaattaagtgtttcctacgacgtgctggcagctttggattcgtttgtcgtttgatgtgcatcccttgttcggacttcggagggctgtttgtcaccagcagattctcttctgaattctaatggagcagattcatatatatgtccggtatacgatctcgaagtatcagttcgtccagtaattaagttacacaattagactgatgattgttttgcctcatattgttaatgtactgttacagaaaattaatatatttggcaaacaaaaatgtatgcatggactgttaaaaaaagagttattcttttttttaaaaaaaacatgtatctacggcctgcaataattgatgctttacctcagctgatcgcttggataatacttatatataatttagatatcccgttacaacgcacgggcgtatgtttgctagttatatacatgcatgtaagactgcaaattacggtgtatcatcatgcaaatcttgataaattggatttttgtttcttgaaatgacctatatgggacatgggacaattatatatttatatgttgtcactgcactatttttttttagtctgaactttgattaatagttatttgaatggaattttcgggcactatgttttttctaccttaatattaggtcactttatatctaagcagttagtaaaaaaaataaacagtcagtttttttctaccttgacaaccccaagttcgtaataaatattggcatcggtcttttcaaagtgtaataaaaacaacaaataaggaacttaattcagcagaattagcacagttaatcccacaagtgtatacaagtaccactataacaaatattttaatcaatcatgttataggccatcagttgtacatgcactgcagacgggacaatctcgacaagccttaatttctatcaacagccacttcttcctcagactcattgggagcccaagaagagacctaaataggcggccattgtcacggcaaagaatactatacgctttcagcaaatcatcgcgagaaagctcaggaatctcttcaagtgctaccaatatctcctcaggagccatccttgacacctgcagatgtttggcagatggcaaagattgcgacagattattaccgttgatttcggttgtgatcgtcgtcgttgcctcgcagatgatggccggtggtggctttgtagcaaaattgtttggaatgtaagtgtgtccataagatggctctcgttgggaaatatcatcatcgtatgtgcatactgatagcagtgtcttgttcttggtgtccatcgtcatctcccatgtcgttctttcgaaatagggtttcccctgtttgtgattgtatggctcggtcacgaggaagcagatgacgtcagcgtcgtctgtgctgatgacagggtactccgggatgacacgtgggatgccggcgtaggcgtcgagggaccagagctcggtggcgtcgatcatggcgtccatggtccatgacaacatggtgtggtcgccgtcgccgtcgatcctgagtgtccagatgttgatgacgaaggcgtggcgagaatggtcgcagagggtggcgccggggtcgccgcagcagcagcgggggaagacgtcgatgaacttgagctcgccatcaggcatctccgcgtgctctcgtcgtcgctgtcctcctcgaattcgccggcgggggcctccacggggagcggcacgtactgcagccgcgggggaatttcgtcgaacaggtcgtcgccgcagaggatgacgccgcggtacaggtcgacccagcagagccgccggtcgccgacggggacggccatgtcggtctcccagtaggagagctcctcgcccttgctgccgtcgtggatgatctccgcccgcgtgacgctccactcgccggagcggagcacgaggagcttgacctcctccagcttgctgctctcgctctccctggtggtgatgagctccgccaccacgaggtcgtcctcgccgtggcggcggcggcggcggcggaggaggccggtgctatctgcgtccagctggtgcaccttcggatcctgacgccgccttctttcgtcctcgtccaatggatcccagtaggacgggagcagcgacaacgacggcggccgtggtgggtcatcgtcgtcgccgtcgtcgtcggcggcggcgtaattgtagacgaagtaatcgatcccgaattcgtcgtagccttccttgtcgtaacgcatctcgaggagcactacggagtggtcgtcgtggtcagcgacgaggtccatcgagggtccgtccttgccgcacggggagcagcggaagctcacactacgccggaccaggtcatctctgacgggcccaaaccctcacctttgacgggtttggtcttggtcagtgattagtggtcactgatgacaaaatcacctgtgatgtatgaaacacccgtcacagatcacccatctgtgaccggtatataagtcatctagtgggggttaaaacttgtctcccgtcacagataagtcatcagtgacgtgtagtaactacctgaccgtcgctgatgactcatctctgacgggttgtaacttacgacccgtcactgatgacaaagtaagaaatataatttttgaattttaaacgcaacaaaaaacctcaaaaaaatattttgaattttactagcaatcctatacatggttacacatcactacctacaaattcacaatttttcacgcaatataacttgtatgctacaagtgagattcgaactcagacctcaacctccatatagagctctcttaccaactcacctactcaacacatattgactactaacccaatgttattattttgtctatgcttgtctgaatcatttaacatatatttaacaccctaaatgacttcaaatgaaaatattatcaactaaatagttatctcatcgtgttttataacttttacatagaaaatatcttcatccgatgttgtttgaagaattcaaaatttcatttttaaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggtttttttgcaaaatttacaaatttgaattttcactcatcactgacgggtcataaccaccacccgtcagagataacgttatctgtgacgtgtgttagttaaagacccgtcagagatgagtggtctcttttgtgatggttcataatactacacccgtcacaaatgacatgtcatttgtgacgagccatggttgtgacccgtcacagacgatctgtgacgggttacaagtgcaagccgtcacagatgactttacatctgtgacgggtcctccctggtagccatatattgaagaggatattttttcggcccgtcagagatgactcatctttgacgagttacgttggcccgtcacagatgacccgtcactgaagcccggatctgtagtagtgtcagctcggggcggaaggagacgcggacgagatggccggaggaggagcgggaggtcgcctcggtgattggcgccatcgccgtcgacgacctcgagcatcacccaccctgggtgggtggtagcctgaggcctgaatctctggccgccggcatcgccaagggctctagggtttcgatgagcggcgatggcggcggcgagaggctctgcacccgcacccggctgtgttcggggctccacggaattctgcctgattttagttaggccgggtttgacaggggtttcggcccaatccactctgaaccccggcccgggggcaaaaaaaaaaagaaataagtccactttgactctaactaattgccaaatctgattcgcatccttgaatcataataccggatatctcgactcccaactattaaaacagttgcaatttgactccatcaacagttttagagagcggtttcgctgacgtgacgtgtaacatcctgaaaattcaagacaatgaaaatcacgaaaatttcgaactttttaaaacttttgcatcatgctggttgttatgattgctattacttgccaaaccgtaaatgatcaccaagaaagtaaagaaaagaactacatttaagcaatagatatgatttacgggaatatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctgtatatataatagaattacgggagtatttaattcgatatgtagatcgattttgcaccaagttcctaattgcatttagggattgaaatttgatatattaaacccctccatataaaataaactaacatatagataaattgagctaatgtgctattgtgttaataacggtctcattagaaaattatagaatctttaataaaccttaaatattggacaatattaaattttgggaaaaattcacatttgaacacttaatacggtcacctaaatgcttgggagtaaatacaaatttaatttgcaacttttctcaatttataaatcaaccaaaaccctaaaagaagaaaaataggaaaactttgaaaaatatataataataataagaattaaccctaattaaaaattcaaataaattatataaataaaatatgagtaatattaatctagaataaatccattggttggaatgacacaaatattgggtaaacttctttatacaaaatctaggatttataaaatcaaatttacacaaaaaataggctaaaatggggattaaataggaaaagacactattcatcggccgccaggtgttcgacgtggtcccctaacccagcccctcctctttccccctctctctgtcgcctgccaccgcgccgacgtcgccatcgccgtccctgccccgcgctgccgtcgccgtcactgcctcgcgccgcgcgccgccgctgtcacgccgtcctgcgcccgcgcgtcgcgtccgtcgtgtcgccgtcatctcgagccccgcgccgccctgtcgccatcgccgcgcgccgagccccgtgccgtgccgcgccgtcccgtcgccgcgtcgccgtcccgtcgccgtgtcgccgtcccgtcgacgctccgccgtcgtcgtcgtgtcgcccgtcgccctcaccgcgcgccgagccccgcgccgtcccgagccccgcgccgccgcgccgccgtcgcgtcaccccctcccttctcttccctcttccccttattccctctctcccctataagagccaccgttctcccctctcctcactccatcttccccctcctctccctcttccccctctccacgcgccgccgcgccaccgccctcgtgctgtcgtgccgccgcattcgtgaccgccgcgctgccgcctcagtgtgccgcgccgtgcgccgtcgtcgccgccgtcggtgagccgctgcccccctatttgtcgtcgtgccgccgggtagagagggagccaagaaagagagaggaagggagaagccgagggagagaaagaagagggaaggaggagagaaaccggaaaggagagagagaaaggagaagaaaagaaaagagggagaaaggagaagaaaagaaaagagagagaaaggaaaagaaaagaaaagggagagaaaaaggagaggagagattagagtgggccccacgtgtttagtgaatagtaatccccttcttaatctttattagttgagtctattacatgtgggtccgggtggttaaaaatcaaattatagaagttttatggtctcgagttcatgacatgtgggccccacttgttattagctcttcctatttccctttagaaaataattcggtaggaaaaaggaataaacccggggtcccacttgtcaatggatatgtcttggattaaaaataaatcgtttatgaacagtagcttttcgcaatttctcggattaattcaaagttgaatctttacactagcataacttattcattttaactcggatttgagtgaaacttgaacctaaattcatctaaattcataagctttccaatgatatataattcactattcaataaaatatatttataattataaattaattaatatcaaatgattagataatagttaacctaaatagtgtgccaataaataaaaaaaatggatattgtacagtagcataattatctttaatatgtcttgtcactgtagcaaccaaataaattagttataatcaatccttcaaattaatgggtgtaaaggaaaatgttagtgccatttactagcctatgtccgaatataactaattccatgacttataaattatttacataaagtttagcctcatattttgtaactaaaatataaacacacatagatgagtctttaacttgtttaggagagtaatcacagagctagttgtatctggaccacttaaaaaaattagttgatacaatgtcatgtgaagtagaatatatatatatagtcggttgatatccattagttaaccaaatagagccatcttaaaatcaacatgtattgtatagcttacagtaaaaagaaactactcaaatatatgatccaataataagatattgttgcttacacatatactatacatcccattatagtggtacggtatagtattaatttgcgtattgcatatatgaaattaagagggagtgtatgacaaacatgtatattagataaatactagttataaatcttgacctcatataattataattatagttcaactgtaaattaggattattcattgtaaaattatgtgatgggataatctgtaaccatactatgattaacctaaacaattctaacatacaaagcaagggtaattgttaacctttataatttattttgacaagtaaaatatgtacataattaaaataaagcctccatcaataaaataataatacaaatgattcacagtaattatttgaccgatccaaatccatccggcaacaaaacctctagtgtataaccgttctatctagatagatgcatgaatagccatttgctagactaaaccacatagtagccagatacgtatctcattcatactacattggctagctcctaaatagaccaccatgataacagaaagattaagaaactttagcccttagcatgttggaaaccattagcaagcgcgaataatatgagcaaccttaggttcaacctcaacaaatatattttgtttgtgcatatttgattgttgcttgaatattggtttttctcgcgtattatagactttgtgtatcggttagtcgtgaggcaatgtcagcaacttccaggaggtgaaggttgatcaagaattatatcaagaataaggactatcctgagcaaggcaagtcatcactattcctcgaacatgttgatcctaattgcgaaattgttttgtttacaagtaaaaattgcatgcaatgatgaacatcctacttgtgattatgccatgccttgattattgtttacccttaaatctttgtaaccatgtttacgtatgagtccctagtcaactatgacaattgcttagaaatgctattctagaatcatgcatactcatatttatcaaatgctatatgcttgggcaattaccttcgggaaggtaattgagatgcggcatgtggagacatgagcgccacattgccatgatgttgatgacatgatttgtgaaaggagaaataaaattaaaacaactgttttcgactggggcggacggaggatttgggtggtatctggaaaaggctagtaccgtccccagtcaattaaggaccgagccatgaagttaagcatgaaacgactcccgtacaaccgtacttctcgaatgggtatagacctagcagattagatagccgagcggaggcagatccctgcatagatggttcacccctgagtgaggcaggtgcgctacgatgggacagccgttgaggtagggccgagaggcgtgccctacatcggtgttgccattggtaggactgccatgagtgtgtgagagagagaacttaacttgaaccataatttaatatgcgtgtgagacttctctttccccgggagcgccagaactcctctcactgctagaaacatggatgcctagagtgcatgaggatttaagttcatggagcgggtactgccaatgcaaggttatcgaaaagctttgccgtgacgcgtctcatgtgttgggacgaggctcatgtgttgggcagtcgcggagtgcgggtaaagtgtacatccactgcagtgtgagtaaaccagatctattcgaatagccgtgctcgcggttattgagcaccgggacatgtattacacttggctagactctaaattctttaacttgtgtgggatgggatattgcatgatgatttttatgctgatggagccacttcctgagaggcgggaatgtggacgtcctcagaaaaccataacgactcaatggcgggaagctatccttgggatcataatggatagtggacagaaccgtcgttgtttaatgtgaatactggtactaaaatttgatcagtctatgctaggtcttaggcttgtgaaaagaactgcaaaactagctttatgcaaaagaacctgaagccattccttgaaataccctctatcatatgcatcgttgctgtggtggcttgctgagtacggttggtactcacccttgctaattatatatcttttaggagagtgttgaagagaagcccttgtcggtacgcttgcgtatccaacaagatgatcggagtgcggtcttgttctaggtctcattccccagtcgactgcctgtggcatgttaaccgggcccttatattatttggtcttccgctgttgttctctgatagttgttggcctacctggccctaatgtaagtatttaaatcttttagcctgaattcattcgtgatatgttgtgattcaactatgtgtgtaccaactactgatccagggattggtacggataaacacagatgatttccgatttccaaaatcgggggtccacatgacgtccatgtggcatcccagtcatcaaataaattaaaaatagagtgggccccacctgtcatcttcttcctctacctctctcccatcctcccccctcccctctctctctccttctttcttcttctcagcgcatgacagcacgagcatcaccgccaccgcccagctctggcggccaccactcgcgtaatcgccaccgacgccgcgggccgctttattttttaatttagggtgggcccttcactttatttttaaatttatttgatgactgagatgccacgtggacgccacgtcagcgaaaccgttctccaaaaccgtcggaggagtcaaattgcaccgattttaatagttagggggtcaagatatccggtattatagtgtagggatacgaatcagattcgggcactagttaagaaagtcaaagtggacttattccaaaaaaaaatctcaacgaaccaacgacccccgctcgatcagtacggctgcagtacggctgcgtttgttccctaccttttggaactaatccctccgatacataaaacggaacgaccgcattattaattaggtattagctttttaaaataaaaagtagaataatatgattttctaaagcaacttttgtatcaaaatatttttagaaaaaatcaccatgtaaccgttcggaaaatgtacgcgcgaaaaacgatgaagatgagttgggaaagccagtgaacaaactcagccttaattcagcagagaagaatcagattgtatctctacttttagctatatcaacatttattatgtgcctgcttatattgagtaatttattggtatcctctttttttctgacatattatgagaattgattcttaagataatgcgatgtgactctccgtacgtgtttggtggagagaaaaataaatgtgataaatttctacggtagttgacatcctcacctaatgctgtgtcaacttgtgttataatccttttggtcttcctgttaagttcatccttcaccgcttgaattaaaccttttgtgtacctcgtgacaccaccatgaaataattttgatgtacgtttagatctaacaactcaattatgactcattatgatcttgaagaacaactaggattctagcggctatagccataatttggtctgagaaatagcaaaagctacatgttttggtcagtccaccgaaaagggggaaaagcattgactcaagatgtttgtactaatctgtgacaaaaatgtgtttgctgctatatgtattaattcgtgaggtttccttgtctttagctcctaatgcctcgaatgcacttttgatggtttgttgattattatgtttagactttagatattttggatatttctgttggcatgtatgtttagacttagatattttggattattatctgtttgtcaacagtatattttcaacctgacgatatgtcattgtttttttttaacctaatgctgaagtgcaaatctatacctcataaaaaaaatcataaggcttccatagaggattttcgtccgtcgcccagcgcgcacctcctctgcaaaccccaaattatcacacaatccaatccaacccaaaaacaaaatccaaatcaaaatcgaaatcatcacaaaatatcaactcaagagacaaaatatcaacacaagagatgatgagaggagaggaaggagcgagcgggaggccgccgctgctcctcgctggacctctacctcgccgcctcgctcccgtggaggtcccgagctcaggggctagatcctgaaccaccacgccaccgggaagccgctgcgtcaaggagcaactgacccgccatgccaccagggagccatcaccctgccgcgccgccgagagccatcgacccgctggatgtagcgaggagcggggcggcggcagcaccccgacgaggaggaaaggggcggccgacggtgcgaaattattcttatgtgtcaatccgttattaaaagtctaacattgattgtttattgaacaatattataagcttgttgccagggttcaatgtatcagaaaggggggaattttggtggttagaaaaatatgaaattgtggatatttttcagatatttcgaacgaaatattcaaacaaactttaaactctcgaacagaaaaaatgaggaaatttgacaagagatccgtcatttctagcaacttctgcaacaaaacaaacgagggcattcatgattcacaatgaaaaggacaccataggaacaacacacctgcagcttgggctgccgtcgcccatgacacggatgaagagcagttgccgtcgatgtcgccggagattgtggctatcaatgtcttccaaagtgtccgctccaccgctgcgcgccgcatcggtgtggggagcgcccgccccacctcggcgcctgtcgtcgacttcgccggagaggctgctcctccgccgttccaaccgccgccgaggaatagctgcggcgcgccgcctagctgcaaggaagatgtcgcctcgtgaggaaacaatagcaagggaccagggaagtgaatcaagtgatacaaatagggaagagaaagggaggaattaagaattttgactgattttgacccttttgatcaaaatatttgaccggtagccatttccatcggacccctctaaaagaactgaaatttcggaaattgtgaaccttgcttgtggcaacacaagcaatcttcattgtgttcatcttaaaggcttgggtgcttccacaaatcaatgaaaaatcctacttaagaaatatccatcagagaaatgtgcatatgcattaatgttaagacatattgtttcattattgcagaatgtttcaccaacagaaagttcttctcttgtgaatgttcaatagcattatgagatcaattcaagaataaacttgagtttaccttttttttttttactagtgtaggtgctgaattgacatctaagctattagccataatattggctcaacttttacaaatgtaaagaaaatctaaaaataaatatcacagtttgatagaatcaacaatgcatgcttagtgccaccaaaattaatttgcaacagatatttcaatcaatcatgttgtaggtgatctgttgtacatgcatagcagacaggacagtcctgataagccttaatttctatcaacaaccatttcttcctcatactcattgggagccccaaaagagatctaagcaggcagccattgtcacgacaaataatgccatacgctttcagcaaatcatcacaatccaacccaggtatctcttcgagtgccaccaagatctcctcaggagaagccatccttgacacctgcagatttttgggagatgactccaatgctaaaaattgtgacaaattactgctgatttcggttgtaattggcagcttgtcgatgttcgccggcggcattgttgtgacatcgccacagcttactacgtggtcggggattttgataggaatataagtgcatccatatggaagtagccatgagaaaatatcatcgtcgcgcaaaaccgacactagtgccttgctcttcgtgtccatcatgaccttccacatcgtctcgtcgtcgtcgtcgtcgtcgtcgacgcggtgtttacgccgtttgcgttctccgcgcacactgaggtagatgaggtttgggtcatgtatgctcacgatgggtaactgtggattcgtgtgtgggaggccgcttaggcgtcgagggaccagagctcggtggcgtcgatcatggcgtccatggtccatgatgacatgtcgccgtcgttgtccatcctcattgtccaggtgtggatgacgaaggcgccgccggaatggtcgcactgcgtcgcgccgcggcggccgcagcagcatcgcgggaagatgtcgacgaacttgagcgtggctccgccgtcgatggcgcagacggttcgggtgtcgagcaggcaatgccgccggttgccgccgcggcggtcgtgctcctcgtcgaacgcgccggcgggggcctccacggggagcggcacgtagcgcggccggcggcggaggggggcctgctcgtcgaacacgtcgtcgcagaggatgacgccgcggtacaggtcgacgtagcacagccgccggtcgccgacggggacggccatgtcggcctcccagtaggagagctcctcgcccttgccgtcgtcgtggacgatcggcgagatcggcgtggcgctccactcgccggagcggagcacgacgagctcggcgccctccaacgtgtcgcgcctgcggcgcctcttggtgaggagctccgccaccacgagctcgccgtcgccgccgccgccgcggcgcacgaggaggccggtgctcccttcacgcagctggtgcgccttggcgctctgatgcggacgatacgccgttttctcaacctctgacaatgggacccagtaagtcgggaacagcgacaaggacggcggcggacgtggtaggccgtcttcgtcggcgacggcggcggcgccggcattgtagacgaagtaatcgaagtgctcgtcgttctctcccttctcgtaatgcatctcgacgagcacggagtcgccgtgggcggcgacgacgttgatcgagggtccgtgaactctgtgcttgctgcacggcgagcagtggaagcttagctgcgacgccgccggtggcgcctcgaggcggagggagacgcggacgagatggccgtaggaggagcgggaggccgcctcggtgatcttggctccaccggagttggaggtggagtcctcgccatcgccctcgacctcgagttcggcgtagtggttgagcatcgcccaccctgggcagcctccggccgccgccgccgccggcggcggtagggtttccatgagcatcggcgagccgatctaatggggctcgagtggtcgacggagttatggaattaattacacaaagaaaacccagatgagtttatttgcaaaatattccccggccggtgtgcctctaggccctctagttctatgggaaatctgaaacagtataaaaaaacacgaatatcaagaaaggatctaatattaaataaataaataaaaaagatgggactttaaactcaggatgtatcttgtggagctagccgaaagatcactggacgtttctcgaaatctgacccccggacgtttctcgaaatctgatacagatgattttaatttcaagaagatttataactttccgtttgtttagacttcaaaatatttatccgttcaaaaaaagacttcaaaatatttaggattgttttcactagtatttcccaactgatcatctgtcatctttttttttcttttgaccgaatgtcataatgccactttgtcgtatttctcaatccgctctcaaaaataaaataatattgaaagcagtactttttttctgacatttgtttatttattggcagatatatatacggtgtgtgcacacgatagattcctatgatgtcaagtaccgtaaacattaacagcgccacaaacaatcatatgaaaattcttagctattccaaaatgaaaatagttattccaaaaaaatatccatcacatgaacatatataatatagtatgtatgtcaagacaaaactgtttaattattgcaaaatgtttcaccaacaaaaactttctctctgttggatcgatgaaaccacatataccaaaaggttgggcaaaattggtctgaaacgacttggatcgatctatcgtatacacttcttctgtcctaactggcagtacaattacactaaatttcgaaccctttttcatgtttggtagacacaactcctataagcttccacatcaaacttttctttggaaaatgaaatctatcgaaacattcaggcattccatgatgccgaccatcgcatggtcggcttcactggccagtcttcctccatggaggtcattatcagcgtcgacgggtcttccaacatcatacatgccacaaggtagccgatgatggacaatgtccgaaactttctagcctacttgaccgtccgagcttgccgtcgtagtactccagctagccgtctttcagtaggcaagactcggtgagctcgactctagtatgaatgaaaataaaaagatcattgcctgagttgtgtgatgtaaagtgagagtgtctctcctccttttatagcatttaatgacggttgtgaatggcggttaccacccataaccatcattgggagccaatgagaactctccatgtggaaggtgggggcggggggccgtgttggttgttcggcccaaccacttccaccgcctcaagacaccgaccttttctgtgaggctgacatgtgggttcttatgacaatgcatggtggataagcctaattatatcagttttactctgatttatgagcccttaaatccgtgtggtcacgtctgattggccagatatgtgtttcttcgcatagcgggtgattgtgatacaatgtttcttcacatggcaggtgagttttcatacagaattacctgcatacaaatatttcactaacacctgtggaaatagttagtaataaactctaccactatgcccagtgtttcattttagttttttttctgcaggaatggatggcacacttaacatttaaggatcgtcaacaagctatcaaccataatattggacatctaagctatgaaccataatattggcaccattcttccaagtgtaaaagaattaaaaataagaaaaacaatccaccagaatcaacacaatccaatagttaatcacacaatgtatacttagtaccaacaaaagtaatttacaaaagacattccaatatatcatgatcatgttgtacatgtagagcagacatgacagtttagataagccttaatttctatcagcaacaatttcttcctcatactcattgggagccccataagggctttgaatagacggccattgtcacgacaaagaatgctataagctgttagcaaatcatcacaatccaacccaggtatctcttcaagtgctaccaagatctccccaggagaagccattaacacatacagactttggggagatgactcggatggcaaagattgcgacaaattagtgccagttccggttgcagttggtgttgcaattggtatcttgtcgaccatcgctggcaacattgtcgtggctttgctataactcacataggtagcaaagcagtcagggattttgacaggaatacaagtgtatcatgtggctgtcgccaatggcaccgaccgtcgccgcgccaaaccgacactagtgccttgctccttgtatccatcatgatcttccataccacctcttcggcgacgtaatgtgcaccccgtttgcgttcttcgtccacaatgaggcagacgagatttggatcatccatgctcactatggggtgtagtggaaagctccgtgggagggcggagtaggcgtcgagggaccaagctcggcggcgtcgatcatggcgtccatggtccacgccatgtcgtcgtcgccgtcgccgtcgatcctcagtgtccaggttctgatgacgaaggcgcggctcgaacggtcgcaggtggtgtgcttgcccaggctgccgcagcagcagcgggaggagatgtcgacgaatttgagcgcggcgccgccgccgtcgatggcgcagatgacggttcgagtgttgagcagacaacgccgatagttgtcgccctggcggtcgaagtgctcctcgtcgaacgcgccggcgggggcctccacggggagcgacacgtactgcagccgcgggggaatttcgtcgaacaggtcgtcgccgcagaggatgacgccgcggtacaggtcgacgtagcacagcagccggtcgccgacggggacggccatgtcggtctcccagtaggagagctcctcgcccttgccgtcgtcgtggacgatcggcgcgatcggcgtggcgctccactcgccggagcggagcacgacgagctcggcgccctccagcgtgtcgcgcctgcggtactcctcggtgaggagcgccgccaccacgagctcgtcgtcgtcgtcgtcgccgcagcggcgcacgaggaggccggtgctacctccacgcagccggggcggcttggtattggtaccctgataagtcgggagagcgacaacgacggcggccgccgtggtgggtcctcgtcgccgtcgccggcattgtagaagaagtaatcgatcccgtattgttggtacccttccttctggtaatgcatctcgaggagcacggagtcgccgtgggcagcgacgacgtacatcgagggccggtaatgatgagctccgtatccggagccgccgcacggtgagcagtggaagcttagccccgacgccgccggtggcgactcgaggcggagggagacgcggacgagatggccggacgaggagcgggaggccgccccggtgatcttggctccaccggagttggaggtggagtactccgagtcgtcgacctcgcgttcggccgtggcgtagggcatgagcatcacccaccctgggtagcctctggccgccgccgccgccgccggcggcggaacgccggaaggcagcgtcgccgtcgccgtcgcaaccggccgtagggtttccatgagcggcgccgcgagccgatcgatcggagttttggagatcacgtgtttatttacgtatgggtacaaaaacctagatgagtttatttggaatacttaccgcctcaccggcaagccaccccccccccctccccgcggattatttggaactaaaattagttcggctaaaaattttggatttttttctttttttgaatttagcaaaattattcaaattgaaccatattttatttaaatttcaaattatttcggaccgaatttttccgtcgtatcggtgccctccgatagaaagtgccggtgcgatatatcgaaccctgctccccggcctgttcctctagtcctgtcctatcagaaatctgatatatatccttgattttaaatttcaagaagttttgaaaccttccgtttgtttagactataaaatattttggatttttttactgtttgccaccagtatattaccctatttccaaaccgacgatcttgtcgttgtttttttttctttttactgaattactgaatgccgtaatgccacttatttcttattgtatttctcaatctgcaactaaaagtgtaataatattgaaagtaaatgcacagatttttttttctaaaattttcaatggtatttgttaattggtgtgtgcacgaaagacttatgttcacaggatatcgtaaacgtcaatggcgccacaatcatacaaaagtccttggtgtttccttccacaatgaaaatatgtgaggagtatattaacagaaagtcctacaaagtattacaaagaattatccatcacagaaacatatgctagtatatatgtcaagacaaaactgtttaattattgcaaaaatgtttcaccaacaaaaacttcttctctgttggattgatgaagccagatacgaaaagttggacaaaattgctctgaaacgacttggatctatcgtatacacttctgtcctaactgacagtacagttacagtaaattttgaaccccattttcatgtttggacaaaactcctataagtttccacattgaacctctctttgggaaaaaaaaattctatcaaaacatttcaggcattccatgatgctgaccgtcgcatggtcggcttcaccggccggtcttcctccatggagatcatcatcagcgtcgacgggtcctccagcatcatacgggctacgaggtagccagcgatggaccatgtctggaacttcctggcctgcttgccgatgaaccgtcccagcttgccatcgtagtactctggccagccgtccttcagtagcctggactcggcgagctcaatggcgcgcttcgccatctgcggacgcccagtcttgatgcaggctgctgtcagcagccacaggagaactgcagatgggagaacacacacataaacgttaagatcttggaatgaggattcaggtgactttggttgtgaacatcagaatcacatttcgccaactatctagggaacacgaagatcggatcaactttaggaaaaaaaaaagtgccacactcaaccctcaaagggatctgtcggttctgttcaatttgatgaaaacagatgaagaagtcaaaatttcatagccataagcaccttagctacccccaaaaagttagtttttacagcttctgtatgacattaaggatcttacagtataagacttgattaataaaaattattagaacaaagtcattatcagaagaggtgaatgttgaatagtattatgtgatcgatttcagaataaactttagtttacctatttattattgtgtgtgatgaattgacatctaagctatcagccataatattggacatgactaatttttatgaagagtaatgcatagtaaggatcagcaacagaatcatctcaagttagcacagtgcaaaaggaaaactttaacctggccatgatcctccattgtgataactccaccgggtgttcttcgggtcgcagccagtgattattctccattcatggttctcaattgcagggtaacatatcttcagaggcatctcaccaactagctcttcccaccgctcctcaatcagatccattattgccactgattgctctggagtagccagagatgatataatggcaatgcaatttccaagggcaaaccaccgaaagtccatcatagctgggctcacgttgccaaggaagtagcctccccggcatggcatgaaatcaaacacccagtcagggattgaatccgggatgacattgaatttgttcacagcagtgtgtgaatactcctctgttttatatctgtatatgttattcaggtgtgggaaatctagccagaagtaattcctcatgtggtaggttagagcatgtagccgttgccctatcttttctatgaaatccttcccttcaccatctggcttaagcatctgcagagcacatctcaacgccatgtagaatagagcttggatctcaataggataaccatatataccctggaaataatagtagatttaacatttgagccaaacagtcatgtaatgataaggatctcaatcaccaattataaaattgtagttcaaaaagtagaacttctaggaatgagattatagtattatactactacaaatgcctgttagcactattatccatttttaagtaaattcaaactacgtagtatctctttcagagaaggttaagaagacaacgcttatacttgaaacttggaataacaatgcagtgctcccggacattgtgctttgaatatcagatttctgcccgttttattaaaaaaatgttttgaaaaaacagaacttgcttggttctaagaagaaaaagcagaaacattcagcttctttgttgccacatcaactgaactgtactgtttttaatgatacatgtcaagaaataaatcaaatcaaggtgaaagctcataccattcgacgatctatcattgagcagccatctgtgcagagcagagttgggaaggtatcaaatccctcagataagcataggttcagtatcagcctcatgcagttctgacactctggtgattctgccaaactagtatctgccgtatactttgtatatgcccggagtagaatatccaccaaaatccagagtccactggagccaccctcccaattgcactctcaccaaaatctgcaactaaagtttcagtgtttctgttccgattacgatccaccttgaaacttgcaggcatcgctcctgctccaagcttgaaacggtctaccattttctccgagctttgcaggtggagtgttttcaagaggaagtttttcactatatcagtctcattattcattagaaaagccaatgcacttggaaaaaaatctcgcacaaaaacctgccattgtaaggataacatcaggaaagaggtgaagcataactgaactattcatttgattcagggggaaaaaaacattgaaaaaacaagcatgcagaagaatcctagctagaaagcaagcaaagttttcaaagccatactgcttagataatcaaactgaacaggtcatcataagtgctagtaaaacaaacgaatttgctctgcaggactccatgccagtgatgatggatatagttaccatttaacagcctacataatatattcagtaaagctattatattgctcgataatcgacataatcatatatatcaacatcaaacaaaggctaagcatcaaacactacaaagatcctaaacacaccagattactcaggtactgatttcaacatgtataaaccaaacattcaatacatcatacaacaagaacataaaaacgagattcagttttcagaaaccatatgaacaagcagaggattccgatttcacctgatcataattgagcacctcctcggacgcatggtcgacggcggcaatcgtcccaaccggctgcccccggaagtacaccacggacttcctgagagcctcccacgcctcgttcacgagcgggtggggatcaccgagcgtccccagcgagaagggcgagtcgaagcccgaggggaacgccggggagtgcatgatgctgtcgaagccgtcgttctggcggtgggagagctcactccacgactgctcgtcgaaggacctcttcctctccagcgtcagcctcggcttgtcgatgaggagccgcgagagatcgaggttgatctccgcctccgaggcgatggagacgtgggacgacaccctcttcatcctgctgatgacctcctcttcttttcttggtcaaatttgtttcagcacgaatcagttcgagtaaatccaatgtgaaattggaaagacaggcaatgcaagatcctgagaagaaatcaagaaagaatatattcggatttgacaccggacagcaagcaatcaatcgaagaccgtagcaaaatcagcggcggcggccggcgaggagagaagaataccttgaatccgaagcggcggcggcggcgtgttcgccggagaagaatcgacgaggagagagaaaccagccaactaataaaccaaccaatgagagcgtcgccgttcaccgatcttgcggtctagatccaagcgcaagaacggcaagatctcctccggcggcggatgggatcaagagggggagggatcgtggaaggaggtggtggtggtggagggaggagactatccgcatttctggctccggtgagcttactatttatagacagcattaattctcccccatttcctggcgccttcggattttctttcttcttcccggcgaacttcggacgtgccacccacactgttcaaagctttgtcgtctccactttctatcttttcggatatttggcttatccaaaactaatacttctctagtctaacatgaagatttcctcaaatttttttttggaatcaaaagaaaggttaattttttgcaagtttatttctaagttttgtgatagtctcttcggtaggtactgacccacgttaaatgtttttcatggtggaggaagggagaagattgagaagatacgtgtaatgaagtgagtcattaacgtatagttaattcagttaattattttaaaatttaaaaatatattaatatgattttttaaaacattttttctataaaaattatttaagaaaaatatttaatagtttaaaaggcatgcgcatgaaaagcgagggaaatctcctctctttatctacagctcaaacatagcatgagagagtgcattgtagatgacatcatgacagccggcgtatgcaatacttgtttatcggtagtatctcgtgacatatttgaaagaataataacaataaaaaattttagcaccaaactcaatatagtgtaatcctatataaaagaatctaactacgagtaatcgaaaaaaaatgaaagtactaaaaaaactaagggctcttttcaaacgcaggattcttaaacacgcagcattagaatatcatcacgttttttatcttagggaatgaaaaaaaacaaaacagtttgaatggagtaaaggaaaaactgagaggagtatacacaaagaaaaaaatattaagaggttgcagctccaaaattcgcatgaaataggaaaagcatcagtggtgtggtgttggagtcgtgggtgcatgactccagtcaaatcctagcttccacaaatattacacgtatgtaaatgagctttcaacatggttttaatgaaatcttgagcgtgtttcataaaaaaaaatcccataaaacatgcccatagaaatttcaaaagaatcccggagatccaattctttgttttaaaggggctttctataggatcctaattcagaacatgatgataagcggaaaaaagtgggacgccaagacgccgatgaactcaagctgtgaaagtcttcttttagagagagaagaaagtcgtccgaatttcatttccagggtcccgaagaggttcgaaaaggtgtacatgagttcctcctataaggggctcattggttgtcaaccaagtgagagggatctaataaagatgagtacagataccttcaaccgatatcgcttgagaggcatagccgtctcttccaagagattctctcttatttcttaagcaagtatgaattgccatagtattcttcgaggcatgattcaagatccaatcgatttgaagtatgaattgaacattggtttttgcatgtcaataatacactggtagagaaaccatctttggtcggttgcccaaaatccataataatcccggtttgaataagaaccgggactaaaaatgatctttagtcccggttgaaaaggctaacgtcactttttgatctttagtcccggttggtagtcccggttcgaaagaaggcaagctgtgtcagaccccccctatgatctttagtctcggttagttaccaaccgggactaaagatctattttaatcccggttgcttataacaaccgagacaaaagaaaaacaaaaaaaaatcgcaccgcgcctcctcgagaggaccaacagccttatcctctcatccactcatctctcctcctctcccttatcttctccaatcttctcctcccttctcatcttttcatctccttcttctcttcttccccctttctccccttcccctctcctccccctcccctgcggccgcggcagatccctccccgacgcaggcgcggccgcgtgcggcgagcggcggatgcagctgcggcggcgcaggcggcggccgcgcgcggcgagcggcggcggctgggctgcggcccggcggagggcggtggcgggcggcggatacagcggcggcggcgcaggcggcggccgcgcgcggcgagcagcagatgcagctgcggcggcagctaggcggcgggccggcggagggtggaggcggcgcaggcggcgcgtgcggcagaagcggccggcgcggcgagcggcggatgcagcccgtggcgacgactgggcggcgggccggcggagggtggcggcggcgcaagcggcgcgtgcggtagaagcggccgcagcggcggtcgtgcggcctggcggagggcggcggccaggtgacagcggtgaagcgatgaatttgcttttgagaatttgtggtgtatttgatctgtgcgatgtaaatatgtgatgtatttgggatgtttctttttagaatttgtgatgtatttgttttgattatctgtgatgtatttggatatggtggatttgtagatgatcgatctgggatttggagatgatcttttgttatgtgattttggggatgatttggggattttggagatgatcttttgttctgtgattttggggatgatttggggatatggtgaaatcaatattcaaagtaaaaaacaataaaagaaaaaagaaaatactaaccggatgtggcttcatttttagtcccggttggtaacaccaacaccaacctgggttaaaaatggctccatcttaccaaccgggactaaagatcgatttttagtcccgggtatttgaaccgggactaaagatagcgatctttagtcccggattcgtagtcccggttgaaaaaccgggactacagggggttgcaaaccgggagtaaaaaacgtttctctaccagtgatatcatagttgacctagaaaagaagagatcgccatctctctctctcatgttcaatcgagattgtgtgggtgtttagtattgtattctagttctggctggttagagtagaggactcgaaatcctcttaaaatcccaaaaatcttctatttttttcctttaatttcaaacgagtcataactacgagaattggttcccaaggaagtcacggtgcaaaactcccccgtgaaacgtttggaaaattggaaaacgaggtgctaaattattattttagctgccaaaccgtcaaaccgacactaaactttagaagtcccgcctaaccgacactaagctttagatggcccgtatattattttcaacattgctcttaaatgacactaagcttagatgacagattgtttccacggatgataagatttttccatgtagcatatggatttgatttctgccttccctgcttaaatggatttactgatcctcattacctcattccataattgtttggataactcctaataataaagtacagtagtaggaaaactaacgagaaaaaatggcatgagataagggcattaacttttgcttagatattttaagctggaaattctttcgatgtcatcaaggttgaataatcgacaccagccgacgacgatcggtggctgctaaagaccaagaaaaagctactttgtccatttgtaccagctaaaaatattccaaaaaaaaaacgttatattgtccaataacgaaggacatcaagtccaacttttcttggatgtttttttcccgttaaacagtgagaaacgaccaatcatgtgacttgtgtaaaaaatattgtcaaaagttgctttcgcttgtggtgtgttgtgctcgatggttttatgcgtaattcaaaccgtgatatttgatttgtcttctatgtctattgaggatgtttggaacaattccatgattatatagctttatatatactcatataatttgataagataaccaatttcatagatggaagtggaagttgatttctataatttcattttgcgagtgtatgttataaaacctatcttttcctcctaataaacaaaccagtccctcactatccaagtaattttgcatcacacgaaaaacgaaatccataattcgtttttagggggtgcttattagacgcaactatgctgaggatgcagctagagaacacattttttacaataaaaaaccaaaaagaattgagttgatagttttaaatttgaagatgaaagtttaaataattcaaattatgggtagagtttttaaaaagttgagttgaaagtttcaaaatttatttgaaaagtttaaaatattaagttgtatgttttgaattttgatatgatatttttaatatttgagttaaaaattttaaagtttgagatgaaagttttaaaattgagtttcttcaaaattgatgtacagtatatgtgaaacatgcatataattttggggaaaaaaaaaggaaaacatacttatactagtgacgagtggaccttgtgggccagaccaggtggtagcggaggaaaagatccaatttcactccctagaaaccgggtatattgccccccccccccaaacgattaaagtagttcaaaacgactccctcgactgtattgcaggtaatttttgctgccgtggtgtccacatggtagctcagtcattaggaagatgaaaaatagacttgggactcacatataagtggcaaaaaaattgtgagttccacatgtcagcctcgactcttattttcccctctctcctcttttctttcatacaagagcacaacaccctaacagtgggcggtgcaaagcccgctcctcgtcctccccctaggaggtgagtggtggcgatggcggaagaagccgacgagacaaccgtcgccgcacgaggcatgcatgccaggagtcgtcgttgctccaaggacttgaccttggagaatggagacgcagagggcgcgcaggggtgtgatgatggtggcgtcaagtcatcggcgatggcgagcgaggagcgcgaggctgacaacattggtgaagggcgccaatgattggggtccgacattaggctccaccttagggttgtaggctcgttgcagcttcgattaagctatcgggcggtgaaggattggcggcgatgatggctccttcaaatccgcttcctcgtggttgatgaagtatggagctcatggccgatgcgcgtgggtcgaagaggagccggtcggacaggcaccttccctgtcaaagaggaggacagtgcttgctgccagccaccgccacttcccctcgttgtctcgccacctccgccgctatggagaggagggatgagactctctttcctccggggagggctgattggctagcggggagaagggggaggaggagagaggaaggatgaagaagatagggagagcaagggagaagaaagagaagggtcactaatacgtggaccctacatattgacgcaactagtttgattaggtcaacgtgccatatcaacgaaatcacttactatcaagagagtcaaattatattggttttaatagttaggcggtcaagatatccggcattgcagttcaggatatgaatcatattggagtggacctatattactgggagtcaaagtggacttactccaatagcattctgttcatttatcagcccaacaaactaacaaagaagggcttcctgaaatttgacacaaaactgaatttcaggcccatgaaagcccatgtagacctttcccgttaacttttgggccccacaaactgaaatgggcccacccacctctcgtctgctacgtggcccccactaattgcagtgaaaaaccccaaaaccgggtggatttcctccttcccttgcacgcctccacgcacccgtggccggagaagaagacgccgccatggacgccggcgagtgctccagctcccagccctgcgcgtcctcctcgccggacgccgccggtggcgtttgggccaagctaggtgcggccgccctcctcccccaccccacccttcctttttcttgggtttcttccgccgcacgggttcttgattcttgaccttttcgttggtcttgcccttggccattgcttgcactgcagtgccctccgattccgcgttcccggaggtggagctggccgaggacgacgccgtggtgtgctcccgggtcaccccggacggcggcggggaggtggccgcgtggtgcgagattaggcgcggcggcggcgatggcgacgcgtcgtcggcgacgattcggaatctgaggtatctccccttttctgctttgctcttctggactgtgcattgtaggcaagatacgctctttttctgcaatcttgttttatcggattgggggaacaaatgccattcattgatgatgcgtgtttggacgaaggttataaaatgcagaaaagttcgtactgattgcgattgaatgtgagttgttgtcgtttggattatgtgaatcgttgcggtgtggtagcatcgtgttcgtgttcttgatcacctcccaataccaaaattaaagaaaagtttcctgtggataaaaaagattcagatttgctaatgattctaaagcgccttgattttcttatccataactcactttccaaacttctgaacctgattgatcaaaccaaaaatgaacttttgaatcgtgctcatttgaaatcgatagaggcgagcccctggagacagggaagaggcagagtggtcatgggtgagttttttttttggggggtggagggtagaggagaagggaagttcacttctgtggccaaggtggcaggagggtcatgcaggttggaaatgaggaagtttttctatatttatataaatagtttctctatgtgcgtacatcatagccaacctgtgttgcaaccttctgttattccttttatcaaattctcgctgatgttagatgcctgtcttgtcatccttgtaatgtatgtttcattggacctctatcgtacgttaacattatccatgtgccattgagaaagctcggatgcaattattgtcgatggaagagtgatccagcaagaagcagttgacatcaaaccggggagtgaaattgtttcaggaccccagaaagatggtgagataactatgtattttgagtttggcatttcatgcatagattggtgattgtgtatatttaatggtcttctattttttttaagtggactattttatgcctttatgaagccaaatgagtgtttacacatgactctgaatatatgtactcattgagtcattttgaatgtttattgtttcctagacctttctgtttataaagtgaaaaatctatggttgcatgttcgtaattgtgcttccgaacaatttatcaaattacaaatgtttatccttttgtgattccgttatgttgaacaggtgaactgtaccactatgtaatgcatttatgctatccatcttcttgcagggcatctgttgtacacctttgatataacaggcctgaatgaccaggacaaaactaatatcaaggtattttgttgaaatgaatgttgatcaacaacaacctcggtgcataaacgtcactaacttttatttaaatgatgatgtcagattgtgctggatattgagaatgcaaagtgcagcatatgcttaaatttgtggcatgatgttgttactgttgctccatgcctccacaacttctggtacttttgccaattttcctagctatttttgatttatctcaaaattctgattggtgctcatttctgtattccttttaagcaacggttgcttctctgagtggttaagaaggtcttcagctaattcgcgtgataaaagtcagagtgctgcctgtccacaatgtaggacggcagtgcaatcagttggtaggaatcacttcctacataatattgaagaggtgtgatagttgtgtttagtgacttaactcctcaatactgtttaagtgctacctattgtacagctgagatgtttattatagttctgcttttgtaggctatactgcaagctttttcatcgctacagcggtctgatgaggagattgcattgttggagtcatatgcctcggtcaagacaaatattgtgagttaaaaatcttactaagaaattgttgatttccaccattttctcaatggattgtataaagtgttgcaccagtctcttatctgccagcactgatatttgtccctgttatctgccataaaatcgaatattgttttaaaatcatcacccttttttaacttgtttatatattgttgttcattttagagaagtgccttcctcagtcatttgttattagttgctgataaatatttagttttgctgttgatagcttttgaactttaaaaagcttgtagttagccttccctacaaataaaaaatggcagcttgtaattatggacaattcaaggcctttctcatgataatgtgatgttatatataaattgaaggttgcatgagttttgtcataaaatattgttggggctaattttaattactcaattcatatgaaatttaattgtgaaactttatctaagtaggcgcagcagttgtattttaacatttctgctattcagtctatgatgtattttaacctaaaattcacaggcatggcatgcattcatcccttttccatggtcttatgctggtgcgatgattcttagatccaccatggggataaacatctgtcagagggaggtcagatggcaacgactcaaagtagaacagagctaggtgaagtagggtacaattgagggagcaatagatctataatagcttgccatgagagagaccagagctgactagagacttgtttattcatcttagcttaacggaaatgtataatccccatccttgtgataatttgaccctgaagcttatctctaaaataaggaatagataccaacccaatctaatctgttaaatcaactggcatgaacagtacccctgaacatgacaatttgtctgtctgatggataaaatgccttattattagagccagttgagtcacaggacaattaatacccgactcaccaaggttataggtgttttctatgctataatatatatgttgcaagtatatttgttttggtatttaaatgatcagtcccatgattctgagttgctgtcaatgttcataccttaggttttggggaaacagaaaatccagtcaaggaagcgccgtttgccacgttcaaatgatgaagctaaccatactaaccatgctgattttctatgccctcaatgtggtaagtgttgaaatttcatttttaatatttttattcttctttttagacatgttactcaaatgagaaaaataaatgcaggtgctgaatttggtggatttaggtgcagtccaggtgctccacacttgccgtgtaatggatgtggaggaatgatgccagccagacctgacaccagtataccacaaaaatgtaaccgataattctgaccatattacaagattgtaattctataattcagttgttatttgattgattattcaacgtaaccatgtgtgctgccgttatgttaggaactggacatatctatgttcatatttttttcttgccatactaatatgcttggtatcaattagatgagctaaaattatttttattacataattgaggagtatgatagatatgcacgattgcctcaagatgtattttgaagtttgcaggcatcatgagtagcttgattgcaccttttccctactgaatgtttatgaaaattatatcctctgtattctttttaattttctggctctaatctatcaaccttatattgcaggtttgggatgtgatagggcattttgtggagcttattggtgttcccaaggagtgaattcaagtcagcataatccaatctgtgatcaggaaactttcaagatggtaagataatctattacttatatcttttagaccccactgtactccatcatcatacagtacatgttgtgtacttatattcactgtttgacatgttgtgtggataactgcataactttgcagatctctcagcgccatatctctagtgttcctgacacagtacatggaggcaatcaatacgagaaagatgtaggaagttttaacatgatcttatactatcatattgctccttttataccccagatagtagtttcacatgtgagtactgagtatagtattttctcctctctagattacagaaagatgtatacagcaatcaggcaaagcattgcaagctataatctcagagtggatagtgaagtttgacaataaggagcttggtaaccttctatctagttaagctaattttttcgttgatgcaaaatctgattatatttgttatttagttgtagtacatattcatgttgcagttttgcatttcttacatcgtgattacatcatgattgttctagcatacgaatgacctgttaatagcaacaatttacacagtgcctgagttgtgtttttgctttgaatggacaaaatttatgtatgacttgaatgttgagaaggaaaacctacttctggggacaattttctctttgtttagcggattactatcttgttgcacaatggacatgcccccatctgt

SEQ ID NO: 66936 - DNA, 3591 bp, Oryza sativa
  unsure (1)..(3591): unsure at all n locations
aaaacctttttagcatcgtattgctattgacactaaataattaaattagtaaatatgatcaatatgacagaccaaccgagaatcattttcgaagatatgctactgttctcgatcactttcgaccattttcatcccacgcaagaacaatctgtcaatcttccagcaattttacatgttacagtctctgacaatcaccacttctcttgattttttttttttgactcctattcgctcacacgctgcacaattatggtttactaaggggtttcttctacgtatcatctaccaagtaggaggaacctatacgcatgtacatacgtacatgtacagtatctttcacattgtgcaatgtagaatgccctgctccgtaattcgagcaacagaagaagcgaaagtcagggagaggaacaagacagagaagagaactgattaacaccaaacttgccggaaaggggatctaacactgaatggcgatttggactggttttgtagcacaggtcggcagccactgttcaagacaaatcatataacttttagggcactgtattatggtcaatctttgcagtagcatacaattattatacacgtccaacaatataatatggcgattcaagctaacctaattaaatatatatatgattaagacaatttcatagctaataatctgtaaaaaaaagttaaagaagcaacaaaaaaaaatatgagtacaatctattatatatctttaaagtaatagaaaaaggagcctccacgttcgctctcatggtctagaaattctcacatttatccaaaaaaataagaaaaaagaaaaatagaactagattaggattagttaaaaactgaagaaataaaaaaaaaggcatattaagaaactcaaattggacaatcggtaaaaaaaaaaaggaaaacctaatcatactactggaatcggacaatccgtctacctaatgtactggaaagagaatgtacaatcagtaaaaaagaaaagaaaagaaaagaaaaacctaatcatactatacactggaaacggacaatattttgggaatacgcgtgttcacaccacttttagaaacattgaaagacaacaatcctaatcaaactctgccgttttcgaattgtatcagtattgtcatgccaataaatacataaccaagccaaaaatacataaccacgttcgctgtggaggctagaaattcccgcattaatcggagaaaaagaaaagaagagtccaaataaaaatacaataaaaaatagctgaaattcggaataaaaaatatgcaatattgaaagagaagtccatataggaacccaatacgcgggtaattaaaactcggaattaaaagtgaataaatttcgaaattaaaaaagaaaaaaagagggagtgagttggaattccatttaaaaattactaaaattccaaattaaaaattagaaattttggaattagaggccttataaaattccattccagaattattaaaatttggaatggaaaaataaaaaaattcaaatttagaaaaaaagaaaagaaaaagttcaggtaggaatacaatttaaaattaacttaaattctaaattaaatataagcaggtgttgaaaataagagtacatataacaaccttagtagattaattaaaattcgaaataaaaaataaaataaaatccgaaattaggcaaattaaaaagagaggttaaaataggaatacaattttgaaacaactgaaattaaaaataaaaaataaaaatatcgaaagaacacaatatgaaaaataaaataaattttgaaattagaaaaagaaaaatactaggaataccatttataaataactaanattggtgataggaaatcaagactattgaaagaaaataccatctaaaacacatagcgagattaattaagtaacatgactataaagaagtagagtggtggcggttgatacaacatataaaaactgttaataaaacaccaaatagaatcctaataacgggtaggctgtgaagcaatcaatcaaggcggttgccgggacttctaaaaagtaaaaaaaaaacaatgctaatcatattcgatttttaaaatcttaatgataataaaaaggagaagcagcgggtggggtgtatatgatagccaccgacggttggcgggacttctagaaaataaaaaatgaattcccacgatagttatgttcgatttttagaatcccaatgacaataaagagtagacggcggatgggccgtagaggaatatagtgacattgtttaataggacttctaaaaattataaaaaataaaaccaacaagaccataaactctaaaaactatgaggtccaatttctaaaggtttggaacctctaaaaagtaaaaaaaaatgataatcatgttcgattttaaaatctcaatgacgataaagaaaggaggcagcgggcatgccataaaggaaaacaatggcaaagccgctgacggtttggcaggacttctagaaaataaaaaaatgaattccaatgatagttatgttcgatttttagaatcccaatgacaataaagagtaggcggcggatgggccgtagaggagtatagtgacatcgtttaacgagacttctaaaaattataaaaaatgaaaccaacaagactataaactctaaaaactacgaggtctaatttttaaaggtttggaacttctaaaaagtaaaaaaaaacacaatgataatcatgttcgattttaaaatctcaatgacgataaagaagggaggcagcgggcgtgccataaaggaaaacaatggcaaagccgctgacggtttagcgggactttagaaagtaaaaaatgaacccgaacgataattatgttcgatttttaaaatcccaatgacaatatagagaaaagatagttgacgcccgtagaagagtataatgacagcgtttgacggggcttctagaaattataaaaactataagatctgatttttaaatatttcaaggagaatgaatagaaatagtggtagatcaagcaagcaaataaagaagcatatgacagaagtgaggggtagtagttggtgtgacttttaaaaactatattatttctcattagaaatacggggatgataagatttagtctttcaaagtcttaagacaacgagatagctatttaataaattttaagtaaaatcatactgaaaaatatatgattttgtttgggtgctagccgcgcaattgcgcgggccacccagctagttttcatatctatgttattagtggtttttataagctaatgctgaaaaataaattaggataaaaatacctaaagtcaactataaaattaatttaatgataagttgtctaccaatattttaagggcttgttgcagagacaattttcagacaaggtgaactttcccttttcgtgtacccctgcaagccgttcattaaccggcacttagtcctttaaatagcacttaggccggcttgactgtactaaacattccagaaagcacactagacaaaagggaatgaaacagcggcagcattcgtcatcagccgaaatgggcaacaatttgtgtgtagattagcatttagcctgatgcttcagacattacccaaa

SEQ ID NO: 66937 - DNA, 39097 bp, Oryza sativa
aagaagagaagagaagacaacaagagagaaaaaagaagaaaaatggaagaatgaagatatgtggggctcacattattttctctcacttacgtgtgggccccatatactttatttatttatttttgctgactaggatgtcacgtcagcgaaaccaggtgtctatactgctataggatctagattgggaggttttgtatagtttaggggtgaagatttctcgtactgaggataagggatgttagacaaattcggtgtaaagttgagggacggtagatgtaaagtttgtttgcaaactcctcctgctttattcctttcgcctcgtcaaaaatcccacattaaacaattcaaaacccttgttatactgcgattgaacggttttgtacagtttaggggtggagatttctggattttgaggataagggatatcaaacaaactcggtataaagttgaggggcgataggtgaacttattccttagctttatttgtcatctcctcattaaaagcctcttccagtgatcgcagggactgagcggtccaggcctagatattgggcttcaaaacaaggttcgagggtccaaaggtctgcaggtggcccattattgaaaccgtcgaagtctgaagaatttccggcgaataggctatgccgcagtgaggactgaggagggtctttttttgcgaacacgcggtgaggagggtcatgcactcatgcttaggctgtggtcttatccccaagtttcttaactcatccccctcagtttttcgcgcgcacgcttttcaaactattaaacgatatattttttaaaaaagtttctatacgaaagtcgcttaaatcatattgatctatttttgaaaaaaagctaatacttaattaatcatgcgctaatgtattgttttgtttttcgtgcgtactgttgggaacaggctggagcgcgaacacaggcttagtattgtcagaacattacagttcacagtggaggcatggactatatagctgtgcaatcagcaaatcacgcagatgcagcctgcccgtctgaaccggcaatacactggaaaacttgatcctaggcatatctcttataggttcgcagtgaaatgtcgctatgtcagatgccacattaattccgattttcactttgtgttattgcatcgcaatgattgagcaatatgtgtgccgtttaagcaatatgtcattttttttatggttcgtttaatcaatatgatgatgccgatcatatcttctggttccggagccggacggatgaacaatttagcatagatcatattgatatatctgctctttaatttaagggatctaaaaaaaagaccgccagaatttaattattctgttcaccctgcagtgtcattttattagatcctctgattactcctaattaattagttccatttgtaattgacttggtgttgttcgtaatgtgtactatgacctacctacagtacaccatgctgtattttcaatttttcatctagcattcgctgttacggtgcaagctagtcagctgatgctacaataaaaggttcaaaatattttaccattagctactcttggtgctttctactctgtccgttcctaatatcaatatttttagcattcaaattttatataggagtataacataagcatcttttagttgtcccgttcatcatatctcatttaatattatccgttttaccctaaacaccttacggcttgtttggcgatatgagggaaggggattgggagtttacatgagggaattgatggtgagattaaaatgagaatttgatttttaatcccagtatcttgtttggtagagttggtggaaattgatagggagtttagttggagattaggtcattaatgaaaacggatggctgagatttgtttagtcaaagtaaaggagaaattccctcccaattaccacccctacacaggtattgaaaaaagagggagttcctccctcaattccacatcctcatcccaccaaaattcccatgtatcccaaccaaacaaagcagttaatagcatcatccctctaaactctcaatcctttctaaaaactccctccaaccaaacgggctgttaacgtactcccagccaggtattatagtttttctttaaaccttattctttctgctataaaaacctaaaaatgctttagatctcattgaagcgttactgatcagctactttctgtattagatccaaagccaatccagaacccaagcaaccattttgcatccacatctcttaagtgtgaagcgcggatcaatcaaatattcaaatggatctaattaagtggttcgcccataaaaaggtagacatccaagtaacaacgactaacaagtatcatgtttttgctgtgagttaaaagctactattaattcccctaaaaaagccagttttaataaacagcgatcagaaccgatcagcctcaaggattgtcatatacagtagtcttctctatttacttttaaggcgtagtgcatttcgtcaaggtaaagatttgtacgttctgactcataaacggacaagaatatacgtacgtaggaggagttggttatattaaacgtgaaggtttccgtcgatctcttctttcgcatgttgtcttctttatgcaccaattattcattcggtaaacactaaatgtgagatcacgtaaagttgtttgaaccagttgcatgaatgttttttttcttgtcttgctgctcacagttcaattatcgtgggttataccgttatgtcgttgtcaattgaccagtaaggtagagtccaccacgaaaaacatgcttgtcaacaatcgcgaccctcaattaaaaatcccatgcttatcaagattgtcgttttactgtctgaaacaaatccattttaattcagttggacgacatcatctaagccacccctagcaccgctagctatatgataggatgacgagattcaccttagcaatcgtaaagacaagcaaaaggctagcccgagtgcccgacacacccaaactaaattcacgtatgctatactccaccgagtctaatcctctcagcatccttaaaatttagtgtctttctttctaagatttgttaaaaaaagttatcttccaaataagaaccattatatattaatttgttatttccttttcgttttagttgtcaaatgaggaaaatgacagggctcgggcgcccgacaggggtggagccgatcgggcgctcccccgcgcgcccctccccccacgcgcgtgcatgcaggtcctgggcctcaccgcattctctgctccacctgccattgcaacaaatcacccacatattttagaaaccttctattaagagaatttggtttatttttttgttccacaaaaaatattttacctagtgtactcacaatgttttactatgtatagatctaatgttgcagtgaactaaaatatttcattgcaacaaaaaaacccacatattttagaaaccccctattaagggaattcgtttcattttttgttccaccgaaaaatgtttcacctagtgtatttataatgtttcattatgtatggatcaaatgttgcagtgaactgaaacattctttcgctatttgctgaaatattgtttatatataaggtaaaacaacatccgatttaaacgagtgaaacattttcgatctacttagtggaacaattccgatatacctggtggaatatcgtgtaacatttaaaaataatttaataataagctattttttcatcggaatatatccatgtgtggtcttgttttgaagatttaattgcaacgaatttaatgatgcaatcggatcatgatttggataagtaatttaagagaaaaatcagtttaaagtagttttgcacataaatcgggcgctgacgttgtgctgacaacagcgcccaatttttctccaaaccgatcgggcgcccgacccgtagactcgtccgtcaaatgaatatcattttattcttttcgttttccctctacaataatgaaaggtataatagtattttaatattttactcaatctattttaactagatactaaaacccaaccctttagggcggagggagtactattaatattaaatttatacaatttatctctcaaattgttagaaacttcaaattaattaggcgtgtaggattaaatgatacttcctatgttttttgttataagacataggttagagcaaggattcgaaaatagacatacaaagcataatcataattcacgactccaatttcgtaagttctttttactaataacatcaatttcgtaaaagaaaaactatattccaataaaataattggtcaaaatcttatcccaatgaaataaaatacatattatttttttaacggagggagttctatatgtttacttatcacataccttttttattctttaatttttattagggcaatttaattctccaatttatcttagttgctccttttaatgcaactgtttgattaatattcttctgttactccctccatattaaaatacatggtgtactttgttttaaacaagactttgactaacaaatttttctaatatattatttatgtgataaaaaatataatcatacaaaagctagttaatcaaagtttgtcccaacaaaacaaaatatgttcctatattttaaaatgaagagagtatttatctataaccatgcttcaatagcattgtgatgtatatcaaacacgcaagcacatgctaccaatgtcaatatacctgttacagatgtcctttgctcatgaatatcctatttctagagtctaaagatctcatcttccatctcttcattatagtgattccgtttatggcgtgaggtgaagtgtgtatagattctagcagcccagctgacattgtcagtggtacatacaaataggaatgtagaccagggaccaattgtgttgataattttgttaatttgtactagtatatgcgttgctagctttcttggatgctctgatgctcagatgcaaatgcagcataacattacaatcgaatactaaattctcattgtagcgatttgttgagcgaagacttaatttagccatgcgtacatactacgtaatccaaagagtttaggtgaaactgaaaggccttttttattcccttgtgaagtacatatgttttatatttgaagatgtcattaccacggaatttgttatcactgtcggttttccgtctggattaggccgtcgacaatgttaaatgagagcaacatcattagttttagaaccgatgtatcattgccagttcatggcgtaattatatggcaataagtgaagtatcactaccagtttgtggagcatattgcaagtgaaatatggacaatcattgctggtctcctcgtgaaccgtttgtgttatcggctcatagcaagtttttatagtggaggtgatagccacctctaaatttatacacatcatctagtttttaattaagaagtaatgcatacaacatgatacttcaatcacacttaccccaatacaacatgataattttacttctcttaatctattggtctatttgtttcatctcccttggagtacatagctcagacagtctgcacaatggtgtaccttagtcctgtcgatattatcactgtcggctggtggcaagaagtgacagtgttgtaccactatcggtttgtgccgtggggcaagcagtgatcgagagtgttccattgtcttttcgtggcacaaccgactatgatactaagggcctatttggcacagctctagctccagctccacccctcctggagctagagctcagccaaatggtttcagctccaccaaaaagggagtggagtcgagtggagctctctcacaaaataaactagagttgtggagctgggtttagacagctccacaactccactctagacctaactcgatcctagagttaaatttaggagttggagctgtaccaaacatgccctctgacgtttagtgccactaacctagaaataatgagtgtcactgccgacttgccggtttgggcaggaaatcgtgagaaactgtggtaaatgggcaatggtagaaccggaagtgatgattgtttctgtgatagtgtgccaacaataaacattttttctctggtcataaatatttaacaagattttatcattttctattgaaattttgaccaccaatatataaattcttaaatatgtactttgtttaaaaaattgtataggtagattggtactggagagtagcatcataataattatgaccgtatgaagtatgtatatatagggcgtgggtcaatggcggtgggtgacgtgtaaacgtgctatgctttctctcacaaagcttacgagagcatacaatgcgcatttgcccccaaaattagtttgatatagtactatagccaagcctcacattgagtactcgttgtgcgcgcgagctaaatagttgcaagcaacgcgtatttttcgtaccttgcaagagtgtgaaagttggacgcgacagaatcatctcaccttcgatggagactggggagtaagtggtgaccagtacgtagtaatatacctgctcctcaacgcaatctatatgtggcgtgtactaagttgtggctagtcaaaaccacttgtacaatttcggactcgatcgataaatatcccaacgcggcagcctacggcagcacgcctcgagtgctaatgactttgcgcggtggcggcgcgtgcagcttgacgtcgcgctgctataaaaagggaaggaaaaaaaaaagaagtcatcgcgcgcactacttacatgcggcaaggtcagcgccggagctgccaatgcacgcgatccatcgagcaataagctagccctgcacggaattgaaaccacacaacgccagcttggtcggtcgcggctgacggcgccggcgcccacaccaccgttgcaacggccccggccacgcgcgcgcgcccggcgcacgcacagcacatacatgggcttagccacaagcgcacgtagctactcgtacgtcgcggccggtgctccgttgggagtgggtggggttgggcggctgtccaccgtcacgcggggcggccgacgtgggtggtggtggccgcgcgggccagcagcctgcagcttcgatgccctgccgtattttgtactagtagatttttgtgtggcagtgtggcacactggcacgtacgcgcgcggacttttttccgtgctggcagggtgtgtttagtttctgaaagaagttggaagttggaagaaagttggaagtttgaaaaaaaaagttgaaagtttatatgtgtaggaaaatttttatgtgatatgatgtgatggaaagttgagaataggagggaaactaaacacggcctatatagtagagattactagagattaggccatgtttagttcccaaaaacttttcgcaaaaacatcacatcaaatctttgaacacatgtatgtagcattaaatatagataaaaaaaattacacattttgtatgtaaatcgcgagacggatctgttgagcctaattagttcataattagtcataagtgctacagtaacccacatatactaatgacggcttaattagtctcaaaatattcgtctcgcagtttccagccgagttatgaaattagttttttcattcgtgtcaaaaaaaattcttccgatatccggtcaaacgtccgatgtgacacccaaaaatttttatttcagcaactaaacagcccctaatgcctgtgccgctcttgccgaaagcgatgcgagatcggcgccggccccggccccggccggctgctgcgagagttaggtatctgggcaggatgtacgtactcacgcacgcgtgccccaagatgcgcccaaaaagaaagctggggagcggtcgcgaaccaacggccactagctgcctcgatctcggtcgatcgatctggctagctcctcctttttgtcacatatctccccggggaatctgaacttggtcgatggaagtggaccggcaatcacacaatgccttgatgcatccatggcttgatctttcgagaatcaagtgacagcgttgcctgcggcgccaatcgatcgctatacgagtagccggagaagatcgatgcgtgctttcctcggaggctttaaactcaccggttttcggtaccgtcagatggcgatcgagcagccagagaagatcagatatgcgtgcattcccggggagctttaattcactggttctctgtaccgtgagatggcgacttaccatgagagctttgtgctcgtcgtggtctcagtctcgttcggcctttcacagatgggagaataacaataatcgttgctagtattgactattttacttcgttttcagtttcatcatagtactaattgaagttcataaggacctacaaggcctacgtaccctttcatcaacgttaccccgatatggcagctgaccctcgtatcagtatctgatacgcgcccggatacggatacgtgcgggatacggccggatacatatcccatacgtatccctcatttttctctttttcagataattaaaaaaataccgatactccttcgatacggcgggatacgtacatgatacggggagccctaaatcacacagaacaaaacgcatctcccgttctccccctccaaacgcgccgccgcttgcaaaacccaatccccatcgcagcgccacccggccgccccgaccacgccgtcgctgcgtcgcctcgccgccggcctgccctacgccttcgctgcgctgccttgccgccggcccgccgccagcgaccggcgccgcaccgcgccgtgcgcgcctatgccgtcgctacgccgcctcgccagcgccgcgccgcgccgcggcctatagccttctccgcgccccctcctctgcactctcctccaggagctccagactcctccacgaggcattgcgccgctgcctctgatcaatcctgcatcacctccaacgacaacgacgttgaggacttgaggtaaatcctgcatcatctactatgtgaacaatgttgcctaatgtctaccatctatttgaagaactatgttattttcatgatttcatctactgtatagtcttgcacttatttatgcatgcctcttcaataaatggtgacttggtgagatgctgtgagcctgtgaatctgtcgtactgagatatcatatatatgatgattggtgcattggtggtttgatgctgtttgcttcctattttttcagtctatattccacactcaattttttatatatatatatatatatattcgcgtatccccgtatccatatttttaggaagatggtgtatcccggtatcgccgtgtcgcgtattcgtatcagcgtatcggggtaacgtagcctttcataaccgcgattgttccaaagaaaacagcagagtttacatcagtagatatacagctcgtaaaatagcaagctaacctcaccgtgatgatgcagtgcatgtagcaagtgaccgcaaggtgatcaggagaggaagccaacaggcgtgcttaattagcctctgagagaaaaggagagagatatatcgctagccctgatcgagaaattcacgccgatggatcgtccagacaaatcacgtggtgaggtgcctaattaagcagctaacagtacgacaaaagaagctctgattatgttagcctgttaataatttatgcgacaaagcttatcacttcccttaactaattcggggagataagatattatacagttctaacagttcgatatgatttaattaatccattccccttctggcatgccgctagaacatgccaatcgcgaagccctacaagccgggttgtcatatgtcattaagaaaactaatctccctaggcccttcgtcacctactgaatatgttattaacacggtccaacaggattcaggaacatcagaattttcctctcttttttcttaaacatgaaactaacaaagcaattattggcagcgtgatcggattggcggaaaactcataaactcgagtataaaaacgagccactaagctagtcctctcgagagattggagtacaaggaaagcaatgggaggggtcaatctagcaaagcccacattgacaagtatttctttccagatcagtaccgtccacgcagccgtgacagcaacagaaagacgccatgtcgcgatcctgacatcgtccttgagattcgtgctcccgtgacgtgtcggcatcggagggcccctcgtcggggtcaatgggcggtggggccagaccaccgaccgggatctttttcctggcgcgcagaaccgtttgtttccgccctctcttttttcacaggagcaccggtctctggcttttctctcgacctttttataagcgcgggggttatcggtcgcacgcgtcgcggaatcagaaccaaaccccaccaccacacaaacgcatgcgcgcgcgctcccccgcgcgcgccgcaccggtcgcccactcgcccgcggacgccaagcgatcgtctcgtctcgcactgtttcaccggtcgcccaatcgccaccgcgcccgtacgtctatacagcgtggcaagaggtgcaagttggtgtcaggatcagtttaattacaaggttgtctgatctatatattgctgcagcacggcgggcgcggggtacgtttggctgcaccctgtctcgcggctgatacgtttgcacaggcgttcagatacagccgatacaccggcggcgctagctgcgtttcttctccgcatggacgctccgagcggcgagagcggcggcggcggcggcggcggtggtggcaggaggtggaaggggaagggggtgacgcccatacagccgcggcggcagctggggacggttttggaggactcgtcggcggcattgctgcggccgctcaagaagattgggcggagccccgaccgcctcctccgctccgcatcgtcgctctccacgtcctcgtcggctccgccttcgcctcgctcttcttcggcttccgatgctccagtccgcgtcatctcgtcgtcgccgtcgtcgccctcgccaccgtcggcgcgacacatcttccccttcgcgtacgaggcctccacgacgacggtgggtgggagcccaaggctccacccgctgtcgtggcagcaatccagcatgtcccagcccgcgtcgccacagcaacagcagcagcagccgttgcagcaccagcagatgatatcgttcggcgcgtcgcctccgtgctcgacgacgcagttcgtcgtcccggagaacgcgcagcagcagcagatgctgctgcggtactggagcgaggcgctgaacctgagcccgcgcggtggccccggtggcgtgccaccgtggctgtaccagcagctgctccgggtcccgccaccgccgcagaagctttaccgcggcgtgcggcagaggcactgggggaagtgggtcgcggagatccgcctgccacggaaccgcacgcggctgtggcttggcaccttcgacaccgccgaggacgccgccatggcgtacgaccgcgaggccttcaagctccgcggcgagaacgcgcggctcaactttccggaccggttccttgggaagggccgcgccggcgggaaaggccgcaccagcgtaagctcctcggccgctgccgccgcgtcgtgctcgtcgtcgtcgctatcgccaccggagacacctgacgacgcaaacacgcagcaacaagctcctcagcagcgagaacagcgggacacggcaggagtgtccatggagaagaaacaaccacagcctccagctccaacctctcgtcaagaagggtgctctggcggcgacgcagctgcgccgtacccggccgaaatgcttcacgcgccggcggcgtgcggcggcatgtgggttgctcccgacgagtcatggttcagcacgtggggccctggcagctccttctgggacgactacgacatggacagcgctcgcggcctcttcctccaccctcgcttcaccggtgacgaaactagcatggatcattccggcacgcaagcaaccgtgccggcagtggcagcaacagcggcagggatgagcatgccatgcgatgatgttccggtaacctcttcttcttcagatctccctccccaagggacacctcagactcctaccttcatgtggaaggaggactaagcatgcatgcacacagccacgcacctcgacgagacgactatctcttccatctcccatcgacttcgacgatctctttcattactcatcgacttcaaccacaaaggtatgattagggtagagatgcttgcagattgcagttttaaagacaattttgcagcatcacacagctctacgtacaacagccacacctatatcaattctcaagacttctaaaccacaagggaacccctgttctaggctgcgatttttaggtcagcttgttggggtgaccacagtacaattccctttatttcgtatcttcccaagattgtgtgtgtcagatattcgttgaactcgacttcaaaagatttgaagtattcatgttttcttttactcatgcgatggctttgtcgatctaactaggtattgattcttggggagattaattactacttcagttaatttactagctactagaatatttcatgcatgtatgtgttcaggtgatgattagttttacttatatttaattatcctgtaccctccgttttctggaacatctctggcattccactgtttttgtgtatactctggggaggtgattagtaacttcatactatttgcttctcgagatatttagtgcagatagttcagagcaaacgatgccaaactgttgcgaatcgtgtactaaaggcaagcacattataactctcgtaagttcgagcgagcagagcagccggggagttcttgtcaactacacaactcacaacgtatgtacgtgacagcgtgcgcaactgaatcacacggcaaaataatcaaggcatggcgcaacttgactatggcagcgtcaccacgataggtggccaaccacttatatcagatgcaaccctgcaagtggtagtccgacactccgactgataagaacgtgcgctgccatatgccgccatgtatatgtaaccgtgaacttaacttacgtgcctttagtgctgtacgtgcagggaaacacgcgagtctccgatcgaccaatcgacgacctcagagcatctccaacagtctccccatctcactctccaagctaaattttagctattctagcaaaaaaaaaaaaacgtgctccaacagcctctctaaccctaaaccctatccggctggccaaaacctcccctccactagccaaatttggctagccacaaatcacttgccaatcgtgggccccacacagattctccaccaccccccatctccttcgtctctccagcggtccagccacgactcgacgccgccgccgccgtgcacagccacgatctcaacgccaccgccggcgcagccacgacctcctcgatgcggcgcagaagggcgggccggcggcggagagaacaacggcgcgcgtcttgaacccacgccaaagcgccaccatcgtcgtcgaggtcgccagccgctgtcgccgtcgtctgcaccgtcgccagtcgtcgccatccaccgctgtcgtccccgaggttgccgttgccgtcgtttggatccggatatgcccgacctccgttgcctccggcgtgacgtgggttcagggcggcgcggcgtggattcgggaggagggggcaacctctgtcgcgcggcctccgccgcctccgcctacacctccccggcgctgcgagtgcggctcgggagggcggcgaggaggcaggcttcgccctgcacgccatcgccgtcgttgaagctggaggtggcggcggcggcgggtcccggatgcgcaggagcaggatggccctcgccttcggcggcaacagcggtggtgggctggacggcgccggcggcgtctcgcttcgttgtggtggtggcagcggcgccccccggcctgcgtcagccttgagaaggggaaaaaaggagagaggggctgacgtgtgggtcccatggctaaaatagagaggatgaatggagagactgttggagtgaaaggcaaatttgactctctaattttttagatggatgatcaaatgagtatttggagagctcaaaatagccaatctgttagagatgctctcactcacgccgccacgcgagcgctcgttaaattcgtcgtcacccagctgcaggtgtagccgtgtaggagtcccagcaccacgcccgccgcagtctgtgttgtgtgttcctcctgggtgggtggcgatcgagtttgatcggcggcatgccgcatgcctcccacggacatgtgcggttgtgcgcgctgccgtcggtgtccgcggatccaatctgctgatgccgtgccgtgacttgtgaggtagtaggagagtactgtggacatgcatcctggacctggactactggagttctagcggtctactagtggatatgcatgttgccgcagattaggcctagataatcatggcctctgggccctggggtccaaaaaaagctttacgtttagatttgtgaaggacttgataggcccatggtatggaagtggttgaatccttcggaccactttaatgggccgaacagtcaataggcctctccggcgagaatgctaattagcgcagacgtgctaattagatatctccggcccagttagtcgcgtgcggttccagccgacccaccagtgaaaaagaagtcctacttttccaagcaaaaaaaaaaaaaaaacgttgggagcacatgctgacgcgctattggaggaaaaatcgcattccataataaccgtattaattaatcttttctttttttattgcaaatttgaaaattacgtgaaattttaaacatttaatgcagatttgaaaacctttccactcaaaatttgaattttttgaagtcaaaatttgaaaactttcaacttttcatttaaaatttgaaaacttttgatctagatttgaaaacttcaagtcaaatttgaaaactttcaacacaagattgaaaactttcaacttgaaatttaaatttttcgaaatcaaattttgaaaactttccacttttcatctcaaatttgaaaaactttcaactcaaatttaaaactttcaatccatatttgaaaactttcaacccagatttgaaaactttcaagtcaaatttgaaaactttcaattctatatttgtaaagaggtatgcgaaagattgaaaaaaataggaagaaatgaaaaaacgcgtcgagaaaaattacaaaaaaagaaaaaaaaagggcgcgtgggggcccagctgacgcgcgcaccagctaaattgctggcgcgtacgcgcgcgctaggagccccccttctccagagtcctgaacctactccgttgcgtctgttgtctcgtccacgatttcgggggttcacgtgttgtcatcatcgtagaccactcgtgtaacaaatgtatccaaaatctgtctattactaacttataataaattagtagaaaaatgagcctccatgttcactctcacgatatagaaaatcccacattaatcgaaagaaaatatgaaaaaaaaatgaaaatgaaagtgtattaggattaggttgtgtaaacggacaagaaaattttaagtggaaacggacaaggaaaaaaaggaaacaaaagtcaaaggaatgatataaatattgtgcaacagaccaagattctttgaaatccacgtgatacaaaccaaccataattatagtactttgtatggccatcagttatccgttatcaaaatttaaacaatacttacatgccatgtcaacaaaatcatactccaagcacaacaaattaattcaaactaacaattagcaccatagaaaccttttcaccacagtccgcttcgtcaacattaactagcagaaatcctctcttcgcaatccaattaattcaatcacgccgacaatctttcctttcaattaattttgtcttaataattaattgaaattgtcatattaatcagacaaaagcaaaaagaaatggtgaatagctaatatggtccctgaaatttcgcttcgggctcagtttagtccttgaggtttcaaatcgtccaaattaatcatttgggttaatatagtccttggacccataaaaaataccacgtgaatacgcgaagtcattcttgcatgcagcggtatgaatgaaacgaacattctacccttatataccatatagaaaagaaataaaagacacaaacaaaataataacaggctagcccaagcccaacattgttgcggagggtggccgagaaaggaatttatacgatcagtgcttggctgcagcaatcataagtgacaactctaaaacgatcatacatgtgtgaaatacttgttttctttttttttctttcttttctatatggtatataagggtagaatggtcatttcattcatatcgctgcatgcgaggatgacttgacatgctcacgtgacactttttgagggtccaagtactatattaacccaattgattaatttgaaggatttgtttggacgatttgaaacctcaaaaactaaactgagtccgaaacgaaactgcatgcaccatattagttattcacccaaaaagaaaaaagccaaatcgaaaaataatttaaagtatatgaaattcgaatttagaaaggaaaagaaagagtcaaactagaaatacaaagttcaaaattagaaaataaaataaaggtaaaaaaagaagagttcatgtacaaatacaattttgacaaaaaaaagaggggagtctgtcagtgttacggataaggtataccctttatacttggatatacgttgtatactgatacggtatacccgcgcgtacacgggtagttcctgtatacgttaaggaaatctattacatgatagaaacagaatccacaaatggaaggagtcctactcggacaatactgggtcgttaccatatcgtgaggggtccgatatctccgagtcctacttggagatcaactgacccgcggtataaaagggaccccttgggcagtatcgaagacatcgaatcttaccgccaacatatccaccacagcctacagagtcggagcttataggagccaagtcgccgggtgatctagtcgaaccaactcgactacggtttcgtcggtatcatcgagttccactattccctttgtaatctatggtttccatcatataatcccataccaactggataagggctattacctaccaaggggcctgaaccagtataatccttatcttttgtttgcttgatgtcgtattacgtagatcctcgttccaacgtactccaataccctctatatccggtctacgggtatcccccgtcgacagagtccaaagtgaaatacacttaaaaatttctgaaattaaaaggagaccccaagtggaaatacaatttaagaaaacaagaaatacatatttaaaaaatagtaaaggaaaggaggaagagtccatgtagaaatacagtttttaaaaattttaaattcaaattaaaaacaaatgataaaatagaagattggatttgtaaatacaatttgaatatctgaaatttagaaaataaaaaaactccatatacaacacaatatgggttgataaaatttggaataaaaatataataaagttactcaatttgatttctgtacaacgtcatacctaaattagtcaatcacaaaattttagaataaaataaacagatatgcaaataagtgtccatgcaaaatttatacaataaaaggcctgtcgacgtttgatgtcgcgattttggtatttgcatagtatggggatcgttagtactaggatatatgcgagattgtagtaaaagagatggagacgaggatttttatacaggtttgggcccctgaattgtcaggtaataaccctacatcatgttggccgaagccggtattactcttattcaccataatcacaccagtacaatatttggggtagcttatctaactgttgtcgacatggcggtctgaaggtctgactcgtagtcgacaacagggtagtcttcctcctcgaatccgtgcccggcgagatcagagatagcgctttcgtctctcctgacagtatccggagacaccgtaggggactagtcgtgcttatccctgaagtcgatatccggcgtcttgtcttggcgtatgttgacttgtattggctttgtggctttgtggcgtctatgttgtccgtgtcccctctcctcccagggggccttgtatttatacccataggtgtcctcttatccaagtagaactagggaaaccaatatggatacaatccgagtagtccttgtcgtttccatatagaactctagtcatcattccttatacggaactcctcctatatccgaaggttgtttccgtataacacatggtatgtggtggatcatgttgagatttagtcaactactattaggtatgtggtatctataaccctgacaaggcccaaatttaaatacaacatataaacacccaaagttgtgattgaaataccaaaagataataaagattattggaagacgaatctagactctatataggaatataatttagaaataactaaaatttgatattaaaaataactaataactatcatgtatgtacaatacaatttgaatattccacattactagtttggtaaagtgagtacaaaatttaaaattattgtcattttaatatattttaataataaaataagaaatatatatatatatatatatatatatatatatatatatatatatatatatgctattatataagagaaatataagaatgctagccaccatgctagtgttaaagaaaaggggatcagattattgcaaatttgaatacaatttgctagaaaaaaaatcttaatctcaaggatgcatgaaattcggcttctttaaactggttggctcggaggaccaaatgacccttgggatggtcgcaggtcagtgtagacatccacctcgccaatcgccatccacccccaaccttcagctggctcggcaatcggcatctcttatcctcacgtgcgcaccacctgctcgatgaaattccccacacggccaccaaccgtgccgatggcacccgccaccgccaccgccgtggcgtccccctccacctcctcccggctcctacaccgcagcctcctctcgccaacacccacggccgctcgctgcctccggccgccgctgtgccgcgggcgcctccgcaccgttcgccaggttgtcgccaacggcgacgtctcctcgccgtcctcggacgtggccgccgaggagtccgcggcggcccccaagatcggcaagcgcgtgcgcgtcacggcgccggtacgcgtccaccacgtctccaaggcgccggacctggacatctgtggcatggagggtgtggtcaagcagtacgtcggcatctggaagggcaaacgcatcacggccaatctccccttcaaggtggagttcgagctcagggtggatgggcaggacaaaccggtccggttcttcgcccaccttcgagaggacgaattcgagctcgtcgaagacgaatagctgaataggtctcttttacagaataatgtgctctcgtcgtctgcagtctgcagatgcagtatctgtatattagaagagaagattgaagagggtgcgaggagatcgcaagtaagttgttgtttgtttacttgtcgcgtgctcttcctcactcttttgtagttctgttaaacaccaacattttgagatttgagaaactgagaacggttcggattatgacaattatgaatgaaagtggttatactgatggttctgttgttggctgtattcagtagtattttttccagttatcttttcaagagaattcgctgcttataagaatatgttactcatcaggatggaaatcaatctctctgactagcgtaaccttttagcatttgattggaatatcggatcgtatttatctattggtctgttcacttgaacatttatcccacagtcccaatttcaattgttatgagcttatttagttgctgcagtaatagcattgagaacttggctcagggttgctagccaactaaactagacatgttaattcttagtagcacaattggtttctcaagacctcggttattgttggtggctcggtttactccacaaactagtaaattaccagtagtgttcaccaggattttaccgtaggcttgtttcgtccctctgcccatcaaatgtggccttgctgagttagccttccatgtttccaattgagttacatggtttgaaatgtattcactgttctggttgaattcccttgaatcttgatctgtcgagtgagagccatgctttaggtttggcctgtgcacatacatatttggacctgaccaaacatagatggcacatgaactggattgtggagggtatttaagctactgtagtttgcctcaactttagaccttgtgattaggtcctgtgtgaaggtaaagtgcacatagttatttatagcacatgttggtggtgattctctccagatatattacaccaggtcattaatgctggaaaacttacttatgtggatatactttctcctcgtcctctacggtgcttgatggagtgcttacttataagcaatagcttgatgaagggactattactttttaagtctataatatggatgatctgaatatattctttgtaggtgataaagggatcttgcatattatcttatccaaggagatgagtgttatattgcagtatatctttcaagtctggtttgatctagaaattagacatttgcttctctatgctttcaggtgctagaaaaatagcgtaagttctttcttttaatttttttctagttcattcacaaagttagtacacatcaccataggttgctaacctgctattgcaccagaattgctgctaacaaattttatgatatgacgctagtctggatgtgatcaagagtgagagtttgtcttggggccttatcgattgccctatggcttatattaattttaagccaaagccaaaattttaattttgaaacttgattttgaaattgactttgatgttttttcaacatagttatttttttcaagtttggcttttaagtcgataagaacatttatacaaaagttttactcacatatcattttttaattgctaataagccgttatgacttataataacccgtaagcaaccgatggggaccttgctgtgagacctttatttttgttgattggggggggggggggggtagattctttttattgtgcaagaaattatcacaactctttttctttaccggtaaatacatgggaaatcctatatgttttcttttcccatttataatgagaatatgcaagggaattatataaagaaaagtaaatcgtcaattttctctatttttttacaaaccttcaacaaggaccaataagtgtttttttaagactatctatcattcatctttaaacggatacttccaattgtgaaaactcattcttaaaagtataaacgaacttttgattttgcatgattgtgacgtgaatcataccttgatgagggtcaaattcaagctgagttcaaccattcctaatgttctttttagtttgcatgctggtggtgatatactgattctgtggaggcaatttactgtgggagatgatagtaacaaattctagagattcaagctgagttcaaccattcctaatgttctttttagtttgcatgctggtggtgatatactgattctgtggaggcaatttactgtgggagatgatagtaacaaattctagaggtctgacataatgttcattcgaaggaaaatattttcttcatttcctttatgttgaacaaaatatattgaaagaagagtaatcaggttttgtccctttatttccgaacagatgtttttgtggttcattggtatggatttctgaaagaacatgcatctgttctggcatgatctatcacatcctgcattatttgttgatcataaggtctcaacttgtggatttggtttccccttctgctggatcctgagtttctgttggaacgtgttcacattctgaaacattgttcatttatcatatttctgttgaaggttacacttcaacatagtaactgacagtatgctgcatttttcttccattctctggatgtatagttaatcaggtcaatatacacgtagaaattagagaaaaatctttatttatcgttgcataatggaaattaatgcttacattaccacatggaacttggtcattctctgaatcgacggaattgcatcagatattccaaaaggtcttatctgaacaaagctttcttcttttattttacactatcgcactatattaatatgctttggtcatgagactgtcttccaaatgaggcatgtgatatgtcttttattcgttttaggcgctcgtacaaattacaatcatgtgttccatgtctcccattaatacgtaggaatgtaggattatgttgacagttgtgatcatcaaaagttgggtgtgatgagggtagagaatgagacatgaggtagcagtgcattgtacttctagcgggtaagcgttttgtttactttgctagatcctgttttcgttcagcttttcagcttttgtgaatgcgccaactttgtacagtaaacgtcagcttgggttctgctgaaaactttggattctattattacgaagtgaaagaaagttggtgatttatctctcaggccatcaccaatgtggtgcttcggaccgtgcccctagcgacagctgttcgcttttccgtcggcgtcgtctccttgcgatggaacgcgtcgctctggtaggggacgcggctctctccgcgcctcaccagcttttcatgggagacgcagccaggcgccacgctgagcgcgtatggagctcgtgggtacggcatcgtccccccaaatttccccttgcaccctcgcctcactctcgctctcccctcggtctcgtcgtgtcgcgcccgacatcgccggtgccacgtccaccaccgccgggaccgccaccgtcgatgcattgctgatggccttagagagagagagagagagaagaaagaggcgatggcgacgacgacgacggatccacgacggcgatgaccagatatggccaccgagcgccgcagcagccgtcggccactagccggcgacgggcggagacggcttcgaggagcccgtgctcaccgcctcgcgcgccttgcccggcctcctccgccggcgccttgcccgtcctcgccggcgctgcggggggcccagatccgcccactacggcgccggatctggcgcccccgaccggccacagcgcgaggcggaggatgccggggaggacgccgatgggatagagggagagagaggggcgacggtggatgcccgcaacgggagaggtggccctcctcgtcgtcctcgccgacgctcccgtggcgccccgtgacgccgctccccgggtccgacgaggccaaggaccgcgccatcgccgagcaaggggatgtggggcacgcctcgcatctccggtgagcagcggcgcgctggatctagcgcggtgtggcgtgagatcggagggggggcgtgggtctggcgacagcgggagcacggagcggcggtggaaaaacgggagaaggggtagagacgggcgacaggcagaggagagtggcgagcggcggcagtgcgagggagagtgagagagagagacgagcggcggaggggaggaggcgagcacgcgtggaggcagaggggaggaggcgcgccggtaaatgaggggaagagagagagggggggagaagagaggggtagtatagtaaaatacctacatgggctctttgggttagggacactcgttgggctactagtggtatcctctattgtaaggggagtttcccagagagcgccctcagtaagtgagggcacctatagagtgtccctgattgtagatgccctcagcccattcgatgtgttggaaaataatgctatgcaatcgactttcgagtgcccttctacagttgtactcacctgacgtgaatggtccacttgcgagttaacccttgatgcatggttgatggccgttgccgttagagcaatcctaacccaggaactatgaagtcggagccattgtttcgacatatttgcaaatgaaaaataatttgtgaataaaatttttatatacgtgttattagcgatctaaaagcaaatgctgaaaaataaacttcgatgaaaataccataaaatcagcttcaattttaaagttgaaaatttaaattttggcgcataagcataagcataagtgaaaagatgagaccatatagcttcttcgtttgccccagttcacatgtgagagttgctagtaggcatggtaatgaaatgttcagatgcacgtactccctccgtctaaaaaaaataaatctaggataagatatgacacattctagtacaataaatctgggctaaggtcacatacaatactaggtttgttttttatgggaatgaggaagcactgcgtgagctgaagttttatccggctggttggaggaggtaagcgtacttgaaattcagtgggatactccaatccggtcaaattgataagagaatgtcaacgaatcaagggtgacggaatcgtcttctaccccaggaactgaaacatcagctgcgaattcccatcacgtgaaaaactgagatgctctccaaacaaagctcggcgagtcgctccaagccaccaatggtttgcttgtttgcaagcgacgaatgtactgtacaggattacaacggtcgacccattcaagttcaaaataatacaaagaactagctgggtagcccacgcaattatgcggctagcagaaaaaaatcatatattttttaagtataattttacttaaaatttattaaagagctatctcaatgttaagactttgaaagaccaaaccttatcatcctcgtgtttctaattacatagtttttaaaatcacaccagttgctacctcttatgtcatctccttctttatttgcttgctcgatctatcactatttctatttattattcttagagcctttaaaaattggattttatagtttttagagtttattgtcacgtttgggtttcgtttttataatttctagatgtcccgtcaaacgttgccattatactcctgtccactatctcttctctttattgttattgagattttaaaaatcgaacataattatagtttgggttcatttttactttctagaagttccgccataccgtcagcggttttgccattatgctcctctacggctcgcccgctgcctcccttctttattgtcattgagattttaaaatcgaacatgattattattggtttttttttttactttttagaagttccgaacctttaaaaattggacttttagttttattttttataatttttagaagtcccatcaaacgatgccactatgcccctctgcagccctcgtctgccgcctactcttaccccgcccgctgcttctccttttcattgtcattaagattttaaaaatcgaaaataattatcaatgtggttttttttctttttactttctagaagtcccagcaaccgctttacttgtttgtttcacgtcctacctgacgtccctccttttaatcgtcattaggattctatttagtgtttcattaacaatttttatatgccatatcaaccgccaccaactctacttatttataggcctgttacttaatttatttcgtcgtgtgttttagatggtcttttttttcaatagtctttatttttatcactaattttagttatttataaattttattcctaattgaaatctttttttttctaatttcagaatttattttttctaaaaaaattagttaataccatattgtgttcttttaatgtttttatttcttattttcaacttcagttgtttcaaaattgtatttatacttgaactctcttttagtttttctaattttggatattattatatttttatttgaaattttaattaatctcgtattgggtccttatatggattcttctttcaatattgcttatttttaattcggaattttaattaattttaaattgtattcctacttgaactcttctttattttcttttgccttaatttcggatttatttttctttttattccaaattttaattaatctcatattgagttcttatatggactgttcttttaatattcattatttttaattccgaatttcagctatttttaaattgtattcctacttggactcgtgtttccttttctaattttggcttttaatttatttttatttcgaattttgattaatctcgtattgggtttttatatggaaacttctttcaatattgctaatttttaattccgaattttagctatttttaaattgtatttctacttgggataaatctcgtattgagtttttatatggaaacttctttcaatattgcttattttttaatttcgaatttcagctatttttagattgtatttctattggactctccttttcttttttttcttttttccgattaatgtgggaatttctagccctcacagcgaacgtggtgtctccttttaaagttattttaataatataatagatataatagttagatagatagatagatgcgagatggtccatcggcatctatctatcacccggccttctctcagaacagtgaagtaccccagtagagtatatactatcatacggcatcgtatcttattacggcttgatacaggactcaattttgaatccactcaatagctgatacagtactcctactagctggttgaacggtaggactacacacacagtacagtgtgcttccttccagatgcatcaacgcgtgcctctgccaccttgggaccagacagctgagtaattatggtgtattttgcagtaaagaactcctttttgggaaattatcagcacaaatccctgggattagtatggacccaaattctccctgggggagtagatgacgagaaccgtagctactgtaaatttggaggtagcacttgtaacttcaagcttgttgagtgagttgtactgttactgttactgttactgttactgtacgccgtgccaaagcatactctgtcaccccaacggctttctcctgtggagcacgcgcgtcgtgcgccgctgcggccgcgcacgaaccccgacgacgcaacagaaaaatttgaaatccacccacccctcccccctcccccctccctcctccgtccaccgcagctggcttcaccttttcctcggttgctacagacgccacggttcaaaacacactctccaacgcacaaaaaaccctcccctaatcatccacgcctcaccggagccaaacaccgccaccacccatgggtctctgtttcagcaagaagcagcaagtgaggcggcggcgagaggagcagcagcagccgccgtgccatgaggccaggaaggccggcggcggcaagaaagctggtgctaaggaggtcgcgatagtcccggaggcggccaagaaggcgccgccgcccaggaaggctgttcccaaggcggaggagccggcggccgacaagaggacggtgttcgtcgtcaaggcggccgcggccgcggctgctgccgaggtcgccgcctcggcgagcggcgaggcggcggatgaggaggcgaagaggcccgccccggaggaggaggaggcgaagcccgtcgtcgtcagcagggtgccggtgcggacctcgagctgcaccaaggaagaggtggacgccatcctgatccagtgcggccggctcagccggagctcgtcgtcgtcggggaaggtggcgtcgggtgagggcggcggcgggcaccggaggtactctggatctaagaggagctacgatttcgaccgcgagaggaggggcggcggcggcggcggcgtggacgacgactgcgactgggagaggcagggcgccgccgtgtccaggccgtcgccgcgccggaggacgccggagcggaagcggtcggggagccacgagaggagcggcggaagtggaagcaggagagtgagccgttcgccagggaggcgcgcggacagcgtccccgcgacggcgagcggcgagcgggcctcgcggcagcagccggggaagatggtgtcggtcccggccagggagaaggggcgggcgccgtcgcccgtgccggccgcgtccgggaagaggtacccgtcgcccaggtccaactccccggcgagggcgggggccgcgggtaatgagaacgccgccgcgcagctggcgcacgggccgtctctgagccggagctcgtcgcggaaggccgagcactcgccgtaccgtcgcaaccccatggcggagctcgacgagaacacgctcggcaaccaccacagttgcaacaacaatggcaggccccaaaaggtaacagacgcatgaaagcttcacacttcagttcacccaatctgagccatcatttctcctcgccgaattactcaaaccatcgaaatgcattgcagaaacctacggagagtggcggcgccctgccgcagaaggtggcggagtgggctaaagatcaggtagccgcaagccggacggcggcgaaggagaagcaggagatcgtggaggtgcccgtggcatcatcagacaccaaaggggggaattccgggaggatgaaggcgacgcactcggtgagcattgtggccgagagcgtcgtcaaccagaagggccggtcgtcgaggagatcttcccacgacttcgacaacaatggcaactcgtacgcatccctgctcctcgaggacatccagaactaccaccagcagagcaccggctccgccgccgccccggcgccagcgttctcgctcccggcctgcgtgtccaaggcctgctccatcctcgaggcggtcgcggacctcaactcctcgtcgtcggagaacaagagcttcgagctggaccggtcggccaacgacaagtgctcggcaaacgggaggtacggcgacggcaaggtcgccggcggcggcacgctcgtcgtcgagtcggaggttgttgtgaaggacgacctgatggagccgagcctgcacaagtacgtctccgtgcgtgacatccgaggcgaggcggagccgcaggaatccgccgggagcaacagctttgccggcaacgcgtggacgccctcgtgggagcccagttccgtcgattccaccgaccggacatggacagcgtcgcagtccaacaacggcgacgaggtggagcagctcagcagcggcgcggtcagcccactggagctgtcgtggcagggcaagcagaagctcccgtcgcaggagccaagtggtggtggccgttcgcgggtgggtccaactggcaatgctcaacgcggacgcagcgctcatcgtggcggcggaggcgctgtcaatgcgcgatccgatgttcgtgctgctccggtgagctcatcgattgcttaacaatgtcaggtggagattgtagtcaggttctcatctttgtaggggcaagataggttgccgtttcagctttgagtttgcgttctttctggtgatgatacattgtttaggatgtaaccatggcggtgacatttgcaatgtatactttgttgttcatttcgctgagctttggtgatcgatttcattatgatttggtgatcggtggttgatctcctgataattttattgatctttggatgaatttcttgtcaggaatagaatgctgtaatttctgatgctgatttgcagagtactatgcatgactgctagggctgctgtaaccattttggtactgcgacagccatgaggaacgcatcagttatccagttactccagtcagttcgagttgggctgacagatcagtcctgaattcagttctcaatgaaaaccatctcagtgtttagacgtatgtatgcagcatcaaatgtagatgagaaaaaaccaattgcacaatccaactgtaaaattgcgagacgaatcttttgggcgtaattacaccatgatttgacaatatagtgttacagtaaacatttgctaatgacggattaattaggctcaaaaggttcatctcatagtttacaggcggaatctgtactttgttttgttatatacttcaaatatgtatccgtatacttaaaaaaaatttggcacacgaactaagcgcagccttagtttacatttcctcatagctacagacgaaaatcaaatgtaaattcaaggaaggaaataaaaaattggcggtcctaattgctatacgaatttgtcaatttggatttgactatctggtgacatgctaccatgaaatttgcaccaggttccagcccaaggggatgtggcttctctattccgatccatgtcccgtagtcaatcaacggtagatgtcatctgtggtgggtcacacacgtcatattcgtcttctcgattggttttctcatctcgttgttcatacatcatactacatccttattattgcctcctctctctcatgccgttaaacatggagggatcaatcaaatcaaaatagaataactgtgtaaaaaccatcgttcaaacatagttttatgtgatttgacgaccaaaacatgttgtttaaagcggagtagagattactgaaaccaatctggaatcgattttgctaggaatctgtcgggtgattttttttgttgctatttcccgtttttgttgccgttggatctgcgccgagatttgtgccaggaatggggtggacgtggtcatacgtggatagggcctcgcgttggattccctggcctgattactttgcactatgcaaatttcgatttccgcgcttgtccgtagccgttttttatttcccctcgctgatcccgctctctcctcgcatttctctctctcgctttccccttttcttctcttctcttctcgttttctccgcgaggcgagagagagatctcgtcggagtgagtgcttgctggagaggtttgtctcgtcggtgtaagtgctcgccggagaggactgtcttgtcggtgtgcgtgctcaccggagaggttggtcgctggcgagatttagtgtttagattttttttgttcgatttgattcagtccaggtccgattcaaattgtgttcgggttcaatctcggttttagttgttttttttgttcgatttgattcagtgtaggtccgatttgctcaccggaaaggttggtcgctggcaagatttagtgtctagatttttttttgttcgatttcattcagtctaggtccgattcaaattgtgttcgggttcaatctcggttttagttgtttttgttcgatttgattcagtgtaggtccgattcaaattgtgttagggttcaatctcggctttagttgtttttgaatcgatgtaatacgatggagagctcgccggagacgttggttgccgtagttttgtttagtttgtctcatcatttttgtgtggcatccaatgttttttggtcggtgaaatcgtgatgctgctgctgcttcgccaagttgcgcttccaggtttggagatttgttcttcctgggctgtgggaagcgttcacggaatggatctgagattttgttgtttttgttgctgcaaagcgttgcttttgagttggggaatggttgtttagcccgcggattcgggggttttaggggaggcttttgattttaggggtgctttttgcttagcaaatccagtttctgtttttgtgcttgttgatgtgtgatttagtggcaaattctaggcgtgaagcaatttttcagaatcatgacatggctttttgttatgtttgtattagtgaatttttttactgaattactgaatttggtagccagcaaatacatgatgtgttcattactttgtaaagcttcacagtgattatattttttatgtcaatgtaaatggatctggatgttgtacttgtgctaaagtgaagtttctacatgattgtgttttttatgtatgatttttgttgtaaagtgaagtttgtattgtttgttcattttaactcatgtccaagctgatgtttatttattgttctttcagatgcctcgtgtccaaacatcaaggttgggtaaaaatcccattgaagttgattctgatggaggtgaagattttcatgttgattatgaagttggtaatgatgtaagttatattttaaatttttattattgtattatgctgtttaagtttacctttaatttggtattacattatttttcttttttttaggttgatgaaggtcctgaacatggtgaaattgatggtttactctctgttgtgctcaggaaaatggtatgtgaatattttttttgttgagttgtgttaatttaattttatattgtttaatgggttgctcaatttcatatttgtagattgttcaagaagtgaaaaagaatttggttgacacttcttctgtcaattttcacaatcccattgtatgtatcttttttttattagcatattttattatgcatggcattttatttgttctattttattgggtttcttgttgcttataatcttgtgttaacttatcaatgaaacggagaattaattcggtcaaaggaaatgtagtactaatgaagtggatagttattttcagattggaattgttctgttttttttttttgcaaaataaaattttatatttgttctgtttggtccatgtgtacaatgcggtactctgaaccttgctaccatgctattataggctactgttagttatgttgaagatgtgagtatttttcaagttgtagttgtgactatacagattcgtatctattctctcaacacagttcagtacagccaacgttgttgagttttttgttttttcttctctcgttgtttggcactaataccttctttgttttctttcacatatcctgcacctaagtatccttggtagctttcatgcatgcaacgtcatattcatgtttcccatgtaactaattcaatctagtattatgcaaacatagccaccataacacgtgttatggatatgttttttttgtgtgtcattgtgtctaattttttctcaagtatatctgttttgatgtgtaatttgtgttagtttgcttggattagttttctcaagtgttttttttgttctacacgcagcagcttttaatatgatatgagcttaaactttttttcggggttgtgcaggtttgtaaggttgcaaaataatagtctagtagtgatggtttctgcacttatagcttagttcaggtttccaaaattttacagacaatttctactaaaattacagtacacttacatgctatatgcattgaatttacaattgtaattttaatttcaaatcactgtaatttctacttctagtgtttgattttgcatatgtatggcagcatggatggtgctattaagattgggtgctatctcaagtatatctgttttgatgtgtgattttgtgttagtttgcttggattagtttcctactagtaaggtttcagatatattatgattttaaatgttaggctatacagccgggaccaaattttatatgtttctgttcatgagtgtatatggttgcctcttaggctttatatggttaccccctcactccctacctccctatgatttcttttgtttttattcatgctaatgtactgttctggtatatgtaattgtaattattatttctttctcttttagcttttaaatattataatttagtaaataagtttttaacacacttctacacttgttttttaggataaaaaaaaatctaaagttcattcgaagactgagccctcatatagcagattctcaacaaaatatttctcaacagttctatcttctttatctcctgatcagaagcgtattattggtgactatggttttaattctttgctgatgtttgacaatgcttatgtcccaaacaaatttgcttcttggattgcaaatcatgttgatgtgaagtcttctcaaattgttttaaaagataaagtcattgcaattaataaagaatgtgttcatcatattttgggtctgcctattggtggtatggagttcccaactgattgtgatgctggaaagtcttttattctttcaaagtttggcaagagcgctcttccatctgtgagattctttggtgataagttcatctgaaaggaaactctctctgatgatgaagttattacttcatttttgattgttgcaatggcttgttttctttgtccaaactcttctttggtccctagcaccaagtatttgactgtgtttgagaatgttgatgagcttcggtcatatgattggtcaaaatttgtgtacgaatggatgatgacttccatcaaaaagatccaaaagtttagtaccttgggtggatgctggtttctctgggcagtaagttattaatttttttttccattctctttgttccatattattattgttatttaattaatttttctttgctttttcatattttattttgctaggtgctttatctggattatgttgagtttggtgacaagaatgttcctattggcaagaatgttcctattggttttcctagaatttctcactggaagaataatatgattactttgtattctaaccttgacaaagttgatgaagaaaactttggccttagacccattaaggatttcaatgatacaacttatttcaaggtacatgttcagttcaattagttttatttatttttacttgtgtttttcttttcataaattaattcttatcattcattcatctttacaacctaaaattttccttgttttaggttgtaccccctgaaaatagaattaatacattcagagataaattggagtctgctattggaaccatgttacctgctttcattaaggagaaaatttgttcaatggttgttagtcattgttctgccaatcacattgttgacagtgagtcttgtgaagatattgctatcagcattatgctcttgctatgtgaacatgctggttctagatatggtggtgatcctgatgaaaacttaatttttgatgatatcaaccctgggtttcagcctaactatgcaattgatgttgaaaatgaaatcccttgtgatgctcataacaatggaagtaagttttcttctatgttcttttaattttattatattttttaatttttcttctatttatatattctttgatgttttatttttttaggtaccaataaatctgttgctagtaaagctaatgaaacaagttttcgccatacaccttctcatgataaggaattgggggtatgtgtctgcttcttatgattataatttatttttttagcttaagttttctaactttatgttcttgtttaggtaaatgatgattctgttattgtctctaaatctgctgttagattttccctttcaccaaactttgaaaaaggtacttggtgatgcattgttaattttttattttcttaagtttgcgttgctgttaattttttatttttgctcagatcaaggcttactaacccctgaagttggatatgctaataactccaattcacgatttgaacattttcgatctggtttgtgatttttctttgctagattttatcttaaattttctatttaaaaatttgtaaattctgttagttcttatcatagttattttgccagcttcaggtcctactgtatctgctgttgctgctgttaggaatgttgcaaataaaattaaatcaagattatctcaactcaacaatgatgacaaaagaggaccattgttccctgatttaattgattcttgtgaagatgaagctgttggttatgctaagtcactttcatgtcaaaaggaatatcttaaccctcgatatgtcacttcctcttcatcacaggtattccttttttattggcttgtgtcttttcttttttaaaaaattcttgaatagattttgtgatgtcatgtttctgtatgctttattttttgactttctcttatttttttatttgttgtagcctggtatatctttacactgtcttgacaattcacctgttcaagtaattggtataaataataatgaaggaacacgcagaactcattgtattcagaatgtgaagaagaggcgttttgatgatgttattgtatgttcttattcttgttgactatatttatatattgtcctaagttacttttttttctataattatttgtttctgcttttttttttagaattctcctgatgtggaatattttggtcattctacatttcctgattgctgcaaggtgttgtgtacccagactgataatttgtataatgccaagaacatgttgaaaagtaacaacctggatttgagttctaccggtggaaaattacctccccatggccctagaagagtcttagttccttctcggaaattttcagatccttatgttctttctgttagacgccgatttctagtgtcagatcaagaaaagagacattacaatgcaatatgcaagttgtccgagagctctaaatggcataggtacagtttcctttacatatatttttatagtttttgcattatgcatgtttcttactttgcttttctttttatatcttttttttttgtagttatgatgctgtagacattgataatgttagagcaaaattctcttcttttgggcaatctctcatgaaaggtggtactgtattgagctatgttatcaatgtgttttgccgtgttttgttcaacaacaatcatccttcaaactccaagagacactatttcttctcttctattggtgtaagtagttatttttcaaatttgtgcttttttctgttaatgttgatatgttacatattttttggtatatttatttcacttttaattttttttttcaggaactattgttaactgatctatcttgtgctgatttgagcaaggtgaaaagatcgtctcttggagcagctagtgctaggaagttgcacctttctgacatggtatttttttttgttttcatgctcatgtaaattttccaaagttatgttgttaattctgaatgattttttgcagctatttttccccatcgaacaccttgaacattggttcctttttgttgttgatataaaggacagaatgttggtcctcttagattctttacatgaaaaaggtgatccctattttgaagacattgaatgcttactggtatgatattttaattttaaatgcgttttcattcagtttttttcttcttgtttttttgtagttgattgattttttttattttgtattcagatcaataatttacagacattctgggattcttattatggctcttcaattgattttactactttgaagaaagtttacccttgtgttccaaaacagagatcttggtatattttttgtgtttaatcttttctgttcaaataattggagcattgcaaaatacgttatttcaggaatgtgcagagtcacgcttgtattacattacttatttgttgatgtccaaattctcaatacttctttattttggccaatgttttctaattttctaaatatcattaattgtcctctcattggggcattgtagaatgttcttgcttcatttgttaactagtgaaattaccatgtaattctgtgagctagatatttttttattctgtgtatgctatgctcacacttttgctgtgtattttaatttgtgatattactgtggtgagtagtttgtgtttacattttgtgatattactgtgctgcatatatttttatatttttttgcgtattgcatatattcttaggatgttagtaataacacttgcccaatttttaacatactaataataataataataataataataataataataataataataataataataataataataataataataataataataataataataataataatacaagaaacaagaaaaaatgccattgtggtacaactaaattcaacaatatcatgaacagtactacctaggttttatttctttgttttttgtaatttaaagagttgtttcaatttttttttgtagctttgattctggaatttttgttatgaagtgtatggaattgtggtcaccaagggttgttctaccaaatgaattttcttcagatgatattgacaatattcggatgttgtatgcaaatcagttattcttccatccaacgaataaaatgctgcagactgaagttgaagaagttgtgctcaattggtttaatcctgtaagtgtgtttttatttttttttcctattcttgttttttgatacatttttagttatgaaaaaaatgtttttcattttttatttgtatgctcaatttgttggtgaaggctgaaatttttcagaaagatagttgctatgaaaattggtttaatcttgtaagtgtcttttattttttgccattcttgttttttggattctttcatagttttgaaaatattatttttgtttgttattgtaggatcaatttgctggtgaaggctgaatttgtccagaagattagtcgctatataaaactgtagtgtgtgctagcatagtggaatgtataggatcatagtgaatgcatttttgcagtgccattacatattcctgtagtgaatacagatgttcacttacatcaaatacttttagtatgaatacacatatatagtgtgtgtagtgcagtaatacagtgaaaaacattaaggtctaatactttcagtctcaaaatttgacatccttgttttctgtcttctaatttgatttgttcttttttgtgcttccttgatctttaggtagcttgcttcctttgtcattttcttcatgtttcttcttcctagcgggcattgcttgcttctctattgtccctgcaatacaaaaatttatatccattagcttgatttttttgcttgcccatgtttgtaatattttacatattattcatttcttttacttgttgttgtagacttctgtattttctttgtacttcttgcaatttgcatcagcgggcaattttctattgtgtgacttgttcttccacatcttgtacaatgtttttttggctgttcttttatcttctctaccatcccttttgttcttgctgattttttcccctttgtgttagctatgtcagggtcttgaatatcttcttgctcatttgttgtttctttttctgcttgatcctcacttgtgttttccaccgtgttgctttcatcaattgatgcttgattttgagctgcatcttcaattatcaagtcaaggttgctatccag

SEQ ID NO: 66938 - DNA, 25196 bp, Oryza sativa
cactcgaaagatttttttcttatctctcactcgattttctcactcaaatttacagtgcattttcttgtaagttacagtgtaatttataaaacttacactgtaacttttgtaagttacactgtaatttttgaatttttgcatgtaaattttaaattttgtattggatttggtctttttcttgaggatatggtaatttagtgtccattatggtgtttcttaattgctttttgctttttattatatctatcggattttaatctaaagattaaaaatctgtgtgatacgattataaaaatctttcgaaagatgtataggtactcccaaattttgataggattttttttatagttgccaaattttggcagcaaaccacttatttggcaattttactaaaatttggtaaggttaaaaataacatcaaagtgaacaggcctttgtaaccattttcatccctgcatctggctaccaattatgaggtagagatggagacagcaagcctgcagttttggttccatggcgttgttgtttactagctctggtagttgcgagcaaccatccgatcaacaggaggtgcggctgcctggtctcatctcatcagtttgtttcttctccatggacaaattctatcaatccaagtagcgttttggttacaggtttctcctcattaagttgttattacagcgacgcagctgcactattcctgctgattaacacaggtagaagtagacaggttgggctaaatccgcaccaaccaattactattatcgtgggtagataaaattaacaacagataatctctcgcaacaaccacgaactgacatgacaaaatgacaacccagcatgccaagacttatctggatatagaacaggaggcaaaggcaaagctggtaggtatagttgaagaagtgagaactgagaaagattcaaatcgggagaaggatggcagatagaattcagatagaccatagatcgattcagcttcagcaagctgatgctgttggagttggcaaaaatccagcaccaaattttccatctagacaaggacattctcgatccattttctcaagtgtggtggtgctatgctccaaccatcctgctctcatctggtccttgttactgtagtactgaaaaaataaaagtgactctctgcaacagcgatggatttggcacattggtcacagtgaattgaacaatgcctagtaaagatagcaagttccagccaaccattcttctcctgcatatccatcgatccaatcattgagaacacaaccaaccaccaagaaattagatcgtctgaattcacacttgcgtcaggtggttcagtgatctgccttatcatcacaaattttgtactccgtttcggattggaatgatccatttcggattggatagcatgactgcaaactgaatcagctggaacatgattcgagacaagatttggtttggtgtgaaatgtcgttagataaatgatctcatttccaccaactaaccagctcgaaatgcgcacctctctccaatccaatggcgagaggagagagagacagggactttttataacgacagcaaccacctgcatcatccacaggcatcatcggatttggagccaggtgcttgttcatacgcgtatttaatttaattacaaagagtatatttcctcctctaccttacacttttactccctccgtcccataatataagagattttgagtttttgctcataatatttgatcactcgtcttatttaaaaaatttgtgcaaatataaaaaacgaaaagttgtgcttaaagtactttggataataaagtaagtcacaaagaaaataaataacaattctaaattttttttaataagacgaatggtcaaacagtgcaagcaaaaactcaaaatcccttatattattagacggagggagtaacatttttcagccctttatactcttaatttttgaaacacccttacaaaacacccagtaggggcggagctacataggagaggggtgcttaggaacacggtcaagaatttttttaagctatagttcatctattttcacccatatatgcaccgcctcaattcaaaataaagcattcctattagcgtaaacttaatcgaaagtagagtaaattaagcgagtggtacatctcttattctcttcattttgttctagtgccgcccctgcacaccagttggactaatgtgaaaacaacattggtaagtacgagtggctggaggtggtgtggttagaagctctagattttttttaaataaatatatattatatttgaaaaataaaaatttaaaaggttaaaaatagcaaaaatttctctctaccttatcctctggagctaatgcacgatgataagtgtgtaaaaaaagaggatagtaaaggagagactattatgcaagaggcagcagttgatgagagtgactcgcaagcttatcccggttgccttgtcaccgccgtaaaggcgcctcctctccctatcttctccactgcctcatctcctctcgtcgtcttcaccgccgttcgatgaatgctactctcatcactagtgcatccagtggtctggatagtatgtttcgatgccaattctgtctctcatggcgacgacctttgctgctgcttggtgatgatggagggtttaattgattgattgtggagtcctaatttggacactaatccgatctgggacccacccagatgagctttagtgatcccatggttgatcaaagcgtgctgcatctgctaatctctgatgtgaagcagattggctgaagaagacttagatatcctttcttctttttttcccttgatagtactccctccgtcccttaatataagggattttgagtttttcttacattaaccactcgtcttgtttaaaaaaattgtggaattattatttatttttttacttgcttaattatccaaattactttaagcacaattttttattttttatatttgcacaaatttttttaataaaacgagcggtcaaacaatgtaaacaaaaactcaaaatgccttgtattatgggatcaagggagtatgtattagctggagtaattatattcagtgctgatagagtaataattgtagcttctactaactgccagtcatgattctaaaaaaatagaaatgtagagtagtatatatctgaatcttagcaaaatattattgtatgatcagatcgaccaattaaggcaagcccctcgtatgctgcttgttcgcaggtgaagctgacggtatgctgacagtagatttacttccttcatctataaatataagtatttttaatgttcagaatttggttatagatataagcatttctcaagtactactttttcaattgtcgtatcgctgagtgtgaactttttcaagtaatctctcagtggtattaaagtaatattattttaagtttattttttctaaactctaaaaataattatatttataaacagaaggactaataattaattaagtgaataataaaggttgattaagtagggtggtacttgcacttccctttccgttgctcgacttgctccaaggggagggtgggtcccaggtgacatgcgagtgggtgatggttggttggttggtaaagtgtgcgtgagcgtgtggggccgaggggccccaccatagaacggcgaggtgagccttatccgaaatggggaaaaaagggtgggctctcttgttgaatcggcaaaaaaaaaaaaactcgaaaaacatttttatttttagtttttggtttttgatttgtcaactgagacggagagagacaagttggttgtcacggtttctcttttcggcgaagcttaggccaatgggagcggtggtgtgtgtgggcgtgtgccacccgcaccaacatggaggcacaagtggtccacgggatcatcatgctttccgttgatccttctcttcctcgagtggcaactggcaacatttgttgtcggggatcttttgttaataagaaaatattttaattacatgcgagttatcgtttactctatccgttatagaatacaacaacctaaaatccgttaccgaataaaataagatgaaacgtatctaaaatcatccagattcatattattaggatatgccccatctaattctagattgcaatgtcctgtaatggagagagcatgtatgccatggtatgaattttttttaatgacctttctgatattcgagctacgagtgataagttaagaaacataagccaactaaaaataacttataaataattttttttatatctatgttactagtgatttaaaattcagtgttggaaagtagactacaagagagcgaaataaactttaaaattcagttttaaaatttaatattttattgtgattggtaagctaacggttagcaaagtaagtgtagctcaactgatttggtttattgtagtaaaaccagtcctgtgtttcctaaaataaaaactgatataccttttttcttacgtgaaacaacagaagaggtcctactgtgctatattatattaaagaaaaactgatatacctcacactactaaaaggagcagtagaacaaatgagcagtagaacaaaaaagcatgggctccagacacaagacgagaagttggcccagatccccgcgacggagagcagcggcccgcactagctcatagtactattcttcgttactgtctacaaccaacaggcaacagatatattcatacataaaaggagacccactgagtggcaactgacacgatgagcatcgcagcagtgttgtgcaacatcacaaagcatatagcatgaggatttactccaggtaggctgatcagcaaatagccatatccacttcagttgaaccaaacagttctgcgttcctctcaaacaagaacagaaaagaaacaacacatgctaagagagattatgctttgctgaatcatgatgatcaggtcaggtttctttcggggcgcccttcttcgcggcctcggcggcagccttctctgcttcaatctcagccacgtactcgtcgatctcagcctcctccagctcgcggaggccatccttgtgtgtcatcaccgcaatctcgatgttcttgccaccgctctcgacaacctggagacatcaacccattactcaaatttaagatatttgttgcatataaaatgccaagcatcaaatgatatagctatgatggagaaaccaactcagcaaaaaacactgaataaacaaaggtcaaaggccaatgagttcgtcatgaaaaaaaaaaagcaaagcaagcaggcatctctgtctacagacaagtaaaaaaggatgacatttgttgcactaaaagagctcatcagaaaattctacatgtgcaacagactgacaaaatgcttaattacctatcaaatggcagtagtaatgtcattataaagaaataagtaccatggactcaatagttaatatgcatatgtgataaccatttgaagccaccaatgaatgtataagcagagtaagaaattgatttcggatatcatgaactgtgcatatgtgataaccaatggcattggtggagccagaatattcttaatgaggggttcagaatctgacctaagtggcatgattattagaatatagtgacatttaccagtaaattatcaaattggttcatatatggtatatagattcatgaaagttcaaatctaataaaataagtgactcttcattcccttgaatagctagttttcttatttgagtataaattgtatatgtttatgtatagtgtggttggttagcaaagagtttggggtacacatgtacccccatgtacccatctacctctgccactgaccaatggaaaaaaggtcaatgagtttgtcatatgtggcaactggcaaagcatgaaacaaagtactaacatactactttgtcttccaacaacgaaaaaaagcaagatatttcactaaaagaggtacagacatatacgtatatgacaaaatgtgcaagagacgtgcattttcacggtctgtatgagcaacagattgcaaaaatgatcaactgcttaccattagctagcataaactcaatggtggctgtgcatatgtgttaaccatttgaagccaccaataaacgaatatataaccagatgcaggctaagaacttgatttgaagtatttagctatgaactatgtgtccttgaggaacataaccatttgcagttagagacttacagtaatgaaaaaaggacatttagacttaggccttctttgtttaggcttataagctagcttatgagccaaaaagcctaagcctaaacaaacaagcagcttatttgtttgccctttttaaagccacaagccactcttacactgttaagccaaaagctaggttggagaaaccattttgttggattatatgaagtggaggtatgactcaaccattgaacttaggatttcaaatccaccggtttataaaacatataagccaataagctgacttaaaatctcaagccaataagtctaagcctaaacaaagatgaccttaatttgatatgtatttttgtaatggtgtatatacattttttttacctagacagtaaatacaatgaactaggcatccgtgcctatatctaagcagcaacatactaaagcggcagcagagttgacaaaatacatgcaagttgcagcttctacagtgcaatagaagagaactacaggtgcagattatcaataacagaaaaacaaaagtttatatgccactaatcaaacaactttaataacttttgaagagaaaaatgtactcacataagaatgcctttaaaaacttttgaaaccgtgcttaacacttaaaatatgagatgcagatgacaatcaaaatacacaaatgattaaatagctagagacgatttactacggataaagagttaaagacctatagccaacactacaacaataaaatttgaggtgcagatgaaaaccaatatacaaatgctgaaatagctggagatgatttatgagattacagatccaagccataccaattgctatgatcactccaggcaccaataagtatcatctttaagatggaagcaaacacaataaaaccaatcccatccatcccactctattttaggttcatgactgcatttatagtctcagccgattgtaacaaagattcagggaactattaatctttgcaccaaattgagtcatatggaacttaacgaagataacgatgttcaatcgtaggcgggcatcttacaaattactgaaccagtcaacataagcaacacaaattagtgaattacttttgagtatctgtcttcagaagcacagttactgattcagtggtagtggatcaaagctagaggtagttttaactagtaaaattattcagtgtgaagtgtatatatatacctcaaggagggctcggatggcaagcttgatggtctccttgccggaggtgtccttgtaattcttctcgaggaactcgcgcatggagttggagttgcggccggtggcgttggccttccaggcggagaaggtgccggatgggtcggtctggtagagggcgggcttctcggtgtaggggtcgaagccgacgatgagggtggagaggccgaaggggcgcaccccgccgctctgggtgtacttctgctgcagtccggcgatgtagcgcgtgatgtactcgacggtgacggggtcctcgacggtgaggcggtggctctggcactcgacgcgcgcccggttgatgagcacgcgggcgtccgccttgagccccgcgcaggcaagcgcgatgtgggtgtcgaggctggcgatcttgcgcatggacctggatttgggggggagatcgatccgcgggtgagatccggcgaaggggagggggcgggttgaaggatttacctggagtcctggagcttgggggtggatttcttctcgacgccgaggacgacggtgtcggtgccgcggacgccgacggcggcgttgcccttgcggacggcctcgagggcgtactccacctggaagaggtggccgtcgggggagaagacggtgatcgcgcggtcgtaccgggccatccctgcctgctggtggtggtggtgtcgccgccggcgaggttttcctgctctcgctttgcttttccttgtcggttgcgccgccgcctccgccttttctcgttgctgctcctgctccgccttttctttcttgcaagaaaagaagacgacgacgacgaagacgaagacgaaacggactcccattggcccatgggccggatcgtattccggcatggggctcgcgttatgaagcccactaagaaaaggccagaaagcccatggtttcttgctcacgaaggttactgcaggctgcatcccatgggcccatggttaagagggatcgaaattttattctccgttccccctttgattcgaggaaaaaaaatcgattttggctatatcttactcgaaaattttttttcttatctttcactcgattttctcacttaaacttacagtgcattttcttgtaagttacagtgcattttcttgtaagttacagtgtaatttatgaaacttacattgtaacttttgttttttaagctacaacgtaatttttaaatctttacatgtaagttttgaaatttgtattggatttagtctttttcttgaagatatggtaatttagtgtccattatagtgtttcttagttgctttttgccttttactgtgtctatcgaattttaatccaaagattaaaaattgcgtgatactcataaaaatctttcgaaaaatgcataggtactctaaaaaaataatggtttgtgtgtgtgtatatgcggtttatgtacctatagactacgtgtattgactgcctaggaaaaaaatataacagtatatcaaacaaaatgttttatcaatagttttgctgcatcataagttcataattttggccatgtcaatatatattgcctcacatgggcataaatttaatttgcaggcatcgagcagtcaccaattatccatgtctccccatcaaaatttgccaatgtcaaaactagagtcaaaccaacactggaatactaggagcccttgtctaaaaatgctttaatttctaaacggatggatttgagagaataaaaaaaagtaagcatgaactagctaattgaatttgtcgacatcatcagggcttgcaaacccatttaaaatctgaattgggcctttcatctatctcctcaaaagggaccaaatctgactcaaacttgaaaacttgttggatgcacttgtggcgtagtggagcttccgctatcttccccctcaaaaaatcatacctgcaaatcataggtagtgtttagttcgtgtgccaaatttttttaagtatacggacacacatttaaagtattaaatgtagactaataacaaaataaattacatattccgcctaaactgcgagacgaaactattaagactatttaatccattattagcaaatgtttactgtaacaccacattgtcaaatcatggcgtaattaggctcaaaagatttgtctcacgatttacatgcaaactatataattttttttttcgtccatatttaatgctctatgcatatgtctaaatatttgatgtgacggtaaagttggaagtttgaaaaaaatattttgaatctaaacacggccatagtatgaattaacaaacacatacctgtaaggctcctttgggttatatgattctcatatgaaaaattgcaatccataggaaattttactataaatgccatttggaacaaaggatttgaagtaaagccctgtttagatttcaacgtttttcttcaaactttcaactttcccgtcacatcgaactttcctacacacaaaaaattttaacttttccgtcacatcgttctaatttcttcaaacttttcaattttagtgtggaactaaacacagcctaaataaattcctgtggattgagttcctaacttcctatacaccaattccgtaggaaacaaacaatgagctcaaacttgtctctctactctctctatagaatccaccaaattctcatgttttttttttcctttcaaccatccaaacaatacacatttcatattcctatatgttttgcctgtttctgtatttttagaatcttgcgttccaaagagtaaaactactactgtttagctaattatttgcaaattgatttagatatgtgtaaaacggaagaagcaattattaagtatatacagttagcttaattaccacagcactctgtagacgctgttgaagaatgcaacgtcagatgcgtagagatctctgagtatgaatgagttgccttcctccattgccagcctcgtcaagctcgccgtcatcttcttctcccacctctcctgcctgtagccggccagcacccagacctcgacctcctcgtcgaccaccaccaccaggcacagcttcccctccaccgccgccaccttcttccgcgcccacctcttctcggtggtggcctccggcggcaggccgatgaggcgccacgtctcggtcttcacgtcgaacgcgaagatgtcctcggcgccgccgctcagcctgtcgggccaccggagccagtgcatggcgccgtgcgccctcaccgccggggcggcctccacgagcgactccggccacaccgcgacgtccgccgaccgccgccacgccatcccccgcgagtcgaacacctcgcagcggaggcagttcctgagcgtggggacggagaagcggacgatcttgaagtccgccgcgccaccgccgccgccgccggggcgcgccagcatcgcggtggcggccgtgcggtagcgcaacctcgggttaggcagcgcgcgccactgcctagtcgccggcttgcagacgtagtaggacgacgccggcttgcgcggcgtggcggcgtcggcgtcggcgtcgacgcagcagacgagcccccggtgcggcgagacggcctcgacgcggacgtgcggggaggggaggaagtcgagggacacgaggtcggccggcggcggcgaggggtgcatggaggagacgaaggtggcgtggtagcggttgcgcgcgacggtctggacgaggtagccggagacggcgtcggcgcggcggcagtggagcggcgcgaaggcgggctcgtaggtgaggcggcgccagcgggtggagacctggcggcaggcggcgaggtcgtcgagcgagacgcgtgtgagcatctcgaacacctggtcctccggcaggctgatgacgtcgcactgctccgacgaagacgaagacatcatggagaagagaagagaagacaagttggggcagaggcaggtactaggtgaggatctagctaattcagaactcgatgtgtgctagctgcattgcattgcaggcttgcagggcaagaaatgttggaattaatgaatgggccttagcccactcgaagattaattctttggaaaatcacaaaagcccacctcatgggatggcatgcatgtggagtttagtaccatcttgcttattctaggagagggggacctccttaaaagggaggatgtcctcctagccacttgaagcatgtgtggtggagagaagaggggaaacacacgcgcgcgctcgctcgcctggcctggcaggcggcgcgcgtgcacgacgtacgcgtcgaatggtccgaaaaattggctcctcacccttgcgcagatgcagcctccttttgcagttttgttttgctgcaaattcggattcgtttttgtgttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcatgcaatatatacgcaaaatcaatctagggtttgcctcctactctgtactgcgccgtcgctcgtagcctactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaatccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagtgttcttggcgatcgtctggtcgaggtgtatatgcatatgaccgacgctaaggagttgtgggatgcactgaatactaaattcggtgctactgatgctagcaatgatctgtatatcatggagcagtttcatgactacaaaatggctgacaaccgttctgtagtcgaacaggctcatgagatacaaaccatggctaaggaactcgaactccttaagtgtgtcttacccgacaaatttgtggccgggtgcattattgcaaaactacctccatcttggaggagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctaggaagtgtccacagcgcaaggggatgaaggcacctgcagggcagacttctaagtctgctaatgtgaccattggcaacactggagatggaagcgggtatggtaatttacctactgttttttcagttaatcaatctactaattggtgggttgatactggggccaatgtacatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgctttttcctttctgatttctgcaataagtctgtgaaccatatttgtggcagtgtggatgatgaggctaatgtttggcattcacgtttatgtcatattaattttggcttgatgtctcggctttccagcatgtgtttaattcctaagttttccattgtcaaaggttctaagtgctatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatggggttgcttggcgaaagtcaatgtaccaataacaaagaagcgcaaacttggacctaagactgtggactgtgtttttctgggatatgctcatcatagcattgcctatagatttttaatagttaaatccgaggtaccggacatgcatgttggtacaattatggagtctcgtgatgctaccttctttgagagctttttcccaatgaaggatacacatagtggttcgaaccaaccctctgaaataattcccagttcaatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggctgtccgtagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttctttgacacttactcacctgttgctagattgaccacaattcgtgtgctactttccctagcagcctcacatggtcttctcgttcatcaaatggacgttaagacagcttttcttaatggagagctggatgaggagatctatatggatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgatgacatactgatatttgggacaaaccttgaggtgataaatgaggttaaatcattcttgtctcaaaattttgatatgaaagatttgggagtagctgatgttatcttaaacattaagctaattagaggtgagaatgggattacactcttgcagtcccattatgtggagaagatcttgaatcgctttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatctcctttgctgtgagcaagttgagccgatttacctctaatccgggagatgatcactggcgtgcgcttgagcgagtaatgcgctatctgaaaggtactgtggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccggctatccttatgaactgtgacaatcaaacggtaattgtcaaagtgaatagttctaaggataatatgaaatcgtctagacatgtgaaaagacgattgaagtctgtcaggaaattaagaaactccggagttataacgttgaattacatccaaacagcgagaaacctggcagatcccttcacgaagggactatcacgaaatgtgataaacaatgcatcgaaggagatgggtttgagacccatgtgagttatactatggtggtaacccagtctatgtgatcggagatcccgtgaattagatcctgggaagaacaaaccattagtaaactagaggagagtatcaatatatataccctctccaagtgaagatgcatgtactctcgtgagctgcaaggcaggttggctatgccttaatgagttctgttggctttaattagcgaagatgttgtcctgcagagcattcttgaaagaactcacctttgtgagcttgactgttggtcgcagtctatgaagattttgggtgaatcttctaggaagcttactaaagacctaggagtatgacctatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtacattggaaaaggcaaatctcagtgggattttgagatttggtgggggattgttggaattaatgaatgggccttagcccactcgaagattaattctttggaaaatcacaaaagcccacctcatgggatggcatgcatgtggagtttagtaccatcttgcttattctaggagagggggacctccttaaaagggaggatgtcctcctagccacttgaagcatgtgtggtggagagaagaggggaaacacacgcgcgcgctcgctcgcctggccgggccgggcagggcaggcggcgcgcgtgcacgacgtacgcgtcgaatggtccgaaaaattggctcctcacccttgcgcagatgcagcctccttttgcagttttgttttgctgcaaattcggattcgtttttgtgttggaaacgttccgaaaaatccggtgcgtgcaaacggcgtggagtccggataagttacgcgcgacttatccggttcggttacgcgcagtagagatcgtgcgggcgccctgatcaagcgacccttctctatataaaccgacccgccgtcttcatgcaatatatacgcaaaatcaatctagggtttgcctcctactctgtactgcgccgtcgctcgtagcctactccatcccgctcgccggcgtgcaccagcgatcgggagagcaggtctccggaacctctgcctttgacgtcctgcaccgggagaaggcggcaataaggtttttgggaagcgcttcgcgcgactgctccctgttcgttcgcgacggctcgccttcctcttcgctcgcgtgtttcgtgccttcgtagacacctgcgaaaagtttcgaccaagcagccggtcttttcgtcacctcggtacgtgttcaatatgttgcgcatatttgatctgttcatgttatactgtgtagtttacatgtgtagatctaatgatgcgttcatgctagttttcatctgtaatgtcatgatttatttatggaatagattaaatcattatatgtctataatctcaacaagaaatccgattaattggatcggcagctagaacagttaataataaggcgagaaaaatcctcgccgcacgcggagagccgaatcgtgaaagaaaaatgcagcgagcacgtaactccatgggttggaaacgataacgaggtgaagaaacgcgtatactatcttctcaacgataacgagatgcaacgatagtcaagcatgtcaggatatcaggactggagctttgggcatgccgcttccgtagcggccaagcctaccagggtgtgtttagttctagggtgtaaaaattcaaaagtatacagacacacatttgaagtattaaacgtagactaaaaacaaaacaaattacagattccgcatgtaaactataatatcattattagccgattggtttctactggattatattgttatttattacgttatcatcagccgaatgtctctagatcattatttacttaagtatcagaatatatatatagccgattgctcaaaaccctatcgacataggctagtattggcatcgtctgaaagtactccatcatcttgtcagctgatcggctctttggtgatcaatatatttatctatcttgtcagttgcaagattaaactgactggcagatccacatctcatcaagttttagatctacactggagctaagcagatcttccagactgttgtgttcgtcgacttagttcgcgcaaacacagttccgacaccatcaaccgagcgcggatttttaatgaaaagatatccccaaaagaagagtctgttcactttgatgccaaaaaaaaccttaccaaaatttggcattgccaaaattttgacaggatttcttatatagttaccaaaatttggcagtaaactaaatgtagctacttttttagcaactttaccaaaatttggtaaggttgaaaatgacatcaaagtgaacaggcccgaagcaagctgtacggcccaatccagcccattgggaggagtagagtagcccagttatttttttcttgacctggcccggcccaaaattgatttgctgtcttctctctccaggtgttagttcatccatgatccatctgtcgttcgttacagccaagaaagaagggatcgaatatttgcttgagtcggcggcatgatgcattgcatgcgactttgagcgcgatatcgtcatgactcatgagttgatgtctgctgatcgatcgagacgccctgaaaccgtgctttccctgacggttcagaattggcttcaggttaacctcagatcggggagtttcatcattactcactgacgatattaattaattcttctagattagatgtggaaatagtagtaggagttattttaatataatgatctttcctctaaaaaaagaaatagtagtaggagtagatcatttccttgaaattttctcatgctagtaaattgacatttttcacaggctgctttagtaaggattctgtcacatcttatctgaatcagcactagtatttcgttactgcttccttcactgaatggttcatctgtcactaagaagaaaataaatcaacaatttgttcagaggtttgaaaaaaagataagcacttgaaagttacaccctctctgaatttaccctcttgtttctttccccttcatagaagatgagatcatctcttgcggggacttgttcttcacgctgtcactgttatgtaagatggggcttcttcctcacctcttgcataaaaatcaaggaactcatgtgatgatggccgttggccgacacaaaatggccacctgaagcataaccatatgaaagcagagatccaggctcataagccctttccctttacagggcattttcttcaggtgtgtgctagcttaacactaaggttatcacataccaaagtaggttcaatattctgcttttcattgtcattgatgagcacaactcacatcttttgcctatgcctcccccttttgccttcaccacattcagaattccttttgcatcttgtttcttcagagttcagacaccctttcattgcagatcagaatgattgattggttggttaattataccaacaaaccctcaaaattcttatcaggtatacatctgagacaaacaggatctgtattactcttcccagtttacctccaaagtgattcttatcctctctataaagacaagagagaatctcagattgtgctacttgctgtgcgtcttgctcaaactttcagaaagaaaaaaaaaaggagcttaccagatcagaatatcagatcatatgctcttctcgtttagattcaaagcagtgcatctggagtccacattgatcaggacccccaaaaaattaagcacagcaaagaatgtaactagaatagcaaggttttctgaaaggcaaataaagcaaagcaaacacttaagctgagcagcaactacaactgccaaacttgaggttgaggacgcctgcattctctatccacaaacaaaaagtcctaaagaatgtgctctccacgtctcccccttttgatcactcctactaccgatcaagaatccttctcacttgctactagctgaataatacgggatgctcctgctgggcaagcaggatcaccactgcaattgccaaggcagattggaaagctaaggatgccggccatgatgccgcagttgcagccatccccgcgccactgctggccttcaagctcgccagccacaccgcatcttcgagctgctcgtggctcggtctccgtgatccgttctttgaattcccactgcaaacataccaaattcatgaaacagttaatcaacctgaaactgatgatgagaatttgctgttgcaagttccttccatgcctactaggaaattgcaactttccagtcaaggccagcttaggtacaatgtgagtgaagtggggacgaatcaaaggagaaaaagattgctcctccttttcttagcctaactctatcacatcctcaatgaacctttactttccccaattcatgttccacatcgaaatccccaattttagcccaaaatctcaatgtgctgcaatcagtccactatacaattctatcatacacataaaaatctcatactggtaatcgaaatctcaatgcaatggattcgctgcgattgatttgaagtgtacaaacctggatggagtggatcgggggcagaaggtgatggtgtaatcggtgtggttgcaggtgaaggtggaggtggcgtcgtcgtaggcgtagctgtaggatttagggcacgccgacttgaagagctgcgagtactgggaagggtggcaggtgtccgggttgccgtaggcgccattgcagcagtactcaggtcggccgaacgcctcgcaggcgctgcggcaagcgcggccatcgtcggcgcggagctcggaggggcagcgctcgttgaggtcgacgaggcagccggtgtcggggcagtcgggggcggaggcctggacgagcatggggaggttgtagccgtcgacgaggctgacgtcgtagaagtccttgccgtcggcgccgttgagggtgaactcggcgagcgtggcgggcggggaggcgcccgcgccgcggcactccacctggccggagccgcagtcccccgtggcgcaggagcccttgccggagtcgtcgaattcgcagccggagcgcgcccagaagcggcccgaccaccccgacggcgcgtagagggagcgcgacccccccggcgagagcgcgaagccggtggtctccagcggcggcgtgccggagcccgacagcacccccggccacaccgtgtccgtgcaccggttggtgaaggtgaaggtgattgcgccgacgccgaccgagcctgcgcgcgcggaggaagaggaatcgaatcccccaaaccccaagaaagaatcaagtcaagctccaaatcgcgagctccagtagatagtaacccagcaatggaagtgactgaccttggaagaaggagaggaggagaacggcgagcgatgtcggggagccgagcagctgcatcagcatcagcagcatccgtgaatccatctcgaaaatcgaatcaagaacgactcacacggttgattgaatgattgagcttgggggatctggtgttcgacaagatttgctcgctcgctcgtttggattgcttaaatcgcggcggcggcggcgatggcgggggagtgggcacgatcgatgcccataaccccgaatccgcggacgcgcagctgagctgaggtcgcgcgttgcgtggtggagtggaagggggaggtggtgctcgtgctcgtgctcgtggccgtgtaaacctctgggcgatggcggctgctggctttataaccagaggaggccgttgcttgctccgcaaattcgcgatgcttttctttcttgcaatcaatcttgcgacttgcgtccgctttgtgtactttttgctcgaatcatctctcaatcagcacgcgagtcaaatgcagcgaccgcgagattagtactccattttacagtgaagaattctgaattggaatccatctggtagcgcactgctaaattggtactccatccgtctcaaaatataatattattcaactttaacataatctttgatgtgctactttaaccaccataattaagatttttaaataaaaagagttgcatattatagtttgttcaatgataaatctactaacatcaattttatatgattgatcatttttattttttttactattaataacaaaagttaaaaatatttgatttagcactactttaaaaatatttatattttgggaagtattgaatacttttatgaacgtaattctagcaccggtcgcctgcttaattccggcttcggtgagccagcagctcgcaaatgcacaccgaactcaaaattcgagccggttcgttttggtaggattcgatgaaatttccagtgatttgcgacggggttcatgttctgaccagtttgaattttgtgaacgttgaggtagtgggacaaaatttttgttgtttgttttgttggtaagcgagtggcttttgttctgtttttttgcttgtcacgttgtgggcacagtgtttggacggtttggatcggcccagcgacgtccatcagacctccgcttttgcggcacaaaacgataggagaaaggggagcatgcaacatgccgtccgaattttcagccccagagaaaccgaaagctcttaataattatcggatccattctgatcaccgatctatacctgacataagattttcttattcagtgaaaaccagcatgttgtcatgttgttccaaggttgatgctcccttttctcccaatgatttcatcaccgtaaacgttgaatggatcacacacgtcttgagtagatgagtggatgacacatttcttgagtatatgaatggatcacgttgaatggatcatatataaatttattataatttctttttaaaaacaagttttcagctttttaatagttaatctgttcgtttatatttttcatcattctattacattcatcacaaaatcattcatctattcatcgttccattctattaaaaaagagcatactcaatcaaactttattcagctcgatcacactgtacctgtgtatacaatacagtactgtgcgtgtaggctaactcatagttcttggcgaattcttcgcacgtaagcaaacaaacgactgatcacgcagcatgcactaccatgcttctggtgtgcaagtgctactctagtactactacactgagtggagtaatcaagagaatcattaggcactaagtcttttaaaaaagagggatattaggcacttgccaggttaccaccgctgcagcctgcagatcactctcagcttcaaccttttctgaattaccactactttttagtactacgtgataacctttctcattcttctttcctaaaaagaagaaaggaatgcagatcagatgaagagatcgctgatcagtagccttagtccacatcgaggactggtttagttcccaactttttcttcaaactttcaactttttcatcgcgtcaaaatttttctatacacatgaactttcaacttttccaacacatcgttccaatttcaatcaaacttttaattttggcgtgaactaaacacaccccgagttaaaatgttgcttttctgaaatctgaatccgaacaaacgaaactattgcaaattaattggttcagatttcagactgttactagtactccagcctagtttagtttccaattttttcttcaaacttttaacttttctatcacattaaaactttcttatacacaaacttttaacttttccgtcatatcgttctaatttcaatcaatcttttaattttggcggtgagcgtgagacaggccagctccatggcgaagtcaagctgtgaaacgcaagcaggagctgtctgtttcagccgacgtgcaatctgacacgctgaagaatcagcatcgatgtgacggccggccatggcctgagggccatctcatattagtagctgcccggttgatcgatcgaccagcctgtaattgatgcaaatgctgttctgtaattgatgcgtactatgctgttgtgctctgcttcagtttccttgtggttatacgtcactgttgagttcggctaatcctcatcgatctgaaagctactgctactgatcatctatctgaatctgatcgagataatttagctctctactcagctagaatatccatctctaaccatccaaccctgacaaaccatggcatctgcctacactgcttttcttgctcatctgataatctttcatgcttattagtagctcaaaagaaagcaaaagatctgtctttttcttttctttttcattcgcaaagcctggctgctaattaacaggtgacatctgctgctgatagctttcagtaaagggaagcccacgtttcatttggctgcatcattagcgtacgactcatagccataggcatcatagctgtagaatccctgtaagatctgaacaggagacagggaaccgatagatcagaatctgaacatggattcctgtggattcagaagaatcttgatccatgataagataggaccatgcaagttgcaacgaggataagatacgccttctgatcttcagatcccgttcatctttcgtcaagttcggtggtcacaggctaggctagtgaatcttgtcaaaatctttacagagatcatatcatctcagcttttttctgcatgagatttagagtctgaagctcaactgatgccagaactgatcgaccacctgtagtcaatcacccttacagaatactcctagctagaagtaatacagtagatgaattaccaagttttgcgagttttcatcttgtcacgttcttgcaatcacggaaagaggggaaaacctttcaaattcaaaccaccaaactcaaaacgaatgcattttaactgggttgattcaaatcacccagcaacgacatgttggg

SEQ ID NO: 66939 - DNA, 27068 bp, Oryza sativa
ttgtggtcagttaatcatgatgctaatactactttaggaatgacagatatgtataggttgcccttttgtgctgatggtagaatagcaatgtgtctaggttcctgaatcgaatttgaatgtagttgaatggacctaatactacgtgattttttttcccatgacttttgacacctttattaattagcttcttctaatcaaactttttatctgttctgaaagggccatatagatgcttttcttcctagatgcatgcattaaaggaggtttatattctgttggccgaaatgcagataaggtcacgggtccgacctgtttcaacatattatatctccatctaatacacacaatttctctgaattttagggatttgaattatttcgtgtaaattacatacaaaaatctggtaaaattcatgtcttttatataggatgtaatcattgtccttcatataggacgtaatcatgtgaacatttcaaaggttggtgaatggtagcaaactaaaccaaatggttattatttatgaatgccttaccattcacgacataggtgctgtaataaaattctcggaaaatcgaagcagaagatcattacaaattataatccagcaaaagtgacattaggacgaaccggaacctaccgatcggccgaaaatggcaggtgcaacaccactgtaatactccactgaataacaaaagtagattaatcaaaattaactagtactccctcgtcccaaaatgtttgacgttgttgacttttttaaaagtatttgaccgtttgtcttattcaaaaaatttaagtaattattaatttttttcttattatttgatttattgttaaatatacttttattatacatatagttttacatattttataaatttttttaaataagacgaatgattaaacatgtttaaaaaagtcaacgacatcgaacatttagtgaaggagggagtaattaattactagtagacaccaactagtggtactccaccttacaacttgggacaaaacaaggcatggccctcttggtctggaaggtgcttgtcgccttgtcatgtcggcaattaatagcaactgcataaacaaatccgccttccggatcgatccatctatgatgatcatctaccagctacctgctcgatgatcttgacagtgtttctgttcttccatctcgtgcttattatactaatatcctgatgaagaattaattaatcatgatacgaatcagttactaataatcagtctgatgtctgtgttaccctgaaaaatttcagaaacagagaatctgagctcatccctgcgtgctgccctgcaaagctgcaatgcacagcagctaattccgcaatctaatgctttttttctgttcatgtgagaaatgaaaggagtccttaattatgatgcatgaatcagttattgagcctgatgtctgttaccctgaaaaattcaattcagaaacagaatctgatctcatccatggagaagggtgcaatgcaaagcggcgcctggagcaagttgaggcagtgcaaggcctctgcttttttggcggcaacagcaacagcaacagcaccatctgaccctgcaacttgagatggaatagtaaaagagtactctctccgtaaaaagaaaaacaatctaaacacgaatatgtcattatatagtataacgaatctagacatatccagattcgttatacaatgtaatattatatccgtgtctaggttgattcttttttaggacagagaaagtatggagggagtattcagagataggcaggggctcacactgttgctgaaaaaaattaacgacggcgacggcagaaaggcagcagcaactttaccgaactagccggaggcactcactttgctcagtctctcatctcatgacctgtctttgtagcggttgatttcctcctcgcgcttttatcagtacactagttgttattggcgccaacccgtttgggacggacacattcatcgggtcctgaagaaaaaggtgaaaccctttcttgatttccttgagttttcggtagtacagtagactgttacaaggcgaccaagtacagtagattagactctttttgctcctaattcagagcaaatctgcatcttcagtacagttctccggtgtctgcactctgaagcagagaattgtcttgaagctgctctgttcatttcagactttagacttggagggatgcaaggaatgtttctgatttacttctttatttctttattgagttactgcatctagtcttgttcgtgaaattagtaacaagaattttcttctcggcaaggcatgacaaataccatagattttcagaccgagaacaaatttacatccaacaacctaaataaccatatcatcaactgaactaagtatgagtggaacagtatttacacaaaatggaggaagtgatcaacaagatcactgatcatctccccaaaggaagtattcctctatctgatcctaattaagaaggactaacactaagcagtaaccaaagctagctaagaaatcaagaacccaaaagagaagagaaagtgtaacgatcatggattggtttgcaggatcatttcatttcatggggaggcttctgaagtcgagcatgccagccctgaggccgaggaagttgttgccggcgccggcgccggcgccgccgccgctgcacttgcactccttctggaggccgaggctgcagccgaagcagaggccgccgcggcggcgctgcagctccggcgccctcacgatcatcgccggcttcgcctcatagtcatcgtcttcttcctggcacgacggcgggctgatgcagaggtccaggttgaggtcggggcacttgggcggcttgctgagtatgagctgctcctccttcgtcgttggcggcggctggggatggaaggagatggtggcggcggcggcgttgacggggcggtgcgtgacggggtcgatccccctgccgagaagcttccggcggatgtgcgtgttccagtagttcttgatctcgttgtccgtcctccccggcagcctcgccgcgatcagagaccacctgacagatgatgaaaatcgatggatggaagagaggcgaggtgaggcagaaggcaagaaaagagaagcgtagttacttgttgccgaggaggctgtggagcttgatgatgaggtcgtcctcgtcggcggtgaagttgccgcgcttgaggtcggggcggaggtagttgatccagcggaggcggcagctcttgccgcagcggaggaggccggcggccttggggagcgagcgccagcagccctcgccgtgggcgcggatgtaggcgacgaggcgctcgtcctcctccttggtccacgcgcccttgttagtgtgctccttctcgcagcacggcgacctccccatcgctgttggtctcggccggcggcgagtcgtcgtcgtcgtgggtggcgcacggcgggtggatgaggaggggattatataggcggggagggaagggaaaggcgccaacttagtttttggttaggttgggttggttggtgttggtctcgcgttggcgttggcgcgcgcgggagaggcggtgggtgccgccacgtcggcgcgcccgtgggatgggaagagaggtggattaggtaggtgcaaagcggaagcgggggcggcggcggcgcgtgcggtggccacacatgtggcggcggcggggcgagcgacctacccgccgccgccgtcgcgctcgctcgccgctgtaataaaatcctgcgcgcctcgcctgacacctagcttagctatgggctactatactactcgtaactgattgtaagagcaagtttaataatatagctaactagtagcttcaaatcttctataactaatgtaataaccaattcatataatagtacttgctatattattaatagctgatcccacctatcatacacatattacgttttggagtttgtgttacagctggctatagatctatagtccactgcttttctctatcttcttttatttctctaaaatatatttatagtgggttacagtctactactgtacatgctctaactagctgctgctgcttaggccctgtttagttaaaaaaaatcacgcggtcacctcgaatgtttagacacacatatggagtattaaatataaaaaaacaattatatagtttgtgtgtaaattacgagatgaatcttttaagcctaattatgccatgatttgacaatatggtgctacagtaaatatttgctaatgacggattatttagacttaataaattcgtctcgtagtttcttggtagaatctgtaatttgttttgttattagattacgtttaatactttaaatatgtctctgtatccaatgtgataatcaaacttaaaaaaatttcctcaactaaaccaggccttagccacgaagagttcgtggaatagtcacaattgcatccggtgattgcaatttcggttctaaatttgggaagacctcaccggcaaatcaatgcatcgaccaaaattttcggattctctcaatttctttttgttgaagttggtcaaagtttatttaactccggtcaaaatctgtcaaaatttcaaaaaaatggtacgagaactgccgacaatcaccgaaatttccatcgaaatcgaaagtgtaaacgttgattgtatctgttttagcagacacgtgttaaattgaatatatgagctttatttgattattggtggaataaagttatatttatggtataggtaaaagtggcgtcaactgtctaacctagtctattgttttaaatacagagagatatcacgttgtaaccatgataatatttactttcctattaagtttataactttatgatctctttccgaacacaacactttcgatttatttggttttcacgctcccttttttatttttatttttttctatggctacttccatttttttcaatagaaccgataagaaactactccctctgtcctataatataagggattttaacattttactctgtttgaccatttatcttattttaaaattttgtgtaaatataaaaaataaaaagttgtgtttaaaatactttggataataaagtaagtcaaaaataataataataatttcaaaaaaaattaaataaaatgaatggtcaaacagtacaatcaaaaaatcgaaataccttaccttacattttggacaaatggagtaactaactattcatagttggtcgaccgtcgtcaataacagcgatatctctgctaaaattgtaagtcgatgtagggtaaaatgacttacatcctgtagtagaggtagttgtatttagtagtatgttaatattagggaaggagcatatacaattagtgttccgaggattgggatcacctacagtatgaacagcgacggcaagttaactactgcatgcaattacatccattcattttggtgatgaatggaccaaatcatcagctacagtgtcaacgcaaaatactgaatattttttgctagtgatctacagtatccgggtgcatgtggaccgttagattcggatctaacaggtggtaatggactgcataagttgcagtcacagtaccaactgcacctgatccaaatccgtgttatgaggattaggatgtgttaaaattctcctgttattaaatattatattttaagtgtcgcgtcaaataatctcgcatggatatctcgtggatcaattctgctcgatgggaagatcatttcgcacaacggggcgatttttatgacaaattcatgtttttcttgcatggaattatgtttgaaattgggatacatgttctcgtgattaaaaaaaatcaaaatcaaacctgctttagttaacccatgttcccgaaggggagagatttgaacacgccgacctataaccatagacttagttgctcgttattgattaaactaaacgatggaaaatgacaggttttaaaatagatttgtactcgtgtatttagcatgcggctaattaatcctcgctggggatctccatttcgtggatagttcgattgatctgtcaaaggcgtaataaacgttgctaaattaatttcagttttggaagtgtgcctgatacattcctcacatagattggtagttcatgttttggtcagcatactggactaaagaaaaaatctcaccgaactcagtcctttttgaattgatttcaccaaacccatgaaatgatgaaattccacacgtgtactctgcgaagtaggatcacaaaaccttgtgcacgccaaattatgatgatccgattcttggtaaatagtcatcaggacatcaacacgactgggaaaaacacacctgttacctactccctcccagtaccatagtgtcaattgttgtactcaatccctgctcttctcaaagaacctcatggttatgatgttttccacctgtattaaaaaacaatctgaactattgatctcatttattaaagagttatgattaaagagttaagatttatttatatttttagtaaaaaaaagtgcggaaaggatataatatttatttagcagtgaatatttgtttttctttttttagcttttaatgtaatatgagcgatgccagcgcaatagatgatcatagatagatttagcaaaaaaaacataaaggataaagtaactctaccattgtattagaaaattacaaatttacccataataatattggtagtataatactaccaatagacaacatcatttcatttctagcagtaaacggctgtgattacatcagcttggcaacaactatagccgttttagcaccggtatgcttgtccaagcacactttagtaacatttgagatagattattcaccgaattattgttatgggttataattaaagcaaaggttctaactcctgttgcactccattcctttctccgagatccattgacacttaattaggtttcgactactgtggaaaagaatctagaagctaaagccctgtcaaagtttgatatgaacaaccatttaagtaggggacaatttcgtttttcccccactttcatctctaatattggttttacccctactttttagggttttcgtttttaccctcacttctttgaactgaaagaggcgtttacccctggattggatggaatttagtgggaccggatttatggaaggaaatatttgaattagtgatttacctttttacccctgtgaaatgttaacaatacagagactcttccttctctcgccgagaccgtaaagacccaggcagcgcaggcggcggcgagtgggcagcggcggcggcgatagaggaaactgggcgtcggccaggggccgctcctcccggcgcgtgtaggagagcggccggggagagggcgccgcggaggcctagcggcgcgcgctaggcagcggcggcggcggctaggggccgctcctccctgcggccggggagagggcggcggccaagcggcgcgctaagtggcggtggggtggaggggctaggcagcgacgttgaggtgctaggcggcggtgggaagaggggtaggcggcggggtggagggggctagtcgagcacggcgtcggcgcgacgcggcgtgccccgtcgagatccccccggtggacgaggtcggcgcacgcgaggacaagcccccccggcttgccgcccaccgcgcgcggcgacaatggcgactgctcggaggccaaggccgcgaccaagtgacggtgagcgttggcggcatccggatgtggcggcgtcggccgggcggcgaccaggcgacggcaggcgtcggctaggcggcggcggcatccggacttggcggcgtcggccgggcggcgaccaggcgacggcgggcgtcgggtaggtggcgacctgcaaggggcttggagatggtgccgagatgttgttgaaattttatcaaaaatttgttcaatttgtcaaaatgctgctgaaattttgtagaaattccatcaaattcagaatctgtgcaaattgttatgttaatgtgggtttatcaaaaatttgttcaatttgtcaaaatgctgctgaaattttgtagaaattccatcaaattcagaatctgtgcaaattgttatgttaacgtgggtcatttaaatatccttttgccaagaatttaaatttccaaagccatgcataaaatgggggcaaaaacacaactaatgaatagagatatgaaagggtataaatatcattttgacaagaatttaacaccgttaacttctccatccaaaacaggggcaaaaaaaaatttgttcggttcaaaaaagtgagggcaaaaacgaaaactctagaaagtaggggtagaatcaatattggatactaaagtgggggtataaacgaaattgccccaagtatatagctgtagctgggtaggaggaactaacaaatccatggcgacacatctgtactgtatgggctaataatctcttttgattaatacttgtgtgctaccgatcgattcgatgggcctctcttattggtgggtgagtacaatggcgatggaccattttgattgctcctgtagtagagtgtaccttcgagaaataaaaaaggcgtacacgtggccggtttataggacggccacgtcacatgtttatctacaccgctgtcctacattctcagtgactcattgtatgcagaaagctccagagcaattactgtgcacgactgtagggtcacctttttaagtacgtgtgtgatgtgtaatgatcaaataccaaacattagtatttaatttttctgattctcccatgcagattagtcttgggtgatcatgtgttaggttaggtagcagtgtacgattgttccagcctcacaggacttgaaaaatcaagtctgctactgctgtagtgctgttgcattccaattgatgaccttgaattctggcttaagaatcttaataccttcgagaactaggacccattgtacatggcttgtctaaagaatcgaaactgaagttgatgagccacatgatattaacaaacagtagacaagaacacatgatattttcttccacatgatgtgctaccatgtcaatctctactctttccttccaatttaattatgtcttcacaaaacagtggctagttccaaatcagttggtgggcgcaaatcctaatcaattggtcaataaattataacaattttgcctgaattcatcgcttgcctgtgacacttcttgcaaaagttgcgattgcttagaagtacaagaatcagtattgaataggtatagccgtcagttagccacggtcgtgtgttgggtcaggttggttcatcagcatgctcgtgaatactataatgaaaaacacacggtatgacattatctttgcacgtgttgttgtaagttgtaacaactactaccaactcctcatgagttgattacaattacaagcatccctctaaaaacgttatcatgtacgaattgttatcagttgccatcatatgactggaactttacgagtaaaaaaaaaaggaccttcagagccacgcttacgtaaaacataactggttggtctccggtataaaatatcccttcaggcaagttaattacttattccacctttggcgtctatcagttcttgaactgctagctagtgagttgaccaaacattcgaaggacacaaaccactgttcttgtagatattagagagcacacagaagacggaataatatatgtccaaagtgcttttaaatagtgaagctatgtcatctccatataattccccatgaaatattgatagggtatatgtagacatgaaggaagtgttcgtatggctggatcatcactagaattctgttatttgaccctgatacttactatgaggccatgctgatgaagaacatagcaatcttacttgctcttcttagaagcctcgtataggtagctcacgataactacagctgcagcaacagctaccccgacagcactctgtgcgagtacagcaccagttgaaagatcagatttcgtagatgcagggccgctgctccgtggagtgaagccaagttcagaaagcttcttgtgcgattcagcgtagtccttgaagaaggtgtcttcatcctgccatatgaacagaagaaatggttctgaatgtaaaacttatattatggagcaccgcaaggcatagtacgtcggcatgaaatattcacagttcttgtagcattttgaaaattattcacttccaattatatagcagtaaaagttgtaaaaatataatgctccgaaatcatatttgacaataaataaatctattaattgcattttcaactaacaaattcaaatactttatagtttgttaatggtcctatagtcctaaaaaatggatgaaagggcatataaaatgggggagttttaagtgcaaggaatagaaaaaaaatatatatataaaagatcctttttaccctggcataaagatccacatagcgtctaaatgaaggatcttccaacaatgccttgtcagttgggagcttcagaagcccctcagattcccccttcagtagctcactgcagttaaataaaatattacactgttatcttctaacctcaaatctagtgcccagaattagtacgtaaatgacccagttttgtattcaacttacagaaagtacgaattgtcaaacttcagaggctcctgagtccatgcgccttcaaatccagacctttcaggatgtgcccttcccttgaagtataaagcgagttgttaaaactgtgcttctcatgaagaatcaggattaccattacacaaattctacattaattagagcatttaccagagtgtgacccccagataaagctactatatctttgtctgataagcccatccggtaaaagatgtccctcaagtgcagtgcacctgctcatgaaacaaagataaaatgcagatatacccccataaaaatagatatatgattacgattatacatatcaaaacaggattctggcaccagttattaaaatactaaaataggaactggcaccttgcatcccagtaaatgtaagaaaggaaaacagacttcggcagaaggaataggaaaacagataaataacataaaacaaattaccagacatacaacagcacctgctggtatgacacctaaatgacaactataccagatatgcaggaatataagataaatgaaagacgaggctcccatctatgaagagatgtatgtgtgtttaagataatgtacatattacggtatgtattgcatgaactgggttgtctcaagcaacactaagtactaaatgccagaacatgagtactagcagacaagtacaggagaaatgcatgggactaaatgtgatacatgtagaatactaacacatattttgactcattgcttcaaacactaggagtcaggaagcatgattataatgacaaaagaaaaggtagaccagttcaaagaatagtttgtggcaattacctttcttagcatcaggaagacgcccttcacgggggcaaactgacgaatcctgattcaggtcaaaagaacttaataagtgtgaatcaataaaagatgcatccattcataaagaaatgttatttcacgtacacgtcttccaggaatgaactcaacagttggacccccagtaacttcaactgcaacaactccagcaagctgtaagaaaaatctagttaggatcttaaaaatttacacagtaatcgataagataaaaaagatcaaatgtgcgacaagaaaaaaaaaagatgtcacagtatcaaggcactcttataataagttggcagcacaagaaccaattcaagcaacgctaatttacctgataaaggtcagcatatgtgatcttagggctcttggctttaataggctctgttacagtaaaagacaattggagaagcataagtaatcattcgatttatttcatcactgaataaagtgacaatataacaataaactagataacgtggaacaggtaaataatgcaattgtacagagaagagtggtgagtactgcaacaccattgagaatagttgcaaaaatatgggagtttcttgttttttagttatttctcccaaaatatttgatccccgaattagagaaaaaaaagagttagtttgtagtccgatcaaggtaaaacccaaaacaatagaaaaagaaaagaattttgagaaactgacaagaaaactcaaattgatttcttaagaggcatcaatcatatagctgatgagtggtttaaagggaactagagccattctgacaatgggggaaaagtgaaagctactttcgtctaatcatctaggaacacattggggacaaacaatacataccgagaagatcaatagcaatctttagaccagcatttgaaccgtgagtgtactcttcctcgtatctaattgaaccatttgcaccaccagtttttgtgttcacgtcataagtgcccgcgtcatgccatctgcaagggagtgcacaggaactaagttttagtccaagagtaatccaagagcacgcagaatatcctccatgataaatgagaaaaactcatagtacattacagaagaacactgtatacaacatataagataaaaaaaatcacaattccatatataaagtactaattaattagcaaatacacgctgcactatctgtaatggtgcgttaaatggtaatgcttcttctgagtccattcgtaattacaatatacatagaacatttgcagcagtagtgcaaacatcccctttttttagataatgaaacatcacttatttgttccagtttgtaacactggtctctcatcagctccacaaatgtaacacgaagctcatggagtggaacacctactatagacagaaataagaaattcgtcttagcttcctgcgatattgccgttatgacggaatatggggagtgattaaaaatgctcgctctcccctgctaggttgctagtttcctgactagtatgagagaaccaacggatcaacagaaaaacgcgtgcactctacatgtgaactagcgaactaaacatcgtccgccgttcctcgttaattccaaaggcgcagtcacacaatcaaaaccaaatctgggagccatccaaagcaggcgcgcacgcactcaaggtgttcgtcgaattgcctcgcccaacagccacgccacggaccagcgcaggtacccgccgcaagcaactaaccaaacccaatcatacagtctcgcaatcgcaagcgacccatctcaccaccaccagcagtaactcatcccaccactcgaggcaagcagagccgagcgggctccaaatccaaacacacgagagctccctccctcgccaccgccgcgcgaatccatcacaaggattaggaactaggggagggttctaggaggagcaggagatggggggtaggccggtaggtacgtacgcgaggcggagcatgatgggcgcgcatcccttggaggagatgagggcgcggaggtggcggcgcgccctgtcgacctggcggaggtactcggcgtccacgaccggggcggccatggcgtggcgtcgcgtcgccggcgaggttggaagccctagagagatcggccgcggcggcggagcggagcggaggcgtgcggcgtcaagccaagcgtgtggtgtgactagtactcactggctactgtgcgtgtgggggagaagagataacgcggggaggcagcgattggttgctccgccccctcgagtcgtcgtctgctgttactgtagttttacacctactgccatgactgtattaaggcgtgtgggccctcattgtcaatttttttttccttcaccttctttatttacttttttgacacgtccccttttattttctctcaaatattattttctctttttgtttgtttgaaataaaaaaatattgttttgttttgttttgttttatgtcttacaccttttcttcttcactttttttagaattacacagtacaacatagacactcacaacacacacactcactcctataaacacacgctgacacgcacgcaaactctacccctatgatcatctttgaagattgggccagcaaattcatcatggagattaatgaagtcactacaggtgtctcgctgtcaacgggtacgtcaaacccaggacctaagatgccactgaggctctggtaaacattaggctacatatcctttcgcttttcttcttcacttttaacaccgaggtatatactctgaataagaggatctctttaaactgatttgatttttgttcgcagatcatttacttgaattgtatcgtcgattcatggttggatttaaatattccatgcaatacttattttggactcaagtgtgcaaaaccaaaaaaaaaatcttatcaatggcaatccaaattactactccctccgtattttaatatatgacgtcgttgactttttaaccaacgtttaaccattcgtcttattcaaattttttatgcaaatacaaaaatacttatgtcatgcttaaagaacatttgatgataaatcaaatcacaaataaaataaataataattacataaattttttgaataagacgaaagatcaaacgtttgttaaaaagttaacggtgtcatacattaaaatacggagggagtacagattactggaccgctgcaatccagcaactgccttacctgttcatcttccaaactgatttggtttgtgctcacaaaccattcatacagattcatagttaaatctaacttgatcatatttgaacgagcactaatttgctgcagttgcatggcatccctgtcagttccttccaaaattaggctcctctcgatcttgcaccaccgcgcgccaaatccgcgtgcgaccgcgcgccgttttgacagcggccatggccgtacggacggatgcccttcgttcccgcgcggccactccttccaccaccacctccttctttaggagtagcagcagcgccaccaccaagcctttggtttctttcacgcgcgctcgccaccgccctccttgctcgtccttccttccttgcatgacatgtccgcggccgcggtgctcgccgtcgtcgccgccgccgtcgcagcgctcgccgcggcggcgtcgggctacgagctgaccaagaacgggaccgtcatcacctacgaccgccggtcgctgatcatcgacggccaccgggagatcttcttctccggctccatccactacccgcggagcccgccggacacgtggcccgacctcatcagcaaggccaaggagggcggcctcaacgtcatcgagagctacgtcttctggaacggccatgagcccgagcagggcgtcgtcagtacctcatcccctcctcacacattgctcaatttgcatttgatttcatccatctaattaaatcgtgtctaaatgaatggctgtttaatttgtttctaagtacaattttgaagggaggtatgatttgatcaagttcttcaagctgatccaggagaaggagatgtacgccattgtcaggatcgggcccttcgtgcaggctgaatggaaccatgggtttgtttgtgtggcttcaccatctcattcagacatgcatgcgtgttcatctctgcattttgcaactcctgtttatatttttgcctcttcttcttcttgttgttgtttttcttcagaggtctgccatattggctccgggagatccctgacattatcttccggacgaacaatgagcctttcaaggtgacaaatctgacaacatcatgatccaattttcttacgcagtatgactgagacaactaattgctccagtttctgaaaacttgtttggtgattgtccgaaatactggccaggtgtatttgaaatgcaggaatgttctaatatgatgattatctccttttttttgaacttcatgtatgcagaagtacatgaagcagtttgtcactctcatagtgaacaagctcaaggaagcaaagctcttcgcatcacaaggaggccccatcattctggcacaggttcatctttcaaattgatccctttcttcctgtttcttagaatctggcaatgtgctaaggaataatgacattctgaatgctgatggtgattcttggttacatgatcataacagattgagaatgagtaccagcacctggaggtggcattcaaagaggctggcaccaagtacatcaactgggcagctaagatggccatcgcaaccaacactggtgtcccgtggatcatgtgcaagcagactaaagctcctggtgaagtggtaacttcattaagatcatacatacattttatagcaagtgcaagtattctcgatggaataaaaacttgatactagactgttcatggccaaagaacaaaagtattacttaatttgttcaaacttttggattgacagtacctttcatgttcaggatttaccacgatttagccattaaatctgaattttattttatccaacagatccctacctgcaatgggaggcactgtggagatacttggccgggtccagctgacaagaagaagcccctcttgtggactgaaaactggactgctcagtaagttactacttactactacttgagtaaaatccaattcatcttgttctgtaagatcattgtcaatgttgtcagtgagagaaaaaaatatatactacttatgcagacttcttagtgattaacatgttctattcctttctggggggtggttcttgatctctacaggtacagagttttcggtgatccaccgtcccaacgttctgcggaggacattgccttctccgtggcgcgcttcttctccgttggcggcacaatggcaaactactacatggtagtactgaacagcaacagtaacctgttcttgacaaagaagagagatgaaatttctgacagaactgacactggtggctttacttgtgtgaataatcaacagtaccatggaggaaccaactttggaaggaacggcgccgcgttcgtgatgccgagatactacgacgaggcccccctcgacgaattcggtatgcaaccctgaacaatccatccacagtacccaagaaatgtgtgtaagatgaagcaccatgagttgtgaagaattcagtttctaacacgcaatgagcaggcctgtacaaggagcctaaatggggccatctcagggacctgcaccacgctctccgtcactgcaagaaggccctcctctggggcaacccctccgttcagcccctcggcaaactctacgaggtaatgccatggcaatggcagtgacggcaagaggaagaagacgtaggacgccattgttgatgatgatgatgatgatgatgatgtgtttccatggtgcaatgcaatgcaggctcgggtgttcgagatgaaggagaagaacgtgtgcgtggcgttcctgtcgaaccacaacaccaaggaggacgggacggtgacgttcagggggcagaagtacttcgtggcgcggcggtcgatcagcatcctcgccgactgcaagacggtggtgttcagcacgcagcacgtcaactcgcagcacaaccagcgcaccttccacttcgccgaccagacggtgcaggacaacgtgtgggagatgtacagtgaggagaagatcccccgctacagcaagacctccatccgcacacagaggccactcgagcagtacaaccagaccaaggacaagaccgactacctctggtacaccaccaggtacgtaggtagtagtcgttgtctttctggatggctctgataccatattgagatttataatacggtcgtctgtttgtctcagcttccggctggagacggacgacctgccgtaccggaaggaggtcaagccggtgctggaggtgagcagccatggacacgccatcgtggcgtttgtcaatgacgctttcgtaggtaactaacttggatgctttcttccatcttcctcttgttgttccattgttgttgttgttgttgctgctgcttgattccatccaccgtgtgcgtttggatgaattgaaatattgcagggtgcgggcacgggacgaagatcaacaaggcgttcacgatggagaaggcgatggatctcaaagtgggcgtcaaccacgtcgccatcctctcctccacgctgggtctcatggtaataaagctttcatccacccaccattttgatgattgttgttcttcttaggatggagcttggtggtgatatgatcagggttttaaatcttccgctatatctgtttgataagagttccagctatttgctctcatgtacaatttagccactatagccctatttagcccaatatagttatcgctatagttgtctgagaaactaatcgctaaatgttttaacccgctatttaaaacattggatatgatgggcaacaacaaccatggtggttgttttttttttgttatttcaggacagtgggtcatacctggagcaccggatggccggggtgtacacggtgacgatccgggggctgaacacggggacgctggacctgacgacgaacgggtgggggcacgtggtggggctcgacggcgagcggcggcgggtgcactcggagcaagggatgggcgcggtggcgtggaagcccgggaaggacaaccagccgctgacgtggtaccggcggcggttcgacccgccgtcggggaccgacccggtggtgatcgacctcacccccatggggaagggcttcctcttcgtcaacggcgagggcctcggccgctactgggtctcctaccaccacgccctcggcaagccgtcgcagtacctctaccacgtcccgaggtcgctgctccgccccaagggcaacacgctcatgttcttcgaggaggaagggggcaagcccgacgccatcatgatcctgacggtgaagcgggacaacatctgcaccttcatgacggagaagaacccggcgcacgtccggtggtcgtgggagagcaaggacagccaacccaaggcggtggccggcgccggcgccggcgccggcggcctcaagccgacggcggtgctgtcgtgcccgaccaagaagaccatccagtccgtggtgttcgccagctacggcaacccgctcggcatctgcggcaactacaccgtcggcagctgccacgcgccgcgcaccaaggaggtggtcgagaaggcctgcatcggccggaagacctgctccctcgtcgtctccagcgaggtctacggcggcgacgtccactgccccggcaccaccggcacgctcgccgtccaggccaagtgctccaagaggcctcctcgttccgccgccaccgcgcaataagctagccagccgccacatctctcttcttgtctctcatcagattctcagatagttaaagctttgacctgctgctgctgccgccgctgctattgtactttgattggttccatccatcatcgatctcactcacttcactggggaattatttaggcaaacaatcaattcatgctcagctccttgtatgcaccatcgtccatggttttatatgtaggtaactgtagattgattaattgttgatgcaaataaatactagtccattccatttggtgaataacaacatataatcatcacaacatcatcctaagtcctatcctatagtgtgcaccatttgctctcacctctagttgctttgcaattaatataccatcattttgatccctgatggaaggtaaaacattccaaatttcagtatgctgtcctcggacagaaacccatacacatcttgcatgacaaatcttacaacaagctctccttggactctttacctatacacatctcacatgaatgacatatcttatgctgcatcagagaatcttacatgtgcttgccatcaccaatggccaatgcacataacctgcttgttgagaccattgcccatcgtattcctcacctcacccattcacaagttacaggttgcaacctcattcattcacatcaatggaccaaccacaccgcgaggtaaatcagagtgcaagataattgccattgaactgtcccaatagcttaaggcactttttcttttcggtttaaaattattataatctagattattgagttattataatctgtagtaaaataagtggttagttgtttctttactagattattagagcctagattattgggtttgcaagtctaaagagggagtggggtagcatggtgggtaatttttcacccaataatctagaaaaagctcacctaaatgagcttatcagattataataagctacttcaataagttgtctgtttttttcagcttactcccaataatctggattataataatcccaagctaaaagaaagagggcctaaatactttaattagtattattacggcacagagggcaataatcttgagaacaccaaaccatcaagtcataaaaaaaaaaggcgataaggatacaatcttaaaacaacaagggctggcccaaggtagaagtagagctagtttacgagcttcaacattgtgatttgtgcatatcaagatgatttcgcttcagcagatttctgctcaacaagcttgtcgatgagtgcagcggcatcttcaaccgttgcaattgactgcgcacttgactcttcgacgctgatgtggaactcctcctcgagacccatcacaatctcaacctgcaccaatccaacaattgagttttactacttgcaattgaacatgtaatcctttactcaaacaaaagaagatacaggcttctaccaacttataactgaattagactaaacatccaaacaaagcacatgtgcctgaacttcatagattaaacatcttgtttgatcattttcacacctgatgcaacagttatcacacttcatgtggcaacttgggaattccaatgcatctgatattctagtcttaaaagtactgaagagatttggaaaacaagacctacatgaagagcgagcctcaccaataatcactatggctgtaaagccattccacatctctaaaaggacatagatgccacttgtaaaacgagagatgctaccaaagcatccctcagatattattttgtgagccaaattgattacaaggatacaactattcaggcccccaaaatatatagaaaatttaggtaaggtgctgcttagttcaaaacaaccatatgcatgacatcactcaaaaaattatgggggagttaccgtgtccagtgaatcagcaccaagatctgagaacttggatgcaccagaaacttcagtgccctcaggaacagcgagttgcttcttaacaatgtcacaaaccttctccactgtctccttttttgcctattgagcggaaattaagaaggggttaggagacactctttagattgtagcaggaaaacacacgacaacacaaaatgcaaaagggaaatagcgcagtcaacagtgccatacatttaaaaacggagtatagggccgttttggattagtgccaaaacggtgccctaccaatattttggtagtttgaacagtgtatatggtggttttggtttgaagccaaaccattggcattgccaatgtctagtttgatattttctatactctactcaaggcttgttctaaattggtctccaaccaaatacaactttaccctaccaaaaaatcaatgatacaagaaacaaaaaggtccttctagaatggaaaggtgaattccaaacagctaaagcattaaaccctccctggtcataaaggaaagggttttggccccaggtgaaaattttcattcatccagaaataacacaactgctagcggatatctcatctctagcatagcaaagcagcgattgatggggaaaaaaaatcatgcatgacaagaaagtatggaactcacggcacagcaaacagcaaatctcataggcactggctgcaggcggagaaatgcatttcccttccttgcgctggtgaaagatatcgaattagtcttgactgcctgcaattcatggaacaagtttatttagacaacagaagtaatgcagaaaaaggaatagcatactatccacaggggaaaagaacatagcatagaaaacagtgttattgtcataattctactgttctagtatcacattagctgtatgtcttgaatttgtctcagtagccagtatggggtgttgaaatgagtaaagatgatttcgatgagaaataatctccaatgcatagttgcaaactcatcagagtttttttttctttactttctgtaagagattttattacaatttccctatataccatgaacataagaattttgcgaagccgtatgacaaaaatccaggctagtaagccggatggtgacggggcgaaacaaaaatcccttttcgtgccaagggaaaacaagatacgcccgttctttattaggtggtagtacaacatatcaatactagaaccaacttttttatggagaacccaaaggaccaatagttttgttaccatccaagtagaatcagtaaatcccagtaacgactaacgaattcatcatcactatgcggaaatctactcgtagcctaacaaggcggaaatttcatacggatacaagtatattgcagccttttcaacctacacaaaaggcagatctgctcggatctgctatacaaaatggatcagtaaacgcacacaaaagcacttgtgccacccacccgaaagcgaaaagggtaaaaaaaaaaagaaagaaaacttttcgccgttctcccatctgaatcgctccaccaaagggcacgaagctaaacccacagatcggccaaagaaacaggcccgagatcaagccgaaagctcaaaaaaaaaaaaagaacccccagcacccagaaaccagtcaggcacacggatcgatgaatcgatggatcgatgtacggcagaacaaggtggcgggtggggggatctgaccttgacgggggtggcgaaggagagggcggatccggcgagggaggaagccatggcggggggtagcacgaaggtggaaggcggcgagcacgaagcgcgtgacagcgactgggaggaggagagaggatggccggctcggcgaggccgcggggtatttatacagctggcgacgccgccgcatcgagtgtatcgacggtggggcccacgtggcggccagctgtccggcgcgggccgacctcgcggatgggccgttttgcttccggcccgaggtgttggtgggctgagtagtaacttgtcagtacgacggtccatttctcttctcttttccggagtgtaagatacgacggtccatttgtcttctccggcccatgctgatttaagggacacagaggaattccctcttcgaaaagaaaataataagataacctgatacgttcatccttcatcgtccttgttataaaagttaatcgatatagcggaacgataactagcattctcgatcgttttatccatcaatcacccaaaacgtgtcagatgataactataatgtagcgtaaatactcagagagataatagagacgaggccatggactcgtagcggttaaatgttagtatgttgattagggaggagcacctataatcagagctccgaagatgtaggctttcactaaacttcattataaatatcgtgtgtttctatatatcatcatcatctgacatgttttaagtaagcaatgattgaacccgatcaagaaaattagtcgtttcgttatatcggctactttgtataacaatcttagtattgtttttcactagtgtgcaatgcttttttttccattttgtttgtgatttttttttttgcgagctaagactgaagaggcatggatgatgttgatagatgtggctcatattgtcggacataccgttttcgtgaggcaggccaagaaaacatgcatgcactttcctgcaagtaatcaactgaagattctattacgcaacatccttcaagcttgctcaaaaagtaaggagctgtttggttgggctgttttcggcccgtatcagataccagcgtgaattgattcccttacatctgtttgttttagatggaccgtaatcggttagcccgcaaacgaatcccagcccaatacaaagttgattacgctccagatcgggcgttacgcgttaccgatacggaggcggagcggagcgaacatgacctagccttgagcgccgccaccttgcagcgcaccgtcgccggcgccgctccccctgcccggcgtgcgtcgtcgacaccgctgccccctgccccgacgccgctgcccctcccctcgcacgctccatgaccgcccggagattgcccgcctcgacaaggccgacaacccactgctctgctaccttcagtccctcctccatctccctcgagttccacatccctgacgactggatctgcgagaaggacaaggctgttgagcatcaagaaggcatggcaaagatcttgaggcacacgaagaaggcaccagccaccaaggaggttcttctgtcgtttccgccgtcgccggtgagaaccctcccctcactgataccaccactctttatgatgatatacttgtgatgctgatgattgatgatctttttcttttcattaacaaatcatgaagtagtttatactagtgaatcatttgtattcttgattggttgcatgtattcctgcctcagttctgtttgctttataagtttacatgagttttgtagaatctgtttttcccgattgcaggaaaaatctggaatagtagttgatggttctttcatatttgttttcgagtgtaggtaagttccgaaattttgtcggaccaactcattttactctctagattttgagaattttgattttcattactgccaggtgatatattattttgcagagtgtgagattggaaaaaaaaggtttgtcgtgcattgccttttcgacagaattgtcatcttgcacatatataatcaatttacttatgtttcgcagcatggactgttccaaaccaatctactcgctgaatctgagtctactaatctagtagtttcactcatgtcaattgttcatccatatatttcctcagtactttatttagacagatcacaatgtatcctcttgttgtttagttcattgaacttctgaagttctcactcccagcatgggtcttatatttactcttgagtattcggaagctacatctacaagatcttgttcagagatcttccaggatgatgctaggctgatattagatacaaattcaagaaactagctgctttcaaatatttgcatgtcaaaatggatccgatatttactcttgagtattccgaaccaaacaccaccctagcttgagatcgttggatcgagattgaactgttggagttccactgctctcatcgtgatccttccacaaggattcaagtgccaattattgcttacctcatgactgctgcgaaaattagtctcgcggtgcagctatttacttgttggttaactgcctatatatctggtatgtgcataactgtcccatgggcaatttatttctttacttgttatattccaaaaactttgttagcaaatattttttttgcagctgctgttgacattgttcaacaaatatttgctctactttctgattagcatttaattttctcttgtccaggaagttgacttcagatggccctgctttccattttcttttaaaattcactttgcagaagcaaatggagggtaaatttgcaggtgagctaacttatatttcatgaaaagtgtatgattggaaaccatagaaactattccacttgttaccaattgcataagtggaacacatatttttgggtttcgtgctctcctttaaactcacagtggcatcttttatttcttttaatgtagaagtaacattataaattggattccttgcatctttgtttgagcatgagaacatatttacatgcatgtgtgcttcttaactttggagtcaatgccctttttagaatgaagcgaggacctgcccgattattcactttcagtagtttctggatgcatgttgtccaattatatcacttgaattctaaagccacatgaacttttcttgaattattcctatacatgccctagctagagtgctatcaggtattaaaaaatacacatttcccttcttttctttattttgggccaggaagcatgtcacaaaatttaggagtttgccctatatgagagctactattgcatatcttaatcactgcatttttagattgttgttggatcacttttgaagactgtttgtgctagactcctttaaggtgtttttagacttttttttaaattattgcatataactgttcggtcactaatttctgaattatttcattattaccacagatgaagcaatgaagaataaccgatgtattagctcagtcacaatatttggagcttgttcattgttatatgaccactatccataatttatacttgagattattaaactgatgttcacattttcaagactgtatacacttcccaatgtgtgatagtatcaaacagttgcatgttataaaattgtgaatatttttacatagctttgatgtgctacacgtgtttgagaacactgctgctatgtagcttgtaatgtgccttagctttgagctgcgtcacgttctaagcgctccctgcttcggaagcagccgttacctgttaccatgttccatccaaacaatgtaatgcaaacatgagacgttacagcggccaaccaaacaaaacctgtaaagtgatacattttcttcccttaccgctgtagctgatcccatttacgtttgcatttcctgacctcaaccaaacaccacctaagatgtgactggtaagcaggcggcaggcggccaacaaacttcgaagaaattagggtgtgtttagtttcacgtcaaaattaaaagtttgactaaaattgaaagtttgaaggaaaaaagttgaaagtttatgtgtagaaaatttatgatgtgattaaaaaattgaaagtttgaagaaaaagtttgaaactaaataaaggcttaaggacaatacgggacactaatttcagctcagatctgtagcatatactcctaggcctggtttagttgccaaccttttctttaaactttcgacttttctatcacattaaaaattttctacatatacaaacttttaacttttccgtcacatcgttccaatttcaattaaacttttaattttgacgtgaactaaacacacctgtagaatcgatcagatttagcaatgcaccgacggaaagtctcaaaccttaat

SEQ ID NO: 66940 - DNA, 4888 bp, Oryza sativa
taactaaccaaccacgtatgtatatgtgaatctctatgcatccacatacttaatggggctattgggtgcaaatgtatgggcggatccagaaagaactaataggaggggctgaacaaactatacaaaactatagccccctcctctaatggatgtatgacaaaaaaaaattagtgggagcttaatgggggctcccatggttgcaacgtcggtagttggggctagagaccctgacacccccatggcagatccgccaaatctgttctgtacaccattaatgggattgctaaaattatcacaccacatttttctctcctatacgtatgtatggttctatctctcagatctcttttaatcagataataaatcacttctaatcctgattctctttagtgtattacaaaaattacaatataaatttgaatcttacaatgtaattacagtgtaagttttgaaatttatggtgtaattacaatgtaagtgtagataatttgcaatgcaaaaacgatgctattttttggtgaaaaatatggtgccaccaatatagctactccccatcattaattaaacataagtgagttaaatatgtcgactttatttctctatgcatacactgcattttgagtaaccttactctttgtataatgtgtccattttgagacatatataataagagcatctgatttgcagttagcgaggctgtcatattaagcactttatcatatcaggaggcgtgggaaatggtaatttctatactatatctggacacattttgattggtgttatgatcatactactacatgtttaggcattcaaataaccctctgagcttgacagaagttgcctggtgcaagataggctattcctcaaataataacaacacttaagtagtatgagtctgtgagattctgatgaaactacactaggcttgcttgttagttactcaggtcatatataaggagaaccatttccatagtctattatacactagaaactattggattgtgtttcttcagtatcttgtagataacttgatttgttttctgtatgcagtcgtattttggggcaaatgtattacatccgcgtaccatcatacctgtgatgaaatacaatatcccaattgttataagaaatatgttcaatatttctgcccctggtaccatgatctgccagcagcctgcgaatgaaagtggtgatttggaggcttgcgtcaaagcatttgcaactatagataaattgtctcttgttaacgttgaagggtaagtttttctaagttagcacatttcttattttgatccttcaatatgtgaaccatatataatctgaattcagtcaccaggctactttgatgatctttagcaagttccaaagaattgtgtcttctactctcaaataattttctagtgcctggaatcttgattttacacactttgctgacctttcaaggttaacattaatataatagaagcataaataagcgcatttaggatttactagtgattgtattgccataatagctcattaatctttggtgcagaactggaatggctggtgttcctggtactgcaagtgccatatttggtgctgtgaaggatgttggagctaatgttatcatgatatcgcaggtagatagtgttttgcatctctagcatggcatatgattgatgaagcttcatcctaacttcaaagcatgtgcaggctagtagtgaacactccgtatgctttgctgtaccagaaaaggaagttgctgcagtttctgcagctttgcatgtcaggttccgtgaagcattatctgcaggcaggctatctaaggtgtgtttatgatattttttttcactcttcatgtttattaaaatgttctatttccattgtgaactatccatttccaagatatggattgcatgataatcaaatgatggttataatagttctcgatgggtatctgattttcttttgaatatgagaaaaatactttgagagaactcagcggttttgattgacatagatgtgttattgcctaaacaaattctacatatgttacaaacttagcactctagtgggctgtcagttgtgtagaatactctctgttctacactataaatatgtaatgatgatattatgccctcgaatttggtggtgaagaaaaaaattacacttatgcgaagccaggggcagcatcagcctggggccaccatgtcaaggttgggctgcgtatgagtcatgctagagaagggcgtgtatcattacttctttgtttctttggaaagaatgagccaatatcctttagttatatctttggctaacaactgaatctaataacatactaggataacaagccttctaatatgttgaacaagatgagaagcctgatctaacccctgtagtgtgtaactgtatgctgctccagctgctgtcccacctgtggtagtctggtagacactcttgtgcgccatacgagtggctggcttgctgcagtgctggtacttaagcccaaccagaaaggtggtcttcgtgtaaacttccatgatataaagcattaaatccttaaaagcaacatcctgaggaaaaattagagctacaggctggaaatcgacctaagaggcttctaatatgaccatatcaaaccttattgtactaaaatgtaccgaagctggttggaactaactcgattgagggatgtatatgttctgtctgcttccttcatggttagacgtttagtgaatgctgcacaatctctccatgatgtggatatgatattgatctgcctactttattatttagatacgaatttatattttcaggtcgaagtcattcataattgtagcatccttgctgctgtcggcctgaagatggcaagtactcctggggtcagtgcaaccctttttgatgcacttgcaaaggtaatcccacattttaagttttgtatgccaaccatacaagaggtcttttcaagggaccagactaatttacttaatgatggacccaggcaaatattaatgtaagggcaatagctcaaggttgtagtgagtacaacatcactgttgtattgaagcaagaggactgcgtaagggctcttagagctgctcactcaaggttcttcctctccaaaaccacacttgctgtcggaattattggacctgggttgattggtcgtactctccttaaccagctgaaggatcaggtatatcatgctccatatccctttttgttatcataatgcacaaagaatagtaaactatatttctattgtggaacactggaacctcactaggactaagaacataagaagatgcacttacacttccattatcatgatatctatctaggtcactcttaccataaggctaattgcctaatttagaccacttctattagtattctagatttctagtgttacgttagtctgctctatatttttcaccatgtttgaagactctgggagcagccactcaccaactctcaagtagtggctatctgatttctgataaatcagtagatgagacacatccatcacatcttctggctggttggccactatccttcccatctccattctccactatccagctcctgcactgtcagttgccacattcagttattggtgccactcccaccagatggatcaatctagatatgcaggattgtatgcagatctgttcttggctcaatttactcctatacctgttattcctaggtgaccttagttccactgtagcaagtttctttgatcagggaatgaatggcatgtaccctccacagaaactcacaggcaatgtaacttctagttctagctctagagtacttctgtcacatctgatcttctggttgtaagttgttttctgcgggttcaatttcagttggatagaaatacatgagcaaaatataacaaaggaaacatttccatattctattgttcttagttgcctgttaatatattagatttgcgtatgatctctaaaaagggtgtgcggttgattgggttaatttatcttttcacagaaaagcaatatgtaaggtgctattttctctttgactgggttttcctattgcactttacacttatacttaattactctgcaggctgcagttcttaaggaaaatatgaacattgatctgcgtgtcatgggaatcactggttcgaggacaatggttttgagtgatacgtatgttaaatgaatctccacttccctcttttctttccaaattaaatctctggtgcagaacaccacaatagatttattagctcggtagctattcttgtttcgttcaaaacttccatgcttcaaaaagtgggcaaactctatttttggcccgcgaactttcatcaaagttcatttttcaccctgaacaatattaagtcttagggtagaatttgtccagttttgaaagtttaggggtgaaaattaactcgttttatagtttacggtgaaaattgaacttcaacagaagttcaagggttaaaaacggactttaccccccaaaaaaaaaattatgtacatgaactctattggtcaaattgtcatgtctgatgatagcatatgcaaatttgtgtcaaacaattgctttactttctattggttgccctaaaaacctgaccagacagaatattgcagaagggttgtagtcaagattgtttgcggatgttgctgtatgataagcattagtattaagtatttacaaaagctgaatgtttctttgtcctaccaaaaagttgattggtttttcatgatttctgactgatgttttctatttatatgctaatctacatgttcttatctgtatatttcttatgttctttctgtagaggaatagatttggcccattggaaagagcagctacaaactgaagcagaaccagccaaccttgacaagtttgttgatcatttgtccga

SEQ ID NO: 66941 - DNA, 69850 bp, Oryza sativa
tattagatcagtgtatgttgcaattgttttgttggagcttgtcgacttggtagtttagaaacttagttagtacctaaatggggcattttgctgctgcttccttcaccctcttgcaaattgtagatattaggacttcttgcatatgccagcctccctgtaaaatttatataaatcattagagcatatgttagaatcaacaaacataattgtagttacctttatttattcttagagcaaaatttattcaaatatattttctgacctggagccatgttgatgtttcttttgcttccttcaatctgcattgcatcatttttgctctcctctgattgttgtctaattgtttctccttcttgtattgcttcacgacctgtgccatgggagaaatgaagtatatgaggtactgatttgttaaataggtatgtcttttgagaatcatttgtattttttagcatgtattgagctttagcagtatatgttcagtgtggcatttgcatgttttatgtcaaacatgaatatatttttcaaatacattgtggttgcaccaaaattacaatacacatacatgttacacttcaattataccaaaattatagtgtacttacatgacaaataaactgaatttacaaatctaattttagtcataaattgttgtaattttagttataaactgaaccacatttgtagtgcacttacttgtcatataaactgtttttacaattgtaattttagttataaatcactgtaagttttatactttttggatttattacatgttgtatcaactgaactttcaaatgtaattttagatataaagcactgtaattttttgccataatatttaggtcaaattatgattgttagcctagaatggttttgcatatatttttaaaatttctgtatttaggcacatatgtgattgtatttctgtgtgtttggtattgagtggcaagtgaaaggagtggtatatatgtgattattatatttggctatgtagttgaagtttttgaaattgtgagatgttttgtacttgaataagtagtgtagtgtttcaataccttttttctccatggatccaaccttgactggttcagtaaatttcattcctgcaaaattcatggaataaattagtatacatgtccactgaaaccatcttactagaatgttaagtattacatatttatttacatagcttattcacaaaaattacagtgaagttacacgcaatataaattgtttttacaactgtaatttctaattttaattttaatttcaaatcactgtaatttctacttccagtgtttgattttgcatatgtatggcagcatggatagtgctatttaagattgggtgctatgttaatgtgttttgagtgtttaacccttttctagttttgataacaatggtgtgaaagtagtagtgtttaacccttaatgtattttttaatattttgcatccttcaccctgcagctgaacattttcctgtgattttttttcaaagttgtactatgatattttttttaaatttctacatgatgttcagatcaacatagtatgtgatttttttaaaagaaaatacctaattgtagtttttccttgtttgtctccccagattccttgttctacctgatgctaattttgacaggatctgcatatgacttcatttctgcaaaattttattgaatgtattagaatacagcaatacatcatagagtaatacattataacttacacaacaaatgtataaaaattacagtacacttacatacacaatgacctgaatttacaaatgtaattttagttatgtaggacagtaatttttgtattccatgtgtatcatctagtcatgttgatctaatgaatctatcctgatctagagatatagatttgatgtgcataaatgattctcaatgatgatgtaactgttgcataatgtatatatacttgtagttgtattagttaaataagtactaaaatattgtggatcgggctctgcatgtactaagattgtttatatggcagatcgagtcatcacacatttccaagatattgagtaccctagattgtttactatgatgttcttggagtgatattcttttaatcctagatttgatttgaatggattattggaaggtactgctcctatataattcctgaatgttctatataagagtattaaatgtgatctatggtctatattctaagccaaatatatagagaactatgaatctattttgctagttccaaattggaaatcactaaaattttatccagccatttgtcttaaatgagtgaatacctagtattgaggagtgaaatatgcaggtgttctgtatgacagattactaatcaagcatcattttatcaattacacttcaataatgcaaaaaattatgttacccaaatttacagtgcaattgtactaaaattacagtgcacttacatgccatatgtactgtttttacaaatgtaattttagtgcaaatgcaatgtaaatttctacttttgagcatatatgaatgtgaaattggtttggtgggttgttttttagtttctgaacttgtttttcattatttatcccttgtgcatatatttgtttttcatatggattgtgccctataccaattggtttgtaactgaagtttactgtggaacatgtcctaattcatgcttgtgttctcttaattttagtttggttctgactccatggatctcaactatcctatccagcatcaagaccaaacccagcagccatcatgcaggttagttgtctctaacccatatcaccatactactcactattgtggttttattttcttttttgtgctgcccaactgatacatatatgttttggaatatatgatgtatttggtgctggaactcctgagttcatgtttgaatagatgtattcaatttttaggtagtaaacaacagaagttgttctgtatggtctacttgtttgattgattgataattttacagtgcatttgtactaaacttacagtgcacttacatgtcatatatactgtttttacaaatgtaattttagtgcaaatgcactgtaagttttactttcagtgtatgaactgtgccctgtattttgttcaaaacactccttatgcatatgggatgggggcacgtatggtgctatgatctaagatttgtagacaattttgaggatgagcacaggtttatggaacatacctaatttggatttcttccttatttcctgtttctcccctgtgatttcactttgatttgaagaattttgctttggttcaaccttttttctcttctttctctcctactcgttctccatggtgtgcgtggtgttgcttttttggatctggtgtgttaatttggatttgtgtttgtcctttttcttttagctttcttggcagccaagttgatgcttttggacagggttgactttacttctttgggcctctcagatatgttctttgtttgatttatttttctaatttgttgtttgggccagattgcagcccatgttttatctgtttttttagtgtgttggcccagtcatttttggccttttttggctgtctgttcggtttttttttaactctattggatgaaaatctaagggcaaggaaaaatctggatgatttttgagaaaaaatcacccgacagatgcataggtggttccatctggaatcatttttcttcccgagttgctttgccgttgtgtactttcagcggctttggttcgtgttcctcgctgaaacgatagacaaaaatcactcacaaagtaaagcgcccaacagaaatcactcaggattgcaagagattggaggggagaatgaaatctccattttcgttttcgatggagatgattcctccaatatttattctctgacatgtaccaagtaccatggcctgtaaagaagggagaagatgaaaggaaaaggctgcgggtgattaggaccaaaaccatagcccatgtcagccgcatccgacccaaagggcctaaatttccgataggccgagaccatagcccatgtttctctctagaaggaagacggcccattacatctaggcccaagcgaggcgtgacaaagaaggacccgaactgcggaactgctgctacacatcaacggatcaacccttgtccttcactcgcgaagtcccctcgaactcccaggcgcgcaaaaagtcccctggggaacttccagcggcgcacccaccgccagcagcagcagcttcgccgcccgccgacgccgtagcggagggcaagccatgaagttcaaggccttcttcaccgacgacggcatcgctctcctcgacaagcgtaaggccctcggggggcacgacttttcctccgccgatcccaatctctctctctctaccccgcaattcgtcgagcacctcacgcgcgtcgcgccgtcttgtctgcccccgcagggttcctgccggcgatggacaaggtgggccgcctgtgccacgtctacctcacgcccacgcacgccatgctcctccacaacctcctcggacccacggggacggggcccgacggcggagggccgcagtgcgtcgcgcagttcgccaaggacctcctcttccgggagtacagcgtgtcgtcgcggaacggcaaccgcgtggccttcgccgtcgacgtcgcgctgctccaccgcgccctccgcagcgcgctcgccgtccacgcccagtcgccggccgccggggacgcctcagccgcgatacaggtgaagctcgtcaacaagctgccggccgggtcccggtctgcctcgccgttcctcactttcgagaccaagggagcccgctctgctgtcgtgcaggacgtgcccatctcgcggcccctttcacgctccgacgtcgagcggctgcaggctgccctcgactccgcccaagagctccctcaggtgcgatgcattttactgaaatgctcgtgatatttcattagattatagatttcctcggagtcggatttggacgcccaaatgtggaactagttaatcaaagttgaataggttttcactgaacaatctctgctgggattattttggctttagatggaggcatcaaatgtacatcccttagtgtaggcttttctcattcgaaagcttgaactatggaattagtgatgagttggattcaacttgggctgccttatcaaattgaaacttgaaacctcacgtgacatactcatagttcactatagcaaaagcactagtccagtttatttcagtcataagaaactaactgcattatttgtttgtaccttgagaaaatttataaatagccaacaagactcaggatcaccgatcacaggcggtacacactaagttagtattacagaagcaaaatgtagaatagcaagtatactagtctggaactgccattcatgttttattttcgtcctgaaatcttagtcatgcttctttataataccatgtcaaggagactaaattagacaccccaactaagttttcctggggaattgtgtattcactcagggaggtttatgttgatttaatataaacgtcaagaatcacagacaactaaaagtatcttctatttcgatgattctaatctctaaatttattcttctttgcaaaaattgtagccctaaatcctaatggatgttgtcatgttgatacttggtttctgttctttctgtagactctagttcaggttccagatctgccacagttgcagagtttggtcgatcgtctaaaaaatgtcggcgatcttctgacagtagctgttactcaatatggtgacttacatctacacgttgccacttctcttgttactgttggttcagaattcaggaaacttcgtatccttggtgttcgtggtaagctgctctacattccaaagcaagtgtcaataatgtctttttagcagtgctgtcattatgttgaaattacctttttgttttaacgtgaatgaaattacttatcttatccatatttttatatgaattttctgcatttcagcaaccgcacctgttggtgatcaaaatttgagtgcttccactcgtaccaatatggcaattgagagaggggaggcgctctcagtggtattactcctaagagcttcacgttttttttttttaccatttttcatgcagctgttcacaagtttctgtctttctgtgtttttacagcaagtgaatatgaagcacctagctaaaagtctacaatgtcatttggctaagcccgactgtaccttctatggtgtgctttccagctatttctgtaatcttactgacaagttccaaatttgtgttggagagtcactttttgcttaaatactgtcctttttaatggcacaggtatttctcctggtggtgcttgcttgactgtgatattccagtatttcattccaggaactagactgacggacaagtccattagcttctactgcaggcttccagtccttgaccctggcagttaaacatattacagcgtggtaattactgacttgcttctgatatcatctaaggatatgcaatactattagcttagctactgtacctttctgttcaatatcttactatcttatgtgttatgacttgcttgtggactcaatatatgttggctcagcaataattcgctattttggaacatagcatttttattatcgatacctgcaaaactgaactgcttccactcattgttgttgtgatatcacttcgttccaagttgagccagtctcctatgcatgcgatctatttcctaactactatttacaatcccactgcttcaaacatccagatctcagtatcatagaaaaataaaaggaaaccagatttacggtaaatgataattacggaattatgttttttattaaccgagtacaaaattttcagtacttcccttttgagtgtatgaagatagtaatcatttttggagcaaatgaaacatttttttatcaatgattgcatggggcaaatgtatactcttgagccccatgtccttggtctggcataagagggaccaaaatcactggaatcattaatcttcctgtacacgcgtcctgtactagccacctcgacgctcttacatgtatggaacgtataatcctacgaacagtttttttatgcagtactaacagtaatttaacaaaaaaaagtgttggtttttacaaaatacaaataaaacttgaaatattccatgtttccatgccaaatgtttgtttgaaacaagtttatctatctaaacgttacaactttggtactgatctttcggcaagcgagcagaatcaatgtgatggtgtagtgcgtattttgaacggtgctttcgcctttagggccccaaccatttctttcattgttaatattgcggtactgccattctagaggaaggattttttttactgaatgtagaactgtaaattatctgtaaaagaagagacaggtaaattctgaaccaccagctatgtgtcaactctgcatctctgatgccatttttcacacattacatgtctgtatatacctgtattccgatcagcttgagcttcagtttcaaaacgtataaataccagtttctctgatcttagatacatattccaccaagaaccggcaagaaatgggcctatatctgctaacagtttatattctagctttcgttaggaccaagctctggatccacaacgtagcctctgagggagggtgtcttgccaagaggttccttcttttgaagccttttccttgcaatgtacccccgaatccatggcagtgcatcctcatttaccttgatcatgaggaagaacagaatgcggtagatgaagatcatgctgaaaattactgagagatcaatccactttgaccggtgcacgttgatctggaatatgtacttcagaatgaagtctccagggatcttcggttggtctgggtactggttgtcaaatacgagaccatccatgtcattctggcattgcccctgtcaggttgataaaagtttggtgtcaaattttcttcaagataaaaatttagtgtgtttcccctgtcaaagagtgggatttaatttacctgcagcgcccagtaatggaagctgatgtactgcatggggtatctccaaacaggcttcggaatgtcgtaaggaagtctaaagtatccagagacaagcataaatattccctaggaaaaaaaaagtaagacgagttatgtttactgagttatgaagttctgaaattttaattgaaagaaaaagcgtttcctttgtaaggcagcaatgtaatgcggccactaaaggataggatcagcagttagaagaacaaaacataggaataagatcttgaacgacctcaagctgtctttaaactgggatgggagtagtgtacagtaatgctgggtagcgtacggtaaagttgtgctgtccagcatttatttctttgtcaagcttgctggtttatttgactcatatcagattatattagaacctttcaaagttttgtaagctctcattcatgaacatatcttaaatgccacatgatcctctgggacaatgccatggaaaaaaaaacagacttaagaactgtaccagacgggaacaaccgagttcggtgtttcgatccaatctttctatagcactatatttaatacatttggtcctaattaatatgattgttaacatgatagtactttaaagatagacctaaatgaacatccattacttcaacaataaaccaagagatataggttaagaaagcttatgaaagaagcataaagatgtacctgaatcccagctcctataatgatccccatgaggaaattagggatgacacttgcaatggccatcatcaagctctcaaccacagtgacgctggcgtagaggttgagaacgaagaagatgtagtgggagaaacctgggtgaaggcgcaccatgaagtagcatatggtccctgacaagaagcatatcaggaccaagaatggcagcgccgagattgtgttgctgatgacaaaagccgcgacaccgtaatgcccattcagccgctccctttggaaaacctgtcaatgaacaagggaaaactgagcaaatttggcatggtaattctagcatccagatgaaaccgtttgcttggaattcaccttcatttcttcaacaaatgaagggaaccctccaattgacatgaaagtgacgaatccgaagacgaatgcggtacaggcagccctagcctgttcagagtgtaaaccaaaacacatcagaaccagccaattaatggattcatgacagattactcatctgactatgttttttttaatataaacttctattacagcattccagtcataagaatcgcttatcagttccttcatttcttaccaggatggatgtgtacttggtgccgacgtcatagtagatggtgccaatgcagacggtcacgaggagatagatgaggagcctcagccagtaatacccgaagtcccttgacatgttgatgaaggagcgcttggtcagtgtgcctgcctgcatcaagaagctagcctggcttcctcctgaatccagcacagttcctttctgcaacgaataacatgggtgtgttagtgttcatcctgttattgcctgtcctggatgcagtcttaactatacgtgggggcgcaagaaaaaaaaaacagagaggaaaaagagtgatatcaatacgcgctgctgtattagggtcgccaagaacacgtaccagtcgtgagatgtcattaactctctcccttgcagcgtagtagtactgggacctgctgtaggatgcaaccaactttctgatggcttcagatgtggtcatcctgtccagaggatcgtccgacctctcgatcttcaatgagaatgcccaaaaattagatcattttaagtgcatcgtgacacgaacaagtttgagcagatcagctatgaacattggtgtgtcttgatctcttcttacccttgccttcatggaacctttcagggtggccttcaccttgtcgaagtcggagttgacgcatctcaggaaatgatccgatggatttctcagtggcgggcacgggaagccggtctgggcgaagaactgcaagcacgagcacaagatggtcacgttagaaaccatggcgaatgatagtggtgacagatatatatatatactggttgctttctgaatctggtgactggtgagatgacttacctcgcatgcctgcgatgcttggccgaagtagacggttttgccgctggagaggaggaagagcatgtcgaagagctcgaacacctcgctgctgggctggtggatggaggcgatcaccgtcctcccgtccctggccagcccccggagcgtctgcgtcacgaagaacgccgacgagctgcgcgcatgatcaagccggcatcacatcgccgcggtcagtccagcgcacaccatcagtcagctcagctgtgactggatgcagggaggacgcgtacctgtcgaggccgctggtgggctcgtcgaggaagaggaggcgggggcgcatgaggagctcgagggcgatgctgacgcggcgcttctcgccgccgctgacgccgcggaggtgccagttgccgatgacggtgtcggcgcagtcctggaggcccatctccacgatggtgccctccaccagggcgcgcttgtcctcccggggcatcttgtccggcagccgcagcatcgccgagtacccgatcgtctcccgcaccgtcagcgtcccgatcaagttgtcgtcctgcgtcacgtacgcctaaaaaaaaaccctccgtaaacctcgtgtttcaccgctaaatgcacttgctttgctatagataaatgaaaatacacttatcatatgtcatagataaatattttttttcgaataggttctcgcttgtttgcagggccggccctgacttttcagtggcccggtacggaaaaaaaatgaaggcccccattcaccataaaaatacaagataatatttaaaaactcattgtcattaatgaatttcacactaatcagtttaaaatacaatcaagaagtcacgatatgctcgatcgccgatcggttttctatctttcctctaaccctatcagatctgataccatagtatacattttttggaggcccctaatttttagaggcccagtgcagtcgcaccgtccgcactgtctcagggccggccctgcttgtttggttattggtattcactttttggaaactaaatattggagtatatatattagaaaatatctgaggacaatttgtaataataactttaaagagcagtgatgagatggcaccgctagtagagtcatttaaatgagtatataatacgtaaatgtgacggtacaaaacggcgccgtagttttggtacatgtaataatggtgtgtacactgtaaattaaaagacccgcctgaaaagaaaaacgtagattcagaaatgagctgatacttttttttcatgctgggcgagcttggttacagctttgagcctacaggtttggtcagttattaaggcattgaaatttgaaaacgaccagcaaattaaacggcccaagttgtctcgctctatgaggataaaccatcagatttgtaatactattttttttgtatgcagaaaagtccccctccttccttccattactcctgtagtataatcgttggtaggacaaaccacgcggtcactgcagctgaatggttcatgtcaccataaattccccacaggttcgatcacgaacaaatccaagtatatccaactgtctgtatttatgctatgtaggtcgccgcaccacaacctctaaatctcgtctttcgaaactactcccactagttctccatctcttataaaaaaaagagaaaagagaaaaaaaaatctcgcgtactacgccccaaatgaatggaatcagagatcgaagagagaaaacagatcgaattgattgctgcacctaacaagcagcagtacacgttatgtgcacttatgcttcgttggggggttatatttacagcctttcgccatcggggacatggcagatgacaaaagtaattaagccctgcaacccgctggatcaacgagcggacgtaggtacgcgttgcgtttgtccagtatgttttgatggcgacgataattagccggtcgatcggaccgtggtcgcctactcgtaaaacgccacttgatgggagtgtgactgtgtgtttatgcacatggcgccatcaacacaggctagggctagctagttcgttagttagcttgactattaatgctgaaacgggatggatacttattatggatgatgactgaacttatctagctaaggagacagtaaagtatagcaagggctgtggtacgagacaattttgattcctagaaatggagattttgttggataaaacaagtgaagcaagaagctaggtatggagtactacatgagtatatgatttttgtatgcgtaccgcggcgccgaaggagagcttggccttgcggccgttgaggaggacgttgccggagaggaaggcgttggcggcgaggcggccggcgagggcgtcgaggagggtggacttgccggagccggagggccccatgagggcggtgagcgagcccggctcggcgtagccggtgagctcgtcgagcacggtctgcgtcttgccggggccgagcgccacggtgaccgagaggtccttccacgtcagcctcgccgacacgtcgccgatgagcgccgccgccgccccgggcatcgccttgctgtcccgccacagcgtctcgctcagcgggctcagccccaccaccatcccgccgcccgccgacgacgcgttcgcctgcagctccaccatggcctgcccggccgccgtcctcctcgtgtcccctcctcctcctcctcccgctctcatggcgcgctctagctcgcagcgaccgatcagctagctagctgtgagcgacgacgcgatggcaagcgaacacgaacacgagagagagagagagagagagagagagagagatgcaatggctgttttgctagaggggagaggcagcaagggaggagttataaaggtgaaaagcatgcaagcataataaagaagggaagttaatggatggatggagcaatcagagagagcaaccatgggagggccactacttaacaaaccgccaaccaaaatgtcttcttttaggctttggctggcaggcagatgagcccttactcctactcgaatcgatcactagtcaccactcctgttctacatgcaacgtgtggtacccaagtatggaacacagtttttttttttcgacgaagtgtcgtgtcttagaaatggaaaatactgttggtacgtacagtactagttttgttggattataaggtgtaattttcatcattaatcccaggtagtttaatgtaacatcccgtgatcagtattctgtacagataaaatatctacagagcgtgctagcatcaaataattagagaacccataagtacaatatactgtcactatatactagcaacgaatggacgaattaaaaattttatgaaagttagaaagggttttaaataatttcatggttgagacttgatccagtctaatttatgctcgatggtgccggtgcagtcgctggatcttatttgtgcgcctgcgagagacgatgacatgcgtcacagtttctgatcaattttgatcatcattcaaaataggggtataatatgtacttcgattataagtgatcaattaccgatcaaattgtaagttgtactataataatagctgtgcgtgaaagtccttaaacattttgactcttcctagctagactaacacattcttacaaccctcgatgatggtatcaatttattttatctagattaattatttttttattaacaaaaatatccaataacaaataatacatgcacacgtatatgccgcgcaatgccaattcacaggtcgtacgtacacgggtagaacaaaaacagtgcatggttttacatgacgtctccagtggcaaaaataatacactccacaccaccacaactacatgttgttgtagatgggagggaattaaaagagcactagtcaatttaattaggggctggctggcgaagcagcaacacgttacggcgtgtgataccatgtccacacacgcacacagagcacatgacgagacgagatccggcagcagcgagcaggtgcattaatagggtactggtagacgttggtgtcgtacttttattgcctgcccggccagcccagccaagccagccttctttctctccctccctctcctcctctactactctcccttcatcccgataataattctcggttgctgattcccttcatttaatctcgaccctcgccccgtcttacatttcgaaattctctttctggaccaccatcaccgcatagtcacaggccagcggtatttccctccatcgcggtgcaagacgataattagtccatgatcgatccatcatgcatatacctaggaccgaactggaagaagcaccctagcgtattgccgctagtagctagctagccaaatttgcttcgacttttgcggtgacgtacgcgcccatatacatggcaactttaggcgtcatcaccggggctcgtgggcgtgtccgcttccagatcaatggagtccagttgctcgtcggcgtcggcgccgcgagatcgagctagctagcgagcgatcgagtcgcggtcagcaccatacctgcgcggctgggcggcgagcgctactagcccatctggtaatacgtagtactgacactgtggcgcgcgtctcacctaccatctccccaacgagatagaggagtcgacggtcaaacgtcaaagctgtccgcttcggcgcgggagaggcagagtagtagtcaacgaggcgttgggaggcagcgggcaggtagaggcagagccgccatccagtagcgttgctcgtcggggcactcgcgcgcgcgcgcgcgattcgatcagtcgggcaaaccgcccggctaacttacgcacgtacgctacgccgttggacgtccgattctggccgtaatgaggtcgcgccgcgtgcagctccaaccgcgcgcttttatcattactactatctcgttccgatccgtaatccgtttccgtccccgcgcgccccacccgcctcccatccctctaggtctcacctgaccggaaaagccatatactctcaaccgcggtgacggcgacgcgcgctgccgtgcgtgcgtcggtcgaggccgccgcccagcacgcagcgcgcggtgcaagtacagtgtagccgctgccacgccgatccgtgtggggatttctccgacgcgcgcgcggtgaggacacggttggatcacggatgggaacggggagatttccgcgtgggaggggaaggttctctgtcgatctgtcactgtacatgtagcgcacctgtaaccgttcggcgtatatgccattcagggtgtcaattcctcaactgcaaaccacacgcggcgctactcaatgcagtacaacgactgtaacagtgatcggtattgagagagcccttgtaataggacgtcaaatgttacgtagtatcggtactgttcacttgtagatactagatagctatgcatactagctagcttaatagtaccacctatctaggatgtgatatgatgatgttaggtccaaactggcgtacttactcctatatagttgcggtgaagttcaccatccaagccacatacgtgatgattctgtacgtagagattaacagtagtttgttggatggtgtctctcgtctatcgtcaaaaacctgaaagtgccatcgatcccctacaactgcactactaccattaagtacacggatgacggatcagtacatataggggtagtactaaaagtactggtatagtagtagctcgtgcagttcatcgatcattcacgtggaagaaacatagtacgagggcgaaaaattatatccgacttagcaaattctataactcctgcctatctacctcgtgcatgagacttgcctgcttattcaactgaatctatatatataggaaagtaaattgtggagagttaacatcacgacgaggaacaggaatgggtatcgatcgtgaggtgaggccccggggcaacccgcggaatggaatctcggtacaagggaggaaaatctagcaggtgggcacgcatttcttgcacttgacaacgcacttggtggacgggatgtggctgaggctgctactggagctcgacctgtagcacctcttgccgcacagcaccttcttcttccggcacatgtcggcggggatgcagttcgcggcggacttcctcgccggcctccccctcgccgtgctcctcagggacgccctgatcgcgtcggcgccgtcgccggtggccgcggcggcgtgccacccgtccgctccggcccggcgcggcgccgcgccgaggaagtcgctggccttggagatgagctccctgagctcgcggccgagggtggtcgggatgccgccaccgccgctctcgccggcggcgagcgagagcttgctaccacccatggcaacggcgagcaggagcactatcaggaagcatgatctcgtcatggctgtcacacctcgtgatgttacagcggtacacatgagttctcatgtgaatactgttaccctcttatataggagggtcattgcagcgatcaaacgaaggcatggaagcatttgcatgaactacctaatttgcagtgaacatcaaacgcgtgatgatgaacaggcagcccaggtgtgaagtgtgaaccatggacggaacagcttagcaattaatcggcctgcctttccttgtaatagttccggcatgcttgctgatgtgaacgtcggctagagaagggtgcatcgccgcctggtcaagttgtttgcttgattgtagtacaattttcttttcatacgccagtaaaagacaggtgtacagaaagaggcatgtcaagacacctggttcattatatacacagttttaactaggacaacttatttcatctatcctgaagagtgtgggttttatattatagtgtggttctttagagcaagcaaaatgcaaataggtaatatattcattgagttcgttctaattctacaactaccgagcagggtttcctaaaccgccggggccggggttaccgcgccccggcggtaagcacgataaccgcggtaaccgtgaaaaaccgtgcaaaatttatcaaaaattcaaattatttttaaaatttatttgaatttaaggaggttaccgtggtaagcccggtaaccgcgcggtaaggtaaaccctgctaccgagatcattcaaccacactcatgcataggattgtaggactaggatagctttcagtcatattcatacataaatgtatataagaaaaggtatgcatttaatcagcatgtccggattccagaagcaagcttcatcaggaaggcaagaaagccaaaccatgttacctgctataataaatttaaattggatacgaaattggtgaagcgataataaaatttaagccgctcacttaaatcattctgcaaatgttttatttctacttgttatccttaagcaagcacctttgcacttgatggcatagtttctccaaggcaagataagtcttattttcatcacttaaacccacacaattctccaatttttgactgacactaaactgagttcacatgataattccatttttcagtgaaaggttatggaggtgaattccccacatttcgtcagcattcaaagacaaaactttttccaacaaggggaagtcatcatcaagtagttagcagctgcattgattcattacttgtgtcacgtcagtggctttggattcaaatcagcaataacagcttacggttctggattgccagctactcagctactccctccgtttcatattactttgcattagccatattcatatagatgttaatgaatctagacacatatgtatgcctagattcattagcatctatatgaatgtagccaatgctacaaagtcttatattgtgaaacggatgaagtatttcataccttaaggtccataacaacctgcaagatggaatcatgaaacttacaggcaaaggatattctgcagaccagtcttgctatccatcattactgattaagatagttggaaagcacctcccaacaacctgcttagcccctgcatggttgagcggaagaaaataagagactataaacgagcatgatcagctagagagtagaggaagagtacgttagttcaaactgaaggttagacttgaatgaagaactcaaaatggtaccgactaataaagttttcctttttatcagagttttgcatgtggagaatctatacattgagaataaagcaacctgtccaaccccccatgttaaatgacactagaccccccaacattaaattagtagccacaaatctcccagcagacatataacaaacaccactgtactgtactgctgtactgctgtagtatccaactatccatgatggggttaatacgttgatcacctgacacaaaccgttgacaagaaaagcaaaatagtagcatgttacatacttatatagagaaatatggtcacctaatttctaattcaatcatgattaggacacaaaagagaactggcccctccaaaaataaagcaatcaacccaatatactccacgccgacgaaatatggaaatagaagctcattggaatgacaccttttttatgctcatgaaagagggagcacagaagataagcaatttggatagattttaacaaattataaagttcttattataaacctaagaagtgcaaaaatgagttccaaacccagaaatcccctataacctttatgcattaacagtagtgcgacagaatactatgattctacagttatagaactccttcggcatgagtatttcagataagcaaatgtagtaatttaaccaagaaatataagccctatttattttggaacaaatgagaacgagaataatcaaacatggatgtttgtctggtaagaatataagttactttattgcaacacatcatactacctaaatttaaccaagagtgaccataagtccacaacaactttgaacctagagttacatgagacatgaaacattctggctaaggaactgttttctcaattcaagatttaggtgttcacagggtttattcaaacatagaactgtagttattaagtatttatttaatccaactttgaagctcataagtaaatttgtggggatattattttctgcatagtaaaactatgttcatgagcaatgatcttccaaagtggttccttggctctaaaaaggtaaaaaactaactttcatcatttggaagagaagttgatacgatagactgcaacatttccatttgcagttcagtccccagaaacaattgttgaatgcatatgtatgccatgaaccaaagcactatgtttctaatagggtgtaattacctaaacaagagtacacaacatgttgaaagagttatcattaaatcacatccaactgaaaactcccatacaatctaattcggaaaaaaaatccccatacaagatgttcttcccttggcaaatggcaactgatggatagatactcaggctaacgcatttatcaaaaccacaggttcatgagatgaggcaaacgatatgcattttcatatcaggggaacaccatgaaatgcccacaggtggatgataaatacgctatgttgcaaatcaggcttgacaacaagcaatgcgacttttctagattttaaacaccacgtcatgttatttaccaagcaagcaaggttgaacttgaaagggcatatttctcagcatatcaaggccatgcaatgatttatgttcaactaaccatcaatagatgtcggaaagcagattatgcagttcttttaaattgttgttgctgaagaatgagtgctgaattttatggctcggaaataagaagcatctgacaggttgtatgaaaggatggtctgttgagaacaataggggagaacccaactgaaaaggatctacaggatatagagaaataacaataggagtatacgcccaaaaaatgcaaaaattgacagaacaaagtaaaagagataaccaaaaattgacaggtgtacagttcctacaaacggtcagaaaaggccatcaggccgtaaaatgaaataaacggaagtctagatggttagctaaatgctcggaaattcctggaacaacattaatataacaaaacgtacacatatgagttatatatggtctaagactttcttttgcacttgaattaacattttccatagtaacctattagtggtgcttttacccactaaggaaaatacagcttaaaaaaatcaatgacagaccgattttttttacttcaagttacaacacaaagacaaagaaaattcaaaactgggagaagcatttttattacataaatattacaaatattcggtataaattacaagaccgtaaaagatggcaaagtcaactaatgcacctcactcaatctcaatttgttggggcgcatcattttgagatccctcacttgattcatcggttcggctatcctcagcaactccagaagcctctaccgtcctagtgatccattccttgagaggatcctcattcaggtcaagcctcaataggccagcaaacacaccacccatgaatgcaactggctcctacacaagaggcacgcaaaccatcactccatcagtacatgttctggctttgggaagagcctacgaaaattaaaggcaattcccttgcactgatgggaatattgagcatctgcagcttaagaatcaactcctatggaccaattcctgtttagaacgctgaaatagctatatgtaaaatgtaactcaattgttgggtaaacctaaaactcccatggattcgtcaggaacctcacaaaagggtgtgttgtttcagaatttacaactagagattttacagcttgacctcgacacatcgaattaattcatgctataagcctacaactaacactggatcggaaaaaaagaactggaagagtcggggacgatacacaccttcaaggcctcccggaggatgcgttcgtccccgggaggattgaagcaagctcgcacggtccccgcggctcccctcctactccgcccctcgaacccaacaacgaagcccctcctcggaaccggagccctcctccgcgacagctacaaaaaaaaaaaaacgaagaagcaatcagtacaaggtcaaaccctctcgcctgatcacacgagcgttcctgctccaagcgcagcgctttaccgcggcgggagctcgcgagtttgggaggaggagtacagcggaggaagcagcggcggccatggataacgcctcgagtgttcgccacgccgcgaggtttgccggaggcggaggatttttttcctcgatgccgtgtacgcgctagatgggctcaggctgggccgaaacgggattccgctgacatgcggcccgtataatatgggccggaatgggattgtgacctacgtgaggcccatggagtgtaaagtgtgggtgggccgtactggagagccggagccgagttgcacttgcacgggctgtcacctgtttacgtcagcgagactgcgagagcatacgcaaggctcgcctgagccgtccgatcctatctgcgcggcggagattgaaacagctcagagacgctcgtggcggccgtcggtgaggtcgccggcgactacatggatgcctccggtcggatcgatctcctctccggcagagatgcacaaatacgtcgatctaccgtctacgagctattctcacctcgctcatatcagacttgttggatcgatctccgtttttttttttttggtgttcctttgtggtttattgctgctgctgttttttcgtgtcagcaagcacgcgtcggtttgtcagttacctacttctctctccaggagtccagcttgttcctcgcatgacgatcgaggagaggagcaatctctccaggctgggctaggctagctagaggctgcatgagatatgtacatgtcgacgacatgcatgtcgtgtactgttgactcctgcttctccgttccgcttagtggtgcctgaccacaggtagtgaggtagagggtagagatagacttcaagtgctcacgcatttcccctgtcccgttttgagtgataattaagcttaagctggactgatggatagaagcagtaactggcttcatgaaccaaggattaatctagtaaaacggtaacgtacgccagatttgatcatgagcaacagtgggaaaaaagtgaaaaagaaatttcagaaaaagctagcaaagcatttttattctagctagctcgctacacgagaaaaagctagttcattctgttttttcagaaactattatgtgtctttctcctgaaagcaatgacaagtaaagcttatgggtgtgatatagtaccacgcaacatatcatatatagatgcacaagctaacgggttgacagaaatataccatgcaggcaaaataagccaaattaaagaatgcttcttaatccatcgcatgacatggcctcgccggcagcacatattttccatctgaataaaggtttatctcatcctgtcatatgtatagcttgaagttttgtacaagatgcacgcacaaactagcttccacatcgcacacatagagcactaaatggtaaaaaggaaaaaaaggcagaaactaaaatgggaagataagtccaaaaggccacctcagcgatatctccacctgacaagtgatgattcatacgacccaaacccccaagacaaccagttataaatgtcagagactgtaccaagtaggaatgtaattaagatcatatctcctagatggctgataagttaaaacaggctatatatgcttctcttccctgagaaaagaaccagaccacacatctagctagctaggtagcccacctcaacatcggcttacttgttttggagtagatgtttcagattagaagcaacatagagatttgagatatgggaagtgctactgctgattccagatctggtattaagctttttgaagcttgtatcaattcgaatctgaggtccttccttcacagtgttacgccaactttggagccctacaccgttgccaaggtacaaaccatcatgctatcttttaagaaaaagaaaggctgtgcttctgcttgtcaaattcttttctcctttgatttctgtatgaatcagttatgtttccatagaaattacaagaaatgaaaaatcccatttgaatggacacctaggttattggagtagttatatccatggaatacaaaggcatcaagcctatgaggctatttgattagcctgggagttggctccgagactgcttgtctatgcgatcttctctatctttttgatgaaaaggatatgcatctccagctttcctcttttttccccccttcatagaatggtttcttgttttgctagttaaattctttttctcatggtttgtcattatttcccttttgagatctactttagaaggtgggattttcacatgaatttggggggaaaatatatcttgttatctacatatgtttcccttctttcttcatctttgtttttattgttggcctatgttattggcccattttcccttgatatggtggttttccattaattttcttgatggtttataatacatctactaagatgtagatgccttaacattatcacgagtttccaagaaccaggaaaaactcatatccttttctaggttgtttacttcttcccctatagaatgcttggtatcttctcgctgggagatgttaagctatgtatgatcatactaacttgttttgcagtaagatttattacttgtggattggtgtctttgtctatgtcatccttctttgttattccacgcgtatgtaaagtggcatggattcaaaatactttttggcgcgagacatgcatggtgtcttcgtgcgaacttttggcgcgaaacacccatattgtaacgtatcactcaagtcaaacatttgcttttggcacgtgcgagacacgtgtcagattcagtggcggagccaggaatttaaccctatgggatcaattactattagtttgtatttaagtgaggtcatttctctatttttttttctgggtttatacatgaaaaatggtcagattgatagcatctttacgaagattctatgtgggatagaattgtagaataaccatttaacatggaaaatcaccatatgaaatggatgtctaaaatggtgatcctttcatccataaaccttttattttgccacaccttgtggttatcattacctcctaacaaatttagccttttatgcgcaaacatgcatgcttcaccaagtgctaacctattggttagaatcctgtgcacaacagtaaacatttaatttattttcatatttgggtgcgtagatgtaatctttattagttacatttgcacacaaccaccttcatgttgacttttgtatttaacatctccacaacttttgatatggtcatccaatgatagaatgtattaattaaatatagaggacttatatagattgtattggcacttattaagtaggaccaaatcataggactaatataggaaactgcacatatggcaagagcagtcgtttcatactactcgacatcccgagttcaattccatgtgacacgctcccttccttctaaataaatgacacgaagctcctccttagtgtcccatattttttttaagaaggcaaaagttttgtctcgtatatattaatagagcaggagaaaaaacaatcaaacaaccaaacaagttatttacagggccctgccgaaaaaaaaacagagcccacaaaaggagaaactacgttggctctcctatcagggttgactcagcgagttttgcgactcccgccttgatccaggtcaacgcctcctctttgattttagtgatgatggtgattggggttggtggccacgtggtggaactgtgtttttttaagctccgctggcagcaactttacaggatgaattgcttattatagggaggatttttattttgttcttaagtagtgctttagttgagaacgtagagtacttggctggtagggtgctgccaggagatgctcaacgacttgggtttgaaccaaagttcctcaccccctctcctatctttcttaaatacattgatactaagttcctcaatatccaacatgttttcagtagtccttagttttagttttattgctatctactggcctgaattaaataatcataattatgatctgtgtctgcagccaggcggctattctggtagagtgcccgagttaggtagatgcttcttccttgtagacctttggaaccacttctacccgttgagcgcctatggtgtcggtactccggttcgtctcccttccggtcaggaaattgagcagtactttgtgccgtatctttcagccattcagttgcacaccatctcagacttcacttcatgcaagtaagtatatatatgtcagtttctttgtgtataattggccatcagatgcatgaagagtttgagagttttacatggttctttttgtctgaactgggcgtggtgacagcgagataatggtcggcaataacttgtttgatgcgaacaactacggctggtgcagtgcggcagataactggaatggtcagtatgcaacaacatcattagcgaggtatgacagcccgaggtcaatgaatggagggccatgttttcagtactttgaatgtgattccccttatgaaaggatgcctctcgcagacaaggtacgcatgcagtagtagctatagcttcaaacttcttctctggaaaggaaattccatcagtttttttttaagtttttaacttgcacttaactttaaagcttactagtagttcatagtatttgcatattccaatgaattgtacagattagttcttccattgcaaactgccatgttatatatcctctttctgacattctttctatctatcatgtattcaggtgtatgagctgtgctataactttccacccctatcatatcttagcagtattgagctctctccatctagttggatgtcagttttctggtaatttttccaaattcaaaataacttcctcatgttttttatttaatcatgtaaattcacaagtacattttagggcaacgttagctttccattaacttgaagcaggattgcagatttatttagcgtctctaatctaattgtgccaaccaaaacagaggtccattatctattaaaaaaaagagagcaaatcagttgccaatcttttatatttacttcaggtatcctataggccatgttcccgcgatgaacaagaaggacctgactacttgcttcttgacttaccatagcctgtcaacattagaaggtaaataaagacagtgacacattaccattaattttttttacttcctctctggaagaatgctatatattcaaatatgaataatattttggctccccgtttgcaaattgcaatgacttgagtttcgtcaaaatcctgctatgcaactgcacatatattggttcatgctcttcgaacaggctttctacacatagtgagatgtagtgcttcagtttttctccagaaatgaaatctttgttttgcatatggagtgtgaaattaatgttctcgatctaattcagaaacattgtgaacattttattgtagatcgtacgccgtttgacagcaaggacccgctgacgcttcccccaattggcctcgcgacgcacaagacggacggagatgtatggacaagcgcgaactccggcgaccaagagctgaccacctccctcgtcggcgcggcggactcgtggctgaagaagcttgacgtccagcatcatgacttcaattacttcctcaacagtaacaggaacctgatccactacaggtccttgaccgaagcaagtaccagtgcagtttgacatggcgaacttgactggctgaaagcggttgccggagctggttgttctgggtacaagaaggaagactgcatcgatactctctcttctttttatttttgcggtggtggtttgcagtaattggatcctaatcactgagacatcgtagttggtactgaataattgcttgttttagaccaagactttatcttgacattgagttttactttcacatgaaaaactgcaaggtgtgtgctcgaaagtatgcagccttcagaaaagggagttatttaaatgtcctcgcctgcaaatgttgggttattttgttgtagcgcagtagcatctgtggccctctctctcgtggtagcatttggttgctcggttgttcccgtgatgatttatttaggaacatggaaatctgctaattattccgtaattttccagccatgatatcaccatgtgcaatttgtggcttatggtacactagagcaaatatgcaggtgctatgattcagctcgatacatcagtaatcctcggcggccacgggaagccgagtatctgcagctgccggcggctcaggctgctccgccatgacaaactcgtacagcgcgccggccatcccggcgccgatgagcggcccgagccagtaaacccagtggtggcgccagttccagccgacgagcgccgggccgaacgcgcgcgccgggttcatggccgcgccgtcgaacgggcccccggcgaggatgttcgcgcccgcgaccaagccgatggcgaggggcgcaatgtcgccgccgccgcttctccggtcgacggcggtggcgtacacggtgtacacgagcccgaacgtcatgacgacctcgagcagcagggcgtgccgctcgtggatgcggtggccgagcgtgaagcccatggggcgctgcaggacaacgtttgtcaaagtgagacgtggcaaacatgacgcacctgtacacgctggtagtggtagatagctcatgccaaaaggaaatacgcaaacattaattttttggttttttgtggtaggccaaaagaagcaaaatacggcgtcgctaataatgatcaattgatatataacagcatgtaagttgtaaatgtgatttaattaagcgctaatgtaggcttttggtgacgaagagataaagaaaagtgagctagttaccatgcctccggaggccagcctgaggagaagcacggcgagcacggcgccgagcagctgggcggcccagtagagcgcggcgcgggcgaaggagatgcggcggccgacgagcacgccgaacgtgacggccgggttgacgtgcccgcccgacgcgttgcgcgacaccgccaccgcggccgccagcgccagcgcgtgcgccaccgccaccaccagcaggccgcccagcgtccccgtgtccctgtacatcttccctgcagcaatccaaacacacaaaaaaaaaatcttcagacaaacgcacgggagagcgtgcgggcgttcatgcatgcggttgggttcgcgtagctattttacagaggccgtagacggagccttcggcggcgaagacgaacacggcggtggctacgaactccgacagcgccgcgcgggtggcgcccggcaccaggggctccatggcggcggcagcggcggcggcgtcagcacggcggggagtgtggcgacctggcagcatggttgacaacgaccaagctagctaggaaggatttcgcctttctttttccgttcgtctgcacctggtgctcctgcgtcctccgggtgaagtgctagttgagtggcaggagccctgagcgggacaggacgacaggtggtcagcgaggagggacacgtgtggcggggatggcgccccgaaaatcggcggcggggaaagctgaaattggagacaaaaggtgatacattagttgcaaatatttgtggaaaccatcagcatttggctatgggctttggatcaaacttagaacgcattacttgtaagtcactgatacatttgaaagaaataattctgcttgaacatttgaaagaaataattctgcttgttctatatccgaactgctttcttacaataacatgagtagcactacaatactatcaaatttgtacttctaagctgtcgtcaaaatcccatgtagcagaagttgcggctatagaaacattgaatttcatcagctgtttcagacgagattagcgatcttacagaacagggaatcaaatctacaaacttggttcatttcctccagaagagacaaggaatgtaagtcgaaacaaaaacttaaaatatgtataattaattcaatcagcattctcgctttgtataactcataactaccaggctcttaaacaacacttttgccagctcaagtaataatagaaaggttggagatactgccacaagttataatcctaataggatttacaaaacttccagctgagtatcctggaactcttcttcgatgactcaaaactcagagcagcaccagctatccaccaaggtgctcagttatgttttaccattaatgcccttcatgataaaggcgaggggccatgccccagttcagaatcatcgaccatcttctctaatgactcaatatcactggtttcagaaagtatgtgaatcctaatgctgtctgcatcctcactgctcacatgaaaaaagaggaaaagcataggtcatgacagtagcattaacagcagttgcagtaaaagaaagatccaccacaaagtaaaattagtcatactctgtaactccgaaaatttctttgacaacgagtgagccatcgcgtgagcagaactctgggagctggatattcacaaaaaaacagtcataagttatatatagcaagggaaaatacagaaaatcagacactggaccagtttgaaaaactatgaaagatcttattacaggacctagacaagactttttaatccatttttctctctgggtgttgacaaagcacggtgcatcaaaacaataatggaataagttttataccccaaattttattattctccaaaggaatttaaatcataacaataatattacctaaacagattctgttgtctttgaatctagttgtttatataacttttgaaaatactgtatcgaattcactccactgaatccataggcaaaaaaacaaacatacaagtatcaccatgataatacaagtaacaacttctaaattctaactgaacaaagacagataatgtttttgaaaaatgaaagattatcatgagctgcaagcagagcaataagtgccctatcaagccttttcatttcagtacagaggtcaagcaaaatctggcttatcatcaacagaactggaccttttggtcaagagaaataaactatcaacagcttacctctgataagtacaggatttttccgaacaacgtttgcacagcaagcttacgcttaaaaccttgttctgtaaacccagctaagtccatgactactggtcctgcaagatcataaagatgcaaaatctcttgagtacttctcacagacttgttctcgcaaaccagaagcataacctcatgattaccaagtactgataggtgacaggagataaataaatcataaggaatcaaggatactctccttacgtatattcatactatatggctcatgcatctattgtatgaagaaattttgccttcaagcagtaagatcatagatttcaactgacatatttaaaaattcaccaaataaagcataaaaatgtacaagcataatggtatggcttacaagtacaaaatgctgcgttgatttcatagaatctttttcagtacttttgaaaaacagttaattagtttgcacctggcataaacaaaataacaaggaattgcagaaattttattactggatgcggattgctaccccacatacatgtatgttaaaatgcttcttgggaaaacatgacaacagtaagtcaaagattttacattatgatacagacatgtttttcacgcttggacattgtactattgcacgaaacaacataacagaaaatccccactactaattgtttgtcatggacatatctgaaggctagcagagcatgtgtaattgagaacgatgggagatacaaccgaaaggcatgcttagtatataagcaggggatgtcatccttcaataagtgttgcacaaatctttaagcatggtaattgcttcttcttctaccttgatttgttctttaaagtgcagttcccatggggtagcatataaaaacaactcgataggaaattgtgggacacacaactatcaattaccagaggaatagcattgagttacaaaagtacacaagccagagttgaatttaggaaatacatgtatccactattaccactagaatagtagaatcagacccaaagaatgagcaatacctttttcccgaacaattcgtcttgaaatctcattcaaaatttcagcaacttcagcatcttctaacattgacgctttcctaagatgtatgagatccacgactacatcagggttgaatggtttttcattcagtgtgtatcgaatgtacttccttactacatcatccatgtcaaatcctgtctgaatacatgccaaaaacaacagttaaatcatgtggttggtagctttgccactaaatacaaaggcatcaaatcattcctgaaacagaagtagatatcatcatatcaacaatggatgtattggtgcaaagaattaacaaattactatgtccaaaatcatcattctactttgtgcagcaaattttctaatttagatcataatcacaatgtggctagcaatctaaagatgtataccacaggataccaatatcaccatcagcagttgattgtcataacaagatttcctgttatcacaagatatccattaactaatgccggctaaagtacactcatcatccataaatagacaataaagcaagcatatcatagaactagtctaatataaaggttgaatcaagggcacaccttctccattagttcttggagagctggaaaatccactgcctccctgcccttctgaaacaactcatctagtgacttcagcaaaaaaatattcttgctcacctgcaaaggaacactgctttaccattaaataccaagaaggtatagcaccataattattctataaataaagtcaagttcaatattgcagtaaaaaagaggaagcaaactcagaagacagttctttgcatctgcgtaaaggcatggaggagtgaaattaagtcatggttgaaagaaaatcattgcaagttcattgcccttctgagtatgctaagttataatctagcttgaaacatcatgaatgcataaagtgaatatagttgatcctctctactcactagaaatactagactgcaacattaaaggaaataccatatacttaacaaactcaatcaaactgaaatttttagtggggtatacactactttatgcctagatataaacttccaaatatagaatcccctgctgttcccatcgcctatagtcactgacataggtaaattaaatgctagatcaatcctaagaaactacttttccccatgatgtacctaaatttccaagaggttaaaagtcgatctcaactctcaagagaacggccagctagaaaacgtaacagaatagaataatttcgatcttatagagcagctacctgatgatataagtgcaattacattccgaatcacgtcacttccccagcttcccaatgagcaccaaactataaacgatggctcttcactgggtatcaaactacaaacgattttgacacggaaaacttacccttcgcttcttctgggtgcgcggggaggtgaacctgcggacggtgcggacgacggcgagcacaaacgacacgcctacgtaggcaagcggcacggcgaggagccacggcacggggctggagccgacgcggggccccggtatggcctgcgtgacggtgccggtgaactccacgaggtccagcgccttgtcctggatccagggcatctcctcctccacctccacctcctcgtccgcctcccgcttcggcacgtcgctggggttcgcgggctgcctcgaggccgccgcggtccggctgccggggcgcttggcccgcgcgacgaggaggggcgtcggccgccggagaggcctcgtgcgggtggggaagggcagtgcgagggtcccgcgacggagccgggcggcaccgccggcgccggcgccggcgatgggggtcgtgagcggctggaagaaggaggtggcggtcgccatggaggcgggcggggtggcgacgattagggcttatcgcggcggagggccggaggttggaagcacttttgtcgaggacggagacccagtgggaagtagctgaaccaaacttgtgaagttggtggtggaagaagaagcaatgggccgaaaggccgaacttggagtactatcatatttgggcctcttgtcatagtgcgttggatgggccgttcttcagaaatctgaagaaaccaatcggtaaattgaacatgtttttcctgtcacaaattattactccatccatcccaaaatatagcaagttttatttggattggatgtatcctagtactacgaatctggacatgaggtccaacaaaaagttgctatattttgggacggatggagtaagtcacgcatatatatgaatgtagtcgaagttatatgtgctaagtgaactagagaggcgaggcaagcagtgaaatagcagtcgtctgatcagttcacaagcacggacctcacctcagacagctgatctgacgaacagttaccaattcaaggcaatacattgatccatcattagctgacagtaatcgcgagaataattaactttgatctttacccactcgtataatccgtctagaactgacgtcatattacaagttcgtcagttctccatttgaacagtaagtgtttgttgtaaattaaattgtggaaatactacttatttccgccgaagtgtcttggacgcttcattgctgactcaaatttatgtaccaccatctcaaaaacaattgatctaatacggaagcactcgtagaagaaacaaggtgatgttgtgtgtcgactggtggaggaatgcctgtatcagtgtatcagccaaacaccacaccatctaatcaaagctttggcttagattctctggaccatgctggtgctctaactttcaggttggacttctcagcctcctcgtcattctcctcttcttccaaaatctctttagaaaacgcctctggattgattttgatgcagtcctgcagtgcgataaaaggcttcacacaatctgatccctgcgaaggcaaagagtccaaaattgtagttactattccggagaaacagacgatgaacaaaaacttagcattcttccaaacgtgaacaacagccagttcttgagattttatttgaacaaataacaggtaaccgaataagtgcctttaattaaaagaatctgccctacattaacattgttgtgtaaccaatttgatttgagaaaatcttctttatgcactcattgcagccctaatctctgttctgccaccaacttgacctggggaaaaggcatactggtgatgttacgcagtgcactctcccatcgaggctagagcaagtgagcaacccaagctaaaaaattctcctgttatcacggccctgctatcacttctgataagagaggaagccttttctctaagatagaagtggcatctatggagtaaggtgactcaaacaacaccgacccaactccaagccgtagtgtgaaatcctgaccagattacttcgattcacctcaaaacttacacttctccttgtttggcaccactgtccagttactcagttgcccatcaagtttgcacctaaaagacccttatatagcatcctcataatttctctgatgtcaaaattttcaagaaagttttaaacatttaatgcaacatagatccctgaagttcttcagtttttgtgacattttgattttccatggattctcaaaatgcataaacacataatggtcttttggtgaacaattggactgggcaataacaatttgttggtagaggagaatatgactgcaaagagtggcaaaggaaaaagacaaagaatttttgtgcttttattatattggggtcataaaatgatttgctcataggaaaagattgaccttatgttcaattagatcaacgaacaacttgagggagctttttatatttgtataatagaaagaaacacagacacatttcctacagtggcatggcttcagcctgaatgcccaaatcagctggaaattatcagatatctgtaaaaacaatggattacatagaaatatatatatggcaaccgatagaaaggttacactacccatcagcaagactgcacatgagaaaattgcatccataaaacaactttttttgtaaatattagctccaaattttagaatacttattaatgtgattcttatgttgactaagtttttcatgaacaccattaatatattatcaccatggtgatgtgcatgaatcattcttgcattgcaaattgcaagcagctcggtgccatggagaaagaaataggaccttttcctcttctgtgcttttcaggaagcaagagaacgcatcaacaaattgacttccacaaggaccatttttcaactcagctacacatggacagtccagtgctttctgtaccttcacatcaattgactgaatacacaaaatactaagttcactgatcatccagggtgccaagaaatagtaaagcaaataggatagtgatatataagcatcccactcaaaagtcaaaagcaaaataaagtaccatacctcattgccatcctcgtcaaatgacatagcctctgcatttaaggaatccaacctcagaatgctagcatgagaaactatggagaacttaagtgatgcatttttttaaggaaaaaaaagagagagaagtccataatattgatggccattgcagtaattttgactcaattttttttgagataaaaagaaacgcgaatattagggaaggacctaatatcaaataaatataaggggtgaagcttcaaacttaggccggctagcctaccaccttgtggagctagctataagacccctgggttttgagatagcaagcttgctaggaactgagagtagtgaaattgccactaatactatattagctcagtgactcctctgacccgggtgttcttattcttttgagagggacccgggtgttattaacttacaaaaggatcagacaaaaggattgcctgccgatgcattaagattttgggggaaacaaggtacagtgtaattgacttattacatcacgtgcatgacattaatattttaatctatctaaattgtcaattccggcatgaatgattggtaagatatcagctatcatcagttcactatccggtacacggcctgccctgcacaatcacatactcgaattcgatctaaaaaaagagagatttggagggagagacttcgctccaaacattttcttaagaatgaaattatgagcatgttagggattgaacacagaaatttggtattaaaaccacacacctcttgccactgcactatctactgcatctcaaagcttcccaaatccaaagcaacacaacaatctagcgcggctaccgcatctcaatgaaaagtcacgagtgcacgagaaaatcgccattggatcacaatattcagagtttttggcatgtacctgcggcgagcgcctcgagggaagatggcgccggggcaggagacggcgacgacgacggcgccgcctcgacggcaggcggagaaggctcctccaccgcctgcgcgggctggctcagaccttgacccatcgaggtgtagcgctagagaagaagcaggcggcggccacactctctcgtcttcccgggctgcgacggcgagaacgggagcaagcggcggcgcggcgagttggagcgtggtcaagtcggccggcgtccaagtccaactaaataacaggcccgagcaccaccacatcaccggaagcaaaattggacccgagttcaactccggcgagcgctttcccagccgtccaaatcgcatcaagattcgtgcaacgcggagacaggcttactgggccggcccggcccgtttggtgaatggctcgcgacctcggagaacctaaagcctaaaccgcggcttgggttcgggggagctccaggccgccggcgacgatgggaaagccgctgggcgacagcgtgttcgccggccacgcggccgccggcgtcgcggcgatcaccgcctccgcggtcgccgtccacccgctcgacaccgtcaagaccctcctccaggcgagcgcccccctcctccctcagattctctcgctgatgctgttgctggccccttctcgggggctttgatttggtactcattcgcgggtgttttactttccctcctgtgctggctgtgcagttgagcgctacggggtcgcagcagaagatggggctcggccaagtggtggaccggctcatgtccgcctccggccctgcaggtttgggtttcttgcccagttgctagataattagagatcttccactgtttttagtggtggtaatcccatatcgtgaattgcgttagggcatgtcgatatgcatagctttccaacacctacaagctactgggggtttatgaggataggtgatgtttgagttttgcggttagtggtgagtgactacttgctcagcctgccatccaaaaatcatggtagcattgggagactgaaaattctaaaatggatggtaatttttatgtagtgcccacattataaactatcaaatttgtaaaaagaacttgctgcaaattgatcatattggtcatacttggcagctggtgttgtaatagaattccaggccacctctttagtttttggccatattcttaggtgtctgttccttataaaatttcctggtcgagaaatacagggagaaaccatgtgaatcctgcccttttttctaattcctgtgtgatgatttctcatcacctatatatatgttacattggaatgaaattattttcctttgaatttattgtgtgtgcttttaggcctttacagtggcattggatggtcagtattgggcaagctgcctgggttgggagcacgttttggaacttatgaactcttaacagccttctataaaggtacagcatggttccagaaatttattgctcaggatggtctgccttatagaatcattttgtctgtccatttgtttgcagttatgaacaaacaatacactcatttaagtatatgatttgccaacttctctgtcatattctcttgccttcctattatcattttcctctattacagaatggttagcctccttgtatcgtttaatgtaataattgccaaatgctgtttagttatttgtactatgaattaccgttgacactgcaattttttgctgctgtccaatgcaacaatctgtagatcattttgaaatgcatgcgtttctggatagttaaaagtattcctttcctaatgcaagtactttcttatgaattgtttgttacgcgaaacatcatatctataagtactgcaatatctgattataccagattcgttggtgacttcatcacttgatggtgaaatatgacaaatgacatttgttttgtatatctcccgcagatggaaaggaggacaactatgtttcttactctgaggctatgttggccggcatagctgctggtgctgttgagtcagttttgtgcacaccatttgaacttctgaaacttcggagccaagttggttctgtgaaaccaatgaaagccacagacccagcaaacattacaaaagtgcatttccactgctctccaaactgttgcctggttatgtccctgacatcagagtatggaatagcagtgtcagccttttgtccaatctttccccaaagcatcctgacatgatgggtgccctgaaacagcatccgtggatgcttactggttcagggaagcccccattgccctctgatgttcaggttccttcaagagtgatagcacttgaaggatggggtgctctatggagaggacttagaccagggatgacccgggactgcgtctttggaggaatgttcttttcaacttggcaattcatacacacagcgatgcttacttggagtgctgttaatatgaaccctcaacccaggtaatggaatgtagtatttttttttcaggaaatagtgatagtaatcgaatcataactgtttatctttttggcattaggtctagtctaaccttttgatgttctgttcttgtcagcaaactggaagaagcaggccctgtatccccttttgcttctagtcttgctgcaggcttctcaggagttgtagcagctgctgcttcccatacatttgataccgccaaaagtcgttcggaatgcactgttataccaaaggtattggcatcgccctactttgaatagtttgttctgttagtttactaatgcaaatttgtagttcattgtgttagagcttacaacttgtaaacactcaatttccctatttgcaagcatgccttacttctgcttgtattacttcagtatatcgcgatggagaggaggcttcttaaatggaaagtaccaggaaattggatagagagaaagacaggaatatctcctgccgataggaatgttctgttccgtggtattggtcaacgaatggcccgaagtggatttgcatcttttctacttgttgggtcctactattttgttatagatcagttcttgtagacgacatgaagagacatcatttaactaagagatctctttaatgaatttcaaacattctatgtgcatctggtgaataattgaagaacaggtaaccacttgggcatccatgattgttcctgtactttgttcatctcatccttgttagagctgcgtgttccaagttataatattggctgctaaaacatttttttatgtcaatcagaattcaaggctgcctcttttggtatcaggcttttgttgaagagataacaagtatcttgtatggaaaccgtattgttggtaggatgactgatgagtagcaactactgaagatcctttttaagtttttgataaggattttgtgagaaaaaaatatgtcttcattattgttcaaggttaatttcatcataagattttacttcttctctcttttttcttgtcattagaaagtaaacggtaaggctttttgtgaatatttttggggatgccataattccctgaaagctgccttctacttctgtttacggtactattcagcaatcctacaatatatcttggaatattttacttcaattgtactggcattccatttggatgggtggctgatcttgtgacgcatctatatgtctttagacaatggaaccaattgcacatatggttggttagatgatttttgttcttaactctgaagttatattataactcttggtcaacaacgcatcatccaaagccactttacatttgggcaaacttgacgttttatagtagttcaggttgaatagtgcccggttttaaatataaagttacttttacagtaccagaaaagtttagtattgtcaaaataaaaaggtggtagtcggtcacactgatgactatggcaaggagtataatgtttttggaaaggaatatgttcctgcctgaatacctgatagcaatattattgaacagaaacaaacctagtggtaaagaatagaattgatgtaaacagcaatcgtgtatgattaagagtaacatgtaaataacataatacaataatgatgtttctttataatttggagtctgtaaattgtagccatatatgtgctcacggcagtaggcaaactatatatgcgccatttcgcgtggttttctttgtgttatttggcacgcatacttgccttttggaccgattgtagaacatcagacaaaggcttttgaaacgagcgtgtcaagtttcgttttgttcgcttgtgtagttgtatctcagaacactggaaactgtctagatgatatagtcgctgcagcaggatcaaaatgtgacagttttcacagtactcagtatagatcaaaaccaagccattctgaagggaatcctgagaaaatggatccacgagtcatattggaatcttttgaaatggttagtttttttcttcttttttttttggcaaagcatttcctttgtcagaataagattcgcctgtacaatgctcttgagattatctccaggccttgtttaaattttgctgacaccacaatttgttgggacaaattttgtacacttcattcgtaccacgtctggcttcgacatggtatactagagcctgaacctctgaaagacaacattcacattcttgctgaatatactgctactgacggctgtcttctttgttccaaagtggatctaatggaggaagatcgtagtcgtcaggttttagagccaacgcaaaatccggcaatggaggcggtgttccaatgaccctgcagattccccacaacgaaaaaattcatcacttattgaggttcacaataccctgaacatcactagatgtagtactatttatgttgcaagaaattttgttgtatgcatattacaccacaaattcttagtacctctcttgcgtatacaggtcctgattgatcttgaccttgcttgaagcatcttttggaatcttgtcaagcatgtacttagctgttccgaaaggagtggggctcctgcaaaattccaggtattgacttcagtatccatgcttaagagtggatttttacactgaacagcaatagctattcattaaacagtatactgagtagtatcagtttaccatcttggtaaagttcttatgctgagaataaaacataagaaaatttgaaaagcgaaatgctcaaaaggtaaaatgtcttgccttgatgttggaggagttgcatggaaggcttcagaagcccttttgctttctttcagaaattcttctgaagcttgcaaggcagctactgccattccatgagatttctctgtgtttccctcgtctagaatcaaaccatggaaatagtatgctgcagcctgaaaaaaagtgcacattagttttgagacgtacaattgcaacttgaagtaatttaacatcaggaaaataaaggttaaaccaacttacacacctttgcttcaacatacttccacttaacaaacaataaatgctttttcccccatccatcggataccggaatttctggaatgctctcctgaatttgatgccaatatttgaccatctcgcaagctaagcgccgttttaccgctagagtggcctttgggctatcaattgccagaccaagttgcatgtcgactccctataggtcaaagattaccgattgctcaggacatgatatcaaatttactgaccagagaaagcaccactgcaccgagaataacttggaccaatgtagaacagtgaatcatgaaatttgctataaattgaattagtgctaatagtttctacttcagcccacagaaaaaatgcaaatagattactaagcatcattcctaatcagaatataggagcttcaggggtaatatagcaaatatgtcacttgggactatagcataaaagtttcagcttcataaaaagtactacaacaaatgtaatgcccattaggtttaggaatgcagttcttgagttcatttacgaaagagccaaatgagctgagcccagaaaattgtacctgacccagagcttgcaggctaagagctttgagatttccttcagccagatctactggaagttgtctcctgtaatgcatacattgaaatggatgtcaatacaccttctttcagcttaaatcctcaaaatcatctactcagcttctcaaaagttcataaccttaactccgacgatatttggggtagtacttgtctaattgcgcagtctaggtagccagatgccttcaagaaaacatcaacagtagctcgtctgctctctgtgtacattggcaatacatggtgcattattagcacaaaaacactgaaagaagtaactcaatggaaagcaggacatgaacattttcatatgcccatattgcttcagaagttcagaaaaacagttttataccttcagaaacccttggcgcataaccatcaccgtatgacctgggaagaagcagagaattggcctgcaacaagcagaccatggccatcaaatgcagaacggacaacacttcataccatgcatctgccatggccgtttcctgcagttggcaattccaatgttagatctaatggctactgtcgggcatcatggaggaagatgacacaccacatttttaggacccaacacatacctcagcattatcctcttggttagtccagacgaagtgcactccgtgccgcaattcgctacctgcagagttcacaggctgaatcaaacgaaacaacaagattgtcaaccaacagaacaccaatccaccatatcggagcaattcctcaccttccttcaccaatcctagcagcactggcagatagtcttccagagcctgtaggagattagcagtgctcgaacctgtagaaaaaataaccaaagaaatgagaaccaatccaaattttgcaggcaaaaccagccagcaattcagatgcgctaccaccaccaccctcactcaccgtgccgcgccgccgcccgccgcttcggcttcagcgccgccgccgattcttgcattgccatgtcgacgacccgcgcccgcagcgacgacagcctcgacgaggcctcgtcgaggcgaccggcgagcgcctgggagaagtccacgctcctcggcacccggagccccgggaggaacacgaccacgtcgccgacgctccccggccgccgccgtgggccgccgccggcgtccttctccctcgacagcccacaacccatggtacgcgcgcggcagacagcctacgacttagctcacctcaccctgcaagaaccacggtgcaatagaacacccagcaatcgaaaaaatatcagttactcgccggaaccatccaaaagggtaaaaccaagataaggtataaaagaatgaaacttatcaaattgagtaaaaataaaactacaacttgtaagcgagtacggtaatttcgcaattggagagagagaattccatcgaacaagaacaaaaaaaaaagggtgaggcgatggagaaaagctcttgcctttattcttccttccacttcggctttgtgcgtttcttcagacaccaagaaccgctctgattgaacccaccaccactatcttctcttcttcttcttcttcttcttcttctgcaggctggcgcgcagcaccacaccgaacgcaaacacagtggagggacaaaaggaagcaaaactcttatcccttggttcgtaggggaccgatcaacatcagagcaagagcacaacttggcgtaatgtacggccaaattggcatacttttcgcatcgaaagaggtagtattattctgtgtttagaacagttcctccaacttgtgccatcagaaagaaagaaaaaaacttaggaaagggttgcaattgcaatgcgtcatccgatatttagcctctgatatcagcgtacctctactgcagtttaaaaaaatcgacaaagtgcattcgcaaacttttctcaaagatcatggaaacgaagctggaaaatccggaggaaaccaagaacctacctaatcttggagctggaacgtcatgcgagcgaacgttgcttctcgctgcaagccagaggtggtctagaaccacaaaatcaggaagggctcaactgttcaagtctagggactagggagcatgcaacttgcaagaagaggaaaccagagcctattgctgctggtcgagcagtcagatggagagagaggcagagagagatgtttactaggctactcctgtgtatgacttgtcctatttaaaggggagaagctttgtgatcgtgctgatgcaaatgcaaatctaccccacaattattaagcccacacaccagtacaccacacagcacagctggtcagctgcacggaggccatcggaggaaaaaagatctctcgagccctcgacgacgcctacttcttcgacggagacaaactagctagcgatctcctcctcgtctgcacaccaacggtttaatcgtcacgtgaactaccaggagattcctcgtgtgatttactactagcctaatcggggacacctgtgtggctgtgcctggtcttcggagtagaaatgtagaataatgtcggtcgccaggtacaagtactatccgtctaaatgcgttgaaactgggaactctcctgtgaaaagagaagctgccactgcttaataaaatcgtaatcgaactgttattgtacagctgtttctgtttcctacgctaatagtggtcaaccatattaaattttgcctaaattttaattctttttaaaatatacgttcgaatttcttacaactccaaagttcttttctttttcgaggtggacgtggccgtatatactagatgctgttgctgtaggagaagccgtagtatatttcaagtaggtttttcgcaggcctaaccaaacgtcacaacgtaaccaactccagaattggatcatggcgtgacataatcaccacttgtttaatcctccggatcagattaaataatcatatggctgccaccgctcatcatagtatagttgggctcagactgctacccgtttggagtatttatcggtggtcatactaaatatacgtgcttaattaaaccatataattttaatcactgcttataacccttgtgagcaagtgggttagataccgtctgcactctggagtactgccagtaatacagccaattcgtgcccaatcttcagtttgtggatgcagattcttcagaccaaatctttttcagcaaatctgcacgcgtatggatgcatgcattcgctgctgaatttggttcgtctctttgccagtgctaatcccatgcgtatctgctgcagatgccatcttgctgtaatgtggtcatgtgtaagagaaacagtgaagaatctgatggcacctaccgtgtctgctactaacaaattgtggttgacatcaacgcgtgtgtcattctcgtgccgaaaggggaaaggcacggtgcctcttgagtgttgttgcaggcttcctccttttttgtggataagtataccagcgtccttcttagcttccaaacaaaggtttaggacacaggttattccacacgtgattgatgttatcgtgtaatcagtatgaacgacactagtacatggctaatcatttgacaagcgaggagacaattcctgctaatctcttggccgtggagcaaagctgtattgtgtgtgacatagattcgtagttgtttccgctaattacaccaagaattaacagttagcatttctacctcgcagaagattgacactgtatattctgtggagtgtacggacagttccctcttatcgacaagctagtgagctgtgcaaacttacgctacaatctgtgcagataaacacagcgaggaccaacagcagagctaggtagcgtgagatacatttctgatatcacacgcccgttgctaaatcctcgctaaaagttgaacaaaagcagggagaccggcccgagcatgttactactagagcttttcatgaccttttcgcccagagaaatgataaaagccaactttatacaaaagggcgatttttagattgtggatgatgatatcgtcgcctcctttcttgttgcagtaagtcgcttcagcttagccttttctgcttgcttgttcgatgatcataacaacttccaaaagcaacagtatggccaagaatttcaggttgccaacaattgcaaggcaacaaagggcatgaacagttgcatgattgcaacgaagagagactaacacgaactgtatttgacagatggcacgatccaatcgatcccgcgctcttatgtgtaccttcatgttcataaacaatttcagaaggggaaattttgtccggacaagtggcacaagtaccagatggtgtggcccggtacattgaccttcaagctagcgatatgatcccaagtgtcaaattttgatatggcagctgttccatgggaaatatctagtgcgtgtgtgtggatgcaaggacggccacggcactggtcaataatgcgattgcaggtcaataggtgaaccagttttggagttctttattgcttaagctcgatcagatttcgttttcagtagagatgaagtttgtgaactcctaaaatgagccggtgtgagttgtgtggccagcgtttcgacagcagctcaaactcccccttgagaaaaagaacggtcaggtgcagggtgaaaattcagtccatgaatctaggtaatggaaatctgaaagaaacaattatcttttctcaaccaacttctgaaatatgaagaacaatcgattcgtagcatctcatttccagtacagttaacaacgtgaatagctatatatattagcagtactgatttcagtgtcgcgtacgatgcatatggctctggcgggaagaagcttctggaagcaggatagaaggttctggaagcaggatattagccgggagggaaggacgcgatcgagaggtcaggtggtcagaatagcagtcaaagcttcggctcggaaggcgccgccggagctaccacggcgcgccacgtagcacacccctccctagcccctacgccggccgcttgccaaactggtccaaaacctagctttctgcttttccgtcgtgcacgctgcggccggccaggcccggggcctcacctccgtaaatatcccgaaaaggccatggcttggctgctaggctcgtgcccgtcgcatcaacgcgtgtgcgagcgcgcggagcggctcggcgggtgattttcccttcctccctcggcggcagggcagcgccgtggatggcccgcgggtcgttaccacccaaaagcataatacgtagatgcatcataggtactggggtgccaccgcggccgccaccaccacgtagccgcagcggtccacgcaaacacgcgacgtcgcgcatttaatcgcgcgcgcgccgcacccacgcgtgcggtgctgcacggccccggatccgcgcggacggcgccgtggcggaacgccaccctcacgtgacggacgacgtagacccaccacccagccgtgaggctctcgtacgtcctgtggccggacgaacgggtggggtggcgcgcacgcgccggtggtgggcgtttgaccggacggttggcaccgtgacattgcgcggattggccgggcgtggaggtacaccggtacgtacgagtacgatctttcaccaggtttcgccgagcgtcgtagatagtagggtggtggcgcggtctcggccggccggttcgagagatgcgcgtcaccgtcctggggctggccggatgtgaagcttcgacaaggaggcggcgcgggccgatcgcctcaaggatggcagcgcactgtgggcacacatgtacacgcgcctggaccggcaggggtaccacggaactcgagaggtaccggccgccttggctggatttgtttgaaaacctggtgctcgagggctaaagatggtccaagacattattgcaaatattggttcgagtatttttcacgggggagggagtcgattttgtatttttcaaatttgtaggaacccgaataaatgatgtaaacttgatgtcatgcagcgtcacattgcttggagattcgtgctcgccaccttcttctccaccaacttagtaggggcttctttttaggggtgggagtggcaccattataacgaaaacactatcatagcattaacaaattaatgctctaagaatactgtagcgagtggactgatatagcaatcgatctagacaatcaatccattttactagggctgtgtttagatccaaactttagatccaaacttccaattttttccatcacatcaacctatcatacacacaacttttcagtcacatcgtaccaatttcaacccaaactttcaaatttggaagaaactaaacacagcctaaatcagacggtggacaacaggggcgaacatcccatcctatgcacctctacggatccatttctaggaaggggtgatcgtgcacgtaaagtcaagtgtagatttctactatactatttactacctccatcctaaaaaaaagtgcagccgtggatatccgtgcccaacgtttgatcgtccgtcttatttaaaaaatttatgaaaaaattaaaaatatttagtcacacataaagtattattcatgttttatcatctaatagcaataaaaatattaatcataaaaaaatttcaaataagacgaacggtcaaacgttgaacgtgaatagtacaaaactgcacttattttgggacggagggaatatgtgtttagcctaaacatgattagtgtaatactacctccgtttcagattataaatcgttttgaatttgatcaaagtcaagctactctaaggccgtgttcattgcaaagggttcccaacccctctccctcgtattccacacgcacgcttttcaaactgctaaacttttttgcaaaaagtttatatatgaaagctgcttaaaaaacatattaatccgtttttgaaaaaaaatagctaatacttaattaatcacgcgctaatggaccgctctgttttccgtgcggagggaatgagttcccatctcccatatccgaacgcagcctaagggtgtgttcggttgggctgtggcttttgaaaaaatagctgtgtgctgtgactttttgaaaagtagctgtgaaaaaaccaaaagctcgtttggttacacacagatggcttttgtaaaagcttctcccctaacgagtagaccccacatgtcatatacataggtatcttctccatcctcccctgacgagcatgctggcggctgacgacttcgcacgtgtgggcggctagctcggtgaggaggcagaggcagacgcgagtggggcggaggccgccgcgcacgcgcgctcgccgtcgccggagctccactacggccacctcccatgcccgccgacgacgactgaacaacgacgacttcgcacgcacgggcagctcgactggaggagcggcgacggcggcggcggcggggaggaggattagcggcgatggcgaagtgaggaggatgaggagcgacgcttgtggaagggatgggagaaaaagaaaagcaaaccgttttttttaatggcagtggtaggtaattttttcctcgaaagcatgtgaaagcaagggtagaggtgtgtttgatttgtactacaccaaaagctggctttgggaaaaaaaacagttgtagcttttaggccttggtttttggattttgcaaaagcaaaagcaggttgaaaagcccaacctaacacaccctaagtttaaataagtttgtggacaaatatactaacattacaacaccaaattagttacattgaatctataattgaatatatttttctagtatatttgtcttgtgctaaatatattactatttttttctacaaactttatcaaactagaaccattttgactttgacaaaagtcgaaatgacttaaaggtcataaattgacaaacaccatgagaaaccattaatgcgatcccagtgatctcctatgtgatgtctgcagtggaagtagagattgtagtcttcgaaccgctccagggcttgtcatcgatatgtcgaagtagctggagcggtggcacgtacaagatcatcggtttgattgcgaaggggtccattagggtggtagcgtccctctactctatgccacctcgactactcaacaagggcaaccgcacgttcttgttctagttctagtcattgtctactcaatatgcattcatgattggtcttgcgtatttgagttggcaatgactacagggagggagggattagagacatgagataggagatggtttggagttaatttacaaagataaatttatatttacaagataatctattatacttattaaaaaaacagcctaaaaagtaggagattttttaaagataaattttataataataactaggagctgccgttttattaatttggggatataaattttatacttcctccgtttcatattataagattttctagcattacgcgcacgcgcacacatacatacacacacacacacacacatatatatatatatatatatatatatatatatatatatatatataaaagattttctagcattacgcacgcgcgcgcacacatacatacacacacacacacacacacacacacatatatatatatatatatatatatatatatatatatatatatatatatatatatatatatagtaaatttgtttggtgctccatggtgcccgggcaccattgttgaaattgagtatatacctaattcaaatgagtatgaaactttttcaattacttagatattaacattagctactttactaactagttcaaagcaagtttgaactgaatttgaacttgtttttgttagattttgattctaggtatatagcatccatacatataattagttaggtatgtaatcatggattgtgaaataaagttaaatttgagttattttgttgataggtataggtatgaatcgagttattataactaggtatatactcacaatttgaaaattttgaaaaatttgagtgattttgtgtatttgataccatggtgcccgagcaccatggtgccccatatgagtgtcctatatatatatatatatatatatatatatatatatatatatatatatatatatatatatatatatatatgtgggtgcgcgcgcgcgcaatgctagaaagatgaattaatgacacacaaaaagagactgctcttcatgctatacaaatatcctatctacggtccggtcaaaaccggcctcgactcgctttgaagcacgttgggctgggagctatgctaatcgctgcacatctccagttttggacgcttccttcaaaaccatagatgaacacgcttaggaagtggacatgaaaagctgcttcttagcttcttctcgacgaatcactctcgttagcttgtcaatcgttatcgtccatgatgttgccgtattcgttcgtgtgcaggagggagcaaattcactccgaaaatgactgaagaaggatggaggcattcggtcttggattcagcatcgcttcgaatagacgcggcgaagatgatggcacgcctgggccgtgcggtccaacaggcgtccgtggtccgggccaaaccaaattattggaacacaaagccctcctcacgctgcgatcagcgagctattcagttacggcccaatcccacgtactacagctgaagagaggaccaattcccaaatcccaagtcccaagttcccaactcgatttttctcgtctcacggaattttttttcttaaaagaaggggaaagcacttgccgtgtatcaaaaattcacaatacggggaaaaaaaaacaaggcagctcgttttgggctgcctggattttgacaacagggggggtcaaggacacaaggcagcagagtcagagtcacacaaaacaaaaattaaaatggagatgcgggggatcgaaccccgtgcctctcgcatgcaaagcgagcgctctaccatttgagctacatccccttgctgtatttcgagaaaaatacaatttaaacatcctataaatgtctctgaatatgacaaagttgtgtccccgcactgattttgatctttattcgggtaggatcagcaacacagaattctcgtccggtgccggtggtggcctgcgccttgtgtaggtaaccagctctatcattttcttttcgaaatcgaaaaccaatatgaaaatggatcatacataaataggagtgaatatcataatgaatatttgtcgaaatataaaaccctctaaactgagcttttaactttttagtaagaaaacacatcttcggttcggctcagtctttagtggatggtttgtttttgatcacccctatttgactatcttaatatataggagtagtaggccctactatttgggttggaccaaattgatgtttggtaatatgggcctttacttcaaaattctaagaatttttcaggaagtttctaggcaactttcgctttcctatggatagtgcctttcatttccaagaaaaaaatcaaatttgttttcatttccaaaattttctaaaaaaaatactccgaccggcactttctgtttttaaaaataggtcaggagtctataaactttccaaatcattttcgctcctagttgtgtctatgcgagatcatcgtcagttctctttctatttggttattaccaggttgacctgacagtttacctatttgaaaggccttgcccatattactaaagtttgggcaagggcaagggtcgcggcgtcaccggacggagtttggagagttagactcaggcgaggccgagagccaacgcgatgcgaggaagaataggaaattgtctcccctgcgtccgcgtggtgtgctatgcttgtgtgtgatgcgtgcgttgcgttggtttggccggcctcagcgtaggcgcggcaaataagcagcgaagaggaagacaaccaaccaaagtcacacgcgcgctgacgcgacgcctggcgctcatttcactccttccattcttcctcctccacgtgaaactcggctattggcgttgcgtttttttaggggtgtttagatccacggtaaatttttttcccatcacatcaaacatttgaacacatgcatgtagtattaaatgttgacaaaaaaaaactaattatactgtttgcgggtaaattgcgagacgaatcttttaagtctaattgcgccatgattttgataatgtggtgctacagtaaatatttgctaataacggattaattaggcttaataaattcgtctcgtgttttacaggcggattttgtaatttattttgttattagactacgtttaatacttcaaatatgtgtcatatatccgatgtgacacgccaaaactttacacccctaaatctaaacatagccttaatagatgatgccccacgttttgctgcgggatatatgttagataatggagaaatgatgaaataatttggattgagatattatgaaaatgatttgagaatgatgatctagcatgtgtatgtttagttttagaatgaagtagattatagatataattactatatacttttatatgttgagctttgtgtgtttaatgggttagtgtggcatacttgcatataggttttaaaagtgttaataaatgcttgtatgttgaactttagatgtttagtggatattaactttatagaaataagatattaccgcaaacttctcgctatacccttgaaacggcccattaggtctttgggcctattgttctgtgggccacatcacccttccccgacataaacaatgacgaaatgtgaactggctggcagattcctgccaaatggagcgaagattccgaaccaatcgcggaagatcggaagatcccgctttgttttcttccacctcccagctctataagagcacccgcaatggtaaagtaaggtgctatctataaaacatgtacacctcagcaatagactagattaatagtaaaccacttcaatggtatgtctacatgggtatctatagctctgtaatccattgtctcgtttttctctatagactatctccatttagtagatagttttgctctctttcttcatttaatctcttccaagtaggaaaatatgctgacatggatctcttgtagagagagcttatagataaccattgtgggtgccctaactgacatactcctccacctttcgatcagcaaagccggagagcaccacaagtgtcgcggcggcagagcaccgcgaggcccatgaccgccggccgaaacaaagggagacacgcgtggctggtcgggagctatagcttttctaatcgccatgactccctctgatcacaccggcctcaccttacttcccgcgtaatcgccagcaaccccagtgggtgcatgcgtggacggactgactgattgatttgcctttgtggatttagtatttttcaacggacagctcgatatcggcgaaaccgatcgagtgattggcatcgtccttattttcgctcgctccagagtattagggatttaatggtcctcctttccgttgggattttgctgtcatgctactctttaatcactctcctccccacaaaaccgtttcaaggaaacgaaaagaaaagagaatggatcaatgggagaagagaaaaccacttttttttttctcttttcttttgctactccaacttctttaactagccacgttttcttttttaacttttttaaccacatctattttccttttcttttgctactatactacaacttctttaactagtcacatagtcgtggtttgtgtgacttttgattcaatttaagaacttaattttgtatataatttgttagtttatcttagctttcaagaaggttttgatgtaagttcatttaagtatcaattggtctagccaactatatatttagctaaattatattagattactttataaataactagaaggttcctatatatatctttttcattgtctttgcctctttctctctctccgtgtttatgtgtctaacgggagacattataaatctccgaaaattttcatatgtttagtttatttgtgtattttttttaaaaaaagtgcatgtattttgattcaatggtcgtcgtttatccaaactcttaaatatgggcggctaatatgcttttatgatatgatgcattcttatgtaaaaaagcttgttgcttacactatggctgtgtttagatccataggtataaagttttggcgtgtcacatcagatatacagacacatatttgaagtattaaacataaactaataacaaaacaaattacagaatccgcctgtaaactgcgagacaaatttattaagcctaattaatccatcattagcaaatgtttattgtagcaccatattgtcagattatggagcaattaggtttaaaagattcgtctcgcaaattacacgcaatctgtgtgattagtttttttaatatttaatactacatgcatgtgtctaaatatttgatgtgaaatggtgaaaaattatgcatagatcatcgatataaggagagagaggcctggataaaagttaatcgccgaatggcccacagttgaatgcacccatgccattctaatcgccggaaaagatatcgagattatgcatggcctacttaaatttggccaaaaagttcactgcagcccccacacaacacaactgtaagatgctgggtgcgttgcatttggacaagccaagggaaaaccaaagagttggttagctgattcatccgtgacacaaactgcaacaccaccgaataaggagcgcgagaaggacctataattaaaccgccaaccaccaggtcttgtctgctacgcgaaacttttcttttcttctttgccttttttttttatttgatctgatttgtttttaggtgatcaagcagaagcaagctgctgcgagcttttgattggaacacacgtagctcaaccgtagctttacactgatataagccatgcatctgcttctttatctaccacatggtggaggtccatccttgatttcatgtaatctattagtacgtactatcctctcctcctccattttgctttctgcaattctgctgcatgtattctgacgaacaatttgcacctttataaggctccatttcgtggcgcatgtccctgcttccacctagactgggacaccggtagagtgaaagggtgactcgatcgcagggtatcagtagttcttctgcaaatctgcaatgcacacaagtcaaatggagagtactggactagttcgagaggaatgcaactttccctctcaaaaataataagttgattttttccattttgctttttccaagtaatggtggcaacgtgacatccctcacaaggtaagataatcataaaccattttttaaggaacataattttaataagatatttaactatttataagataccattgaacccacatgttatagacacatgaaaacgcacatgtcatagactgtaagtggtaaatccttaattgtcacatcttaaaagtgacaaaaaattaaatgcttaattttaatatccatgatataaacataatcaattgcgtcgatcaaatggaaaatctttacttaccgttttcctgttctatatagcatgccacaaccgtccgaataggaaatcgtgtgattgtatcatggcatgtatcaatttgcgttgagctaatgccaagatcatatgttttcatccttatacttgtaccttcgccaacatgaaattttagtagtttattttagaaaatataatagcatcgtagcattagtcatcgatattttttccttaagtattattaatttttttacaactgggattgcttcaagatccgttcaaccctaatttatttatctaaccaccctctcctcctcaccacttctagccaacctgacttgattgccgttgtcagtctcttggtctctaccagtctctgtcaacccaatgccagccgattgccgcttcccccctccttctccacaagattcatcattgtcatctccaagtatgtcgccatccctcccccttgtcttttctcaaccatgagatgtcggatcctcaaccgctacccccaaccttctaactagaaggcctctatcactcccacagctcacttcacccgctgccctccttcgtgcctatatctctggctatcaataccttgctgcctgtccatatccgctccaaaaccactagtcttccaacacttgaccattccattaaagccattctcattggcccccatcctcttaccgtctttaatgtcaaaagcttaatccgtcaaagcctactagagtttaggcgtcactgatgttgtcaccaaaggagttcaagttatctttctacctcactcttggctagatgtgaagaagattgctaagccgaccattagatcttgatccaagggcatttatcgatagattgagatatgaggaaaatctcaattggccgaggaatatcaaaaggcaaatgttatcctaactctattgtagtagtcatggattgcaatggtcagtaatagcctcaaaataatgttggtttctaattggctagtcagacatacatgagatggttcaagatccttaggctttgatcattgagaaatagagactttgcaaataaaagcagatgattggaatttcattgctgtcaattatttacgttcccaatatgtttataatgttgcacctggtggatctttagcaagcgtgtatcatatcttaagagaatatagcatgggatagataacccataagaattatccatagtagaagatggattatagccttttttttccgagaactttatacatggggttacttacactaatgtgaatggcttatcaatgccacgacacgttgatacccccattcttttcttttgccatgcgtccgggtggaaccaatagaacgggactttgcaaattgcaaacactgaaagtaagcaggcagggcctgacctgtgtcattcttcacaacctaacttgcacctccccgactaaggaaaaaaaaacagtaaaagagctagctcatcaatgtttggtgggtcatcacttttcacacgcatatccttgttctcatggtgtaaacatatccagctggtataagaatatgatatagtgccttaaacgcatagtgggatgagctactaggggggtcatatacatagttaaatatactacaaagcacttacgactacagtaactgaatatgcatgcggtgtctgcatccatatacatttgccattggataacaatgaagctagcttctcctttccattgagctccaagtatatctaatttgacgacataccgatttagattttgaatagaccaatttcgcaccagatacatgctactttcacctttcagacactaataatctatcaatatgagataacacacacatgtcctctttatttgtatattccagtccttatctattctagctgtgcatagggaatattttccacgcaaaacccagcgcatatcccgcagtttctccaccttttctcatgtttttcttccttccttttttttttttttgtcacagcaagagtgctttagctatagtcaatggaaggccaaactaaagttatccactttgacctctgaaatcaaaacgccagctcccccaacaaccttttaactccgatgtctatctccatatgaccatatcccacgcaacaacacagagcatggtcacaaaagcaacacataaaaaaaaatccaaacgagacatgtacacattgccagatcgcatcatcactgacagggaagccataacgcacacacatgcgcatgtcctgatcagtgatcacagcacatgcatgctgctgccggccggcgaactgtcaactctcgatcgagggcgcccgccgctgatcccgccatagaaaatgacgaccgagctaacgaccgacgcgagagcccatcagctcgatcgatctgcctgcctgcctgcaggctggctggatcgatcaatcgatatatcggtacgtcggcaccaacccaacccaacccacgaggccacgatcggtggcgcgcgcggctgccaaccggggacggttgggtgatccgactcggtgcccggtaggacgcgacgctgactcagtgcaacgtgggcgtgaaggggaaaaagcaggggaaaccgcgaaagtgcgcgagaaaaaaaaaaggggggggccttggtgaccgaacgtgtgacggcgtcttccatggtcgcgcggccgcgtacgtacgtacttcttcgctcgtggtgatcgtgtagtagggggggttggacccatcgcccagtttatccatctgtttccgcgtcatccccgtcgtcagatcagcgcgagtgcgtaattgctcatgcagatgcagaaatgcttgaaaaagaaaacttggagtaatctggacacataaagttgctccgggcacattgggattattactttgctttacccatgcaccgttgcacgcatagaaagatcaatgacgcactcgacggcgaggaacagtcacagtacagtcacgccacagagcctcttaatttggttctttccctacctgattcccctgatcccctcccaaatttggtaccatgtgtccatgtcataaattatccgtatcccaaaccgtatccatgctataacatgcatgcatgtacgtgacaactggttggatgatagagtatcagtccatgcttggatgactgtacaaagctgcagtgcagtagtgggcacctcccctcccctctgcacatgcagcacagcactaggtgaggccagctccatataggaaaaaactccttttatcctgaatcccggtgggagacggtgactgttccattcaaaagtgtactggataggctccaaatctttttaatttgatccttctgaggagaaaacccttgtataaaaggcacccctcttcctcctacttgaagcacggagctcgagcaacaaccacccacgcacatcaaggagtcatctcaccactcaacgacagcctcgcacaagagcagggaggaattttcggttgttcctcgtcccaaggatcaatagatggagaaggcagcgtgcaacgagcatgtgatcgggatcccagtgagcaacagggctttcggcatcgaggagccggatttcccaagcgaaggagcagccgcctaccacgccgaggcgaaaagctctgcaaccgcgcgtacgagctccagatttggcaggacaggggacaggctcgctcaaggcatcaaagaacatggtacgttcttctccagtccatcttggaccatactacttttgatcttggatgagttcgatttttcatggttgcgaattggagaattggtactgaacaatcttttcttgatgatttgcagtgactctaggaccaaaactgtacgagaccatgaaaggcaagctgacgctgggcgcgagaatcctccaggcaggcggcgtggagaaggtcttccgccggtggttcgccgtcggcaagggcgagaagctcctgagggcctcccagtgctacctgtccaccacggccggcccgatcgccggcatgctcttcatatcgacggagaggatcgcgttccggagcgaccggtcgctggcgctgaccaccccgagcggcgacacggtgcgtgtgccgtacaaggtggccatccctctgaggagggtgaagacggccaagccgagcgagaacaagcaccggccggagcagaagtacgtccaggtggtgaccgacgacggcttcgagttctggttcatgggattcgtcagcttccaggtgaccctgaagaacctggagctggccgtcgcgcaggcgcagtgatcgatcgatctctgatgaaacaaacgtcgaagttgggtcgtcggtttcttggtcgtgtgccttgtgtgtggtctggttaatctgttgtgcatatgtggtagcgtcgtaggtgtttgtggtggattgcttggcgtttttggctttggagcaagtccggtacacatggtaggagaaattttagtgcatcaaatttcttgattggtgttggagaaaatagtgccacggcaaaagtgccatcatatacatgtggtatgtacaagatcaatgagaaatccaaaaatgtttgttcaacactacatactacagtacttcagctcatctcttcttggcttttattctagagaactggtatcgcagactataaatgatttattttgtgtgtgtgtgtgtattattggaactagctaattaatatgctgaattattggcaagactgatcgacttgatgaatcaagacctttcatctgaaactatgcgtgtataacctacttttctcaaaaaaaaataaaataaaataaaactacagcctaaaaggtataagaggaaaaaatattatgcgatctaatcatgtcagcatcactctaaaacttgttgattgcatcagtttacttccaataaaattgatcccacagctatatatctactatactatgcatgaattattggcaagagtgattaggtgcattatgtcaccgttgggcactttaattcattgaactatacttaacgagataaatatatcagaataaccggatcataataatatgaaataaaattatgaatataactcatttttaatagagaaattacgaataaaccggcatgaactcaacagggccatgctctgtgtgattggcattgccttggcttttcagaagctttattgaagagccaagctaacgtgtttagccactctcgacattgtatatctagccaccgtaactgtcaatacttaacaaccaagcaaccaactaggccagttcagttcggtgaataccatcgatcgttaatttaagtacataaaaaccattgacatcaataccttaaatatttctgttgaatatttggaaatccatgtgcagatttgtctcgtaaagtactttcataattaattttagaactttttaaacgttttgtaatggacttgatcgatgtgcagatttgtgttataattgtattggggtttttaaacgttttgtattaaaaactattggttagaattgtattttgattaccacgtcgatgtgaacttctttttaccaaagaaagtataattttagaacacaagttatagagaaacaagttggatttgtttcaccgttttaacataggtcaatccctaaatgaaattcaacacaagtcaatggaaaattttgctatagaacattcaaaatttatgtaatttgtgatagacatcacaaaaatgtgttatggttggaggaaaaaacaactaataatttagccaagtacattcagttcaaattggagatagaaattattaaaaagacagaaatgtccctagagtaacgagaatttaatctgacattgaagtaaagatgaaatatgatatctgctagcaatatactttaagtgatggttgattgagagttgcattattttttagaatcttgttttttttaaagatttcctctctccaactgttccggaaatgttctcggataaattatctgtttttttgtgttatcccatcgtgaaacttttttcgatgtccagtaccaataaattttttaagaaaagtagatatcctatagctaaaattatcgtcaatccctcttaaggattttggaagcagttgggatgggattttgaatagcacgcgaaatatgtaagtcattaatgcataattaatagagtattaattactatatagatttatttattttttaaaaaactttcatatagaagacttttgcataaaacacatcgtgtagtagtttgaaaaacattctttccaaaacaaaaaagttgtggttccctgctactctgccaaactcaacttagattctgttgggtgtgtttagttcacgctaaaattggaagtttggttgaaattggaacgatgtgatgaaaaagttgaaagtttacgtgtgtgagaaagttttgatgtgatggaaaagttagaagtttgaagaaaaagtttggatctaaactcggccatacttttaaacagaaccaaactacgatcctaagagggaatttcaggtgcaatcgcagctccagaacacctgaaattcacacccagaagaacacctgaaattcacacacagaactcggactgttctctcgtcgtatctagaaacaccacatttcgcagatgaaccgtgtggtagacattagtacactgcatgacaattgacaacaaagcatcatcattgatgttacttctcctgccatctccttaggttgtatttagatataaaatttagattcaaacttcagcccttttccattacatcaacctgtcatacacacaacttttcagtcacatcatctccaattttaaccaaaatataaactttgcgctgaactaaacgcagccttagaaaacagcaggatcgtcctgaaaacgatctcgtcggaagtgtcccccgtttctccagcgacttctccggccctgcgtgggcacgtactccgcaggaagatacgctgaagtaatccaggcgcagggacgagcccgagccccaccgccaaaatctgtttccgagcaggtagccacacgggctttccttgtcgttgtgacaacgcagcgcagcggtgcagccgtgcagcgcacgcagcgcattgcgttgtctgcgttgcacgcccgtcgcgcgcgcggacgtcgctcgcgtctgcagatccagaagcagtgaggaagcgccgggtcggcgtcgcaacggccctcctgttgccggcttaaatgcgggcgacaaggacggcgcgtgggcgcccatgcgaccgcgttgcttgccttgggcagttggcaccacagccgagcggacacgcgcgcggggggcggacggttacatgcgcgcgttaggtgaggtcggggccttgctgagtcggtgctgcgtgggatgtgaccaagacgtctgggcttggtttggtagggaaccttgaagttgaagaagcagtgcacagcacagcacagtcgtttttgcctctgcttcctccacatcgatcaatcacctgttcgccgtggatcccgtgcggccgctatctcggggaacaattctcgtgcacgccacagtgtgtgttcattcgagccataacgtctcggtgcaatgcacgaagaacgtagctatacaagtggccttgcaaagtacgagtaacctagcatcggctcggcgcagtggggcccctttcgtagctcccgacacaataccggcccctttttttcccggggatccggtgcgtgcaggaatgtgcaggcacatggggcgcttctcggaaagcggcagccggcgggcatggccatctggccgtctcgataccatagagaaatctcgaatctcgctttcgagcaatgaatataccacacctggccttcacatggaaggtggggctacctccaaaagctccatttctagccaggccgaatggccgagcggatgacgcggccactcacgaaacgagcagctgcaagcctgcaaccagcaggcagcaagaggagggtctacgccttctttacgcgaacgtggacctcgcctttctgatccaccggtgactcggccggcccggttgctgactccgcaaatccactgcgcgcctttgcgaaaaggatccaccaccccgccgcgacgcctatataggccgctctccgtggctgcactccggtaccaatccacttttccttccacgctaaggcaaacagcgcaacgcagcacacaacacaagcactagctgctcgatctcgtgaggctcgtagtaagcacactagctgcagatcgagcgaacagccatgaggaagtcaagcatcaacggcgtccatgtcatcggagtcccggtgaccgccaaggcgtttggcatagaggaggaggtgtcgttggccaggggccagtcgttcaggaaggccgacggcgatcaccttgcggtctcgttgtcgcaccccagcccttatacgtctttcggctataagcacagtaagtatatatattggtcacgatcacatcaaaaccgtcagatcaatttctgatgcacgcaagacatgtggtttctaatgtttatggtgatccttgtatctctgcaggcagcaagggtcaggttatccactgggtgagcaagctgagcagaagggcacagggcttcagggagcatggtgagttagcgttcatgcatgcatgtttaattcgccataaaaaaaaacttgttgatcattaggacttaagtgatgaacgccgtgtcctgatatatatccatcaccgtgtgtaacgtgcagtgaccttggggccaaagctgtcggagacggtgaaggggaagctgagcctgggcgcgaaaatcctgcaggccggcgggatcgagcgcgtgttccggaaggcgttctcggcggagaaaggcgagcggctggtgaaggcgctgcagtgctacctgtacaccaccggcgggcccatcgccgggatgctcttcgtctccaccaagaaggtcgccttccgcagcgaccggccggtcacggtcacctcggccaagggcgacgtcgcgcgggtgccctacaaggtggtggtcccgctcaggaggatcgcccaggtgcggccgagcgagaatgccgacaagccggaggagaagtacatccacgtcgtcacggtggacggcttcgagttctggttcatggggttcgtgagctaccagaggtcgtgcaagtacatgcagcaagccatctcggagctgcaatgactagtgcgcgtgcatgttggtggtctggtggtgatcgcgaggtccactattgtttgttccgtcggcacgatgagaagagaagttatgggctgctgcgccgtcttttgttgcgaggcagccctggctgaagttgctcgatcttatttcgggttcttccgcgtacgatttggattgacattatgtgtgttctttcaaatactagtagctagtattttgtacgatgggccgcgaaaattaaccatgacccgtgttgatgaatggaaaattttaagttgttcagatccttctcgagaatttcctagaggccctgattgttggtttaaatttttaagcagatatcgcggactatttctttattatagaatgaattaaatatttatttaaaataaacttagtagatagcttaaggcaaattgtataattaatgcagtactactccatactcataaagaaagtcgtttagaacaatgtttaagtcaaaccttgggaatataaatcatgaataattctcaagttgttgagtttgaaaaaatataaaaattatatgtatagatttgtcttgaaaaatactttcataaaagtatacatatatcacttttcaataaatatttttatagaaataagaagtcaaagttgtgttttggagatcgtgtcgctgtcctaaacgacttcctttacgagtatggaggaagtacttctttgaaaaaattctctaaaccttaaagcacatataaactcacatcttaaaagaacagggccggtacgaagagaacttctcatagtcagcctagtctgtttaacgttaccgtctttatatctgattttgagagttaggggaacgggttatatctgattttgcggttgagggattcgattcaaccaggggcatgagttaagggagacaaaatagacttatttctaccagacgaggccgtttaaaccgatggagatatggcctgtaatttgctccgttgacccgtctgtatggactgggccggaacagatttttatctttaaggcccgaaagcatctaatcgtaccgacccatcgcggcgttcatatggacctgtttttgaacgggtctcgtctaccgccgccacctactcgcgcgcccgggcggcgtggcattggctgcctctggggcgttagcggcgagctaccgcccaccgcagataaatagaactcatggaaacgcacgtaatcaagcggacaagctgttggtgtactgacggtaatgcctcgttgcctcgtacgaatacggcgtttcgcgaaactgatcggcgtcgatccgtgtcctgatcgatgaagcctttgtgagcttggacattggctggaggacggatccaaattaggttggttgggaagcaatctggcaggatatacacggctacgttgcaggcgcacgcggtgggtcttatgacggattaactgcttgtacgtggtcacctggagtaacaccatcactggattttcttctcggtgtgttgctgaagtatgcaagtaggtccgtgtgtcacgctctcgcggctcgtctctacgagagtagtaacgtcgtcattttacattatggaatgtgaactggatctaggcaacgtcgatcgtttgcaggtccaatatgagttttgaaaacaagctagtactattgagaatctgtgcaccttgttttgcttcagagaataaatggagcctttgactgattctagtcaaggtggttttatgcgaggtcattcatgggtttcattgaacaggttagcaggagtaatgtttctccccctctctctagaacagggatatggtagtgtttagttcccttcaaacttttaaaaattccgtcacattaaatgattggacacatgtatgaaatattaaatgtggacgaaaaaaaccaattgcgcagtttgcatgtaagttacgagacgaatctttttagcctaattacgccatgatttgacaatgtgatgctacaataaacatttactaatgacggattaattaggcttaataaattcgtctcgctgtttacaggcggaatatgtaatttattttgttatttgtctatgtttaatactttaaatacgtgtccatatactttaaaaaattttagcacacgaactaaacacggccataggctatagagcactccagttctcgagtagtgtactaatgtcactagtcaatattttcatcattgtcgagttcattgcaaaagtgtctccaaaaataagtactcatgcagattaattctaatactactcttgtctctgatactccctccgtcccaaaataagtgtagttttacactgtttatgtctaatgtttgaccgttcgttttatttgaaaattttttacgattaatatttttattgttattagatgataaaacatgaatagtattttatgtgtgactaactttttttaattttctcataaatttttcaaataagacagacggtcaaacgttggacacggattcctacggctacacttattttggaacggagatagtacataatattatgaatgtgtgaatgtgtctcattcgattaaaatattatatattttgggacaggaaaatagtactactagagtctagagaaccctgatttgcatgatcattcttttgtttatagatagtactagcaacctttttttttttccttacgataaggttgggaacgtgtcaatcaaaatcaagagactgtgtaatcctgtcatatgagcaaggttaatagtatcgcttactaccagctactcaaaccctaatattagtccactatcacatcatcttgttttttagattgtatagaggttgctctttacatgagtggcttattctctctctcctaacttctcttattcacctcattatctaattctatatgataaatttaaagataatatgtagagatttacgtggttttttaattcacctcatcatctacttgcgcttataccttttctccgccaactgatcggtgcagcttatgtggttttttaatcgctggtgcagcgccgcacctgctgtgatcctattgcacctgctgtaaggagtttagtagtacgtactactgccggtgaatcctatatatttataaagtttatccccaataagtatagttaatgctaattatctcttttttcatgaagccacacatcacctcaattatttttagcctttagataattcatcaagggtgtaaattgcatctccccttgacggagcgtggggctcctcaccgggagaccgcgcaggcccccctttgccggttcggccgggggccctggatgagattctaagctcctagtctgtgtgtggaaggttcgcgagaaaggaaacacacaagacacgggcgatgtatacaggttcgggccgctgagaagcgtaataccctactcctgtgtttttgtggatctatgtatgaagaagctacaaaaaagctggagaaccagagagctcttactctctccctctctggtcgttctggatccgaaaaaaataaatcccccatctaagtgggcaaggtcctccttttatacctcaaggggataccacatgcaccatctctctcttttttgtggggacttatcctatcttttcataaacagacggagacttgtatggttgccgtccgaatgaccttctgatgggacggcccatacctacctccacttccgccggaagcaggcgcgacgtgggaacatggctgt

SEQ ID NO: 66942 - DNA, 2306 bp, Oryza sativa
agtagttcatcacaaatataatataaaaatatattcaatagtggatttaatgaaactaatttggtgttgtagatgtgtgctacattttttctacaaacttggtcaaaactgaagtgagacttatgacaaacccaaaatgtcttgtgataaggaacggagagaatagtgtgctaacacaatagcctttaacatgaaaggtagctgaaaattgatcttacttgattccccattttttatcaagctcatgtttcattgcttttgtaacacagaaggcaccatcagccatccgtccaaaatgcttctcgaacctagaacggaaagaacacaccactgtattaacacaagcgatcagtatgctatatctagcagataaacaaacaggacaaggaattaccagaagtagattttaactatgatatggcttctgccatgagacaacccgagcagtgtatatccaaagttatgccaatccacaatagacttagcacctcttagcccgctagccagttttacagcagccaatgttggaacagagggtggattctgtcagacagaagatgagatgatcaaataaaagaaatcagttccattccaattgtacgacacgatcagtcacgtatgaggttttctaattaacaaataaattataagtatcatacagaaggatctataggttatataaatctatcagttaatacggcctacaaaacgatgagactttgactaagtacaggctgcacatatcttagctgaaatgttgaattgaaaatggtgtcatgcagcatgacttgctaactaagctgggaaatactttgctaacaccatggttttactacaatgattgatgaatgatgaatcataaaagaattccacactactgaaagtgatagtgattgtagaaaaatacatattgtccatgtaattctgaaccatgcatgcaaaactgcaaataaagaagctcaatgcaattttgtgataactgacctgaacaatgaagacatcagggcgaggaatcttgaaacaaaggtaccaaatcaatatgataaactggatggcggctttaagtagcattgacagggcaccagatatctttgatattcctgttaactgcactgatttctagaaggtacaatttgtaagtactgatagtaggcaaaattagagaacagccaacagcataatgctttcgcacaatcagtaccatttcgtggatgtgaatcaatggattttctctcaataatagatgtgggtcacttcctgctcatttacccaaagcagaacataggtcaaatttcaacaacagaaggtcgaaagctgttggaaattcagcctgtctgtgtgccctatgtggtatagttaggtataaataacttcgagttacaatgctggagtaaaatccaaaagtacaatggaactttgaaaagagcaatacctccatttgcaacaatgtccacttccataccaccctgtcaagaaaaataaagaacgactaataaactaaaacatagacatatgctggcacatagagttggctgtttcacaacataaagcatgttccaatttcccaatttttttgccacttgaaggaaaaatgcttagtaaatgcaaggcaattttcttctattcacttcaaagtctgtcttatctaacaggattaatatttgcacgtgcaatcacactttcagggataaaaaagcacatttttaagggagcaaaaaactgacggcattaatcaaagcgaaactatgtcagctcacactttcaggggggcaaatgaccaccactacgttagttcatcggtgcactggcacaactgagacgtaccacatctccttcctttccttgttattaccatgctatataacctaggaccaaaggcttctctagagtagagtatagatggccaaaaggcccgaggcccgacggcccggcccatggcacgatattttggcctggcccaagcacggcacggcccgacggaggtcgggcccgtgccggcccagcccgaccactgggccgtgcctgggcccctccaccggcacgttggcccggcacggcacggccgggccggcccggcacgatgggccggcagctaggcccgatacacaaaaaaaaataggggagtaaaaatagacattatatgccatgaacgaaagaatagggatctaaaatagactttttttatctatacatatgtcagccaaagaggagggacagaaaatagacttattttagctatacatatgtcagcccaaagagaagggacggaaaatagactattttagctatacatatgaaatagccca

SEQ ID NO: 66943 - DNA, 2118 bp, Oryza sativa
tgtgtgtgtctgcgttcgtgtgagcgagcgagcggagctaatgaatgttgtttgtttcttgttatatcaagaggtggggctcttttgcaggtccggccgtcgtggaaagcggaattccaactctcttcttcctttcagccttatttcatcgggaaatttaaatatttgtcactgttaggtttgccaattatccaaatatccctcttacatttgcccttattttttcccctctaaagtggtggctttttaactatttgccacgtttgcccatgtagcatgccaacgtggcaacccggtataaagatcaacgtgggacccacttgttagtctcataactcccctttcctctcttcatccggtgtggccaaccctaccaacagccaaagcgccgccccacctaggtcgcacccccacgattaactccaccccttctcgtctcttcctttggtggtaactgccatcactgccgacgacgacgacgacgccgacaccaaattcccaaaccctagcttcaccctcggccttgccgccgcaagccgccatggcggagaccatcgacgacaaggtcatctacttccaggcggtcaccggcatctccgaccacagcctctgcaccgagatcctcgctgcccacgactgggacctccagctcgtcgtctcctccatcaccgccaacccctcctcccttgacccggcccccatcgccgagggaggcggatttggtcacgccacacccgtctccgcctccgccttcgcagcagcagcccaggattgcgtggaaactgatgacgcttccattctatgtggtctctggtggggttgggctcatcgtcagttcgatctgtctcgttgcctgggttgccgaagccatagctggggaagcacggcgacgccaagcgcatcttcttctctagcgacagcaccattggaggagtgggcagcactcggctataagcggggttggccgcacggaggaacaaaggaaggggggcctgtgagactcacaggtgggtcccacattgatttttacactggggtgccacattggcatgccgcatgaataaaagtggcacacagttaagccaccatcttagaggggcaaaaaaaaataaaggcaaatctaagaggggcaaatagttaaatttccctatttcaaccatcagtgttcgtgtcttgtactgattgttgggttgaaaatatttattgattaattttatgtctcaagataatttaatttatacatataatcaagctataatatgtggcaataatccactcaatgttctaaatcatacgggttactaagcaagggctaattagactgctactagttattttggttaagatattgttgtttctatgtgattcgataatgtgtgttacctttttttcaattcattcataaagctaaaaaatagttaaaacaaaagaaaaaagaatattttagcatggtcttatttttaattagaaagcttcccccctgagcggttgaaagagaagagtgaagtggagaggccagatacaacggtagctaggtgtaattgaggcacaatgagaagattggcaaagccacagccatagctggtacaagaagcagatgaaaggtggtgatggccagccaagaaacactgaagagggttaaatgacatttctttaaagtgtgggtcggatttaggtggaaggcatcgggaggaaagtggtgcaaggacgtgttgtgatcagagaagaccccattagagacaagctagcaaaggaggaggcccggatgtgctcccttcgttttatattttaagttgctttgattttttttatattcttttttgttttacagggtttataaaaaggatagcaatatttcctatacaaaacaaacatattatcaaaatatgttcaatgttatatttaataaaattaatttggtgttatagatgctgctaaatttctctaaagacttagtcaaacctaaagaaattagggtaaaaaaaaaaggcaaagcaacttataatataattcagagggagtattcaagttagttcagtcttttggggtgtacaattcaggatttggaatccatttagagtaggtttaatagttagctataagggaactataaatata

SEQ ID NO: 66944 - DNA, 2987 bp, Oryza sativa
gttcgatttcatcttgctcatttatctcattttggacttccaacaaatgcagccaatgctacagcaggttcatcgatttcctgctctactggttccgtgtatcaatgccaagaaatgtatgtatacttcacacagttactaataattactattatcaatccctcttcatgatgcgaatgctttatgataatattaatcaattcctcttctttaaatagtcatatgtgataggtcccctgtattctgaagccacaccatttctgaaacttaacatgtcttacagaaattgttctagaactttcctgtgttccaaaccaactttgttgaatggtgttctaattatttggatggtcaattttgcaacatatctctaaactatacatggaattaatacttggtttgttcgactgcttagttttgctgcacatatattctatagttgctttcatgatctaatcctggactcctattctaaccactggacccttgttgctttctaatatcctgagtagaacaacatataaatgtttcatttaacaatagtaagctcatgaacctgtaaaaatctttgatcgccgctacactgcttcatttattcatagatcataccagtcttctaatattgatggtgatgttctgttccagctccttccacctgatgctgctaacagggagagctgctggtatggtttcatgtgccgaacccagcaccaccggcctgaccatgctaagaagctcaaccatgtctgtcgtccaacaagaggcaacccctagcctgcctcgttctctgaaaaaaatcatctattttcagtgttcaacagcagcattgtacagcaaagagcaagtgccataggctctggtttctcagtgtttaacagctctgtttgattagtaggaatgattgtcaggtacatcaaccagtttcaaatgcctaaactgatacaacctgtttatcttaatctctcctattgcaaccttccatacttatgtttttgcaatgcaacctcacatgctttcaagttgctatttttcgcccatctgcgagtgtttgaacagagggagcagaagagttcttctgaaagagaaaaatgcaactaggcaaggcctggctggcttgaaagcttgatagatacaagaaccagcacatatatatatcctgttaattaattaatcttgaccagtgcctgaaaacgaaagcgcattgcacttgcactgcatggacacaagctgttgctgtgacggcagctctgtcggcaggtcaggggatatgcatataggagcattcatatctgcaaggcactccctccgtatcaaaatataaacactttaaattatttaacaaatactaaaattaagaaaaaaacaattccttccagtaacattagtggttaatttttttaaattttaattgcttagattcctctctcaaacatctgattggctggaaatatatggatttctgtgtattgttccgtgcctagaaatacttatattatggtacaaattctaaacaaatgcttatattcttgggacggagggtgtgtataattcagttctatatatgcctcgctttcacacgcatgagaccaatgttttctcattgccattgcaagattgataggaaaaggatggcgatggcgacgtgttcatgcaacttcaacccatctcgccgtccttgtcggcgatttccccagaatttgttatcacgtcgtcctcaggttactgcagagtttcaatcagtcagcatcatcgacacatgatcaccatctttgacactgcaaatcagccgcaattatatatccgttttgtgtgaggatgttttcatttggtccagtcatgttgagtatcttttgaggtagcatacggcttcttttggcttatggtacatatagatgtgacaattttttttgaggcaaaatgggaattttgttaagcaaaaatgagaaaaaaaaatctggcctctgcatctgccaggaatgtgctaacatgcttagtgcagatttagggtctgtgtccatcaagctttggctaatcttatcctggtgtttgcttgccttttgcaaaaattgatctaccttttaaacttattaaaaactgctgtttatatatgttagtactacatgtaaagctagctagctagctagctgatgctgcatatatattgatacagtaatatacagtaactctattagttttagcagcagcagcacagaaagcaagggaaaagggaaagggcaaacagttgggaatcatggacagggccagctctccatgccacagtgccgaaaaaaaaagtccccaaaaaaatgtatatgcacagttgttctggaatgaaatggagattaatttcattattttgtctgaaggaattgggcgttgtattttttggaattttgttggagcactattggaaggcatggaagaattaattgtgactgtggctttatcagcatcaccgtggcgattggttaaaattgcagaccggatacttaacgcgttagcaacaacactgtacacacaagttgagtggcagtatccctcacctacgctaggtcgctatcaccacttagatatctctaatcccacttgttctcctagctttcgtctctcagtatcagtgcgtcgtcttagcaaagagttatggatataaatatctagcttaacgcagcaaatgaaccgttagatttgtctcaagattctcacgtgactatgatgtatgtgctaacatgacggacaacgattgatatagaaatgccccatatctgttaactttgtattagctcgaccatggcgcccctcttcttgttttttttttaaaaaaaatattattaccatatcattttttcctcctgtgttactctcttcttaattaattagtcttgacaatatgataggaacatgtattttttttaagataatgagaaaaagattctagcttttgcttcatcaaaaggtagagccaaattattacagactttgcagcgcat

SEQ ID NO: 66945 - DNA, 2172 bp, Oryza sativa
caccaacaacagctgccaccacaagaatcagcacacagttagctaccacgcacatgcagccagcgcgccaccgctcaccggagctatcagaagacggaggaggaggacggcggcaacggcggcgcgggcgcacgtgcgtggcacgcgcgggtgtgggggtggagaggtgtggggctaggaggagaaagagaaagagagaggtgagaggaggaagagagggatggaggtgtgtgtgtggggttggtaggttttggggtttttgattagggctttcttctcttataatcccctcattttgggtcagatttaggagggtttaattggtatatggtattgccttgctggtgatatgatccttgcatgtggttaactaaggaagtttattaatggacagctaattcggtgattacatttagctggcgtatatttgagattcgtggttgagttgggttagtgtgaatgcgttcctggcgataaattttgggaaggttattatgttttccttggtattgttcatttatttctatatctaacattcctgacaattaatcctacctattttattttttcctaagatcgagatattttatccttgttcatcttacttagaaatagtcacgtgaaagaattgttgactcccctcactctagatgtcaaattctcatgtgacaacaacctctccactttgctaacattgttcgtactacattagttacatgttgtgatatctacttatatatatatcgttttctaaccctcgaagacttcaaaattgtaatcccgtaatcccctttagcagtgtattatgttgaaaagtacatatagcaaacgacttcataattgatcgatcgatgacacatgtagtgattattacaccgagaactcttcttttagcaaaaggcaatggattttacagataggttaattatagaccatgatttccatatggttgttcatcccaatgtagcaacaaaatttaatagtatcaactaacataaaaattttaccacaatctagaattccaagtaacatcatcactaagtatgtgatactgataggacttccatatactttcaaaccttggagagctggttgctcaatctctggtttctcttttgcccagctttctagggttcttagatctttaatcatttggagaagagaggagctacatatctagtagcttcaaattctctctagagtgagctaagatagctgtggcatgtgaggggttggatggatggagtgtacgtgtagcagctaggccactcgtgggtcctcggaatgatgaacccaaagggcaagcaaagagggacagtagagcgtcacccttttccctttgtgctaagacacaagctgagaaatattagaaagcacccacacattgccctcatctttgttgctccgatcctcacggaggcgaaaaaaggtgtcggattttttttttgaaaaaaaattgtaaaatggtttgcaacaagaaagtaaagataaatttatgagcatgaataagatttaggggatgatgttggtcaaagatgcacgcaatagctagaactcttgcatagaacaagctctaataataaatagccatcccgtcttattcatgtgagatttataggacacattactgtaacatgaataggtagtcaatgggtgttcatagtactcaagcatgcaaattcaagacttggactagaagtaataatgattgagttacaatttacatgtgtgttgtaaacttgcttttatgcaacacgactggtagtactattatatatataaagtgaagcaaggtgctgttagtgtttgtgtgaacgtatattcgtaagagtatgtaatagaatatcttgtccttggggttcccatgctccgaatccatacagaagtgcgaaattggttataacaattaaaagaaggactaaatattttattctaaaaaaataccatccctttgttgctttctatttatttttttcacaccttttgcatataatttattctatgccacagagaaatacaaacttgttcatatttatcactattcgctaacgtttcacaaaattttgagattgccatgcatgcctagtcctctcctttctcaatgtaatgacgtagcttatggtctgtcatttcttacctcactaagtctttctcccattgatgaacatgatt

SEQ ID NO: 66946 - DNA, 2480 bp, Oryza sativa
ttcatggagtaaggatgcatctggagtgtgtgaacttgacatcaattaattagtagggcttggtattatgtgcatgcatccctcttgcaacaccagtgtgatgtgatgaggtcctctatggtgttggctagcacagaatgataatgtacttgaccctctatccactatgaaatttggatttcttacccacctttgaatgtttgatagttcatgatgtatatcttgtcctatacatgatttggctattgctcattaaatttgcactagaatgagattagattatcaatttttccttaatttgtttctacttgttgatttatacgagtcatattttttatagaaaatgttctcagatagtactcaattaattgtttcataatgttcagacgatatcatttttaaaaccatcgtaaacacactaccatactcttatatcattgataatacagaataacgacataccgggtatatattctcgttggcatgggttatactaatttttttttgccatgggtagaataacggggccgtgaagccaaggggagacattgcaggtgcggggtgtcagaggggagcatctaatgctgctgacagctcatcccaacagcaccaaccaggtctcttcactcactcacacaaacagtaagtctcactctctcttatctcacacacagacacacagagagagagagagaaagatgagccaacagtggtatacagtgctactcctgtcctctccatttccaagaaaaacaacgatcaaccatccatcatcatagattaattaattaatcaatcacaggacgatccagtagtagttgatgatcctagctagatactagtactcctccagctagctagtgtgtctctcctagtagctggtacagccaataaaacgctaaagaatgaccccggtgtacgtttgccatgcagctggccaatttgctcctcagtgctccaacatcttttgtttttccctttttcttcagtttagacactactccctccgttcccaacaaaatccaacctagtttagagatgagatattatctagtccaacgaatctgaacaaacctatatccaaattcgttggactaggtaatatcccatatttaattaggttggttttttttagatatttaactatttgccactcttacaagtgacaattagggatttaccactagggctatatatcatagacatatgaagactcacatgttatagactgtgagtagcaaatccttaattgttacatcttaaaagtggcaaaaagtaaaatgccatgttttaatgagggagtacccctctctgccatgtattttctccatctaaaaagagtttaattctaactataaattcgaataacatagattttatgggacggcgggtgtagatctctatagttaatctactaccaatagtttgcataaatgatactttctccatttcatattataagtcactttgtttttaagtcaaacttctataagatcgaacaagtttatagaaaaatatagtgactctaataacaccaaattagtcctactaaacctaacattaaatatctataaacttagtcaaacttaaaaagtttgacttagagaaaaataaacatcttataatatgaaatataatgagttagtgaaattctaacattaaatatcctatagagattttcgataaaagttagcgaaattctaacctcttgaaaaaattccttatatctctcttattcgaatcatgtgttttttatgtctatttaaatgagcattttctatattatctatatgttttataatcctttgttttacagttatattcgctttcttcgttttttttctaatccttctattcaaatgagcccttaggaaggcatatctagattatatgctaacagtactacagttcttaaaaagcaaagatactgttcctttttaaaaagaatagagttccatggaatatcttgagctatctagctagctaagagtgtagctagtttgacatacatgtgaggtgtgagatagagaacaggcgtcgtgcatagttgcagcctagcttaattagctccatcaaccattcatgtagggtactcatcatatattaaccgtttgaggataaaacggagaagaataatgatcatatataaaacgaacaacaaaaagaaaaatgcatcagcctatatactttcttgatttattaattcaatccatgtgcatcccatctattgcaaaaactgcttgaagagatccaagatattttttggaatatgaagaattttctggggcttctagatttaggatggaaagaaccttcttttaattttacgacataagaaactttatgtagaacacgcccctcataaagaaacgaaaccataacatgaaacacaaatgtcgatgaagaaataaagccaaaatacgataacgaaatgagctgaaatcaagcaaaaaaaaattttttttacaaagacgccatag

SEQ ID NO: 66947 - DNA, 646 bp, Oryza sativa
ttttaccctagaaaaaaaaagaaaaacctaaccctttgaatcttaggtatccttcaaatcttcggtattcttcgagtcttcggtacgcttcgaatccttatggggaagtctataaattatacgccccttgcttgaatcataatgacttacttcaattttgaccctatcccccatcagtattcgtatagaactagaccggatctttcctgaaatatagcccaggatgatggtgtcattctctaggcgaacgcgaaacattccgttgggtagggcttccataactaaaccctcgaaagtaatttttgcttctctcgggttttttttttctctcctatttttcttttctgccatatttttttctcctatttttctttttttattttcaaataaaaaaacgttgtatttttgtttgaaaaataggaagttcaagatagaattggggtactataactataggtggggcgattaccgctataggcggggcgattaccatatataacataagacttctcccccaattctgtttagtcgagcttctcgatctgtcattatacctcgagaagtagaaagaatagcaattcccattccgcccaaaaccttaagaattccttgatagttggtataaattcgtaagccaggtcggctg

SEQ ID NO: 66948 - DNA, 15955 bp, Oryza sativa
tatatccatgcatcaggatttgtgattctgatagcagaatcacaagtgaagtagcatacaacatgaagaatatcatcgagtaaataactcttaaaataggctataacctataagagctcatttaacactactatagtcaaagttctactagcaggaatttcaagcaatcctgtcctttggaaataaacatttgaggcagtccttcactaaagaaggaaagatcgggaacaacagaaaagatgggccagtgttcaaggtgttacctctaacgttttggaatcacactcattaggcttatattgcttctcgtcatgctctacaggtaagagagaatgctgaattggctgtattggatcattatatgtaactcgattctctaataagttcaccacgctcttgagctcagtcactagcatctcaagtttgtcgtttgtcatcttcattagatctttcaattctggatccgttgttccttcagtctgatagtgaccatgtataattgatagtattagaaagaggatgattgctacagaaatagcggggaggggtaaagcttgttttgtagagtacatattttttttaaaaggaacatatagctctagtttgttgaatttctagtattgacttgaacactagataaatgaaatgtagctagagatcttcatatgcatccagctcaatattaatctgacgattttctaaaggcacacttttgcaccatgaggtgaatcttttgtctgctcatatactatcatactctaatgggatactatccaagccctggcttagtttatctataaaaaaaaaatgtgattcgatagctagcatagttcagataataataaatgagaagttgagaacaaaggaaatatgtttgaagctagctcctcatgtcttaattctatgagttatctataatgcagggatttcagtaccagaaatgtactccctacatttcaaaatatagggtgtattttattttgttatattataatagagtatgttagtcaaagccttgtcctaacgaaaacaaaatacaccctatattttgaaattgagggagcccaagcattcctatatctccagttcccatcatttctatgtcagaattttggtggttctgtattcgtttgagcagttgcaattgataaaataattcagatgaaagatcaccttgtaatccaatacattatatggaggaagaaagctcatctgtggtgctccagatattgatagcagctgggggaagagataaaatcttaagggcttagaaggttgagcctgagctttctgtgcctttctagcttgcttttccctttcagtgtcagccaacttaacaaccaaagtcgcacttgaaccctaagtggatgtcgtgaagttgttagaaaattcagtaaagttgcattccttgtttcttcagtaaagatcaatttgctatgttgtttgcaggaacaaaaccaatgttgcaggctggagagctctacacagaagattcagataggagaaggcttacattgaacacaacacgtgtgccattcaaagcttcaatggccgctctagcatgttctttgcttccaaattccaggatagcacaggctgcagcttttttgtttataacaaatcaaggatgtgagcactaaaaccattcatagtatttcagataacaaaaacgagacgatctgtaagttctactaccttttcttgttttctgtggacttctcagtaccttcagttgtctaatatttccgtactgcgaaaacaatgcagaaacttcattctccttcacatcccttggaagcatgccaatgaaaagcttctgctctgcggctgcgagtcaggcagcaaccgtttcagagtacaacatcagcagggttgcaagagtgtcacaagaagaacaatgtcccaagttatttaggaattaggaccaattcttctttgattaggaatcatcagtaccaaatacattgtattgggaaattatacctaatcgttccagctcgccgtccgcgtattttacctgcattgccctggacgcctgattgaggcgacaggaacagaatttgtgttatcagaactacagaattgacaatcatagagcacatatcatctcatcgaatgtagaaaagtgttagtatatttaatccagtcctactttgcatcgccatgatatagagaccgaggtatttattccattatctaaaagaatcataattttggtatctattgcatatatgaaactaggatctagaagttatactacatcaaatccaattcaattagcctgcgtaaaattgcgtaggggaggttgtcttatcagaactacagaattgacaatcatagagcccatatcttgtcattggatttcctttttgataaataatctcagtgaaaacgagctttttcctgtctgattctacacaaatcactaggaaccaaaaagaacatccttttccaatctccatgaactgttcctgtctccatccccatcttcagaaaaaaaaatcaccaaatcaatcatggatagaaagatacttgcattgccctggatgcctgattaaggagacaggaacaacatttctcttatgagaacaatctcattgaaatttgacacatattatctcattgaaatttctttttgataaatatagtctcaatgaaaatgaacaatccctatatctgattccacaccaatcatgcacgaggcacatctttagtcacaaaaagggaaaataaaaatcctttacaatctccttttccatccccgattccagacaagaattcaccaaatcaatcaatcaatcatgaacagaaatcatgatttttgttgcccccaccccaaattgtatccaatcttgcaggtgaatgcaagtgaagaacttactcctgggagggtgcacttgttgtggtacgcggcgatggccttgtctgcctcctccctcgacgagcacaccacgaagcagcaacctgcaagaacccaaataaattccaaattttcatcatcttcttcttctgcttctcacacacgggcaagagcaaatcaatggctcaccgcgggaggcgccggtggcgcggtcgcggatgacggtggcgtcgtcggcgcgtgcggcggcgcggaccacggcgaggatgtcctcctccgccatgctgcgtggcacctggccgacgaacagccgcaccctctcgccgccatcctccccatctccggccatcgccgccgcgatctgtgtctctctctctcacgtttctttccttttctgatggcgcctgtccgtcctctcctcgttcttgcctgcgcctttttgctatctctgacgacgagcactaaccactgactgattgtttgattgattgatcagtatcagggtctcgatgagtacaagttaattaatcgatgagtagtaccaccaagatcttgatctcgagtaggagtaaatgtgatcgaatcatcatctgattgagcgaaaagcagcagcattgaatgagcagtttggtcgagatggagtgacgtcgcgagcgatggtttgctttgatctttctttctggtcttgctcgcctttttttctttctttttctgctgcagccttttgcattggcagtttctctcctttcatttgcttgaggagaagcacagagaaggaaagagtgaggcgaggaggaggaggagatggttttggacggaagctgcagttcgtgcaagtttggcattagagctcagagactctcacatggcgggaccaaggctcgttttttttttcttcacgacaaattgagataataatggttattagaattaaaagggattttaatttcgtcgaagggcatttggtctagtggtatgattctcgctttgggtgcgagaggtcccgagttcgattctcggaatgccccttaatttactttttttttttttgtttttctgagcatgcatttcctgaagttttttttattccttttcttccatgcattcattccttttcttttttcctttgttctttttgcatgcatttgttgaacactaatcatcatcttccttcttccttttttctgagcatgcatttcctgaagtttcttttccttcttccatgcattccttttcttttttttccctttttttctttatgcatatgcatttgttgaacattaatcatcaactttccttctgctggttcatccttcgggcaaattagcatttcctttctttcttgacactgtataattgatggctagttctctcccaccatatccatatgatttaatatcctactttaattatacaataatggcacccacaatggttatccataggctctctaccagagatacatgtcagcatattttcctacttgaaagagattaaatgaagagagagagcaaagctatctattaacctggagataatctatagagaaaaacgaggcaatggattagagagctatagatacccatgtagacataccattgaagtggtttactattaatctagtctattgctgagatgtacatgttttatagatagcaccttactttaccattgcgggtgctctagtagctccgcaaatcccactttaatatccttcaatgatttcacctttcctcctcttcccctattacatctttcaccagcaccaaaccctagcagacgttctctagtacttcctccgtttcacaatgtaagtcattctagcatttcccacgttcatattcattaatatcaatatgaacgtgggaaatgctagaatgatttatattgtgaaacggaggggtactatttcctcaaatcttgttccacagccctaccgagctaggtcacatgcaaacatcgtcatgtgcataatgtcttcagtcttcacatcatcatggcctcatggggcattaggacagccttattgccaacatgtctattggcaagaatgccactgaaaatatcagattaagcttccatagtttgtcccaaaaatgcttgtgtcttttgcattttttcaaaagccgggtaatataatgaaaattggcaaatattgctactgtggacgaagcagacagtctgacccctccccttcacgtcgcaccactcaaatatgaatatcatgctgcagtgagctgaagatcactctggattattctcacatgtggatgcatgtaaagcatgcaaaaccttcagatttcagactagacagcgcatcagatttcaatcagagcatgtgtttcgctatgcaacctgtacgttcagaacttcagactcttgagtgacagcattcagatttcattagaggcagcaagcgtttcactaatcactatccgagttttgcgttccgtgatgaagttaggcgtaggtctcatcagattatttactactgagtttttttttatttttgaaactttttaatttttaaatttaaaaataaatcttttcaaaatttatttataagatctaaactttttgtcactctaattgaattggcatagcaaaacaacactatcacgagtgttattttaccatgccggtatgactggcgtgacaccgttatctcgctttgtttggtgtgttagtattgttttaccatgtcaaatgggctggcgtgatttaaatgttcagattctgaaaataagttttagaacggtatattttttaattaaaaatttcaaaaagaaaagatctactactgaattgttgaaacgtattatacgctccatacttcaggaagtatataaacttttttaaaattcagtagtatacttgtatttatggccatacgtatgtgtttttcatgtcacaactttaataacttctatttaataaatttatatgtttacgaagtgacatatcacatatttatccatttaattaattaatttttaaaaaagaattaacagctatttagatgaacgagggtttagaatacttttccacgcagatggtgatactatatatattgagttgactgttcaatttaactcaaaagctaacatgatgagtgaagaggagcagttcaatttatattcctagcactactaatgcacacggccgcacgtcggcgccggcgacagataccatcaaaccacaccgcgttccaacgaggagagatcagaccagatatatatctgatatttatctgcatgactagtattctctcccttttatattataaatcatttgattttttttaagtaaaattttgttaagctcaattaagtttatattaaaatttagcaacatcaaaaatattaaattagttttatcaaacgtaagattgaatttattttgataatatgtttatttttttacttaggaaaaaaaaccaaacaacttataatataaaatggagaaggtagtatttaaatactcctccatgatatcacccctggctactcatgggctattatactatttgccatgagaaacgcttccaagaaattatattcgagtgaactaaccaatcatgttaacctgtcattattatactgataatttattctcaaatcatagctgcaagaactacgatctcgctggtcgctgctattatctttggattcgtcgtttctggcatctgttactacgagtggaataaaataaatactagtttttgccaagataatccaacgtcaacgtaactactgagccactagtgttataaataatcagcttcgagaatggagatgtagttttttttttacgagggagaatcgagatacagttcatagcgcagtgataaatggtgtgtgattttaacctcgagatcccgtatttaattcctaacatgctcacaatttttcaaaaaaatgtttggagggatgtctctcatttcaaatctttctttttattataaataatcagcttctctccttgagctactcgccgaggcacactttgactgacacttccattgcagaagaagcagaagagacagatcaaagatcaagatgttcagagcattgcagatcgtcctcaggtatagttttacatgatcctagctgcaaattaaagcttcatcgctgtcaagatcgccttggattaagaacaagaacagcttaattacttatatgtgtttttgtgcaattttatatatttgtgtgttgggtgcaggggtaagagccgaggatttgtcagtcacttctcctccacggcttcaaattctgaaaggttgcaaacttaatttcagcatctatttatgtttgattttttttttgttcactttgtgtttggttgcttgcgggttgtgaatcatggagaagcattgcgccgtgacgtttgatttttattttttttttggtttttgatttgcaggttggctgggaaggtggcggtgatcaccggcgcggcgagcggcatcggcaaggcgaccgcggcggagttcgtcaggaatggcgccaaggtcatcctcgccgacgtccaggacgacgtcggccgcgccgtcgcctcggagctcggcgcggacgcggcgtcgtacacccgctgcgacgtcaccgacgaggcgcaggtcgcggcggccgtggacctcgccgtggcgcggcacgggcagctcgacgtcatggtcaacaacgccggcatcgtgggctccctgtcgcgccccccgctcggcgccctcgacctcgccgacttcgacgccgtcatggcggtgaacacgcgcggcgtcctcgcgggcgtcaagcacgccgcgcgcgtcatggcgccgcgccgccgcggcagcatcatctgcgtggcgagcgtcgccggggtgctcggcagcgtgacgccgcacccgtacagcgtgtccaaggccgccgtgctcggcgcggtccgcgccgccgccggcgagatggcgcgctccggcgtgcgcgtgaacgccatctcccccaactacatccccacgccgctggtgatgcgcatcatggcggagtggtaccccggggcgagcgccgacgagcaccgccgcgtcgtggagcgggagatcaacgagatggagggcgcgacgctggagcccgaggacatcgcgagggcggcggtgtacctggcctccgacgaggccaagtacgtgaacggccacaacctcgtcgtcgacggcgggtacaccgtcggcaaggcgcccaacctgccggcgccgccgcaataatcaacacgagaatcggcgaacgaataatggcaacaattatgcattattactccgctaatgaacaaatcatatgcttctcgttgtttttgcatcgatcaaatgcattgttgtgttgggatcaaatgcctttgtttggagtggatgaggttttgggctttttgcccacgacaaacaatgtcaagagatgctgctccaagtcttcttctttctttgtttaattaaatttcacaaaacgaaagatatatcaatcaagttatcacaaaactatatatttaaaatggtgtatcaaaaaactacagagttagcactaaatttaccataaaattacaaatttaaggtgaaatatcataaaaatatagatttattaataaagttatcacaaaacagcacatttagctttgtaatacttttattattaaatttatagttttgtgatacttagtcttaaacttatagttttgtgataattttatttttaaatatgtagttttgtgatacatcaccttaaatacgaagttttgtgataatttgatcaaaatacctgtattttgtgattttttttcttgaaatgattaaagaaagaaatgctattccaagtttgcgacccgtcggtcacaatatccaaagctcgcatgcaaatgcagtccaacaaggtaagctaagctagctagcgggaaactattttaaccgctcgagtagatgtccaaccgtttattgtatgtcatctaaatgattataaaaaaattaaaaaaaatatgaataagatagatcaatatgtaatgtatcaatccacaaacatgcatgttaaaattcaacttctacatactataacaaaaataacaaacaaaactcaaattactatatgtatatttatagttaaattttttatttttgttacaacttgtagaagttgaattttaacttgcatatttgtggagtgatatattacatattgatctatcttgttaatttttttgaaaattttttgtaaccatctagttgacatgcaataaacgggtggacatcttttcgagctattagaatccatctccatagctagctccaaaatccgtacagtgacgcgcaaagtgagaataattcaacttgttaggatttaggaatcagtctacccaaatttaaattctaaattttacatgggtgctcgtatttaagagtaattatcacaaggatttaaatcctaaatttgacatagatgctcgcatttgtgacttattataaaaaaatccgtatattctattacacaacaattattttattaaaatagatgggtaccccacgcattgctatcgaagaattatatggtaaaatagtagatatgagttatgaaattttatttcttacttactatatcattttctttaatgtgcttatatatttagcacttatctaaagattataaatgactgtgttgttactatcttttggggagaagagatgcaattgccccgttgataaaactattcaaagacgaaaaacaattaagatgatgtggcttcattagagaggagagaattagcattatctatacttggtgcagataaactttatagatatataggattcacgcacgtgacagtacactaaggttgtgttccgtttcaggggatgagagctaatccctcccgcacgaaaaaaggagcgatccattagcgcgtgattaattaagtacaaaaaaaaactaggaaacgggattccgttcaacgggataacctacatacatgcagtggcttacatggagagatcaacccagctctatacaaaaggcaagggcccacatgcatgtcctatccttttttctcatccatccatgcagcttatgggtccacgtgcatgtgcgtacatgcttgacgttttgctcctgcatgtacggtgcccacatgactttggcaaagaggtcgatcaattccatgcagtaattaatcatcaatagtgaatacacttattagatcattagtacagaaatataatccctcatacctaatatgtattataacttaaaaaaatatagtgcaaaaaatggttccttggatccgatacctacatatatcgtaactgatatctcataagtatcatcactagtacccatgtatcatcaccaatacctgataggtatcatcactagtaccagataggtatcgtcaatggtacccatgtatcattaccggtacctacatgtatcatcatcggtacctcacaggtatcatcactaataccagacaagtatcgttattggtacccatgtatcatcaccgatacatgacatgtatcatcaattggtacctatatgtatcttcaccgataccttacaagtatcatcaccggtacctacatgtattatcatcgatactgggtatcgaccaaccgatattgttacaactgatattataggtaccatcgagatacttggtacctatatcagcatgattcccatatgtaccagatttgggactggatatcgggtatttggctatcaagtaccttgtacctagattggtctgatacctataggtaccatacctagtactaggtatcagggtacataaggtatcatatacctaataccagctgagtatcgggtactaggtacctggtacctgaattgatgttgaacgatacctgttggtattgggcctggtatcagatattagctttagtatcagattccaactcacatgccacgtcacatgcatgcaactagtaacacagccacgtcacatgcatgcatgtagctagcaacacagccacgagtaatcaatagaacgctcctgagaggaagcaggtggcagggccccctagcgacgcggaagggtatctcgttcccacgggatcccgtggtctagctatcctcattaagtattagctattttttttaatttgatttgattaagcaattttcgtatagaaactttttgcaaaaaacataccgttgggaaaaggggtgcctcaagagtccgggttggtaactcttgcctccagcatagaaaacggagcgatccattagcgcgtgattaattaagtattagctatttttttaaaaaatgaataatatgattttttaaacaactttcgtatataaacttttttttttaaagaaacacaccgaaatagcagcttaaaatgtgtgcgcgcggaaatcgagacggggagttccgaacctgcactctcgaacgcagccaagtatgcatatttttggcccgccaggccacgtgctgtgttttctttctttttcccccaaaatttattcctttttaattacacaggccagtcgtcttcttcgtcatcctcgatcagcgagagaatataatttgcttctctctctctatcgctcgcggttgctcaggcaagctgagagcttaattcagaggcatcatgttcacagcgatgcatcgcatcctcagcaggtatggcggattcttgtagctgttctccgattcggatttcagaggagcagccagctcagtgtgacagtgtgaagcttactgtggaaacaaatggccaaataattggggttggttgttgtaatgcagggggaggaggacacctgcagcttcgtcttcctccgtcactgccttcgccaccgcctccgattcacagaggtgatttgatcgattcatcttggagttgcattgagccattggttggggacgctgatttcatcttcttgattgcgaatcggggatggatgtgaatgtgatttgcgggtctgtaggttggccgggaaggtcgccgtcatcaccggcggcgccagcggcatcggcagggcgacggcggaggagttcgtcaggaatggcgccaaggtcatcctcgccgatgtgcaggacgacctgggacacgccgtcgccgcggagctcggcgcggacgcggcgtcgtacgcgcgctgcgacgtcaccgacgaggcgcaggtcgcggccgccgtggacctcgccgtggcacggcacgggcgtctcgacgtcgtcttcaacaacgccggcatccccggtgacctcacgccgacccccgtgggcgcgctggacctcgctgacttcgaccgcgtgatggcggtgaacaccagggcggtggtggcgggcgtcaagcacgccgcgcgcgtcatggtgccgcgccgccgcggcagcatcatctgcacggcgagcacggcgggggtgatcggtggcgtggcggtcccgcactacagcgtgtccaaggccgcggtgctcgggctggtgcgcgccgtggcgggcgagatggcgcgctccggcgtgcgcgtgaacgccatctcccccaactacatctggacgcccatggcggcggtcgccttcgcaaggtggtaccccagccggagcgccgacgaccaccgccggatcgtggagaatgacataaacgagatggatggcgtgacactggaggccgaggacgtggcaagggcggcggtgttcctcgcctccgacgaggctaagtacgtgaacgggcacaacctcgttgtcgacggcgggtacaccgtcggcaaggtgcccaacatgccggtcccagatggccattgataatgtaccacggttgatgaataataatgttggtgatgtgtacacaattcgtagtattaactctgtttcatactgtaagttcgtttggactctttttaatcaaacttctttatgtttaattaaatttataaaagaaaattagcaacatttacaccattaaattagtttcattaaataaaaacattaaatatattttgataatatatatattttgtattaaaaatcttgctacatttttctataaattttgtcaaatttaaaaattttgaatagaaaaaaatcaaagcgacttatataatactccatatgaagcagagggagtatattgtgccaatcagattcgtgttatgattacaatgacatttatgtttagaagaaaaaaaaaggggctgtttatatatcatgtgacagaaaattccacctcctatcattcgaattttggaccattggatgtgcttcaagattcgtgcagaccttttaacttaactcgtctcctcctcccccggttccagatcgcgccgccaccctcttcctcccatcccacgcgcgatccaccaccgccaccaccgccaccgccccaccgcgccgccgccagcctcgccagctggccggaaaaggtcaacggcaccggcgagccccctccccctcccccttccccttcccccctcactttcttctcatggcggcgacgacgaggtgcccccgccccgccgtcttccccgtctccggcggctccccaccgccggatccaccaccaccggccgccgcctcctaatcccacgcttgctttgcccctgccgccaacgctggcccaccaccctcctccatccccgcggctttggcggcgtcaccgccgcttcgccgcccaccggagtccaccgcccactgccggtcctccgccgcccacggccatccctataagccccgaggaaacccctctcttccccctccctcaacccccctcctatcctcacccaaaccccaaaccctaatccgccggagttggggtgtcgtcggcgccggagaagaaggggagcccgccggagttggaggagagaagccaatgcacaaatcttggtatggatccaatgatcaaaaaactgtaagatttcatccccaaatttcattcgaatgccatatagcaatctcaaaaaaaaaaaaaaagaggtaagatcactatcactccacggaaaaacagggcgacgcccgcatgaatgatgtgctgaattaacgaatgaatgggccgggcatgcacggagtggaccaactcattcttttttctcaagttaaggaagatgattaattgattatatctccggcctatgtatctatgctgtgttcttttgctggctttcccaacttacccttttttttcgtatgtatgttttttaattgttaaacggtggtgtgtgttttgtaaagaataatggagaagtagaaggagaagattattcaaccatattaatgtttaattaacctcaagcttgttgacacgatagggaaatataaatcttatgagtatatgagtttataaaaaatgatgatcaaatattataatgcttgatttaagacaaaacaagtaatttgaaatagaggattaaattctagcccgattatctcacatgacatccttgctcattctaaagtctaaacccactggttgtctagttttgacttcaccgttgaccacgcttgtcctcaagtaaacacgcatactatagataaaccaagagaacttcaatatatttggtctcttttgaaacacgggattaacaaaacataggaatatgaaaagtatatgatttttacaggaatgcaaatgtaaaacacaaaaaaaaagaatgatttgtttgaatagatatagaccgtaggaatcaaatgcgagagataaactcaaagaaaactttctgagaggttggaactcttgctaattttttcttcaaaatctatatacattgagccattcctttggaatttcatagaatttaaaaagctcaaatcctttatttcaaagagctaaataggaacatcttctatgggatttgaatctacaaaattcattcacaaatccttcgtctctcaaaagggccttaacgtaataaatatcaaacatactccaacaataattgaaaagaaaaagaaaggatattcaaccacattaatgtccagttaagtttgagcgcggccaaccaccttgaagaaaaatccaaccacgtgatttgaaaaattgctacgcgtacgatgaaattcgtactacgttaggtcccatatttatcgcatacaccagagactctgtgttcgggaggagggttcccaacccctcctccctggcacacaaaataaaacatctattattgtataattaattaagtatttactaattttttttaaaaaatagattaatatgttttgtaagcaaatttcgtatataaatttttttaataaaaacacaccgtttagcagtttttaaaaagcgtgagcgcgaaaaacaagtgagggaggttggaaaagggaggtaacgaacggagctacatgtatcgtactatcatcgtatcaagtttagtatcgtactatcatcgtatgaagttatatcgtacgtattagactgctgcgtggtctgtgtatcaatatatacatttctcgtacgatctatatgacgactcctgtggtatatgatgcgtgcaatgcctccttttctttttctctagaagttttcatgttccccaagtcaaaccatacggtggaatagatgaaagaatgcacggtttgcaatgacggtgaggtttgtgagttactattctctttcatgagggcgcctagctcttctgtgttttttcttctagcaattttaccattcaacatatttagtatctcgatgtaccatattttatacataaaaatttaatacctcgaggtactaaattttacactagaaagtatcttgagggtattaaattttatactagaaagtatcttaaggtactaaaagtttatgatattttaaggtgctaaattttatactagaaagtaagtatcttgaggtactaaaagttcatggtacttaaattttacactaaaaagtatcttgagatattaaagtttatggtacctacagatgccaaatatatttggatagtaaaattgctcgttcatactggtttaatggcccatcaactttgatatttgcacatggcctattcacatcatctcggacaatatcgttaccaaatgatgggtgtggttatatttacaacgccgcattttctatactccctccgtttcgaaatgtttgacaccgttgactttttagcgcatggggctgcaggaatt

SEQ ID NO: 66949 - DNA, 62275 bp, Oryza sativa
gaggaagtcgtgcagcgcggcggcggcgtcccgcagcgaggcggcgtaggcgcggtgggcgtcggcgagcgcgtagcggtggcggatggcgtcggccagcagcgcggcgcggtcccggcacagcgccacagccgcgccgcccccgcccccgcccccgtcagtcttggactggccgcaccccatggtcggcgcgcggcgggcgcagcagcagcggtagaaagttttaacggcgcggcggcgacactggacgcatgcagtgcagtgcagatgagagatcttaagcaagggagcagcacgtacagtggcgatgggcgatgggcgatggcgacgcgagaatcttcgcgcttttcggcttcgtcctcgagtcgagcgggccggcgcacggtgaaaacgtcacggactggacagcgcgggttggcggttgccggcggcgagcggagatgagcaaaagcgggggggacagccgtacgtgggcggcggtgaaaaaggctgcgttaggccctgttgagttcacgtacaaaaattttacacctatcatttgaacaaagtattaaatatataaaaaaaaactaattacatgattaatttgcaagacgaatcttttaatcttaattgctccataatttaacaatgtgctaattaggcttaataaattcatctcacgattttttccacgaacgtgcaaaaggattgcacgtcaatatattagaaaaaaattcatctcacggtttactatcggattctataattagtttttttagtgcctgaacacccatatgataacttatataatatgctacgtgatacgctaaaactttataccctgcattaaaacaccccccttattcggctttgctttgctccggtggtggggacgacgtcacgacgcgacgcgacgcggcctctgcgactccacctcatgttgtgtgcatgcttcgtcacgcgggcggcgcacgggaggcaggccatgcatatgcatgcatgcatggtctggctcgctcgacccccactggacttgaaaagggtaggacatggggttgcacatgtgacgtgtgtggggtacgtgacgaccacaatcgcaccagaaagaaacaaagcttgtagtagctggctgggctaagcttggcactatgccggtggcaggtgtttttgttcttgctggtatccattattgcttccacccataactctagtttttttaaaaaaatatcccataactatagtttggctttctattgttcgttcaacctttttctttcatcatcttcttcttgctatactactcgttgtagtcaagattacattcgtcattgaattgatggagctaccaactttctcgccgtttcactagcagcaacggcactctcagcagatgaggaatggcgttataaatggctctcaccaaccaacttttaatattagataagagtagattttgttatttacatgttattcaaataattatgaaaaaaatataagaaagaattaagaagatacataaatatatgtgatatataacatttcacaaatatataagttaaaataatttaacttatacaagtttcaacgaaaaaaaaattaaactatatacttagttaacgtaaatttacattttatttaaacgtgtataaattaaatttgatcatgtatatttgaggaatgatctatcgtatattaatatatcttattgattttttatagaaatttgaatagtatgtaaataaagagggatgtcctctcaagggtttagaattgtttccatcttaagtgaatatgattatatattacctccctatttaatatagggaattgcttaaagattagtcaccagttttttttaaaaaaaacttcaaataatattattggcttatccattattaaagctctgacttgttagtagctctcaagatatttagtttaaaaatataaaaatcatattgttaggtatttctttgaaagtaattttaaaatattataattttgtttaatagtattgttattatatttttaatagaaaaaatagttgtaaaagtcgcacgttaaaggtagatagtgtcatatatttatatttatattctactggttaagttgtgcacaatgatctggtagcaatttcatcttaaaatttgagacggtgcaaaccaaagtggaggcggcgaacccagccaaggatggtggagatgccaccacacgtcgccaaggatcgatggtgcaatgcaacgtcccgctctcgaagtcccggacgccgaggtccagctgcgcttgaacagcgggtggatcagctggtcgctgtcgtcgtcggctcgtggtctcctcccacgccgccggcgagataacatgcatggccggacgtgaagcatccggagctgaactccgtcgtgctcacgtcgtcgtatacgtagaccctctctcctccggcacgacgacggttgggtcgttggagagatgagatgctcgtcgtcgccgtcttgcgccacatcttctccacgaatatgcattttgatcatgactaccggagacgcagacgcgccaccgaggtcgacgactctatataatcaatccaactacgcgcgcgacgataagaaacgtgaatctgaattcgcctacagtttaacaaacgtcgcgtagcaaatgcactggcagccaatgtgcccaattggccactgcatgccgaccaagaaaatcaaaccttgtatgattgtccatgcagaacacgttcttgattcggactttggtcccgtactcgatctggtgaggaaaaaagattattcagagagattcagagaggcgcaattcgagatttcgaaatctggatagactggtgtcccactgcatcatgatcatgatcagctctagatgactttgtggcgactgctgagattgctcgtactgctgctatctttctcgtctttccatggactgagtccagtccaaggacaaaggccgagacagacaccaatgtgctttgccaggagtagagtatatggtgatttgactggtttcttcctttcatggcgatgcacaaaggaaaagctcacgcctatttgcatcgagctgctttgctgttattagccttttggagataataacaactcctgtaaataaaagtttagggcccctttgaatcaaaggatttatgtaggaatttcataggattcaaatcctataggaaattttcctatttggccctttgattcaaaggattgaaactttccaaatcctatgaaattcctatggaatgacacattgtatgtagattttggaggaaatttagcaagagctccaacctcttggaaaatttcctttgagtctatctctctcatccgattcctgcgtttttcctgcgctccaatcaaacgaccatttttgtgtttttcctgtgttttgcaatcctctgttttacacttcaattcctgtcagaatcctatgtttttcctattcctccgttttttctaccctgcgattcaaaggggcccttaggggttagccagagctaagctagtgtaggagtactaattaaccactatacaggagtactgtcttttcttttctttagttgtttaaaggttgtcacctcatgtggagtaattatttgtatgtatcgctacctcctagcaaagctaataatacaggcaactgcttactgtataaatcattatagcttatctcagctgactcatatagtggttagctcttcactataaatatatggtccacttatccgtcttacagatttttttttcctatgcctaagccgactgtaagtttacatcttacttttcatctctcatccacctcagcattaagcgttcttacagcccactattatattttctctcgtgacatcagtaatccgtagtcctatcgtctatcgacactaccatattcatcgtacacgctgtttctagcaacagaatcatgagttacagaaacaagctttattcaaagagaaccttttgcttaaaatctgaaaatttccacaacatataggtagcaaccataactatacagtaacaaagttgcagagattaacttcctcttaggggaaaaaaagaaatccttctaattaatctctgcacagagtattcagataagtgaccatgctgagatatccaaatgacaagttgccttttgaaaaaaaaaatcagaaaagaaacctcaacttcaatacggctcatttagacattcaggcccaacaagcgggctccggcctctgggcctgatctgagctgtatttgggccttacaaatgagctgttaactcggatgggcctaggcccacaccgtgtgggctgcttgcagagaaaccagaagcagaagcagacacagacctcgtcgcctccagatcgacggcgactacggcggcggcggcgggtgccaccgccaacgccgaggcagagagcggcaatggcgatgagccgcgcccacccgtctgcatggggaaggaggcggtcaggcggcggaggagggggaggagatccgcatccgctccagcttgaccaggcaagctttcctcgacgccctcccctcccatcccctccgccgccatgcgtgtcggatcgaactgcttctccgtgagatttacagaggaacgccattttctggaggatgcatgtgagatgctgcagtgcagatggattggaccacaaggtacattggcgataagaatttgtcgaggaagttgttcaaatcgaagccaaccaaccaacaccttcctaaccctaatcaaatttgatgtgggcgaaaagatctgcggctagcctatcacccatcgatctcttcctacgccattgaagttaacaagcaagctaggaagctacatgctgtcctcgtgtcgatctctttattatccacagtacggtacggaccagtatacagttgcatcacttgcatgatcattgatcaaacagctcacaacctcactcctttcccttgcaggattggtctttttttatggattgctttgcaattgtaattgacaagaaaacacagcgaggtatagcaaagaactcttcagtgtagttcttggaacaactctttacagaagtgcaacctgcagcacattgcgagttcagaaaccagaaatgcgcaagagttcagaaaggcatgtaaaatggagaacatatggatgccacatctgatgatatcacatcatcgtagaaatatggagcacataccatatgcaagttgcttgtaatgctagtcaagtcttcctcaaccaacccctaatgatcagataaggaaggacacacgaagcatcctaagaaatctcacttgatgtggctctccatctgatgtttcggtgtgtttcttgtgttgacagatgctggagcttgaagtaaatgcctctgcatatgcttctatcctacactgaaccactgctgctgtacgtacccaatcatctgaaaccagttcagtactatggtctccacaagaggaccccaatgcaccaactgttgcctccattgtagccaacattgcactaccagattcatgaccctgctgctcgcaccaactagtgtcattgatgagtgcgtgcatgtcatggaccaatttgttgctcatctattcaaagcactaatggatatcctctggaaagtgaaaagttgatatattttcttttaaagatggccatgatccaaatcagatccaaggaacacatgcaacgacttgacttggaggcagcttcagtccgtacgtagaaataaagctctctctctctttttgaatgaacagtgttgacgaaaaaaatcgaatacaccggcctgggagatctgcttaactcctgtgcaggtctaaagattaatgagatgcgggcgtgccagtcagtttgatcctgcaattgaaaagatatgcaaatagtgtcacaccccaatccggcaccgccgcacaacggcacctgatagggggcatgtcgtaggaaaaacggcgcaaaccgcttcctacgaaaccgcgatctcggtaccagtcccaggacatagtgctggtacccacggtgacaaatatgaatcattgcaaatccttaaaataaatagaggacttatttaccttaacttaggttgcagctcagacagcccgagaatacaaccgacgacacggacgaggcgaacaccaacaacaacagcagcagcggaaccaacggtctaacacccaacaccacaggcgacggctgggaaccaggacgaaaccctaatcttcacttcacctcatcttcaacttcagggcggaggaactatatatatttatatagagcaagggtgagtactttcgtactcagcaagtcacgggaatttaggtgtttaatgcaagcttggaagagaggcaatgttgttttgcaaatcttttatttgaagacattttgaaatcactaagtgatttatttctttctaagtttgggccgaaaagagacttgcgtctcgattcgactttcagagatgtttttcaacagctcatttggtaatgtaccgacctcccgggtcagatcattacttctcggctcccagagccattccacttgattaatcggctcccagagcctttttcattttctcggactcccagagtccagctgcccagcagcacaacaatccgcttccactcgggaagcctagactatgatgcccatagacatcccgaatcacacagattcgtttcttgaccactcaggtcatccatctgccacataggctgattctggttacgattcccacaccacaacaacttttcacaaagcacatgcaaacaaatctacgcaacgagaaccacctcacatccgcccatgaccatgggcacggctgttcgaacagttagttaatcctctgcagaggggtacactttacccacaagatacgaacttattccgaacacccgtcggtatcggaggttcgcaacaaagcctttcccaagccgacccagggatacctcatgccacatagaaggatcaaatcctcacataaatataggccattttaggcgttcacaaatcaaactccaaccacctcgatcggtaattcagcaagcttctcgttcttgcattaccaggaacccggtttgtccgaccccgccccggcgttcccaactattggcatgcgaggtttccctgaaccgactagttacttagccagggtgtcccattccaccttgtggttgcactttgattatgttcgatgagtttcccacaggaatcggtccttatatgcgaatacgggacagtgccacacaggcacaacccccgcatcgcgagttttcacaattcattttattttcaaacacaccgacaccacatgtcgggttttgaaggcttcacaaacctatttcccaagttttcgacaaacaacggtgtatgtgggatatttggtatacgcgctcagagggcacgattaccgaggtaccacaagggtggagcgacaaggaatcagggtagtatgacctacggaaattagtgcgactactgggtaggtccgtcggtttggcacgcaaaccgaggccaagcaagttaagtgtgtgattctaataatgcaagttgcaaacaaaataataatgacttttcaattataggggcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaggaccaaaataaagatcctatttagactaattagtagtgccattaaatagatctcaattttacggaattactggaagtggaacggaggcgatcggagctacggatcgagggatatgaattttggaggtctaaatggattttctggacaaggaaatgttttgtcgaaatttatggaaataatattctcaagaatattattgacagtcactgacgtgcggggccaagggtgtactgtacatggggggggattaagtggacttttgttcatgtgtgtgggcactgggcttggacagagggagtaaaagtagacttttcattttcccctaggccgagaaggggggatggttgacgggccaagcccacgagcggggagagggaggaggggggctgactgggcgccggcttgactcggtcaagctggcccggggttgaggtggcgtccacgtggaagccacgtcggatggggaggcagaggaggccgggcaggctgatccgatggctagcgatgagcgacgcgaaccggcgaacggcggcgaggtggattggggggttagcaccggaagagagaggaggccaaggggaatcgattcaacggagcggattagccgggggaagaacgacggcggccgacggcggtggccaatctcgccgacacgccgatgtggccgcgcgtggaaagagcgaagggcgcgcggtctcagggtcagctgtcgtggaaaaggggttgcgacgcgcacacggtgacgcgggacccgaaggtcaccggcgacgcacaggcggcggcgctaagcggtggcggaaggggcggcacggcgcgagagcgagaggggaggccggcggccatgaggcaacaagggggagatcaaggggatccccgagagcgtggtggcaagagggattgacaagaggggagccgacggcggcggatttcgacggcgatcgtcggcggcgagcaaagggggaaaacttcaccggggcaacgggggttcgattcgttgaagttggagcatctacgcgaggtcgcgagctcattccaccggtcgagagggcacgggcgacgccgagagaggccggcgacggcgagcgacgaccaggacagagcaagggcgcgcggcgagatgtgacgaacggtggcgggcgcggcgcggcgtgcgacaagggaaaaggggttcagtggggagctcaccgacgagagaaacggtgtcgacggcgcggatggagtcgcggcgaggcggtcgcgtcggcggggtggcgcggcaccgagagggcgcggccggggaagaagagatggagaggtgcaaggatggggcggcgcggagctccttgtcgactcctcgtgctcgctagctccccgacacgcacgacggcagaggagggcgagaacgacgacgaacggcgagacggcagtggtgtgatggaggagaggaagcgggaggtatgggagggggtgtgggttttgtaggtggcgatgtcggtttgagagaaccgaccttggggcggtcaaggagatgaggcgggtggcgcgagcggtcaagcgacacagaggtggtgacgccggcggtggtcggggaaaaggaaaaagaagggggggaaaggaggttggtcctttgccatattgaggagaggggaagcagctgcttctcccattcttggacgatgtggcgtggagtggcgggggccatggatgacgtcggcaatgacggtggtggtcggtttggcatggagcgggggcaaggcggcagcgcgtggcgtcggcggtgcaagggctgatggcggcggcgaccgggcggcgagcgcgcgcgcgggaagggcgaccggcgaattcaaacggcggcggcgggaatcggcgccgaggagaggagttcgacgagagagagagagagagagaggaaggagacaagagaggcgctgcttctctcgctcggcgcgtgcagcgcacgtgtggggaggaggaggagcggccgagaggagaagatgggccggaaaagggaaaaacggcccaacgaccaagagggaggtgaaacggctgagggagggaggtgggctaaggggaaaacggcccacaatacccgagggaggtaaaatagacttttgcagagaagactgatttggagtggattcgaattgaggttttggatttgaattcaaatttgacattcgaactcgatggtttaggttggaatcaagggagactcgaggagaagtcaagaaagagattcaaaacgaaaacttggatatttttttttagtcggagcgaatattcggcaaggattcaaaggaagggattgactttcggaatttgatttcggagacttgaattttggataggaaatcttgaggtggaggatttttgatttcgatgagggggaacaacgggatttgaaatgagatcttggcacgacttagactcgcacacaaagaacgaaaattttcgcaattaggattttgccgagttagtttttaacgactcatgaaaagcggagcgttacaaatagtagatcaaaacagccgatcggctgacaagccgatggagtagttccagccgatatccaataatagccgatgccgatactagctgatagcgatagggtttaagcaatcggctatatgtccaatgtagatgatgatataaaggcaatcggctgatgatgatgtaataaaataacaatatagtccagtataaaccaatcggcaaataatgatatgataaataagcatcgatccgaaggttgaagcacacatcggctggaggtccgatgtcatgaaatccacaagattagattaaacagcgaaacatttgttgtcatcggctaaatccaacttatatgtatatgcaatccttatgagccgatgcaacgtccagataactcaccggctgaaaccccgatgaaacccttattggcaatcaagaagcaggctagagattatggttctaagcacgacttagtagatcaaacttaactgatgcaacactaagtatgaaaaaaaacataatatctagacaatcaagccgttgactgagttttcagggtggtagatgtctaagctaatctaatctagcaacgcgatttagccgataccgacagaaaccctaaaacgagaagcagccgatagagctaaattgatatgctaagactagattaacagagacatgataaataggtaggcaaatatatcatctaaaccagagcaatccaagaggttgaatgtactgatgcagccttgaacgacgccgacataaacgatacaactacctaggccagtggaacattggacttaccccttagccagagatcgaacaccgatgcagccccgcgtcaggtgccaagtcccgccggacgataaaaataaagtagaaaaggtaaaaggtggcgatgcgccgaattgtattgattgtgaagatagattacatagaccccgggtgtacatatttatacccatgggttgatacaagtccttgttggaccaaaaagaaactttcataaagataaaaggaaaagataaagtctttataggacactaaacacactttcctaaagataaaaggaaactaacaaactattcctaattaatagataacttgccatgccgcattctctttgaactcggtctcttctggataagcttcctttagtatatcaatttccttaaccgaatatagcaagaatccgacaactgacgacttgacaactctcatcagctaatctcaagacttcgaagccgatgactactccgggcttaccaaatttcactgttaacaaaaagcagcatatcatgatcataatgtttagcagaatttgaacttatacgctaactacgttcaaggaggttttaaatgtcttccatttgtcaaatttctcttagtgagttagtggtaggatttagcgtcggaaaccatgaaagatgtacttcttttcctttgtgttgtgaaacatgtacatgttcttttcctttgtgttgttttttatgtgtgaacctctttgatctcaatgcaataatgatacacattcccaaaaaataagccatgaaacctataatcttcataaaactacacttttttttttgcgaggaactacactatttcttttagaaccactctaatactatctgagataataagccagtagttgggttcaatgtatgtcagatctggcaaatgaaatatggctccaccatgggagaaacaatgatcgtgggcattgaaatcctgtaacacggattgcaacatctcaccatgggagttcatggccttgtcccttgccagctagctacttcgtgtttggtactactgaaaaatctgaaactaagttgcatatctccctatcacatatctcccctgtaaatacattgccattgacacaaaccatcaccaattcaccaaaaacaacctgacatttcctctctttttttccctgatcacttccttggaaagcaaagcaaaattaagcaatcatgatcagctccaagaagctagttcagctttccaagaagtggcagggaatgggtgccatcgggaggaagagggtgacggcatcggagaaggagatcatccaccactcatcctgcagctcatccgtcgccgggaagggcaactgcgtcgtctactcgtgcgacgggaggcggttcgagatcccgctggcgtacctccgcacgccggtgttcgtggagctcctgaggatgtcacaggaggagtttgggttcagcagcgatggtaggatcacactgccgtgcgacgccgcggtgatggagtatgtcatgtgtttgctcgggagagaggcctcggaggaggttgagaaggctctcctcagttccattgtgatgccctgcagccaccacccaagcaggatggcgcagcaccagcattttgctgtatgcagcatctgaagtctgaagaatcacacagcatctgaagtctgaagaagagctccagggatattcagcttgttcttcctctttttttccatcttttttcccaaatgtacctttggagcacagtttttttgtgcaatgtttttccaaggtactgcgggtgtacagatggagcatgtaaaaataatcacagcattgtgattagaaaagaggatcaggctaaatttccatgcagtggaataataatggagttgtgttgtgttaagatctttgcttttccagactaaaacacgcagcttttaatataccttccctatttatggttatttgtcagtaaggtttagcttatgtcgtgttttaaaagtctttagccaaatgagtataattgtttcgggagtgacatgtttatggagggatgaacacctatgtttatggagtgacatatcagtatatcacatgttaatctatcttacttttctattaaaaaaatgatattttaagcgacatgtaaacacgatagaacatctccttgagagatgaatggactttccctatatgaaacaatactaagtctgtgttcgtttggtgtgttgggaacaaatatcttttgcacgaaaaacgcaatagtctattagtatgtaattaataaagtatttattatttttttaaaaaaggatcaatataattttttagagcaactttcgcatagaattgttttgcaaaaagcgcatcgtttaacagtttaaaaaatatgtgcacggaaaacgagggatgtgagttaggaaagttggggaaagaactcagccaagatgttaacatttgttgatagtcaaatttagcactagatcaaatttggacttaaaaaatcttggagatgtccacatatggtaagaaaaaaaaagttagctctaagaaattctagtcgcagaaatctaaatatacacaagctgttgtgtcatgtgtgtaataacctattaataatcttacaacaataattcttatgacgtctgcgtgtcattgcttgatcactaccgtgtgctgctgcatgacgagcaccgagcccatctccagcgagtcgttggacgcgaggatctccgccgcggggcccatctcgccgccggcgtccgcccaccgttccagcccggccaagagctccggcggctgcctccctccccggccgacgatgaccagcgagaacatcccggccatcccggccagcgtctcctccacgtcggcgggcctctccacgaccttctccacgtacatggccatctccgtcgccgcgtaccttttttcacgaacacacaaaatgattgtacgtcaatatactaaaagaatagagtttttgttacacgacgtcctcagccagaccggccctcgccgcgtacctctcgtagaacctccacaggaagcgctcgtcgacgtccccctcctggaacgccatgtccagctcgtcgaccttggcggaggtgacgctgtcgtacgtgctgcgcttcacgaagcggaacaccgtgaggccgatggacgggtgctcggcgaggcgggaggcgagcgacacggcctcgcggtcgtcggcgccgccgaagaacacggcggcgacgacgtgcgtcaccgccctgtcgctgcacgggtggaggagcgtcctgccgccgccgctcgtggccgccgcctccgccgccacgctgctgggcacgttgaagctggtgccgctgttccggtaggggcggtcgacgaggagccccacggtgcacggcgcccgcgacagcacgccgtggttcagctcccgccgcccgccgaggcggcaccacatcttgccgtcgtagcgctgctccttgtggcagggggcgaggaggaggcgggcgtggacgccctccgccgcgcggcagacggcgccggcgtcgtccagggccgcgccgccgcggcacaccacgtcgatctggcggaaccagatgcccgtggcgcgggagaagaggtcgacgatcgtgttcatccgcgtgacggcgtcgcggccgccgccgcgttcgtctcgtcctccgccgtcgtcgtcgtcacggattcgctggtggtacgggatccggacgacgcgctcttcgccgacgtcgaacaggtggaggacatggacggcgggctgctcctgcggctcgctcaccaggagctccaccaagctgagcatgcccggcgcggcgtgcgcgctgtgcacgcaggcgagcatgtggagctcctgctccgcgcccaacgactccatggcctggtgcctcgtcctgtacgcctcctcctccttccgccgcaccaccgccaccaccggaccggcgacgagggtgctgatcaagttgccgatgatcatcgcgtacagcgcttgctccgcccacacctgcgccgcgcaaacaaataatccggaattccgatgagttgctccattgccgacgttgtcatggcgcatcaagtgttcgaccggttacctaccccttctgatttggcgaacttcatgttcatggtgtcgacgtggcccttgatgttgaggaggacgctgaagcggagcgcgtcggagagcggcatgctgaggtaggaggcgacggcggcggcgccaatggccttgccgaaaaggccgagcagcgtaatgagcacgccgggcacgatgatggcgcccgacatggagttgaagttcatcctcatgccgatcgtcgcgaagtagaagggcagcatgatgcccttcaccggcggcgcgagcgcgtcggcgacggacctcgccgcggcgccttcccgcgggaacgccagccccagcgcgaagctcgtcggcatgccgtcgaagccgaggaactgcgggatgttgccgacgaaccagatggccaggagcatgaccgccaggtcgcggacgccgacgtggtgctggccgacgttgcgcttgttgatccgcgtcacggcggggcgcaccatccacaccgcgccggcggccacggcgagcgccaggaagcctttcctgatctggtgctcgccgcgggcgacgccctcgatcttgcccttggcgcgggtggtggacgacaggacgccgtcgccgaggatgcagatgaggttggtggcgatcccggcggcgacgacgaggcggccgttctcggtgacggtgagcttgagctcggcggcgatccgcgcgacggctatggaggaggtgttggtgagcgccagcatgagggtggcggcgagcagctcgggcgtcttgaccggggagtgcatcatgctgccgtacatgccgctggagacgacggcggcgaggagcaggctggcggcgacggtggcgtaggtgaaggcgacgcagcggtgcgtggcgtgacgcagcgcggcgatgtccatgtcgaggccgacgaggaacatgtacaggatgcgcgccgcggagatgtagccaccgtacatgtcctccacgttgtccacgtcgacgtgcacgatggcgctgcggagccccatgccgccgaccacaacgccggcctggacacacacgatccgatcgattatgaattcaagaaatgtactaggaggatcaatgagccgagagagtattacgtacgaggatctgggagatgacgctgggctggttgtagcggcggaggaagaggtggaagaacttggagacgaggatgacggcgagggcctggatggcgacgaggaagagcgtgtcgagggcgatgccggggatgggggagagagcgagggggtcgatatgggagcaaatgtagtaggatcttgccatcttgcttgcatatatgccccggccgatcggcagccggccgcaccgccgccgaggaagaaggctacggcgatcgccggctcgccgtttgatcgctcggcaaacttagttccggcctcctgcaggtgtgtgcagtgtgtttacgtgctagctagctagctgcgccggccgcgtgttcatgcatgcacgatagatgcatcatgcaaaaggtagaaattggagggacggccatgagtctcgtggtggcggtggccggggagacgatgcctcgccccggaataggcaggtggctttcgcatcatgctccgcctggctccatccgcgcgcgactgttgtctgttgcattgcaatgagccatcttcttggagttgggctgagcagtgagctagtgaccaaggtgaaaactccattcatccctcaaggttatcccctcatttttacatgccacttaaaaaatcatcaaatttttttaaaaaaatttagtaagatagatcaatatgagatatgttgctttcacaaacatgtaaattcaaattcaacttatacaagtagaaaaaaaacaataaatttgactatgaatagaacgcgtaattcacggtcaaatttatttttttccaattgtataagtcgaattttaactcgcatgtttgcaataagatatattatatattaatctatcttgataaatttttaaaattttttgatagctttttaatgacaggcacaaaatgagaggatgtcccctcgagggacaaaaatccacttcccagccaagcgtaaattaaggagaagatgatgaaccgcgagacataggcacatccattcatcctctttgagacaagattaccaatggggaattggggatactactcatcgcccaccgcggcggcaccgtagcatggacgagggcgcggagctcttctccgattctcctggcgagaaatttaggattataccatcgtaaaagagtggtttcgctggattgccatcgcttcaaactgattcattgtaatgtcacactaaattgagatgtgtttaccaaaatgccattttagttcttttttgtgaatagaaagtttttgctcaattttatttttttcccgaccaaaatacccctgacgtgggcccatccgtcatgctctctcccacctctccctctctcccgagacctctcctctcaaggacgccgtcggctcgcgggcgtggcgggcagtggccggtggcggcggcgggcgtggcggggaggtgggcgtctagccgtctagcggcggcggcggctgcggctgcggcatgcccctcgcaggcggcgatgtgcaattgtgcatcgccgtgcggccgtcggagtcgcggaagttggggtctgctccgccgcaccggcgacgatgctcgctcgccgtggccctggcggatgcagatgaggggaacccgttgcctcgcgggtgtaagtacgtgtccccctcctccatcccccctcccttcctcattcgcgttcccagggctcacaccctctttcatccaaccagtccgggggtcataggtcttactcggagctaggagagagagattcctcgatctatgacttgtgtgctagcaatgccagccagggagtagtttactgaatctgagccccatcgagtcccagtcgatccatcgcacaaatttcattctgattttacatgtcatatttaggcaatgggagttctcaactatgatggtgtgattgagatttttatcatactttgctatgaattgtcggcttcggctaatatagttagaaaacagtttgaccctatgaggagcgaatgaattttcctaaaaatccattattctggggctcatgatttttgtggactttactatgatggtgtgattgagatttttatcatactttgctatgaattgtcggcttcggctaatatagttcgaaaacagtttgaccctatgaggagcgaatgtattttcctaaaaatccattattctcgggctcatgatttttgtggactttagattgactctaatcttgggctaaaagctgagttcaggaatggaatgatccttttgtttcttagagtaagtcactttggtgcatttttctcagctgattgcttagtcatgactcgagttctgtaggttgtccactaagttatagataaatcccacagattctacttgaattgatccattacttgagaatgatttgtgcggtattattcaataattttttgttcatttcactatttttatttgttccaaactttgcaacagtgctatttttccatgatttgtctcacaacatgtaagaagtgatttgtacatcatgtctcacatcacatgtttgttaatatatgttcttttgttaataaaaaagagtaagacttggggtgatttttcacactctatgtcaagtatgtccaacaagttctttatgctgtgttttttcatgaaacaagaaaaaaaaatcaataactcaataagtacctagcatattcctcccttatgttaagttggattatcatttttcaactgtagtttgctttgcatgtattattcttcccttcacatggagatgttatccaacttaaaattttctgaagttcagttggctgatgacaaacttgtctatgctgctggttttgctatgctgttagtcatcaagaattagtgaagccaacatctgatagagtaacattgttccatgtgttgttaacttgttattaatgctactggtttctgtttcatatggagattttcaacaacagcataccaggtcccatctttttgcacttctatctatctatttaggccttgttcggttacacaaggattcgttccgggctgggaatgataggtataacaagaaatttataataggtacaacaagagaccgggatttattccgggtcgggaaccaatttactcatattaggtacaacaaaacatctggattagttccacacctcttgactagtggattgattcccggtctcttattgtccctatcatgagtaaattggttcccggctcggaataaatcccggtctctcgttgtatctatcataaatttcttactatacttgtcattcccagcccagattgaatccttgtgtaaccgaacaaggccttagggagaatttttggttcagattcacacagatgagtctacaggcgggagtaacactattcctacaacatccaatttggggtctgttgtgggtgtggatacgctggtgcttggacaggagggtgaggcctgcagcctcgccgccctggagcctggtgagacaaacagagaagggggagaccagagataggtttaactttctttcttgattgattccaatttactgccatgcctctccttatatagagcaggctcctaacaaccctatctaacaaagcctaacaaactaactgaatgcatgagatgggctgagttgtgcccataacagtggccactatgctgtttgttgagcttattgtacagttgttatattagcagtctaaggtcaatctgttgaggagttaatcatatttccacgagcaaggcctaggatgctgcaatgtattccagatagttaaattaatgttgttaggaaggtggcaaaatatccacacttaagctttaactatgacataagtactaaattaagctactctaacatgtgtgcatctgtgatgtgacgatatatacaatgaagaattcatttccccctacctttctgtttgatttaaatatttacctctggctgagcatctatgtagcttgccacttactagggaatggaggcaatctttccaagttttttttggttaagagatatcctaactggtaatgggttaatgacacattggtaatgcatggatgtgattccagaacaattaataccatataatagataattaaggtgaatgcgcatggataacttacaaagagatagggttcatatggagaatgctatattgcattcacattattcaaaacaagattaaattaagaactttgacatctgaacaagtcattgttcaagtaatgaacaatactgcaccactgggaaggaataataaacatgcagagtagacaacatggactggtatggctggtccgctggtgtataggtgaccttattatgtgaaaatagggaagtagatagcagtacggcagagatggtgaaagaaaatgagctgatgaagcattttacgggttgcttgatgagccacgcctctgtgactcaggaagattaccttcattgccatcaaatgaagtgggttcagttgagccatctggtttgctgttatttctgttgcttttcatttgctcagtattagaggagatccgcccttcatcagacttttgtaaggcttctcctgtagttcctctgattttctcatcagcatttgcaaggaggtcccttttcttaggctgctcatttccagatccctgcagtgcagcttgagacccttgcttcacattgtcttcttgtgatatactggagtagctggacttgtcaccttgcggttgctgcactctcatgctcttatcaggaatagaaggtagcatttctctggacgttgctgagctgccatagcttactgtttctttgccatctttagatgatataggcttgttcagcccggattgcagttgctgcttggatgtttcttcagttgatgttggttgaactcttccagtgctactttgatttggatttgccaacaaatcatccttttgggccttgccaatttcattgattagtgctgcatcagctccttgctcttccttggcttctcttggctgagacctatactgatcatttggcaactgctgtgtggatggtccatcgttgtatgcttcattcatgttcttctgtgatttcacgactgaaggtcctgcaacctgtggtccagcatctttgggaactcccggacctggcagcccatcaggtgctactgtgttggtttgaccagcttcagaaataccattctccttgttccttgtactgaaggaagacggaagtggagcttgggatggcatttgatctgtgttatgtcatcaaatcaataagccatgatcaacccacacattaaacatacagttcaaaagaatatataggattttctttccttaggacagggactcataatcctaataggcaatagcacattgtgactaaatttagaggatgaaccaaatatccaaatcgacattgagctaagcattccaacaaaatgcaaatatgagaaatgattttttcagtgttgaaaatgctggagtgccaatataaatgcagcattttgctataagattttgggattttcaaactcatctagaaatttggaaactactatctttttgcagaaggtattgctgcctgttttgtggtgatgtttagtcgttccaccgtattccttgacctgctgctgagcatgcatatacatggaactctacttgattgaattgagcaaattttcttttagtgggggttactttacctgctgcgcgacgacgttgagtgtcaggagttggttcttgtcttcttggtgaagtaggcacgcctgttggagaagtgactgatggagttggttcttgtcttcttgatgaagtaggcatacctgttggagaagtgactgatggtttgactgctgtattttccccacgagcatcaggtgtgcctccttggagagctgtagaagcactctgtctgttggatgctggtgcttgcgcctttgaaggtggcgtttgtctttcattagctcttgatgtcttggccaagtcatcatcagtactgccatatgaggtaggagttcctcctctaattggttcaattgtctgttgggaacttgaaactggcttctgcttgtttgctgttgccttttcatcagcaggaagtttcatctctctgtcagcataactagtaccacgaacatcaggggttgctccttgaactgttgtttgctttggtatggctggagtgttgctttgatcagcacttgatgtttttccaaacatatcatcactagcgccacgggcaccactaattctttcttggattgatgctgaagcacgctgagtgacagaaggtgctgcttgccttggtgtcatttgtggtgctctttcatcgatggaattcttgtcatattgttcattaccaactccacgatcagctccttgccctgttgctaaaacatttctatcattccttggggtttcctttgttgtgcttggctgtgtcctcttgtcaacaccttctgttttggccaacccaacatttctaggagcatcaggagctgctagtttggttggaggaggtgcagaggtttgtctccattgattgatggtggatacttgagccaagccatcatcaggggaaacttcctttaatgattcggaagctttccctgaactggctggtggcgcttggcttggcactactggaattttttcttgctcattgatggatggtgatttttgtggtttagtggcaccacgatcatcatatggcattccttcttttggttgtgaagcaactcttctttcagcagcacttgttggatagtcaggagctcgtgtgccagctgacggagatctaccactttttctatcatccaaaatggttctgtcttgcacatctgagggattcttatagatagatggtgtttcctcctttgaaggtcgaaaatctgtaggctgtgatttaacttcttgtgcttccttttcactttcctccatcatcttccggagcctcttggtagagaatctttcatcttcactcatgatgttatgagtgtcttcttgagactctggttgcattgttgacaagtcaggtattttcagaattggtggtgctataaattgcttatggacattttgctcacctgatggttgttgacgtggtgatgcagctatcctgttttgatcagcctgtctagcatccttggtgaattgctggatgccacggggttgagctggttgtgcagtttcagaacctctctgatcagatgaggttttcttcacttgctcagcacgtccctgtgcataaggagactgaacaccacctcccagatcagaagatgttttgtctgcctcagtgccaggagaagtgcctagatctctctgtgcagaaggccttccagaagaagtttgtggtatgtttgtggtaggcttggtatatggagctggcttgtcaaagcggggatcaacactggcacgttcatcaatttcatggggagctttggttgatattggactattaggaccgactgcctcactgatatcacgtgttttgggtatcttggtagaagttttcgagtcttcttgtggactatgttttgtaggagttgctgtttcatcggtatggctcctagccttaaaaaagccagagagatgggatttatcatgagcttctttcgatgttgtttcactaggtttggtttggtatggggcatctttggagctggatatatcagtatctgttctctgaggaattttgggggtggtagatggggtgaagaaggtactgctaggctgtttctgagttgtaggagctctagaccttggggttgatggagttttctctgtggtagtaaagaagttgctttcttttctaggtgagggtttatcttggcggattgtttcagagggcagaggttgctctctttgtgatgaaaatgaggttgagatcataccagcactgggaggtgggactagtactgtccgtgactcagtgctagtcgtctgccgagggtctaagcgaatggtgtggccaacagatgtttggggaagctctgtctgccactgctcctcctgctgctctagttccatttggtattcctcctccactctgttcatatccttcagcacctgcttccaagattggcggttggagattgtatcccaccacctctgcacattcttccttgagtcatacaggtaggcaaattcagatgtcacaaggtggtgggtgtttggcaagtgaacaaggtcagcaagggtgaacttgttcccagcaaggaactcactctcaccaagcctttgttcatagacttcaaggacttcttccagttttcttttctctgtgttgatatcatcatcgtcgtcatcctgcacaggaaaggccaggtggcaaaacaatgcccggctcggaggatcaaacgcatgctcctcatgacggagccattgttcaatggaagccctctccagaacatcctttcccagcaggaaaggatacccacgctgttcataggtttctgctatgtagcggcaaattgctcttgattctgcaggtaagaagggtcagtaccatattctgattgaagactgaagatgcaccattactatatttctggtttctgtggacagtgtatgtcctacataacctcagttgagaaaattgagatagttttagatagtgtgatttcagttgccaattcacatgattaatacatgctaagaagcatttgtttattttggcaccatgaatcctgctagtacaaccatgatatacttgctagaatgtgaaatgtacctctctttccacttgagtgcttcatgaggtttttattttcgaaccagtttttagacatacattcagcatttcatttcatgttcaaaccgtaatcatgaaacaaattgccgctaatgatgaatgcacgacatggtacacagtggttgcacaatggcactacattttgatgaacagggtctgccaactatttccactttaaatggaattttgaaatgaaaggggacatgatatggtgtagcacctaagtttctgaaaaccagaatgctgagaatcattctttctttgtttcattttaagtctactgttatattaattattttcatcctgaaataatgaataatgtcaatcttctgagatcacatggctattgattgacatgtcaatttcatttcatctacaggtttaaaattcctgcaccaatcatttgcagggtggatgcacaagacataaattgaattcaacttatttgattcggttcaaaaatgtctcatctacaaggcacgcatgctgatacaggtaacaagcatctcattctaggatttgtgattaaccaaaaaaaaagctatgttcctttagccatgcaagcttacctaaaccatggatacatcacacaccttgccaaattaagacaggctagattgtgcaacaaacattgttaccttgtagaaatgtgggtccatcgtagaatggaactggaacactcctcgatgcctacagtcacagaacaaaataaaaactcgaaatgagatataaatatataaacccaagaaactgcttctattgttgtacattctgggtgttgccgaaaacggaaagtaacacataaatgtggcagcaaagtacctggagcctgaggatgtccttgtaagaatccttgacagtctcaaactcgatgtttttctcatacaggcatgcaagcactctggacacatcaggcatgatcatggatttctcatggtataacttcacaactggagcacctgctccggtgctaagccctgccatgacagcaagagctcaggtttgctggttgaagagttgaatgatatggcatgcaagtaagtatggtaactccaccctacaattttttaatataagaagcttatctgcctccaacgagaagcaaagagaagatgcttaaagtgagaacctagaaaaaagttgtgacaccgtgacatgatgtagtaagaaataaaatggaattaaagaaaaggaaaaggtaaagagaacaaaggggagggaaaaaagcaaaaggtaaagcaaataaaatatggagatttgaacagtgatgatgttctttagttattccaacccttgctgcgatatctatttccagcacgttgtgattttaaagagcaaaggtaaaataataaaaagctacttcttggacactacctaggtacaaacattattatgctgccaactgaacgggaggatagatcgtatcagatgtactcccctattagctaacatcgctttattcatccgttgcccctttaaccaaaggagatgcaaggtgctctggtgcgtaaattcacatgttttgtcacagaaggcaagtataaaatcagagactagcagcagtccagcacaagcctctagcagcagcagacaaatgggatgatgatgggcaccgagggtgcctttgtaccaggctaccaggttacccatacctgctagtggtaggtttgaaaccttccaatagaggccaatagaggcctgatttagttcccaattttttcttcaaactttcaatttttccatcacatcaaaactttcgtatacacataaacttttaactttttcatcatatcgttccaatttcaatcaaacttctaattttggcgtgaactaaacacacccaaagtatactccctctatccataaatataaacgttacaagggtttaaaatttgtccataaatataaaaaattacattcaagtttcttctcatcttacatttaactatctttccacttccaaccatctcacatttaacgaggaatattgttgttggtggggggggggggatttgtgacttttctcttgccccggtttcgagtgcttcttcttaattaaagtactttaaggggttttaatttcctcttgtggctgacctttttttaaacaacctataaatgcttttatgtaccaagctagcagcagaagccttgcataatactatctcatcccaaaataagtttattttttcctgtcccacacataccaatacaaaactaagaaaactacaacgactctactttattaaatcctaatgcaattattaatcaatttatctattccaaatacaattatttcctactttcacaaactttgatataatgattattctaaaaataaatatattttagaacaaataggaaaagctaaaaatattttggcataatagcagacaaacaggataaacgatggttgtactacaaggtagcagtagatgcctggcatggtactagtagcagacaaacatgataaacgtacatgcctttgtaccacggcttcccaggcttgtaccagcctaccaggcctacccatgctgaaacctttataataggatctccatattagtagtaggccgttaaccattttgtacggagcactgttatgtttttaggggttctttatctagagcagcatataaatactcatcacaaaagttcatatagcacgctgcattgtactacctccgtcccaaaataagtgcagtcgttgaaatccgtgtccaacgtttgaccgtccgtcttatttgaaaaatttatgaaaattttaaaaaaaattagtcacacataaagtactattcatgttttatcatctaataacaataaaaatagtaatcataaaaaattttcaaataagacgaacggtcaaaactgcgcttattttgggacagaggtagtactaggttaaatcgagataaagtattgggtgtggaacacatttttagtaaattaagtgtcaccggaaggactagcatggtacgggcatttggaccaaatttacaacattatggcgaaatggcatgtggcttagtggttacacgagcctaagtagcaccttaggttctaggtttgactttccatggaagcgattttttcaggatttaacagctttgtgctttcagtggtaagcgacgtacccgttgatagcgaggcgcatgtggtgatttcaatctccaggatggatcctgtggtgacttcgtcaatctccaggatagattggccggtcgagtcttcgaaaatgctcataggagtgagtgtgcgtgagttgagtgtctgcgttatactgtataattctcaaaatttataacattaagtaatgttctagtgtttagaaatgaagtaaattattttcatttgtgaatggttgcaaattatatgcacagtttataggctccatgttttctgaattcaactcatgtagcctattgactgattccacatggtattgagtattgactctttctgaggactatattgtgaaccattggatctaaaatgtgcgtcccggatctcctcgttacattttataaaacgtctccctcaccaaccaatgcacaaaaattttcctcctaatcccagctatagcaaggtaccaaactagataaaccttgggacaacttgataatttgcatatcaacttgatatatgttaaactgagtatttatctagtttgacaccttgctatagctaagattgggaggagagaataacttagattacggcagcggttggagaaacaatcggtgaattgagtcagccgtcgatagacggcctcacatcaaaagagcaacatagttggcagtattattttctgccagtgttgtttatctgttgcaatcgttgtccaatggtgtaaatttgatggcaagagaaaatgtgcgactctcatgtcaagattttagctcagctttactgaagatatagaacaatatgttattcatataaaatcggaaaatttatgttctttctgagaaaaaaggttgggaaaattccatcctgtctgtagcaaaagctatgtaagctccccccttcctttccttcttgaaagattaaacaactcttccttacagccgagctagcttatggtatcccgacggtaagcgcaataaccacggtgactgtcacaagctatgaaaaaccggaaaaagaaataatcaagaaattcaaaactgtttaaaattgtttaaatttggtgggattatcacgcggttagcattaaccggcgcccggcggcattgtcaatcctgttgaagccaacttctgtttttgccgatacaaggcatccacagttccataccattgtgtttctcccttgcacacgtctctgtcatggtgtcattcacccaaccacccgaaaaccatttgcccattcaggtcttgcgtggaacattgacaccatatattagagtagagatgccttcaccgtgaatccttcacctgcatatgttgctcatgctgaagaaagaaaaggtcagacaaattgcgatcgagacgcagctcgcaatcgccgtagaaaaacctgtggcacacctcccctgttggtggtaatcgcctaatcaatgttccgttgaaacaattgctcgctgcagctagcagaaattgactcctccctacacgtcccgctgcacccgtcgcccgggcatcataggagaagtttctgaattcgctttcactcgcctcatgtcatgaggggctctctctccatttctgcacttgtgtttggtcttgtttagctggggaaaatttctatgtttgtttgtcgcatcggatatacggacacacatttgaagtattaaacatagtataataataaaacaaaaaacaaattacagattcccagcaggcagcataggagaagtttctgacttcgctttcacttgcctcgggtgtgtttagtttacgctaaaattggaagtttggttgaaattggaacgatgtgatggaaaagttgaaagtttgtgtgtgtagtaaagttttgatgtaatggaaaagttggaagtttaaaggaatagtttggaactaaactcggccctcatgtcatgagctgctctctctctctctatttctgcacttgtgcttgtgtgtagctgagagcatcagacagagacacaggaagaagagggatgtagaagaagcttagccgttaagagagagagcgaggcaaggaaagaattaaggaagagagaaaggagaggagaaatgctggaggcgtacgtagctagccccaaccactctggccgcgcgttgccatcaacgctcccgcgtggtcacccgtttctgcagcggcacgtctgaccttatggctttaagctcacgggggtgccggtggctgtggatggactcgttcctccaaccacctggtgcgccaccccgatagagggactgtgttagtactccctctccattaagcaaacgtagtacatggcgtgatatattaagtatctggacaagagcacatcccgtattagattcgtttattttaaggtgaagaaagtaggcccttcaaagtgccttttggcttacgggttaagggcccatttgaatcgtaggaatgaaaaaaaaacagagaaataagaaaaatacaggattctgataggaatacaattgtaaaacagagaattgcaaaacacaggaaaaatacaggaatggccgttttgattggaccacaggaaaaaagcaggaatcagatgaaagagatagactcagaggaaatgttccaagaggttagacctcttgctaactttcctccaaaatgtgcataggattacccattccatacgaattttaaaggaacgaattttaaaggattggatatgattcaatcctttgtttcaaaggccttcataggatttttttttctataggattgaaatcctccaaaaatcctatatttttcctacaaatcaaaggagccctaaatgctgaagagatgatagattatctgattttatgatagtatatttgagagtgtaaacgaatgaattaactgttacgaagttgaaagttatttatttttttaaaaaaaaccattctaacaaatttatgcagagaacttttgtagaaaccgtactgtttagaatattggggagactgtctgtcagtctgtgatactaatatgcaaggaaaaagaagtgcccgtacggttttttcattaaaaaaattcttaacatttttaagaaaagtagtaagatcagtgtttaaggctttaagcttgcgtggcagcctgtcaggcaagcggtgcatggctgagctggcaagccaagtgcatatgcttcatatcatatcatctcatgcgtaccctttccctcggctaatccttgtgaattatacacgcgcttgattcattaattcatatgtgtcgtgtactactaatcaccattcaccaagcaagcatatttatatgctaacaagattttttttagagacgtacccaacatccacaaagctagctagctagatcctcctcttctctgcactctgctagagcaagctcgatcgatcgatcagtgatatttccccttatccaaatccagcacaaaccaacaatatccatggaggccgtagcagtgcacgccagcttctcgtcctactcccctccggtggtcgccggcggccgcgacgacgccggcagcagcagcagcagcaggagcatgtcccgcctgccggctcgcgtcgccggcgccgtagctcgcggcatcgtcaccttcgtcttcgccacaggtaggtggtggtggtttcttgcttctttttgtttgcctcgattaattcgagctcgatctgtttcatggaagtaattaacttgagtaattgatcgattggttgacagtgggcacgatcctgggggcgatcaccggcgggctgatcgggctggcgacggagagcggcatggtgcggggcaccgggatcggggccatctccggcgcggtggtcgccatggaggtcgtcgactcctccgtcgccatgtggtgctcccacgactccgggatctggagcgttctctacgtcgtacgtttactaatctcctgccaaaatctgcatcccctactgcaattacagttccatctcgcagctgagacgatgaatttgcattcattcttattactaatccaacttatcgtaccaattagcaatccaattaagtttatttgctgtactaaaaaaagatatgattaagctttccttgttctactaattgatagtaccaatttgcaagctaattaagctttttgcttgcttgctctaccaaatttgggagctaattaagtttggttgtgtttgtgtgttcagcttgacgtgatctggagcctcctgacggggcggctggtgcgggagaaggtggatccggcggtgcagaacgcggtggacagccagatgaacgccgccgacgcgcccttcagggagagcgcgccgacgctggcggagatgttcgacaccggcatccccggcgtcgccgccgccgccacgggcatgccggcggacgccatcgccgcgctcccggtcaccacgttcgccgccgccgccggcggcgacgaccgcgccggctgctccgtgtgcctccaggacttggaggacggcgagcgggcgcggaggctgccggagtgcggccacacgttccacctccgctgcatcgacagctggctgctcaggcacgcgtcgtgccccctgtgccggcgcacggtggtcgccgccgccgtcgccgtcgacgacgtcgtcgtcggctgagctggcgcgagctcgcatctggttggctcgttcgtggttaattaggcttaagctagaagattagtgagaagggcgtgcagtgcacggcacgccgccggcgacggcgtgaggatcacgactgacgtgcgtgtgtgtacctactacctcaccttcttttgataccttgattcgttttggcgtagtacatatgtgtagcggatacttgcattatactagtatatacacacacacttgtatgtattgtagatttatatacttgtacatggagaccttgtgattaacataatagagagatccagattttgtctctatcttagttattaatttcatcactaattttgggcctattcagattactaccaaaatcaacctccaaaatttggcaatgctgaattttttataaatttatagaattgccaatttttgataggatggaacaaatatgttgtgccaaaattttctttacaaatatttggtaaaattaaatgcaaccatatatttgtcaactttaccaaaacaatgatatagttaaaatgacaccaatctaaacacacgcttgttcttatgcaagatgcatattgtggtttgctatttgttttaagacaagtcataatcgatcattgaagacagttcagaagaataataatccttagtgcaatgctaaacagagtaactggaagcactgaaccatccttttccaaatgaaaggctaagggaactaagggagtgtttgaggagaaggggattgaggagattgggaagatacgcaaaacgaggtgagccattagctcataattaattgagtattaactattttaaattccaaaaatggattaatatgattttttaaagcaactttcctattgaaattttttgcaaaaaacgcaccgtttagtagtttgaaaagcgtgcgcgcggaaaacgagagccaatctcccctatcacccctaaacgaacgatgcctaaggaaataaacctaacagcagaaaagaggcatatagacagggtaatctctatacttaaaacacgacgaccgcgtccatgagcctattttgatgtacactgcctacatggaaatatcgtagttcaaaggtttattgttgagttacagattttggtgtgaacttcattgaactcaaaggatttttaagagttcttctgcgagatatgtgttgtggtttgctcgctggagtacttttttaaagacaagtctcaatcacaaaatctcaatttactagagtacttattgtaagaagacagagtttagaagaataatcttagtagctgaaagtattgaaccactttttttcaaaagaaaagcttaactgaactaggaaaatatacttcctaatgaaatctaacaatagaaaaaaaagaatatcgatagggagctgcggcgttgtcacaataataacatctgtaagtctattttaatgcgcacactgcttcacaaactagtgatcgctttcgtctgcctctataaaaatagcataattcaaaggtttgttgttgagttcattattgaatctgagaagcactaactacaatcctaccaactagagctacagaggtgatatgtgctcaacccaaacggcgaacggtttaagttcgaaagccctcctcctcaagaggataccggtttcctgattcctatgaggtcacctacataaagggccatagttgaaagcccatcaattgatttcagcgttaggcccactcacatcgccgggtggtgggccgtgtaccatatgatccgcaggcttctctgggggcttcttctttctggcttaattgacttggttgggctaattgatgggcctcaattccatcccatttatgtacatgggctgagatttcttttagcttaatttcttgctcacaagagcagagattaaaatccatccgactccaaaagaaaaaaaaaaactgggagagatcggctgtagtgatagatgatcagctagcagctatagctcttgattgatatcaccaccatgatggaatgcttctaaccacaagctgtactaaaataactttcaagagaaatgtcatttgcatgtcgcagttggttggttggtcggtcggttgatcgtgtgagaacgcagtcatgatcgactgctgctactgtttggcttggggacgcacagtcaatgctgcatgaagcacgtgatgtgacgctgacactcatcagtcatcactcatccaaccttccgccagtctgtcccttctcttcactgttaacgttgtctaatgactcctggctccttttgttttaaatatagtaatctaatattatcatttcgtttttaatataatccgggtaaacatcagatttaatttcaataaaattaggattaattgtgatactgttatctcttcctcacatgaaacatatgcatggaaataaagacattaagggcttggcaatttggtaatattgtcaaaattttgataggatttcggatattctgatgtaattaaactaaatggatgtatatatttgacaactctaacaaaaaaaaatggtatggtttgaaatgacatcaatctgaacaagccctaaacctccaaaggtgaagatttccccatatatcttataagtgaaaacgctcctcacaagtttaaggaaaaccaagtaaaaaccaataactttttatccgtataaataccatctaaaaatcccctaaaagaacaagctactcccattgatttttacagacggtctcggtggttttgtaaacattagaggatctccaaatcaccaaatgtacgtaccagctgctgcgtgcatcggtccaccgaggtggtcacgtcgccgtcgtcgttcgtcgtcaaatttttgtggtagtgtcgtagtagctgccacacgagaaccatgtcgtgattaaacaataaatactgacagtccttgctatatctagctacttctctaattaattaatcagcctgcgccgatattgttcttttcaaaattcgattttaaattcagtcatcaacagcgctccagctggttttaatttcaagtaggtgaagttgtacttgacgtgttgtatataatactctcgtttggtaatcgaacagtacgtacatagcaaacgtgatatctgacaatgacagtcgcaactatataattaacgattactcctcgatcgaattattcacaaattaaatcgatcaacgcaatattgataagagatcgcgacgaccgtggcaactggcaagtggcaacccacttatatattgaccgtgtgctagatacgcactattaacgatcacactattgtgatgcgaccagagtttatagaaccatataattatcacgtagttatatttacgataaccttctcggttttaaaattatggtatacctcataataatcgcatatttttcacggtaaccaccaaatcgtgaggtgataaacatgtttttttttcttattaagttatttttagataattaatggataaaatctgacattggcttcaacaaaagctacaactactcgttacaaaattgtcgctcatcatgaccaataacaaaagaaagtggagtacgtagctaacaaagggtaaagagaagacaaatataaatccatattggtcacagttcagcaatcctcctagctaatgaatctctatccaaaataatatattaattcatattagtcataactaataactttgccttacacgtgtgcaatataactagtatgtgtatgaagtggtcatatacatcgatcttctaatgaaaaagaaatgtagattaatttgcattatttaaaaaaaataattatgaaaaatgaatcgggcaagatgcaatggtccattgtatgtattaagtttgagagttattgcaccagtgtcttctagacccagttgctatatagtaggagccaactcatatcgatcgtcgcgtcaaacctctccatcggtcgattcagagagagatcgagatcagcgtgagagagagagagagaatgagcagtacgagtggatctgcatgggatcacagcaacaatggaggcggcgggtcgccggagttgagggaggcgctgctgctgggtgacggcgggtcgtcgccggagtcgagggagattaaggggattgctgtgaagaagcaggatgacctggaggagatccggagcgtgggggagctgatgcggctggcggcggaggagaaccggcggctgtggtacctggccggtccggccatcttcacgtcgctggcgcagtactcgctcggcgccgtcacgcaggtgttcgccggacacctcaccacgctcgagctcgacgccgtctccaccgagaacatggtcatcgccggcctcgccttcgggatcatggttagtcactcactagctagtactccctccgtttcataatataagacacaactatattttttatatgttacataatataaggtatgcatgcatgcatacaattaattagaacctcttctccattaaactattatttttttaaattctccatcctcaatatctctaattctattggatacatgcattatatttattagagtgattcaaactaggagataataataattatttcttggtctttgggttaagagcggttatgccttatattttaaaacggagggagtagggagtagctggctggctacttccttaatagttactccagttacttccattcatctattcctacttacctaccacctccgtcaaaaaaaaatattaaatatgatacattctaatacttttatatatatatatatatatatattaaatttatagtactaagatgtaccaaatttaatattgattaattttttagatagagcgaagtgaggggagtataatataattaccctcgttcaccgatcgatcgtgtgtattactatctccatctcaaaagtactgtcctttttttaatttgtgtaaaaatttactgtctttttaactatcaacttgactacagtacacttttcgagagaccttggaagtacagtagttaattttgcttgattagcttcccaattttttcttcattatgtctaaactttatcttaatcacaggattgagttgtacatttttgcgcttatgtcagttatttggatccaaagttttattaaatcttagtctaacttccttgtaattagttaaaacttgttttcttaagacaaattttaattttcttcatccaaattaacaatcactgcaaatattttttatacgaaagttatttttaaaaaatcatattaacccatttaaaaaaatagcatatatttaattaattacacgctaatgaatcactccatttatgtgcgcgagagattggatcccaaacttcaacatacgaacttaggggtgaaaacggtacggaaacggacggaaacaaactttatcgttttcgttttcatatttttttcggaatcggaatcggaaacaaaaacggaaacgaatagtatcgaaaccgaaaacggagcgaaaacgaaccagcgcggatacggtaacaaaaatttatcggaatacaataacccctcaaactgagcttcaaacttttgtcaagtccaattcgcaagtctcaacagtcaacaattcatcataaaacacaattatatcaagtctaattgtttagtctcaacagcaaaaatatattcttctataacttcatataatttgcataacaaatattctaaaagaatacagcaaaacagaatggtataagtctataaggtatacacaattcaggtgctatactgctatcagcctatcactccaggaaatgggtttgagaacaacaacagaacatcagtccatcaacacttagttcatcaatcatcacagaacagcaatagttcatcaatcatcacagaacagcaatagttcatcaatcatcacagaacagcaacgcacatcagtccatcagtgtttcagtacttagttcaatcacaaaacacatcaccctataaatacatagttcatcacaaaacatagttcaatcacaaaacacatcagtacatggttcaaacatatctcatccacttgtgcagcaggagtacactaatttgaaatggaaacttgaaattagatgtaacttgaaaattaaattgaccaacattttcttcaaacatccattggcgcaatgccatcctcattagaacattccgcttctactgtctctgtctcttgttccgttccattagccttcaaaaaaaatgatagagcattagtaaaagtgcaaagtcaatcactatatacacctgctgctgctggttgctcagatgctgccgctgggctgctggctgctgcgaggcgaggagccgtcggcgttggtggcggtgaggaagagactgcagtggtggtgtcgtcgtcgcctcgtcggtgtggtggttgttccgtcgtcggcggcggtggtggcgatggtgaaacggcgagacgcggtgggacggcgccttgagatggcggggaccgagcaggccggcggaggtgcgagatggtggcggcggccggcggcgaaacaacgaagagcaagggcggcgcgaggacggcgggggccagccagccaggcgaccagcggtaggcgcgagggcgcgccggcgccgtgcgagatggtggcggcggccggcggcgaaacgacgaagagcaagggcggcgcgagatggtgggggcgaggacggcgggggccagccggccaggcgaccagcatagggcggtggggggccggcgccacgggcggtgggcgtgagggcacgctggcgccgcgatgccgcgatctggacgccgcagccgccgctccgcctccaactcgcgagtcgcgtctgagttctgagtctgacggtctctctcctatagggttagccggttagggtagatgccgccgcgatttgggttgggctgggaagctagggatgaattatggactattgaatctatgggctttttaacttcggaaattccgacaatttttctggaatgtttccgatcgtttccgggttccgacggaaactgctattatcatattcgattccgtttccgagaaaatatttccgttttcgattccgattccgagaaattccgaaaaaattccgactggccgattcggtttccgaaaacatgaccggaatccggaaaattccgtactgttttcacccctaatacgaacacagcgatagttgcagtagagagttaagtgcacatgtcttttttattaattccttgttttctccatcacctgcgcaacatttttttattacatggacgcgtatgcacacactactgtacacacaacaccatatgcacacactcgcacatgatttatatatgtttatgtatcacttttgacccttctagtagtatgtcttttttatttataaatcatgtgcctactacccagattaggaggatcgaattcaacttaagaacgaatggaaggctatgtaactttaattttggacatatttaaattagttttaactaaaatttcaaaagtatgttagaagattttttttgggaaatcttgcttgaatttctgacctccacttgaagattcccgcaacacgtgttacccgttctctaagagccagattattataagtcggattataataagccgatatagaataagttgttagatgtttatttctctaaattgttagctgtttgttagttgttagccaccaaataatctaaaaaagcacctttcgaatggattatcagactatagtaatatggtttataaattgtaataatctatcataataatctatctgtttgttttagcttactcctaaaaatgtgttgtgtgtgtatgaatgtgtgcggtgcagtacgggatggggagcgcgctggagacgctatgcgggcaagcttttggcgcgaagcagcatcacatgctgggcatctacttgcagcgctcatgggtgatcctcaccgccatgagcgtcatcctcctccccatctacctcttcgccaccccgatcctccgcttcttccaccaggacgacgagatcgccgtcctcgccagccgcttctccctctacatgatcccccagctcttcgcctacgccctcaacttccccatccagaagttcctccaggcccagagcaaggtcatggccatggcggccgtctccgcggcggtgctgctgttccacgtcgcgctcacgtggcttctcctcgtgccgctccggatgggcctcgtcggcctcgccgtcgcgctcaacgtgtcgtggtggctcgtcgtgctcggccagctcgcctacatcgtcatgggctactgccctggagcttggaacgggttcgactggctcgcgttcaccgacctcctcagcttcgcccgcctctccctcggctccgccatcatgatctgcctcgagttctggttctacatgttcctcatcgtcattgtcggtaacctccccaatgcccaggtcgccgtcgccgccgtctccatctggttagtgaaaactcaaatcatcccttagagggatatctctttatttttgtgtcactaaaaagtcataaaaaaattgaaaaaaatagtaggatatatcaacatgtgatatatcaattcacaaatatgcaaattcaaattcaatttatacaagtagaaacaaaaataacaaatttgactataaagtgaacgtgtaattcacagttaaatttattatttttgtttcgaattgtataagtcgaattttaactcgcatgtttgtgaaagatatatcatatattgatctatcttgataatttttaaataattttttgataattttttgaacggcatgcacaaaatgagagaataaccccttagggacaaaaacccacactaatcagtaatcactcatcgtcttcactgttttatgctcggatcgtagctgatgtcgatctcgatctgtttgcattttgcagcacgaacctgtttgggtggcagatcatggtgttcttcgggttcaacgcggcgatcagcgtgagggtgtcgaacgagctgggcgcggggcggccgcgggcggcgaggctcgcgatcgcggtggtgctcgtgtcctcggtcgccatcggcgtcgccttcttcgcggcggtgctgctgctccgcgacgtgtacggcgcgccgttcacgggcagcccggaggtggtgcgcgcggtggcgagcctgggcgtggtgttcgccttctcgctcctcctcaacagcgtccagccggtgctctccggcgtggccgtcggcgccgggtggcagtggctggtggcgtacatcaacctgggctgctactactgcgtcggcatccccgtcggctacgccatcgcgttcccgctccgccgcggcgtgcaggggatgtggggcgggatgctcactggcgtcgggctgcagacggcgatcctggtggcgatcacggcgcgcaccaactggaacaaggaggccagcgaggcgcacgccaggatccagcactggggtggcacggccaagctcgccgtcgacgaccccatctagttaagcgacagcgagcttcatcatccatccatggcgtaagaatttgtaatgtacctgcacaatgcaagtacatgtacatcctgttgtcggatttggtttgagattcgtgcgcgtagcatggattgcaataagaaaatgcagatgtgttgatatgtcgtggttttgtgtatccgagaatgtcaatccacgatgcaattatgcagtgtatgtgcaccttgttgtttgtttggatttgattggagattcgtgcgcgtgtagaatagataaatatcatgaataaagcatgatattatatactagtatctccatttcatacaatttttttctaaatcaagtttatagaaaaacataacaatattttcaacataaaacaaataatgttataagtgttactgtttttttaaaaataatggtcaaacatttaaaaattgactttaaaaaagttaaaacgaattataatattaaacggagtgggtaaaaagaaatgcagttgcgttgatattgtggttctgtgttttggcagtttggtctcagattctgtttgtcaatggcaatggaacttgggcaatggatgtgtatgatgtaacgcaagcaacattcgttctccagtgacttactcacggaaaattttttttgacagaattggcttttggtgctactatataaataaaactaaaataagtaaagatatttccgtgctataagaccatttttttttccattggattttgatgaaataagacaaaatgacacttgcatgaagaggtaggagagcaaactgaggcccctatcgtttagccaagtacggataatagcaaaataataatatttataggtaagatttttatttatacgttcttagtgatttagatgccaatactgaaaaataaactttaaataaaagattttaaattttggcaacgagcgatgctgtatggaggaagcgatgggcctgaatcctaagccgtctaggatgaacaagcccagtttaaaaccaacacggccctcacacagacggcccagctcagcccagcaaaatataaaacaaagaaaatacaggaaacacaacgaaaagcagaggagaggtagcccaagctcggaagggaaggggagcgaccttcttgaggcagaagtcacgaaccaaccagcgccgccgccgcgatgacggacgtgcagatgagcgactccgagccgcaggcggcgcctcccgcggcgccggcggcctccgccctccaccgtaagcggtcctcccccatcccccagaaaccctcgggtggaattcctcagatttgtttctgatgtggttgcgcgctgttcgtcccagatctgaaggagatcgcctcggtgatcgaggccggctcgctgtccaaggaggtgcgccggatctcccgcgccgtccgcctcaccgtcgccctccgccgccgcctcgccgcccgcgacgtctccgccttcctcgccttcgcgctcccgccttcctccgaggcctacacccgcctcacctccctcgtccccaaggtgaattacttctcatgcgttcttcttctgttactagtataactcagcgtaagagcaacttaatattccatgtgatgcaactaaactatcagtgtttagatatagttgttggcatggataaacttactagacatgcttgcatgatgtgtgtgattctggaaagtttcccgttggtaagtaggtacctctgacaaaatttccagcactgagatatttgcattgagttggtttaatttaacatagtgatcagtaattctgtgtggatctgggttttctatggcaaaactggaatttccaaaccttggtacctgtgatgctaactgtggatatttgatttatcatcactgcattatcaaccgctctgtagttattttggaattctttctttaaataagctaatcatatggttaaaattttaaattaactggtaaacaggaattttgggtgggtgtggtcttatttttgttgttatcaaaactggaattattccattggtactactgatgtaattcatagatgcttgttatttgatttatcactgtggtgtttgactttctcatggctgttttggatcgcctgtgtctgtcattccatgattagcaacctaaatcgctgaacatatagcatgggtcattttctttcatctcttgataggaagcacttgcaaatagaggttaagtgagctccttcactgcgcacttcgactttcaaaaagatcatattttcatgtatcgtatatttgcaacgttgttcattatcgttatgttatttctgcatgtttatgctgaaatctatttttagaacatattagaaagctattcctagaagtctagagctgtaacgttaagccttatttagcagtatctctatgatacccaagaaattgattaccagtatgagatactgcactctacttgtttttttttttttcatttgtgatgactctgttatatgaagaacataatatgctgttgcactatggtcggcgtagtttctgtttttgctacttgttttgtaatttagggctcaggacctggaagcctaactttgttgtttcattgtgtatacaatgatataataaggagagtaaggtaaaacatactgttatcatatgcacggtgtctgatgtccttatttgttgctttttaggaagatgacactgagatggacattgacatggcagctccagcaactcagatttcgatcaagcatggcctccctgagattgaaatatattgctatttgcttgtcctgatttttcttattgaccagaagaaatacgacgatgtacgtctaagactactgattttatcttctgctctcagtgagacattctaatttaaagttctcacctgtctctaggctaaagcatgtgcaaatgcaagcattgctcgtctgaaaaacttgaacaggagaactgttgatgttctggcatctagactgtacttctattactcatatgtgcatgaactcaccaacagccttgctgaaatccgtgggtacgtcaaggtcttatttaatgcttagttgctcactattcagtgtcttactaccatgtttatcgacttttcctgcatttactctcttttcaggaatctgctagccttacacagaatggcaactcttcaccgcgatgaacttggccaggtagttttggtttctatatcctcattgatttattaacctttaagtcatctaattcttgtaatctgtgtaaatatacctgttttcttgattgcaggaaactttgctcaacctgcttcttcgcaattacctccattataatttgtatgatcaagcagagaaacttaggtcaaaagctcctcgttttgaagcccactccaatcaacaagtatatatctgcttgcaccatttattactctacagcttgtgaatttattgtgttttggatgttgctcatgcgaagtttcatactccacttaaatttgtttctacatgttgttgttaagacaccttcattttagttaatgctttatgattattgaagtatgagatcatccttcagccaactgaattcacaggacagactcttgggcatatgctaataagtgccttttattgcagttctgtcgatacctgttctacttgggtaaaatcaggacaattcagttggagtacactgatgctaaggaaagccttctgcaagctgctcggaaggcacccattacagctcgtggctttcgtattcagtgcaacaaatgggctattatagtgagactacttctcggagagattccagagaggactgtgttcatgcagaagggaatgaaggaagcactgacaccctacttcgagcttacaaatgtaagtaactagactttcctgaaatactgtgttgcataggtggaaaactcagactgacttatttgtggtctctaggctgtcaggatcggtgatcttgaattgtttagggctgtcgccgacaaatttgtgagcacttttagtgctgacaggactcgcaatttgattgtgagattgcgccacaatgttattcgaaccggactgcgcaatattagcatttcatactcacggatctcccttgctgatattgccaagaagctaaggctcgactctgataatcctgttgctgatgcggagagcattgtagccaaggcaataagggatggcgcaattgatgccaccatagatcatgccaacggctggatggtgtcgaaagaaactggcgatgtctactcgacaaatgaaccacagattgcattcaactctcggattgcattttgcctcaacatgcacaatgaagctgtgaaagcaatgcggttccccccgaactctcacaaggaaaaggaaagtgcggagaagcgccgtgagaggctccaacaggaggaggagctggcaaaacacatggctgaggaagatgacgatgatttttagactggctggccacttctttggcactttgggctgccaaattgcaatgttgagttggttgatctgagagaccgtaacacacctatacatgccactcacaaatgatatttgagtcatgcaaaaaccctttgcttcatctgccggaaatttatgtcgatgagaaatttatgactccaaatgtgtctagttggataacttacttttaccttcaccttgtatcatggattcgagaatttcttttgtaccatgcgaaattcggctgcttcattcatgtattgtggttcatgtgtgcgcgtgcgctttatgcatcctgtacttatgtagtagtggtagtagtaattttgtcatgtttgatcgtgcgcgtctcttggtttttcttccaggaagtgacccaagaacgttaattttagttgaaacctaaaagctatattaaggagaagtcatgatggagtagaatattttgtgttgcccaaatctgtgaattgccgtggctgtaatgaatggttgagcaggtcactcaagcagatgttaattactgtgttctgtttagctgaatccatgcatggttatcaaagatacgttccaaaaaaaaaaagggtttatgcaaagaagtactctctccgttacactggagcaggtggcggcgcgagtttatttatgggccggggagaatagctcaccgcctcacccaaaggtggtggtaagctcgcgtatattgggatcgatacaagctagcagatggccggaattggagacgaggaagtatggagaagcatctagaagtggctagaatacgatcgaacgccagtgtggttggactttttctttctattgctgcgtagaagtattattaattcttccccacccagccagcctctgcaccgtagagatcgatagctagataattcccgacctcagtcgatcgatcacaacatgttgttggcttcaaattctgcagatactttagtcaaaaaataataataattctgcagatacctagcttgctgtaaagtttttctggtcgctaataactaattaatgatgatctcctccttccttgtagtctcctcctccatagttctgtgtatatatactccctacagttttatatattgtgcggtcactgcatggatgcatgcgtgggtcgtcattggactggacacgatacatgacagtatctataggatttaacatgtatatatagctaagctagtatatatatataggagtatatttatatactcatgatttattaattaattacattccgacagtatatgaatgtgtatgcatgtaggagtactaattaacaccttgtaattagctagccaaattaaagcgccgatccaggcgacacagcgagatcacgcgcatactacgtatttcgatctatatatgcaattatatatgcatcggaattagctagctgctagctacagtacactctataatcgtcctcacgtacgttcacaaaaaaatcacgtacgataaacaccaccgaagaagctgaagctcccaggggcgtcgatagatagatcatatcgcgcggtgtgtagctagatctcggtctcgatcatatcgatgcattcatccattatatattttcctttccttttgtttcccagcctgaccccatccatcgatcacttaatttggatcaacaaaattaagcaatgaactcaaatatggatcgatcaatcgctgtttcacatttgccctccatgccgaccgaattaaagtctttcaaagatttgcacacagtacgtgcttaattatatgcgtgcggtttgattattaaaagctagctagctatcatcagaatggatagatgcaaacccttgcatgatgttatcgtccaggggatcgcattgatcaacgtgttagatcattgatcgattaatttatttgtcctatacaaattacatatataggataagatcgatgatgaacaaaaaagttattatatataggtttttcattcctcttgtaaagaaaacaaacatgataatatttatagtaggacgattgattgattaaactcaaaacctctagtagtagtaacataatttacaactaagctacgctagcaattaatctaatcacgcccttaaatattacttactcaacaagctagtccctgcaaataacttatatttacaaacaagtccctccccggccggctactactactctacgccggcggccttggccttggccttccttccgccgccgatcggcgccgtggcggcgtagatctcggcgatcgggcggagcctccggttcctccgcggcctcccgcccacctcctgctcgtcgtcctcgtcgtccgcctcgcccaggccacccccacgccgcggcgcgttgctcacggagcgcggcgacgaggcggaggcggaggcggaggtgaaggagaaggacgacgaccgcggggacgagctgctctcgctcaggtggatcagctgctccgccgccgccagctccagcgccgtgaaccgctgctgctgcttcggcgacgacgacagagacatcaccaggctctccccgtccgcctccgcctccgcctccgccgccggcggcggtagcttccggcgccgggctagggatccctccatggctgattggatcgaggcggcggggcgtggatgggttggccgccggttaatttcgtgtgctctctctctctctctctaatttcttcctcgattttttttggttggtttattagtattattttttatttttgtgtgtgggtgtgggttaagatggaagaagaagggagttaatcggtcatgtggttgctgcgtgcggcgtgactcggcggaaaccgacttcgcctaggcgtgtaaaacagaaaaagtacggggggttttgtgaaaaatgtgattcttggttgggaacaaaagctgatgggaaattgcgtggccgtgatgagtctgcctgcgctggactcgatttttcctctcaggggggtatgtgagaaaatggctaggagtactaggttaacggagtgaaggagttgtgtgtaatttcggttttgtgcgggggagattagagtaatttgacggaggaggagaaagagttaaaaggtgggcatgagacacgtcatcacggcgcacctcacgtggctcctagttgccgccggttaattcatagaaaagtcaaagttgcagggcttagctagactgcatgcacgtaccagcttagctttgctttatactccgtagtatccagccatccaggtagggggtgtgttatgttaataatcacacggctaaattaaatcacaacaagtcgagagaaatgtaaattaaagtctgtacatggtcggtacgcgtgtagtgttcctgtactgtgttggcctctcgcgacctttaatttcagacctttaatttcaggcagctaatgcgtgcgtagctgcgtgttgtatgtatcatatatatgtaggtgattggatggatcagtacacaagccagtttgtatatctctgtcctaatataattaccgttaaaaactaatatttagaagaactattatagcgttctttatcaaattatgtatttaggggtgggatggaaaaaaggcacaattccaaagtaacaagcattttgaaacaaattttaaattctaaaataacatctattttcgaacgaaaagagtatatcacggtctcatgtattctcaatcatccaccctctaccttagcttagacatgatgacattcacccagccccatctctcaagattatttggagtgttggggagagattgatgtggctatacgatcgcggcagctaatattgctttactatatatacaacccatctactgctgcagccggctgcaaagcagcattacagcccattatgttccaaagatattattgaaaagctacatatttaactatatattctagaactacaaatatagtataaactttagcataaaattatgtatttaagcagacaattgcagaactacatatttacaactctatcagaacaatagtgctaagattttaatatccaaacttaaattttgggatagttttggtgaatgatacatcgtcttaaatctgttgtaataatttcaatagtttgactagagtatttttttagttttgtgatttactttcttttccatgatccaaatataattatagatatattgaaagttttgcaggcttgttcttttatctctactgtgaattagacagttcggatcaaacttttttcgatcgatccaaccaatggtgtacacagagaaccgaactagaacggaggctgacgatctagtcttgttcaacctgagtattattatgtaactgtggttagttcttacatctgtagcgacgatggcgtttgttctcctttttgtcggtcagagtacattttattttagctgtatgcgtgcgtttgaccgatcaacgcagctagctaaatcagttagttacgtacatgaagcttgattggtcattaagtaatcgatctgaaacatgtaacccttctgtcccaaaatccgaacataactaaagagggtaaagctaattgagaaatatttctgattggctaaaagtgaaattaaataagacatgataatagtaattagttgtgatcgataaataaattaaagtaaataaagttgctatactattttatatgagattttgaaagctaattaaattttgttaccgggacacgatatgatcgagcgatctctacacatatacgtgtcttaatttggtgcgaataacagcgtatgtttttgcgcgccgaccaagctttgccatgcttggttgcaggctgccgaaacgatggcgtcacccgttaggctagctatagcctagccacctctggaatcttccagaagcaagcaaccaaagcattcaattcgaaaaaataaacaaaaattcgatacatttcacaggcagcgtgtacaaaaaacctcttgcaagccgaccgatcgctgcgtgtcatcgattgtttgaaaaccaaaactcaaactttgtacaaattcttctttttctcggtccattccacgcgcaggtggcaaaaggagaaaactaaattaaccaaaaaaagtgaaagcaaacaccctacgagaagaaaatatttacagataggtccgtccatccatccgtgcgttcccgattcctctagcgcggctgcggctgcggctgcggctgcggctgcttcttcttccccatgtcctcctctctcttcttccgcttgccgccgccgtggttctccttcaccggcagcgtggcggcgtagagctccgacaggtggcggtacctcttcctgaccctcctatccagccccatgtcgtcgtcgtcgtccatcgccgccgacgcctcggcgttgttcaccgactgcagcgtggtggacgaggaggagtcgtagccatcgtcctcgcacccgccgccgctgacgctgagctgcacgagctggtccgccgccgccagatcggcctccgtgaagaagccgtcgcccaccgtcgtcccaccggcgccggccggcttcatctcctccacctccatctgatcaatatctgatgcgtcttcgcctcgatccagccgcgagctgatcgatcgatcgatggaacgatctctccgccgcgcgtatgggtgatggatgatgatgcggttggtgttgggaagaaaggaagaagatggaagcggaaaacagtagagctgcggggttgatttgcaaaaatatctccggattagccaaggccgaggtttatatagcgccttcgaggcggacccgcgaggaaaccgacttgggccgcacggtgccacgcctcgctgacgcgtgggcccggacgcccgtgacgtggagcccacatgtcggcctgcgagcgttggtgggccaacgggaggcggacgcgtgggtgggtggcgttggtgtcacgcgcgcggaggatggccgtcgcaaactcgcaagtcgaggatcgcgggacggtggggatcttctgcggacgaaatgtggctcctcggcttcgggccgggccgggctgcgctctcgataatgggccggagaggcctgtcatggcccaacactacttgtgctcacacgtcggcacggcccggccccatggagataggccactgtcagaaagcccgcatgttgtctcgatgtgatttgacgctagttcctttgactaaatgtctaataaattaaaattcgattcatatgatccttctagaatgatcgatccttcgaagacagtgctggggcacaaatgcatgcacgagcgtaccaccaacagccacacgccattgttaagctatgcgtgacttgagacttaattaaccacgactgttattattattatttttagtctaaggagagagaagctttattaatatctgaacaatggattacatttatgatctaacaagtctaaaatttttacgggagcacaaaacctccactctccataaatctagtactcattaccattttaaccacgactattattatgactctagcaaggtgataaatagcattcgtagcggctgctatagcggtaacgaacctctactgctaccgctacaaggtagtggactttatctagcgtattgaaacttagtgtctgctatagcgcttcacgaccttaatagcaacccattattaactttgttgaatcactatatataatgctaaacagtgttattcacatatggataaaataatttagcactgtgtgccttctttttcttatatatttatatgctatttcataatatttatgttattaaatgtagaagtaattaagcatgcagtttacattttaatttttaagtgaaacttgatgctaatattgatatacaatataaatttatggttatttttcttaatttcgttattggaacttaggtccacaataatacctactaacctgctatacgctatttattagatttcaccttgcactctagctactctcgctcgatcgggtgtagatgcgatgccgtactgtagaagcgcacggtaacgactgtctttaagtatatatatatactacatgatggagtagtatatggcggtcttaattactctggtaagcacacgtatattgggtagggactgtttcgcacacatgagtactactagtatgatttaagccactgaaggccattttggtttgatgccaaaacgtgccctaccaaattattggcattttgaatagtagtttggctagtgtttaatttgctaccaaaatataccaataagacacataagttgtcaaagtatttggtactaccaaaatttacctatgatttggcattgtcaatattttggtatggtaagggggtgttcccctctctcccaaacacccctaacaaaccaaacaagccactgaattttgattggaccgctccgatctaaccctgatgatgctgacaactctctgggcatgtctggctagcttgttgttaccttcaaccatagcgatccaaagtttcaaacattataccatctcaatcacatagtactaatctttttcacatgaatacatgatcactccgtacaaaaaattcggtagtaagatataaaatcaaacagcatatatgcctacactacatatacctctacggctctaccaaactgttttatatcaaacattgtcaaattaactttttggtgttggatggcattcccgctctcagcaaatgcacgtatcattgctgtctctctcttttttttctttggtcctcttttctcctatattggatggtacaatgcataacattgcgaacattgtcaggtagcgcggtttggttgttttggcttgactatagctaagctggaccctttttcgagaaaaagcgatggatcgtagggtaatatttttaattcaggccttatttagatccaaaaaattttggccaaaaacatcacatcaaatgtttggacatatgtatggggcattaaatgcgagaaaaaaaccaattgtatagtttgcatgtaaattgcgagacaaatcttttgagcctaattacgccatgatttgacaatgtgatgctatagtaactatttgctaatgacaaattaattaggcttagtaaattcgtctcgcagtttacaggcagaatctataatttattttgttattagtctacgtttcaaatgtatgtccgtatacttcaaaaactttacatccaaaaactaaacacatcctcagatgatcgatctagctctggccatttgcagtacggagttttctgcaacaattcaaggtataagtaaggccgtgtttagttttctcccttattcccgactttccatcatatcatatcaaatcaaaaattttcctacacacataaacttttaactttttttttcaaactcctaactttcttcaaatttctaacttttttcagaaactaaacgcaacctgtgtttagatggtgaaaaagttaggaagttagaagaaaaatggtagtttggagaaaaaaagatagtttatatgtgtaggaaagttttcaatgtgatgtgatgtgatagaaaattgggaatttgggagaactaaacacggcctaagaaagaaaaagaaaaaatcaggttgatgtcgtcacgttcgatggaacagaatacatgcatgatgcatgtgcagatgtgagatgtgctgaagtgctcgtccagtatatacaggatagattgcaagttgcgagaaaacaaacaacgaatctcagcaaaagtgatctgaaaacgttctcagtgaacatgaataaagctggccaaaactctctgttatgatcgatctccattgtctagagctttcacgttcacggatggatcgagttttgatgacgttcacggcacgaacaatatactccctccttcccgttttattggacgtttccgaccagttcaacaggattaaggaagcaatgaagttacgattttgcccttctttgttcatatctagtattccctttttaaaacatgtttgaccattcgtcttattcaaaaatttttgtgaaatgtgtaaaactatatgtatacataaaagtatatttaaaagtatatttaataataaattaaatgataggaaaaaaattaataattatttaaattttttgaataagacgaacggtcaaacattttttaaaaagtcaacggcgtcaaatattttggaatggagggagtacatactgctgctccgccggctcggcgacgaggcggccgtctgcctcgccgccttgatgccgcacgaggcctccagctcgtcgtctcgattttgtctttcatgtcgtctccccacgccgtcgccgccacacaagagcaggaacccatagcattgctgttgttgctgatccgaaatggtgctcgtgctgctgttgctgcgttctgatctgaacttgatgctgctgggtgctggtctgaaatattcagaaatcagcttctcctaatcttgaaaaaagtcggtcctcacatgaaaatgtgaaccataaaccattggcagggtagagataaaaaacccacaactacaaccaatgactgtattccaattacggctcagaaatcgaaatccacaactgcaaccaaggattgaattccaattacggctcagaaatcgattcttttgattcctcaaacacaaattcatcaatagaattaacactcaatctgagttgcttacctctctcgtgcatatcgtattctacacaagcaccatatggtgttcgtcgtcgggcaccggcctcgacgtccgccatgccgccgccggcggcggcgacgacttacggcaccgaggcagaggacgaggccatcgtcggcgagcagcgacatcatcacctcttcgatagcaagcagtagccggaggggacggcatgagggagttgtggatgcagccgtagggaagcgcatcccagctccatgctcgatctcccacggtgttggaggacaggggcaaagacggaatgcttcaattgatttggcttacggcgtcaaacattgtgacactaatttttttttgacttgcggcgtcaaataaaatgggaaggagggagtatataaccccctgtcacgttaaggcatgtacaaacaaagccatttctagagtaccttcactaattaaggatactttttggggcactcatctcccaatgaaagctacactaggtgaactcttcaaaatatgaggtaattgggtcaagatacttaaacccacaatggatgttccaaccaaaaagcccacggtgggtattttcctatactaccctcctccacccctagctcaccgacgtgtcgccaatctctccctatctctcgcgcgtcgccgatctcctcgccctcccaagccaccaccgccgcctccctcctcgccctccccaatcaccgccaccgcctccctcctcgccctccccagccaccgtcgtcgcctccctcctcgtcctccccagccaccgccgccgccgctaccagagctttgtcggcgagggcgatgaggagggctgtcgcaccaccgtcgactccgcctctctcctttcgcctgtcgttcgttgccgtcgactccacccctctcccttcgcccgtcgttcgtcgccgtcgctgctcgcccctcctctctctctctctctctctcttcctctccctcggcggcgagcgcaaggcgagggcagcggcggcgaggtgtcgtcttactcgggcggcggcggcggctcctccgccttgcaccgccaccggccggaggcgacagattcagcatcgtcctgggcggatctggcccccacacggccagatccggtttgagcggcgccggtcgcgccgcattgaggaggagatggtggcagtgacgggcgcgacgccggctgcggagacgtaggtactcgggcagcaatggcctctctctctttctctcgtcgtcgcctctctctctctctctctggcagccggcgagggtaagggggaaaacagggggagagagcggtgtccacaggctcctcccctagccacggccgacccagtgcggcttcttgcttggtcccccagccgaggagctcgtagagccacgtcccttgcagaggggtcgcggccctctgctgggagatggcttcgatggcaaaccccgacggcgtgagcagggacacgggctaggggtacgcattgaacatgcccttaatggaacacttttactaccgtaatcgtagatgtatgacagttttaataggattcattaattgtgttggtgcttgttaggttgtttgtttttattttaagatagtgtgtttttttgactctttatgtgtaaatgctaataagcgaatttgtataatactaattggctgtaactcgtttagtaaaggctaaaaatatattccattatctaaaaatttactaacggttttcataacaattaaaattaattgttctctacgcacataaataaaactgggaactacaacagcagttttaattagttccttacccaaaatatgatgtgcttgtgggaggcctttttttcaggcaggcaggcacactcccctccgcgcaaggataatagcaagtaagcttaatataaacttacggaaggagagagagaaaaaaaaaagcagggtgttggtttttatataagagctagctttatacgtccttcaaaacaaatatatatattaaatgcataagtgagagagagatgagaagaaaaattaattcaaaacaaatatattaaatgcataagtgagagagagtggagaagaaaaattaaagccaacattataactaatctattactacctccgtacatatatgtctgacgttggctagtataaatctgaactagccaacgtcatataaaaaaactagagagagtatatatattggctttaaaatggactagtagttctagtccttgctctcatattctccatgctgaggtagctagctagctagctaaacctacctacgagttctaatattcttgcagattaatctacgagtggagtaaatttcactccatagcccggccgacaacccccaacaaacttgcatgctgacaccgatcagaacgtcgccgacgacgtcggcttcttcgccgccgccgccgctgccgccgcctccgcctccgcctccgccgcggcggccttcagctgcacatctcatcaacacgtcgatctatgagcacacagagtctgacgacgaaggaaggaaggagacgatagggtagtacgtacctggtggcactggtggcgcagggcggcgttctcggcgcggaggaggcggacctcctgctcgagctcctgcaggtacgcctgcttccgcgcgcgcgaccgctccgccgactcgcggttcttcatcgcgcgcctcttccgccgctctacgccgccgccgccgcccagctgttgctggtgcagctccgcgcggtacagcagctcccgctccagcgacgccgacgccgccgctgcgctaccgccgccgatgcaggaggggtaggagcgggacgacggaagcccgtcctgaaacgacgccggcggcagcacgagctcgtcatcgtcgccgccgctaccagtaccagccgctcgctccatgctcgctggaagtggcaggtagcaagttggcaaaaatggcagatagcaagttgggctctctctcgctttgtattggccgcgcgttgctcgcgtgactttgaattggcctgtttcacactagctagctaccacatgcaagctgctttggaacatagcaatcacaagctaggtcgtgtggtcctttatatggtactccccgtcccattggaaagcaatctaatcattgtaaagcaatctaatagcggaaaaaatatatgcttgtactataaatctgaagggtagatatatttagattcgtgttacatctaatactagattcatatcacgttcgatcatagatctcaacgccaacaggactgacatggtgcttaagggccatatatttcaacggcaccaaaaggcctagcgttgatatcgggtgacgggtggttagctagcgtgcgcccaccacgttggctagctagccaactcgaacaatccgattaggtggcagctatcttagggcatttacaatatgagctacttctaaagtgttcttactaactgaggatacttgtaagggaactcagctcacaatggaggccacagctaagtgggttcttccaaactcgaagcaactgaatgaaaacactctatcccacagtgggtatcccaaccaaaaagccacatatattaatttcctctcctacccctgtcggcaacgcggctctcactcctccctctttcttgtcgcctttctctctgctctctcactccctcaacttgctctctgctctatccctctctctctctctctctctctcagcaaagcggacggcgagggcgcgcatgtcgcggcggtcgaggcagcggacagcgagcgtcgcgcgggtcgcgcgacgaggaggaccgccgccgctgccggagcttcgtcggtgagggcgacaaggagagccgcctactccactgcggatccgtcgcctccgccgcggatccatcgacgccgccgctcgccgctctctctctcttgtgggtccgcctcggcgccgtcccggtcccggtggtcgcgacgaagctcctctctccctcttcatcgtcgacgtccggcagagactctacctctgccaaggggtggaataggaatacgagctggggaaccgatgtccacaggagcccatcgcccccgccccccctccccccaatgcgtctcttggctacgttgcttggctaaaaagcggcaagagacgcgtccatcagccaggggacgcgctccatcgtagggagcagacgcggacggaaaagcgaacgcccgtcggtgaggggacgacctaggggttacccattgtagatggccttactcacgctaattaagatgatgaacatcaatgttattggggttggcattaagattaaatattcatataataagcggttttgatttctatagtcaaatatttttaagtttgatcaaatttacaaaatatatatatatataatttaataaaactaatttggtgttgtaaatgttgttaaatttttctacaaacttgatcaaataaaagaatttttattaggagaaaatgacttataatacggaatggagggagtgttaacttttgctaaggttcattttttttaagggttaatgtgtcaaaattttgggataggagtagtaatggctttcacaatgcgacagctcagttttccacatcaaagattccacgccatatcagcttctcccgttgccaactgaagaatctggagcctatttgagactcgcgttttttaatagctgaatttggtagtgctcttttccaaactttaattactcgtttattttaacaaaaaaaaactacaaatatttggaaagatatcaacaaagccgcgcaagtgcacttaggcgtaactaacagatcagattccgatcttcctcgatggaagtttagggtgtctgtttgagagaggtagaaagtagaaattgagaagatatgtacaatgagttgagctattaaccatgattgattaagtaataattagttcatacttaaattttgaattactatattttttaaaaacaactttctatagaactttttctaaaaaacacacactgtatagcggtttgaacaacgtacgtgcgaaaacaaggttttttttcctctttttgttgtaggaacaaaaacaaccttaatttaccatcaccttaaaaacatatctttctatgattgtctttgcatcttggattttttttaaaacacattataaatgcggacgcttacaacatgcttatactcttccctataaactcacatacttatatatacattacccatatgagcatctttggaaaattgtgctgatatatcttaagaccgacaaagttaacacgagtgcgtcgctatcgacgaatatgtcacctatcattgaaaaaataactagatgcaaatgcgaacacccatatcaaagtctaagatttcaatctaggtgagcagatttacacgataagaatcttaaccagtttatctcgcttactccgatgtgcattttggattcttggtacctaatcgatcgtcgatgtgatggtcatttggaataattaataattaattgtcagcgttacggataaggtatacctcatatcatacgacttatggaatatacgggtatggtatacctcctattctacgatttatggaatatacggatatggcatacctcccgtgaacgctgttggaatctgttacaaattatggaaaatatctccacgagtcaagtgatttcgaaagtcctgctcggtggggatagagtttccgttatatcgtataatatctgatgtctctgagtcttacttggatatcaagatgatccacggtataaaagggacccccagggaggggtgcaaggcatcgaatctcatcgccaacacacccaccatagtttacaaacccggagtatgcagagccaagtagccgggagatctcgtcgggtacatcgactatgatcttgtcggtatcgtcagtttcgtctacttcccttgtaatctgtggttcttccatatcaatcttatataaactgaactatggctattacctgatatggtggcctgaaccagtataatcactgccttttgtttgcttgatgtcgaattacgtagatcatcgttccaacgtaccccaataccctaatcatccggtctacgagtatcactcgtcaacattaataatctttgttttaaaatataaaaatctagcactgatccaatgtttagatttataatgctaggtagtttttttaatgtaagtattag

SEQ ID NO: 66950 - DNA, 6139 bp, Oryza sativa
tatgcctacataaaaatatatttaacaatgaatcaaatgataggaaaaaaattaataattacttaaattttttgaataagacgaacggtcaaacatgtgataaaaagtcaacggcgtcaaacatttcgaaatggagggagtataagaaatcatcctttgacagtacaaatcaacattgtaaccacgttataaatttaaaaaattaaaactgtaaatttcaattctaatattaaattttttctagtacactatataagagaattacgataaaaacaatcgattatttacttgagaaagtagatagaagagatagaaacatatatatactttacataaaaatgtaaaagagatgacaatcacataggctaaaaacgactgcagacatcaagcttaaaaatgtaacaccatgttttctattagcaaaaccacaaaatcatctccgacaacgttggcatcgcggcgcaaccggtggtcaaattaattgactgaattaattactgcttcgtaaatcctccatttcgtgtgttcgattgacactagcactgatcaggacaagagaaaaagggaagaagaagccaaagccattgtgctatctctcgcagaaagataggagagcctgatagggagatgaccatatgcggctgatctaccatctacttcacagtagtagaatttctcagcatgctaggtaaaaaacggaactctttcggatcataaatattaatttcatgtctaggacacgattcgtttaagctgtttaaaattcaagttccgctagaagcacgggctgagttgccaaacatctgcttcctccgttttttaatatatatacaacaccgtttgatttttaagatacgtttgatcatccgttttaaataaaaagttgtgtaattattatttatttttattgtaacttaatttatcgttaaatgttatttcagcttgacttaaaaatattttatatgtgcaaaataattgaataagataaataattaaatatttggactaaatcgtggaaatcaagaacgaaaaagagaggcacgtgctgacggtggccgaccggccttcctgaagggggctcgcagtgcatcaagccaaccaaccggctgttggctgatggcaaaatgcgggaaattcagaattcacttacttcctccatttttaaatatagcacatttagtacgagtgagttagtttagaaaatgaactaactatcctgattagatatttaaaatataaaaatggagataatacaatttaacattaagttattattcacgtgtcacgggtatgtcgacatgaacaatacggagatcggcagtggcataaccccatttaaatcctataaaaatactacacaatttctgaaaattgttaagttgggtatttttcatctttgtccctcatggcgatctcgcgcattgctgtaggaatttatagatctatatatgaagaaaaaacttagtacttaaaatatgatagggatcatggtgtacaacttttgaatcactatgttaaattttaagttgcaattctctgtcttctagttagctttatttcagctagatcacgaagaggaacgatgctaagaaggaacttagcatcaattatcaattattaagagagaagaaatggtgagaaaacccagcgttgaggggccaacgagagcacctggtagctccctaccaccgggctacaacgccgttctcagcagggggccaccaccatccttccatattcggccaaaacactaccttataagtgtgtttagttcacgtcaaaattgaaagtttggttgaaattgaaacgatgtgatggaaaagttggaagtttatgtgtgtaggaaagttttaatgtgatggaaaagttggaagtttgaagaaaaagtttgtaactaaagtctaggtcacggacaaacaggagaagaagaagaacatgctgcttgttgtgactgcaccgacgtctttcgtggaaggacgtgatcctgcggtccggcacgccgtggaataacgcatggcgatcaaagaccaaggacgattggaaggtaagctggctcggcccttcttaagaggctcaaggtgagccagaggccatgatcacatcataccttcttcctaaccttgcaaaattagggaacaattaattcagctactagtagctgaatttggagctagctaattaacaggatgttcagagctgcgcagctcctcctaggtacatatcaggcttaattgtactgtgttagtgagagtgagactccaaattactagttgattaggatgacttgataagtgcatgtccatttgtgtggctggcagggagacaacagagctcttggggcagcaacttcgcctgcaggcttcgtcagtggcttctccacggcttccaactctgcgcagaggttcgctctttggtcaagttcgttgtactaaaacgtatcacatcataaacttttaaacttttaaagaattatatgtaaggatagtgattgagacaattagactatgtttatttataaaatatgtatatattgatgttgcaggttggctggcaaggtggctgtcataaccggtggagctagcggcatcggcaaagcgacagccaaggagttcatcgagaatggcgccaaggtcatcatggccgatgtccaggatgacctcggccactccaccgcagcggagctcggcccggacgcctcgtacacgcgctgcgacgtcaccgacgaggcacaggtcgcggcggccgtcgacctcgccgtgaagcggcacggccacctcgacatcctctacaacaacgccggtgtcatgggcgccatgccgcaggacgacatggcgtccgtcgacctcgccaacttcgaccgcatgatggcgatcaacgcccgggcggcgcttgtcggcatcaagcacgccgcgcgcgtcatgtcgccccgccgcagcggcgtcatcctctgcacggccagcgacacgggcgtcatgcccatgcccaacatcgccttgtacgccgtctccaaggcaaccaccatcgccatcgtgcgcgccgcggcggagccgctgtcgcgccacggcctgcgggtgaacgccatctcgccgcacggcaccaggacgccgatggcgatgcacgtgttatctcagatgtacccggcgtaagcaaagatgatttggagaagatggcggacgccgccatggacgccggagaggtgatggaacctaagtacgtcgctagggcggcgctgtatttggcttcggacgaggctaagtatgtcaacgggcacaacctcgtcgttgacggcggcttcacgtcgcacaaaggatccgacacacgtttgaattagcgatgtgtccaactatagatggacaaatggaccgctcggcccgggcacgaccagacacggaccaatatgaattagtcacatgtgctcctcattggaataagtctgttgtacctccctcatctgtttgggttgtcttatatggctggattaagtcaattttgcatccctcgtctccttgggccatgccttatgtgactagaagaagtctatattgcatcccaaatcgttggatcgggtcgtgccaggccggcatgtcgtgccaaggaaaaggtccaagcacggcccaacaatcgggctgtgctggcacgggcctaacaacaatcgggttgtgccgtgtctaggccgggccaaaaccccgtgctgtgggttgagccgtcgggccctaagccttttggccatctatacgtccaactaacatatattgaacagacaccactacttgtcttggtagtctcgttagaataagataaggttgtcacatatgtgttgtcggaattagaaaaatatcattgatatgatggtagagttattgctgcatgactctagtcatataatttaaattctggttttctaaaagaaatgttaaattttggtgttcataagtatgattgtgtgcatcagtggattacagtagacgactaggcaattttcataatttactatctatatatgtacaatacaataaaacaaaacttgcatgggcaactctaaggaggtatgattgtgtcatcgtagtaaatttatgttttaaattaaggacacatatataaatatttatttataaattatttttttaagttgctaataaatcatccggataagcataaggataaatgaaacgatagaaccctcaatctatcgcaatcgttgagtcactggtagccgcgccacagccattgcagctgcttcctttcattgacagcttggaggataagacacgtgcaaattgccatggaaaattggcaatgccacaagagaagagaaggtccaccttatcaacaacaattaagagaaaccatgtggaagaagctgacactgtactgattccggcacgcaataatagaagacaagagacaaggggtaggtaagatggctggccttcttaaggagaggccatctgttaattagtactacctgatttcaagcaaaggcttgatcagaattaatccatttaattctgctctgccttgcaaggaactttgcctgcaggcttctccatggattccaactccatccagcggtttgctgctctttatttcagctcctttgctgcgaataattataatttagacatattcttttcttagagtatagtagtaatgtacattagtccatataattaattttctgatacaataggaataatttttatcttcggcttctgtcataagacggtgtatttatggatgtcgcttgcagtttggctggcaaggtggctatcattaccggtggagccagtggcatcggaaaggttacagcaaaggagttcatcaagaatggtgccaaggtcatcatcgccgatgtccaggacgagctcggccactctgcggcggccaagctcggcccggacgcctcgtacacgcactgcgatgtcaccgacgaggcgcaggtcgaggcggccgtggacctcgctgtgaggctccacggccacctcgacatcctctacaacaacgctggcatcatcggcgccatgccgcaggacgacatggcgtccgtcgacctcgccaacttcgaccgcatgatggcgatcaacgcccgggcggcgctcgtcggcatcaagcacgccgcgcgcgtcatggcgccgcgccgcagcggcgtcatcctctgcacggcgagcgacgcgggcgtcatgcccatcccgaacatcgccatgtactccgtctccaaggcgaccaccatcgccatcgtgcgcgccgcggcggagccgctgtcgcgccacggcctgcgggtgaacgccatctcgccgacgggcaccaggacgccgatgatgatgcatatcatctcccagatgacccccggcgtgggcgaggacgacctggagcggatggcggacgccgccatcagcgccggcgtggccatcgagccggagtacgtcgcgagggcggcggtgtacctcgcctccgacgaggccaagtacgtcaacgggcataacctcgtcgtcgacggcggcttcacaacgcataaaggagacgacaatcgcatgaattaatgacacacccaactaattaatcgatcgaacacccttgttcgtcgactcgtcagaataataaggttgtggtgcatatgtacgtgcattgcacttgatagtgcagcggcaaggagtgtgtccctccaattctcgtttttttattcccgaattttggctaatatatatgttctcagagttataaaaacaccgttacttttttttataatagaatagaatatttcggcatttgctaagaagagctacagctaattattgcaatctagcactctaaaaagaccattactgtggtgtaggaatcatgggcagggtttaatatatcagaaaggagaaatttttcggaaattcccaacgaaattttcaaacaaaatttgaagttaaacaacaaaattacagaaaatttacctagatcagaatataggtaagtgatcaagtccagctaatccaaagcagagtgacaggagaagatgaaatgcactttatgcaacgatgctaggccagctttgtggcttgtgtcttcgtcctcgtcgtgccgaagagccaaggagctgccgccggcgactccagaacagtgttttgccgaagttcttgaccggagcata

SEQ ID NO: 66951 - DNA, 2261 bp, Oryza sativa
taaaataagttttcaaaaaggaccaaaatgtaaaaatttcagaaattaaagagtaatttaattttaaaaaggtttttaaataaaaataaatttaaaattaaagggataaagtaaatcaaataaatttcaaataattttaaaggttaattaaaataatttaaaattagaaagtaaacaaataaataaggaaaaagtttttaaataaaattttaaaaatagaaaatttggtatcaaaataaagggtttgaaattagatgaatttagatcaaaaggttcactggaattggatttgtggtttgagagatgtggattgctaaagattgaaatggaaataaaaggaaaaaggtttactttatagaagtagggcccactgtcagttccttcttctctttcttttttcttcttccttcttcctgcttccttctccttttctgtttcttcttcccgaataacaacagagagagagagagggagacagggcgtcggtgctccggtggttgaacggcctcgatggcggcgtctaagcgtgttcccgagcatcgcgcacccggggagggtggaggaaggcagaggtagagagtaggatggccggaacggcggcgacaagagcttagctccggccggctatggtggtggcttgtggcagtggctaaaggagaggggaaataggaaaaaaatggaatcaccggagtgaggcaaagcctatggtgaaagggaattggaagaggagctacggaggaggagatcggccggtggcaggcgacggccggtcatggcaggagagagagagaggaagagctcaaggctctgatgtgggggaaaaagaggggacctcgtcgtccttttataggctggggaggtcggtggatggagagaagtcgacgacggcacagctcggcgtcggctcggaatgatgaggggcggcgacgtgtgtcctcgccggattgggcgtcgtcagtggtttggtggtcggtggcggctcatggcaacgcgtggcgcggcgtcgtgcggcggtggcgaaaatggtgggcggcggcggcaaaagcggcgggcgacagcggctgagcagtggcggccgcagcggtggctgtcggggtgccacgagggcccctggtttgctgcggcggtggcgggatggctacggcagtggcgtggcggcagcgggcggcgcgatatggcggtggcatcggaacttggcgaggcggcggcgctcccacggaaggggagaggaggcggcctggcttgggccggctcggctgggcttcggctcagttgggctggcagctcaagaaggagggagtagaaggaaggaaggaatgggccaaatgaatgggagttcggcccaaattgaataggaagctttgataatggaataagttcatctaaggtcccttaacttgtcaacgaatcctattttcgtcattcgaccgcaaaaccagatacaacgggtccctcaactatccaaaccggtgcagattaggtccctcggcggttttgaaggcagttttggctgacgtggcacctacgtggctagtttgacttggtcttgatctgacgtggcattgacgtggcgcttacgtggcaattcgatccggaaaaataataaagctcgtgggacccacatgtcagtttcacatagaaattaataaaaaaaatggtggggcccacgtgggccccacatgtcatcctcaccccttttcttcctcctctctcccaatctcccctctctttcctcactgaccggtggagcggggcgatggacggggcggagcggggcggccggcgggagcgggccggcggagcggagcaggttcgcgggcagagcggcggcggccgcatgtcaccctcactcccctcttcttccacctctcaacctttttgtcggtggggagccggcgcggtgactgggcatcggcggcgcgcgggaacacaaggcaacagcggcgtggaggagggtggtgccattggcgcggcaagggaggtgctggctacgatgggggcggtgggagaggaggagagcgtcggcagcgcgggaaagggcgacgggcggcgcggcaagggaggagttgagcggcggcgggcggcgggagagcgagagagggcgacgggcggcaagggaggagctgagcggcggcgcgcggcggaagagaagctgcgcggcggtggtgaccgccgccgaggagggcgtcgcgacgggcagcagagagatgggcggctgccagttgccgttagggagaaggtgcagctccacgcttctcgct

SEQ ID NO: 66952 - DNA, 3987 bp, Oryza sativa
tccacgcttctcgctccgaccgccgccgctccgcctgccccgctccgctccgcccgcggcccgccgccgccctactttgctccggccgccccgctccgccggcccgctccggccgctgccgctccgcctgccccgtccgctccgcccgcggcccgccgccgccctgctctactccggccgccccactccgccggcccgctccggccaccccgtccttcgcccgctctagtcgccgccgccctgctctaccggtcagtgaggaaagagaggggagattgggagagaggaggaagaaaaggggtgaggatgacatgtggggcccacgtgggacccaccatttttattaatttctatgtgaaactgacatgtgggtcccatgagctttattatttttccggatcgaattgccacgtaagcaccacgtcaatgccacgtcagattaagaccaaatcaaactagccacgtagatgccacgtcagccaaaaccgccttcaaaaccaccgagggacctaatctgcaccggttttgatagttgagggacccgttgtatctggttttgtggttgaaggacgaaaatcggattcgttgacgagttaagggaccttagatgagcttattcctttgataatttgtgtggagggttttgaatggaattcaaaggagatgaaaatctaagggacgaatatttgtggaatttttgaatttgactagaattcaaaggggaaaagttctaaaggaagatatttgtgaaccttttgaactttgcacaaggaatataaatataatttaaggaattgaaaactaagggaattttgaatggagggttttaaatagattcaaaggagatggaaactaaagggaataaaaatatttgtggacttttgaattttgaaaaataatagaatttttaaagtaataaagaggtttgaaatatttttaaaacaaaactaaagatatttattttttaaatataaatttgagaaggataaaaataaagatgctccaattttatagaattcaataataattaaatgtaaaatttgtcacgaaagattttcaattttaaaaactaaaatagtcaaataggaagggaaagaaatacaaatgatttaatgtctaactttggataaatttttgggatggtggcaaaatagatagaagggaagcaaataggactttagccccaatatatgtggtatagatttttggtgaaatatttgtgggctaaaggaaattggattttgtaagaagggggattaaatataagtttcttagcacaagagcaatcactcaaaaatttgtgataatattattcttgtgctacatatgtgattaagccataggaatcaaattggcggctcgatccaactaggaacttaaccaatgaatattttggatcgattaagaggaggtaagggttttcggggataggtttagataggggttgatccaaaataaatttcagcagaaagggagttatactggtttagctctaaagataaaagtggttaatgggatataacagagagtcgggtcaatcggggaaatattggcccaagctaaatagtagactttggaatcttgaattgataatttagatgaacaagatttcaaaggggaaatatttgtgggagtatagaactggattcggaagtatatgtggatgggaatttttataggaacggaattggtggtagattgataaactctaaaggatgggtatgttgactcaaagggggattgaaaaggatattttatggactctggggatatttaggtggagatccaaaggaaaggtatagtatcaacatttcatgtactctagagatattcgggtagagttcaaagggagagtattaactctgagaaaattggaaattatcattttatgtactctagggaggttagagaatgacatttcatgtattctggagatggttgagtggagatcaaaaggaaagtattggttctggggaaaataagaattggtatttcatgtgtttgggtagagatcaaagggggagtatttggtggaagataaaactggatttggtggtagtgtggtaagctctaaatgaaaaggtattaaccctagagagattgatatttcatgtgctctagagatggttgagtggaaattgaaagggtatttgttggagatgttcgggaatggattcaaaggaattataatttagagccaaagttagagattaaagaaaataaatggaaaggtttttaaaaatttgaaataaataaaatagagaataaaataaggattttataaaatttaaaagagagcttttaacttcgcaaataaaatttagatctaaagtaaaagagattaagagaaagcaagattattccaatggaagaatcaagaagagtgcaactaaaatatttcgcaaaaaaatttcccgaaattttgagtccgttacactcccgctctgcaccaccgtgctggcgctgtcagtcggctgcccgactccctaatcatgtttccgacgccggcgaccatcatctgcaaccatcgacagcccaggctcggcgccttggccagcggccaccattctgcccccgctgctcggcgcggcggcggcgacgcgccggcgttgtctcccctcgacagctttgccccttgctatcccttcgtgacgttcgagacgatgagactgacgaggctagacggctttggctggccaagtttggacagcgagggaggcaggttagctagccggatggcttggccattcaaatagcaagtctattggagaacatttttttttccaaaattaccaaattttggcttggagagagtgggatagctaggctcttggagatactcttatatatcattctaactctcttctagcaaaagggcgccctagatgcaaaggaggaggtgcctacccactcactcaccttctaggccccccgatgtcatacattattccacgctaggttttgctatttgacccgcgacgatagatttttaggcttctgtttttttaaattttcgtccatagaatattgcatcaagatttgcgtttgtataaatccaacttacagttacactcgattatagtgcacttacactcaattacaattacatagcactacttgtattcagttacattgcatcgaaattagttttttcagcagttaatttctctattcaagttttacgatttttgacatgtttattttttttttgttatttcgtctaaatcggactatatccattgattgaaaattctacgagacttaaaagattataaatacatcgaaagatgaatagctagttccgtcccttccacgttctcatcaaaatccgtatcccgacttgcaaggcgccttctccctcagccgcttttctttcatgcatggagcaagagagacagcgccgccacctccccgcgccgcgcgcctcccttccgccgtcgcgtcgcgcgcctccctccgccgccgaccgccgtcgtgaaaccctagcctcatcccctcacgccctcaccccctacatggtggagggggataataagactgcaggttcagttctactacagtattttcttggattatggattctcagttttttttttcttttaattcctagccgcgtatcgcgttcgtaatgttgcggttatatatatatatatatatatatatatatatatatatatatatatatatatatatatatatatatatatatatatatatattagggcattaggcgcgcggcggaggagcaagtcttcggcgaagggcgatcgaagcaggcggcggaacaaggtacgcctccacttcaaaccctagaaaattctcccactaccccttgctcgatcgacatcgctcgcccgatatcgatctctgtgtgtgtgtgtgtgtgttcctgcccttttctgcatgcgtcaatcgcatccaatccaaggcgatgtttataaatcacaaacacataaattaacctgtgtactgtatacagagaccggg

SEQ ID NO: 66953 - DNA, 7663 bp, Oryza sativa
gtcctcgttgtcacacgccttcatcagctgctcgtgccgaactgttcgattcaacataactgccagctggcgaacctaggttttgcactattcgtttatgatctggtctcagttataagttcttagattgaggttgcaattcttcttctggcgtgctaatatatcggttgattattgctcccgtgcttttgatctctttgtgggtaacttcatctatacttattcggtgccctggattgtcttcttcaaagaaaaaaatgcaactggggatgaaaagcacaaatttgatgacttacaggaatgccatatccagggatggtctacttaattgatataaagcaaggcaaagtaaacgaatgaacaaatgtatttgttttatcttttgtctttgtgttagaacttaactaggttccttggaattgtacctctgttgactattgattggcgtagtgacttccatatctctcagacagtgtcttgttatgacggcaatcgaagtttttttttttttctgtttcgtcaccttgcaccttcaatttcatcaatgttttgacgtttttggatatttgttgtagcttcagtgttagtcaagttcataggttctttttgtttaaggttaagtggttacctgtacttcacttttgtagcctagttacctttggacttctccataatgatgttctgcttttcatatatacacatgcagtcgtgtgtagtcagttttatctgtaactatctccaaaagagtccttctaaacatatcaaggaataagtttcaccaatttgccgagttgcttttgcgaccataatgcctactaatggtgactcactattacaattttattctctgtggtccagggttggaaagatgacagataatctaacaggtgattgctcaacaagctcaaagaaaaggaagaaagcttgcaaaagttgaggagagacaggtgagtaataggtttgattttcttaacatacttacacatcttcgtcataacaatcacaataatattgtgcaatgcttcctcatctaggaaagttgcatgtggataacatttttgaagaggagtttggcagcttaaagaattctggtgaaggagcatggagtgaactgagtaaagtggctgtgtcaaacttatcgaaagtgttgtctcgctggtttcattcaatggtgattatgcacgttggcttttaaagtttgtatcgagtcatcactcttaatgatggaaatcatgattttgtgcagggggtatgatgtattctgcatgcacaggcatagttatcaaaagtgatttacatggcataagttacctgacttcagctagcctgattagatctttggatgatgaaagcaaaatcatgccatatgtttgtatagctcctattgtacatttttgtttgcatagctctttcacattcatgcataaggtctctcaccctggatggctagctagtccccgggggtgttctggtcgcgtgccacctttatagggggagtgttctgggagggtccttcggatccctccgttgtatatatttctttcttaatgacatgaagcacagacctgttttttcgagaaaataagcattcaatgcatatatcttggaaagacattttggtccaatttgaccgatctgctggtcactggttattgtttgtggtgcctggtaaaagatattgaggccaaaagataaaatgtatgattgtatgcctaatttgaatagtggattcagagggaagtgaaacataggcacatagtgctcaactgctatgacagaggctatatatccatggctgcgtgcttgcgggggtgttagggatcctcaccactttatttttttcttgaagtgttactccaatatgcagttttccaaaaagtaaatctcaggttgcataagtggggagactaacccacaacctacactgctaactgtatctgtgttatgaaactttgaatgacatcactgaccatatcagctacaaaaagaatataaaatgctaattgtccttatcaattccaccttttctttggtaactactcttgatgaatttactatgtactgcaggggtgagattataccacttgatagcacaattggaaggagcacaaatgagatacaagaatctcctgcaactcccaatgagcagaagatgaagtcagaagatgaagtcatcttcttctagtaattcagaaggtaaatcgggctaggtcacttctaatgttaattatcatgcaaaagttgtcatcatgttttaatgttaattattgatcattactaacacatggtcattaatcgctttaccttgtttctctagattacgatcctgagaatgatccattttttctggaggagacccctttcttcccggttgctgatggtgatggtgagtcattgcttttaattttgctgtcattgttaacacatgatgattaatcgcttcagttttttcaccaggatttgggaaatttttaattaaggaactaacgtctcaaggttatcctttgccagctatcattgatggtgagtttgttgctgactactctcttccattgcacattttgacagttgtatttcagcactctcatatgtggtactacttttctttaaacaggaggcatgcatttggttaatacttttgaaaatgaatttgttgatgatatctggagtaaactcaccaaaaaagttgcttcaaacgtgtctcgtgttgttgtctctcttgcttcattcaaaggtaatcgcattgttataatctcattgcattttcatttcttttttatagatcatcactattcactaactatgattcattatgatcttgtaggagaagaacggatttttgcttgcacaggaatatttataggctgcagtgaatccaacacaaggatcctgacttcagcaagtttggttaggatttctgatgatgaaaacaggattaatgataacttgaaggttggtattgtattgtcctccttgagcttattcatttgagataccggtaaatcctcatattacttctgcagattgttgtacaccttccaaacaaacaacaaactgtagggacattgcaacattatcatctgcattacaatgttgctattgtcagcatcaaaggtttccgttgtcttcgtacggaagaatttcatgatccagggcaaattaagtgtaagaaggtattatctgtgggacgtgtcttcaagtcaggcaaattaatggccacaggtgggatattgacggacaaaccaagcaaacttgactgcaaagaacttatggtctccacttgtagaatcactaaggtacagtgaatctccaaattgaagtcttgcttttcctcgcaaaagaaaggctttaattttcttatattggaaataatttgttgccttacaatatgaacaagagcaatttaatataacactaccaaacattgccatgtctgcttaccaaacctagccaaagggcccgtctaataaattgatggccataccttaggcaagatttgggaaataaatgagtgcatgacatatgtttcctaggattaaaagaacggaaatgaaacaactgttttacgaagtgtggaaagattggcaaagtgtgaaacgctcctgcttctgcggaactacgtgtgtaatcctttgtttttgtgctaggctgggattggagggcccctgattgattttgatgggaatttcgttggtatggtaggaaggagactccgtatttaccaagggatacaattctgaaattattgagctattttgatggagaagggtatgtcttctatgtttatatgtatacctgtgttttcaacttttctatgtcttgttatttagtttccttcaaattttcaacttttctgtgtcttgttgtagggatgtctctgctgagatcatggacagaaacaacagatgccctgtgcccaagatacgttggcattatcctcacttctgcaagccacgcaagtcagagaagtgtggttaatatgaaaagtactagacgagacccctgcgtgttgcagcgggaaatcttgtgtataatattaaaatttgtaaattgattatggtaaacatattagtaaaatattgaaactgattaacaaaggaacttgattgctatcatacaaaagactgaccaatcgaacgaaagagtcatgctccctaagacattttgaatgggcctagccatcagattttgatctaacagacagggagtcttatcggagagggagtaggtaaccgagatatcttctgatgagaataagcaaatccctattttttttgttgaagaaaagaaaagcgtgtccacgtggactggactctgaaattttcctcctcccttctggagtcttcctcatcagaaatcagaagaggagagggtgggcaactcgcagatcgccttctcgtcgcgctcgcgccgcaggggtcgcctgaggtatgcagcttcacctcccccaactttctagggttctaatcgcctctgctcgctcggattatgcgtggtgggtatggctccgattccgccggagtagctggatctgtgtgccccgtgctaatttaggtttggctttcgattcggccgcgcttcggtttgttctcgcgcgtgattgcttcgttcggccatagggctcatctcaggctcgacatgtggacggccacaaacataaaaaatccttgttaaatttacggttcatgtggtaggggggcttttcaggatcggaggtttaggtgatttggagtagcaaaacgattttgctgtgttagagaattcgagaatctgtgccgtcagatgctaattagctggttttgaacaaatgttaagacatcctgatattatttgctgcgtttaatgttcaaactttttgcacgggtgttgctgagctataaaggatatgaggatatagtaccaagttctatcgttttgttctgatacatacaatttgctgtagtttatggcaccatcatactgagatatatatacctgtgcacctttcggcttctgtgcagaacacatagacaatggtgaaggctgttgctgtgcttgctagcagtgagggtgtcaagggcaccatctttttctcccaagagggagatggtaattcacctaaacacgcagcgacaacttgtattctgtccttcccgtgttctttgggcgtaatttgttgccttccgtatttaggtccgacctctgtgacgggaagtgtctctgggctcaagccagggctccatggattccatgtgcacgcgctcggtgacaccactaatggctgcatgtcaactggtacatatgcacttcattccccttttgtttatcaggagaaatggatggattgtggtgtgcttactggggagtttgttctatgctgtaggaccacacttcaatcctactgggaaggaacatggggcaccacaagatgagaaccgccatgccggtgatcttggaaatataacagctggagcagatggtacttttgtttgttctccttctgtgttgcttacattctgttattttggggattacatagttttgcattgatgggaattttgatagctgttctcgaattgtttaatgcactgcagcaatcatgcataaccccactgatagtttttacttattgcctctccaggtgttgctaatgtcaatgtctctgacagccaggtaggaaataatcttgctctctcaatgaacatatgtgctgacctttttcttatcatttcctcttaagacagttaatttgacatcggtaacattctttgaacggcagatcccccttactggagcacactccatcattggccgagctgttgttgtccatgctgatcctgatgatcttggcaagggtaatgctttataaacactcagatctgtattatttatgtaggaatgattatttgtcagatgtcttcttttatcattgttttggatagagacatgaagccgatgtttgtgtaatgatgcctttctgttttatatcaggtggacatgagcttagcaagaccactggaaatgctgggggccgagttgcttgcggtgagtgacttggttttactcatgtccttttggcaaatctgtttaattcgttttcgtccgcggattgtttgtttcttctcttagaactcccatcaaatccgtctgttcttatgatgcttgctcttctctggttcaggaatcatcggactccagggttagacgtctcaactttccaacatacagaagctgttcatgttcgctcgtatggatgttgaaataaaaataagcacctgatgtatgaccagtgtgcagtttgccccagtttatatatatgtgctatactcctgtccgaacattacagtcatttgacttgagtgcatgcgttttaagtatcattggtggacttgagtacatgtccataacccatcatctgggatgctgcgtttgagaccgttcatttttcagcaaggggattgctctgtcaggtaacctaaattgacaaattcaacctaggcctggacttatttggcgctgcacaggtgcattctatctatatgaaccaaactctgatcgatgagtcagcaacttaggattttctgcttgaagagccaacaatgaatttggaacaaatccgatttcaaccaacaacgaatttcagaaagataaacacaatcaacaacaatgcctggccaaacgaaagggaaatgcggatagcaacagcgatctcatcgttttcagggaacgacacattttgaatgttcttgcagcaacattcgacaccacggggaaataggagtggtggaaacgtgaaaactaccattgaattgaaaaataaacattgaagatttgtccacgtcattacgggtaaaaattttacttacaaatttactaatgaataaaaattttatttgagagaaattcagtaaaaaattttactcgtgttagcgtggacgaatatcagatatttatttttcgatccaacaatagtttctaagtttctattacatacatggtttgcgtatattttacccacaacacgcaacaccatgacatacttgtcgatgcacggataagactgagataagcacatgacgggctatgctttgcctgataaattcaagcacctcaagtagagctcggtggatttcggaggaggtctttgcccaccgtgaagccgccgtcgacgacgaggttgtggccggtgacgaacttggcctcgtcggacgccaagaacacggccgccctcgccacgtcttccacctccagcgatgtcccttccagctcctgcatctccctcgtcaccatcctcctcacctcctccgcggtggccgccgggaacgtctcggcgatgatgcctagcgccatcggcgtcgggatggcgtgcggcgagatggcgttcacccgcacgccgtcgcgcgccagctgcctcgccaccgcgcgcaccatgccgacgatggccgccttcgacatggagtacaccggcgacgccacgccgccgagcaccgccgccgagctggccgtgcagaggatgcagccggcgcggcgcggcgccatgacgcgcgccgcgtgcttgacgcacgccaacatcgaccgggcgttgacggccatgacgcggtcgtactcgtcgaggtcgagcgccgcgagcgaggccggagccggtgctcctatgacgccggcgttgctgtagacgacgtcgagg

SEQ ID NO: 66954 - DNA, 51216 bp, Oryza sativa
  unsure (1)..(51216): unsure at all n locations
taaagcagtatagacacctggtttcgctgacgtgacatcctagtcagcaaaaataaataattaaagtatatggggcccacacgtaagtgagagaaaataatgtgagccccacatattttcattcttccatttttcttctcttttctctcttattttcttctctcatcttcttcagcgggtaggcgacgactggccgtgatgggcagggtgatgctgagcgagagatgtggggcccacatcattttctctcacttacatgtgggccacatatactttatttatttatttttgctggctaggatgtcacgtcagcgaaaccaggtgtctatactgctataggatctagattgggaggttttgtatagtttaggggtgaagatttctggtactgaggataagagatgttagacaaattcggtgtaaagttgagggacggtagatgtaatgtttgtttgaaaactcctcctgctttattcctttcgcctcgtcaaaaatcccacattaaacaattcaaaaccttgttatactgcgatttcggttgatatatacgccattcgagttttatgcaaagaattcaacccgcagtcggcaaggccccttgcgactggtccgcacagtacactcctatttgatttggccatgatcactgaacactcggatccaagcgacaggccaattgcctgctccacaacagcccatcagattctacgatgttgtcatttgtcaatcacaactgaagaaccggatgactttgatgacatcacagcaacacatgcatgacactggttctcaaaagcctccaaacacatgacgcaactagcctagctaaaccttaaaaagctaaccaacggcctataactaaccaaataaacaaacctataggctacagctgacctgtgaatgtgaatctatatctaataatatccctatgtgcacctgtgcaattacgcttgcagatcttttgtcacagcccgtccaaacccctctcttgacaacatggccgtccaatcattgaacacaccctgcgaccatatcacgtttgctgtatgaaagtcacataaggttgtgcatgctacaatattcctatctagaggttggcatttggtcttaaccaaaaaattggtccggcgacttcattctttaaaattttcggtcttcagaaaatgagaaaccgaacttgtaaaataaaacaactaaccaatagtttaattaaatcgatagtttggtctttcgtttgactaacctacctaaatttgttacaccggacgatatattatcacaggcaaggtacaaaagcacaacagcgacaatggtgaggtgcaataggtggtggcgcaataaaagaaggaacctcggtagcacaccataacaagcgacgagacgtagcagcagacgacacgccacggaaataggtggggttgcagtgtagcatggtggcgatatagcttgagctagggagggtactgagccatcacatctagggtttaggagtagtcatatatctgtgggtggcccttgaggtggtaggctatcaagccagcggttaaatttgggctaaaattaggtattttggttaaaattaggtatacgaccaatcgacctgaaaaatgattggtcacaaaaaccaatgttttgatcgatgactgatcttttgtatacttcggattctatctaccttttgttggtttttttctcgcccatatcactttgtgcgttaaacccaatacttgaccgcccaaattattataagacggtaagctgaaacgcactacatcaataaatcttaaaatgagatagttacactatctattaacttattaaagtaattcaaaaaggagcctccacgtttactcgcatgacctagaaattctcacattaatcgggaaaaaaagaaaagtagagtccataaagaaatacaattttaaaataataaaaacttgaaactaaaaaaaatataggaagaggagactagagtccatacaagtatacaatttagaaataattgaaatttggaattaaaaaaaagaaaactaaattagaagtcagagtcccacaatttaaaaatatctaaaattgaaataaaaaataagaaatatttgaagaagattctatagcccatatagaatataatttagaaaagctgaaattagtagttaaaaataaagaatattaaaatatgagcttagagtccatgtagaaatacaattagaaacaatggagattcggaattaaaaaataggaatattgaaagaaaagtctagagtatgtgtaggaatttagaacaaattgaaagtcgaaattaagaaaaacaaatagagtttagagtccaagtagaaatacattttagaaataactaaaattcaaaattagaaaataagtaatattgggagaagagactagagtccaattaagcatataatttattttggaattaaaaaaattaatattggaaaaaaacttagagtctacatcggaatacaatttataataatggaaattcggaattagaaataagaatattggaagaagagtataatgttcatataggaatttagaactaactgaaaatcagaataaaaatttaaaaaataaaagtagaatttagagtccatataaaaatacaatttataaataactaaaattcaaattttgaaaaataagcaagattggaagaagagtgagtccatataggaatataatttagaaataagtaaaattcgaaactagaaaacaattaataactataagtacaatacaaaattcaaaattatgttgctatttttaatatattttaataataaaatatgaaaatatttaagctattatatgaaaaatatatataacgatgctagccgcataatctgtgcaggccaccatactagttgcacataaaactaattatatgcagtaaagtttattagcgataaaaaataatttatggataaaaccttttacatgtgtgttcttacctatttaaaagtcgtgctggaaatacgatacatcaaaatcaactcaactctaaaattacatttagattttagctatgactgataatttgaaaagcaaacaatagtgttgtctaggacagtgagttttgacggttaactttgtctcatggaattctttggactaattgcactacatcttttacggacagctagcgaatgtaaatatataataaaggaatgataattgtgccgaccattttttttgtcttttataggtgtgttggatcattttttttaaaaaaaacaaatatgtaccgggccaattgacagagaatgcgcctaattaaacatcaggtgcactgcattccgatggatcatcaccaccaacctccaatagcgcgtgcacacatcgaattctgctttcccggctctcgcggtctcctccgccacaagcaaatggcgctgtggtttgattcgatcgaatccttccgctgctgctcatcaacggagaccgtggcgtcctgtcttccccccccccccccccccccaaaaccaaattaacgtcgtcggccaatccagctctcggcttcgatccctcgagctggcgatcgatcggcccatgtgatgggagatgtcacgagtcgcgcacagcgatctcattaacgctaacaaaacttcgaatcagattggtgtggccgggcagtacgcgttgtaatcggctaattagcttcaactaaaaagcccgatgcgagctattcccccatcggttatctaaagaagaaagctattctcccacatgcaagtgagaataccgtcatggccacgccgcatcgggcaaaatcgacaagcgagcaagacagggccatgtccaatcggttaaagctacgggacacatatgggatacagtggacgtgtaccatcgctcagcgcatgcagcagcagccggagcagccggccgattgacggcagattgaggcgctagtatactactactaggtgctgggaacctgtccgtgtcacgcatcacaagtctcgtctcgcagcgccacgcaatagccaccagactgacaaccggagacggaatatgcgtcaggccgtgcatccatcgtgaatagggaaaagggggcggaaaggagcacagtgaacagattgtcggctcccggaggaccatggccagccacagcgatcacatactccctccacaaaaattaaaaaaaaaacttgttttctgtatctaacgttttgaccgttcgtcttatttaaaaaaattattaaaaaaattaaaaagacaagtcacgtataaaatattaatcatgttttatcatctaacaataataaaaatataaattataaacaaaattcatataagacggacagtcaaaattggacacgaaaacccatagtttatcttttttaggatggagggagtagatcagtaacatgggacaacgccccagtttcgagtgaactaccaaagcaatgtagggctggattaatttgaggcctaaattagacttaccaaaattaatcatgtcaaaacttaccaaaatttaacattgacaaaatttagtaaggcttatttagaccacaaaacaaaccaaaccaaccagtcatatcccaaagcctttgattactgattaggtgctacgacgatgaaaacaacacgttcatacgcaactgcacatccctcgaagcctcaaactagcccttgagctactactaataagccacgaaaaaaaatagcaaagtaaaaataattatggatatcttttttctccgtgttttgggacaaacaaaatagggatagatggagaataggtttctcaagctcaatgcctaacggtgattattaatagagttattatctcatttctcattgataatagccgagcagtaaataggaaagttacaagcatattcttaaaaacggaaacccgaggataatcccaaacttcacattttgaggccattaagctaagttgttccaactattcaggatcgaactaaatctattagctcatggccacttgtctattcaattagtgtaagttagatgtatacaagagtgtataaccaacccaatttactctaatccaaatttattcctatgtttttcctaccgtttaatcaaacactcattcctacaaattttatgagtttttcaatcatctgttttgaatatacactggtggagaagtgctttttagtcccggttcgtaacccccctatagtcccggttttcaaaccgggactaataatccgggactaaagatcgctatctttagtcccgggtgaaaaaaccgggactaaagatcgatctttagtcccggttgatgacaccaaccgggactaaagatatttagtcccggttggtgtcatcaaccgggactaaagagagggtagcggcagtccatcagctggtccttgtttcttttttattttctcccgaatcgagtggtatgcatatcatcaaatcaaaccccaaatccacatcacaactccacagcacgattcacagattcaccacaaattcattcacaatatccattcacatattcattcacaacatcacaaatatattcacaatattgattcaaaggttcattgacaacatcgagtcacatactcattcacaacatcacagattcattcacaatatcgattcatagattcattcacagatcaaaacatccaaaccacaaattaaaaaaaatcaaaaaaaaatcgactcaccggccggcctcccatcccgccgccggccggccacccatctcaccgcttcccctccggccggatctgggggaggggagggccgaggcnncggtgaccggcctccatcccgccggcccgcgccgggccgccgccggccgtcctccatcccgccgcttcccctccggccggttctggaggaggggagggcgaggctgccggcgaccggcctccatcccgccggcccacgccgggccgccgccggccgtcctccattctgttggcccgcgcccggccgccatcccgccgccgccggccggccgccgccagccccaacccgtgcctggccaccaccagcccgcgcccggccgcctccatcctgccaccgccggccggccaccgccagcccgcgcccgtcccccatcccgccgtcgtcggctgcctctgcaagaggaagagggggaggggaggaggagagggggtgagagaagaggaaggggagaggatggagataaggaaggaaaagaaaaagatataaggatgggagatagagagagagagggggggctacgcatgcgcttgtgcgtgggctggtgcgtacgctttattcccggttgatattatcaaccgggagtaaagatccctgggatctttagtcccagttgaccaaccgggactaaagatcctatctttagtcccagttggtgttatcaaccgggactaaagatatcggggggcctgacaaggcctgacagatttagaaccgggactaaagatcatttttagtcccggttggtacaccaaccgagactaaagatcaaatatgcccgctgtagccaccaaccgggactaaagatcatctttagtcccggtttttagtggaaccgagactattgtggatttcgggcgaccgaccaaagatggtttctccaccagtgatatattcgtataatactcctttatttttcatattcctgtattttcttagtcttacgtttcaaaggtaccatataagtatacgctgaaaagtagactacgataaaaacaacctaatcctaaaatcaactttataattaagtgttaaatcttttgttggctgattagctatgaacggatgagagtgcagatccattcatcagttgcacttgaagcatgaggccgggtccggattggacgtgcgctcgtgtgtgaaggtgatcgtgcatgcgagggcccaatcgaaacaaactgactatcctggaattgcgatttgtgggtgcgcggttgcatcggcagctggcggcctggcgatatatcgatcatcatcagggcgggttagcacatgatcgaggcatctcgttgctcccaattatatgcgtgaagctccttttaggaacacaaacaggagcctagatatacaagatatccaatgcggcaaaagctcttgctcttttctgtgtagaccggttacttgattagggaggtcgtaatagtcaaaagagggattagttggcaccagcttgttttggtacaagtttatcctagtttagtaacgactcgccaaatcaggagggaagggcatcgaccccctcgtgctctctagttctcattgacacaggaagctagattccaccaacttaggttattgttttatcggaattgctaaatatttgttgacatatttttatggctaaatctttcactttctaaaccgttggatgtgtcctaaattcatactaacagtttaatacgcatcaagatatgtacttttaggaagaaaaacaaaatcatatttaggaatcgatcatgtgacctcatgggatgaaggcgtgactgccccattgggctactatatttttatgatctagattaaacttacatcttacttatactataattacatgcgagtttatatatgtaattatagtacaaatatagtgtaattatgaaaattacatatgtaattatagtataaatatagtgtaattataaaaaatatattgtaattatgttacaattacatttgacagatttttgggctaatttttagtcgaatgttgtatagatagtcccttgttttatttgagctataaggacgcgtgcttggttgatagtttaacaacacgtacatatataggccatatagtaatgcagccgtggtgatgcatcgcagcttgtccctccaaaaagtccacgaatcccctggatgcgtacaatgcatgtggcgaatggcgatccatctgatctgtaatgttctgcatacttctcaatcatcacacgtacaccaaccacgcaaatcgatctgataaaaaatatactcctactcgtaagatccgctcagtggcattctgcacacgtacggctactttaagctagggctacagttaattaggtatggatgtttgtcccctgcaggctgcagcatctgcattactgcttgaacgtcgagctgcgtgttatcgtcccgtccaagcagcacatgcgcacagtgattcagtgtgcgatactgggtgtgagctgggtggcgcctgtccggtataactttgccgatgcgattgtcctcgtagcgtagcacattccttcatcttctgaacatgttttgtacaaatgcgaaccgtacactacctatcagccttccgatattaattgctgccatgcaattcacctatcagccctaagggcagtagcagcgcgtcttgagattttaccgaacctcacccgtcaactagataaaaactatataagcaacatacttcacgatgcaaagttaccttatagtggatcccaccggtaccgtatttttcccttttcatctcccaatctctctcctcttgttcttttctcacgggaatccgaggccgatttccggctcggcccaggcggctccggcgccaggcagcacggcggtcgagtagcaacagcgtcaggcggccgggcgacctgagcggtgacggcgtcgggcagcccgagtgacggggcggtcaagcggcgacggtgccgagtggatctagctgctccacgacgccctccttctttgctaaactccttcacggccgtgcgagctcgggggatctggcagcgagcccgatgaagctagcaacatcctcacctcccttagccccctcccatcctcctcttcttcggcggctgtcgagcatgaaccttgacggagcggatgaagctacctcaccagacgatagcaccgccgagcttgccagatccgccggctctagccttgggcgtcggcggcagtagctagaccgtcgccatcttccctttctcccttttcatcatctggcacgcgtaaagtttaggcagctctgacaaacactgacgaggaatgcggtgttttgtttggctccgcgttcttcagttggtagcgactgaaactaaggtggcatgaaatctatgatgtggaaggtctaatctaaataacacgtatatgcaccgtgaacgctgtgagagtaggggtgtgtttactcctgaaaatagttggaagttttggaaaagttgggaatttgaaaaaaaaagttagaagtttatgtgtgtaggaaagttttttatgtgatgtgatgaaaaattgaaagtttggggtagttggggtgaactaaacacggcctaggaatacttattgtcactgcgtcaaatgtgatatgctcatgatggtgcgctactagtgaaacggttcgtatttaaccgtgggacgacgtcactgcacatcactcatggagatcggagtagagtagagtagactggcagagcaggtacgtacagcctgtgggcaatggcctttaagggccttgtgtagttgtaaagctgctgatcatggagtatagtacgagtactctaggcgcacttctgaccatgttagctctgaccgacgagggggggtgttaatgcgatcgatgcgtacgtacgcctgccggtgtgggcgcgccaccggccacccgacccacggccacggggcacgggctcgatcggatcgcgtagctacctagcgtgcattgctccagcattcggatttttcgtcgtgcgacgcatgcgcatacatacctatatctgcacgcacccgtgtcacccgcgtgctgccgtgcgagacgtcacgtggaaaaccgccaatcgccatcatcctcttgccgtgccgtgcccccgtgccccgcggcccgcgcgctatgccgctatcgagaagcaatggccgcgaagccggcgtacatagctactgtagtagctagctttcagttggtgctttcgccgcgcgcacggggcaaacgggcaaaccggcgaactgttcgggcgatctccgggtgatggccctgatggggatgggtacctatggtggtgggttttggaacaaagctagcgatcgagaccgggtcatggggggaattattggcggagtggcgcgccggtcgatcggtcgatccattgttccttctttatgagcacggtacgtgatgccctgatggtacaataatgcatggtcgtcgtgggctgaattgtggtggaacaccgcggagcgcattagctggagcccgtggacacggtaagtaaacccgtccagaattggtccgtttcatacgattttttctgcagagtccatgtcacattattctcctcaatcggacttcgattacagctaagcatactgatactaaatttaagagcgacatttcactgcggatatatataccaacgagaagctaattaaccagttttattagtagcggcatgctaatacttttctaagagagggggagagaaagagagtaaaaaagaaaaagctgggacagtacgaaagacctaaacccaccacacactgactgcatccgatgtttcctactgtttgcacacagaagctctctgcaggagttcacgtactacgagccagatccctgtgacgtgcaggatgcatcaacggtattggttgcataaagatccacagcctaggcgtggaggacgactcttggtctttgcaaacttctgcgctggtgcgtacaggaattttgtacagttgtactgttggaggctagaatgactctgcctgcaggagggtccaagcttaagcaatgttcacttccattattagagttgatctattattaacagaagggacagcataggtgacagccacgtaccgctgtggttatatgttggtttcattgtttcacgatatatatgcatgcagctaatgtttcgtgttccggctttccggagatccgccactacgtttttatgatcgcttgctgagttcgggagcacgaaaaatggtgttacccattaacacatgattaattaaatattagcctaaaaacttaaaaatagattaatatgatttttaaagtaattttcctgtaatttattttcaaaaaacacactgtttaactgtttgaaagcgtgtgcggaaaaaaaaagaggtgagttaggaaaagaggggaaataacacaacctaagtgtgtttctaatttcatcgtaaatcaggtttgaacgagtctatacaaatagaaaagtaatattaacatctactgcatactttctatgtctctaaaagtctcaaaccctaacatcccaataagactttaagaagagaaatagaagatcataatacccttaattaatgtgaaagttatattagcggatatgtaggagaagggtattgaagtaatagaatttctcattttgcggattggtggtaggtaagaaggtagaaacttgtttattttgggataatttttaaactctagaagttgatttattttgggatggatggagtatcaaaatgaataaataaattataaacatacattttataatagacttaattatgctcatttgatatcataaatattagtattcaatgaatttaatcagaattacaatagtttgacttagaacaaaactagcaatacacttacattttggagtggagggagtgggacctagctacaacatgcacaagtataccaaaaatatgtaactaaaagttaaattcactaatttaaagaattgtgctctgtgagggctatcttactctatattttatttacatggccaggcaaaaaaaaacttttatgtacacaataatattttgcatataataaaattttaaagtaaaactagagttaattaatatatgcaactcctagattatgtatgttttcaaagatacaatatataaattacaccgtcataatctagactcatcattatctacttatattcatcctaaaatataaaatattttatatgagtaaaattcgttatattatgatgtagtaataaagtaagtattttttttaattaacatggtttttttatttaatctttgcggcaaatatagattaagtataccatcgttaatacttcataagtctcaaaataagttgtttttagagtctaatcatattgtcccaaaatcagttaatttttcatctttatctaccttttctcataaatcgagaacttttttccattcaatatgttatctatccatctaccaatagtattttttcattaataacggtattttgatcttctctccaaaaactaaatttttgttgggatactagggaacgaacaaacgagatttggagggacactaggaatctatttattttgagaatccatacatgcaacctaattaaatagcaccatacactatgtatatgtatggatctacgtactgaagcagggccatcgctcatacagtaataatttgctcgtacgcactcaaacaatgaaggagacaataaaccaaagcagcagggtcaccgtgacaccaacccatgttctcagctcactggagtactggatgcttggatcccttaatgccactgtcatggtccaactaattcccggacatagcaaatgcgtgtcctacattgtacctatcacatctctaactccgcagtttcgcgtgcagctagctgcatgcatgcctagctttgtcagccttcttccagaggtgaagccaggataaaattatagtggggctcctcagccttctgagccttataacaatctcagacaaagtctattttagccctcttgtaataaatatatggatttaaattttagggggggtcttaataggggctctaatagtttattagggggtagggggatctaaagaccccccgcccccacacactgcctccaccactgccttcacccctttctcactaggagtgtgtttagttcacgctaaaattgaaagtttgattgaaattgaaacgatcggacggaaaagttaaaagtttgtgtatgtaagaaagttttgatgtgatagaaaaattagaagtttaaagaaaaagttgggaactaaaccaggcctcggtcgatctgcaagactgcaagggtacacacggtaggtgagagctacaaggaaaccgtcctggccgccggcacgagcacggttgcgtgaccgagataagagaaacgcttgactactcgcgcgtgcaacacgcacaaccggttgaagaaaagaatggcgggacgccggccagcacacgcggtcgtcgtacgagagctctcgtgctcccgcagcgtcttcctcgcggtcgcggagtatacaatatacgtggaccggcacgataggccgggttcgttccagatctcgatccactgcaggcaggacggccgtaagctagctacaagaacatgtgtcgaccgatcggaggtagggtgtcaatttgcactgcggggaaggcgattgacatcaacggcaacgcggtgtgttcgatcgccaacttggttgacataagaaccaggcggcggttcgcaggctgctgcctaattaacgttctgccggagaggaggcatatgcatgcatgcaaggccccatgattttgttgggcgcgacgaggatgtcaatcagagcatgatatgatgatgaccaatatgcatgtgagaatagtggttccgccaacgagattttttattagataatgaaataaaacatcccggcctttactcatcagagttacagccaattgttacaaaagtaacacccaatcactgagtgtagtttaaatgaattaaacacacacccaacaaaataaaaaatcaaactaagataaggagagcacatttattcaagtctatttgtgaatctccatccatagtttgcaaagagttgcatgaccgttgtctcaagcctacgacatgcaaccttcataagctctcgatcatcttcatacatttgcagctgtgcccaaaatcggagccaatatgttgccctgaaaattacatacatatatgagatagatggtaatttgtcagaaaccatatcattcctagtcaaccacagagcccaacatatggcagaagctcctacaagtatgagtttactcttcttcttgtctaccccaaaagccaaccatcaaacatattagatatggtagtaggaaggtataaaccaagagagaactgtactgctctccaaacaaattttgtataatgacactctataaaaagatgttgaatagtctcatttttcatacaaaaacaacatcttaaactgccattccaatttcgtcttgccaaattatccttggttagcacaacccctttaagcaagtaccacataaaaatcttaatcttaagtggcatcttaagcttctaaataatcttgtttctctcaatataaccattattaattaaagctagatacatcgacctaacagaaaatattccattctgatgatattttagctaataaacgaaatatcatatttgcaaacgaaaacagtggttccgcctaccacgacttctgtttaaggttttggagtagcagtacatgagcaatattccaaatttaaaacataagatgccattctatttaaggtaacgagatgatccgtcgtagtagagtgtacaaggactacggatgtctcaagacacatcctaagttaggccgtgtttagtttgtgtgctaaaatttttataagtatagggacacacatttaaaatattaaatgtagactaataataaaacaaattacagattccgtatgtaaactgcaagatgaatttattaaacctaattaatctatcattagcaaatgtttactgtagcaccacattgttaaatcatagtgtaattagactcaaaagatttatctcctaatttacatataaactgtgcaattagcttttttcttcatatttaatgttttatatatatgttaaatatttgatgtaatgaaatttttaaaaattcgaaggaaactgcaacattgccttagctagctggagtagtatttggagaagaacgagaacgacagaagtacagaaccaagcgaccggccattccctccctacagtggaggctgtctgttttgcatggctcaacgcgcatctccacagtgctacggagcatacgctatagtatagcctataggcaacggatggtcctatgcaaaaaagaaatgcgtagtctggatctggccaagtgtccaaaaaataacaatgcatctatccgtcacatgcggagaaagctgtcgcgtacattggaggccatcaagctatacaaccagttaggggtgtctagatagatacatataaagttttggcgtgtcacatcggatattatataaattattatatgaggtgttcggacactaataaaaaaactaattacagaatccgtcagtaaactgtaagacaaatttattaaacctaattaatctatcattagcaaatatttattgtagcaccacattgtcaaattatggagcaattaggtttaaaagatttgtctcgcaaattagtcgtaatctgtataattagttattttttcagtctatatttaatactttatatatgtgttcaaatatttgatgtgacatgatgtaaaatttttatgtgcgatctaaacaggacctaaaattttagcataataccatatcaaatcaatgtgtttttgctgagaccagcacttttcctacagtaagtttccccgcggagtaatcaataaactcccggtgcctaatgccctaatctcatagtggggcccatatggcagcgccctgcactgacgtactgacagctcccagtgccccgaactctcgcaaactgccgccgtctcacacacaaacgtggccacacccccacacgccagtacgccacccacgccacttcactgcccttttggcccgaggccgagggcgtggatcgacgcctacgtgccgcctgccgccgccaccgccgtctgggaggatacggcacagtgcatactggattattaccgggtactttggtagagtggtgcaacttagagcaggtacaatagcagattataaaagctataaatatattttaaagagataaaagaaaagagaagagcaacgggctacagatctatagccagctacagcacggactgcaaaacgtaatgtgtgtgtgacagtgggaccagatattaattgtatagtaagcaactattgtatggattggctattacattggttatagatgagcaagtttaatagtatagcccgctagtagctccaattcatctatagccgatctaatagccaattcatacaatagctgcttattatactataaacatatggttccacctgtcatacacacattgcgtcttgaagtccatgctgcagctggctacagatctgtagcccactgctattctctcatcttttatctcattaaaatatgtttatagctagctaatagtttactattgtgcatgctcttagggcagtcccaaccctccacataggatggtgtatatggcattaactacattgctatgtaggacttttagcttatgtggcactatattaattaagagagagagtgaaaagaggaagaaactgggtctcatgcaagacagtttcaacacgagaacctatgcactagacactatcaggttttgtattgggagagaatagtgtcttcataataaatgaagaataaatatgattggtagagaagagagatgatgtatttattaatagcccactttaagaaccatgagttatagaatgtagtttctattgtgatgtcttattgacatggtactataaacactatttatataccctatgggttgagactgtctacgccgaaggatgcctcctgttcggggacaacgaaatcggcgacggtcttgagaaggcagcaggcatacctcggagagctacacacgtttcatctcgcatttatggttttacttatctcaaaaatgatgattgttggtcgggcgagtagcattttcttttccgagaaaattgatatcttgccattttcaaaatagagtttcgcttgaatgtcattctcaaaagtggtttcgctaaaatgacacctttaattagggacaacacgttataatgccatttcatctatttcttctcattttaatgattttttaatgttttttcttgctgagacagaccaaaatacccttggatagtctcatctctccctctatctcttccttctatccgttgcaaatggtgggtagcgccggcggcggcgcggctggggacgaggacggcggcggcggcgctgtctccgtccccagctgcgccgccgagccgagcagccttccccacccacgtcggcgccatccccgtcctcgtctctctctctatctcttcctccgccgccagacgaagcatcgcgagcagccgtcgttgtctcgcgaagttgccacagtcgttgtcgccgcaaccatcatgagcacagcagccgcagccgccgccgccgtcgtcttacgaagctggtgcgggcagtcgttctcgccgtagccgtctcacgaacctgctgcagccttcgccttgctggatccgcagaggaagatgccgactcgtcggatcccttcatcctgctgctttgcttcctagcttgtagctctcgtaggcatgaagcatgtgaaggaagcagaagctaaagccacgttagatgtgcatgtttcattgaatcaattggcagctagctgggaggaatcgttgaaggttctgatagatgcgtggatttggggattaattttttcacctgtttttctgtttcttttttccttattgatgtatgcaagttgttcattaaaaaaactgtgtactacattgatttctttggaggagtgataaaaaagccaaagatttgtcatccactacattgatttcattccaaaccgagtggcgctggcaccggcgccggcgctgcccaccaactacaacggataggaggaagagatagagggagaaatgagataggatccaagggtattttggtcatctcagcaagaaaaaacattacaaaaattattaaagtgagaagaaatggatgaaatggcattacaacgtgcacgttgcccctgattgaaggtggcattttagcgaaatcacttttggcagtggcatttcagcaaaaccctgtttagataatggcaaaatgttaattttctcttcttttccggacaggtacctttttagaaaaagcacaactgtgatatgcggaaaacattcacgcccctatatctgttgctgaatttgccccgttgtttactgcctacttcccccgtgggccccgtccaaagcaaaacgtttctggtagtactcactccatcccaaactagtacagtataaactataaaaagtttctggtagttgtgattagtgaaatactgacaaatcattcagtggagaaaataaataagatattgttgcaattagttgatatggatagtaggcacagggtaacaccgtttaaaatgcatgattgaaaaaacacataaatagaaaaaaaaacacaaatgaataggataaaaatacatatgcaaaacaaagaattggagaagaataaattttatgggaataaacataaaaatatgttaattggattattagagtttaggatcccttcaaatcaagactatttgtggaagaaagtttcctacatttttctcttgctcatttatacaaataaaaaacaacgagttagtcacaataatttgaatcattggctgttgctgtgtgatgactgaaataatggtaataatttcgattagtgagagcctagctgtgtaggatcgaacacaagcaaccaagcctatcagagggggatgaatggtagggaaaaccaaaaacccaaaaacttttagcggaaataaaagttaccctcaaatcgatggaaatctcgacgtagtcctatcgccgccggtcagactgctcgcacgccaccggttagatcgccgccctgccacctgaaaccgaagaaacacaaatcgaagaactctcaaagtagatgacaactttattgcttctctatgtgtttacaaagtgcaacaacatcactccttacaaaaatctcgagtaaactcgaaaccctaactaaactatcaactccacgctctgaaaaacgatacaggaagcctcacgctccctctctatttataccacgaaaaacctcctactcaaagtaagtgtagaactcctattcatgctgctgccaaccatcggcatacatacatacatgcatcagcatccatacaccacacatgcatcgctacatatatgcatacacgtcacgctacagtacccagagtactgtagcacatatacttatcctccaagaatcctgactcagtcaccttctcagatggtatcccgaccgcaatagacctttgctccttcctgagtatagtcccggtcctcaccattgaccaaggctgacctcaagttacctgcacacaatcagacaaaacaatcgtttctgggcacagatatcacaacctaacccacattagtcacacgcactcacaccaacatccacacatcttttcaaaccaattcgttgattaaatcatttgcaaagccaattgttcatcacaaatattaaccatgacaatgatttcacaagctgaaattaaatttcagtgttggtcatttttgctcacttctagttgtggaagagtagaattgacgtgtcaggctggtcgatgtttctccaagcagaagtatgttgaaaaacctaatcaaatttgctaaatggcactcaatagaaatttggtatgaaatcttatggattttagaccatcggatgcatgcccatgcttcttctcatccaactctaacaagcatgttctcttctccagcgcctgtggggcacaaactctaacagaagacatacaagtcagagtttgggataggggttggagtaagaggggttaggggagggaggggatggggctttctctaaaacatagagggatggcagcgagcaggatatgggcgggtggtgagatgccggtggcggcgcggagccacaggggtggtagctgggaatggattggtgttgggggcggggggtgaacaacacagccatgttagtggtgaggaggcgatggcttgtggtggcggatgcaacggtagggggcacctcgctaccgctagcttgaagataaggacatgtgagaatgaggagggggacgacgtcaccaagagaggggctcaccaacgctattcacgccttccgattaactgatgaggtgggggttaatgtgataggcggggaatgcggcggctaaacgacgatcttccgctcactcactcgcgtgcgagcggggaagaagggagagagggaggataagattacttatgtgcatgaatcacaaagcccacattaaatggtcaataatctatcaacatattaaagtaataaaaaaagaagcctccatgttcactctcacgcattagaaaatttcatattaatcagagaaaaggaaaaaaatagagtctttatagaaatacaatttaaaaaagcttaaatttaaaattaaaaaataacaaatattgggagaggagactagagtccatacagatatacaatctagaactatctgaattcggaattaaaaaaaataaaagtagagcttatagtctatatagaaatacaacttagaaataactaaaatttaaaatttaaaagtatgaaatattgaaaaaagagtttagagtttatatatgaatataatttagaattaattgaaattataaattaaaaaataggaacattgaaagatgagtttagagttcgtatggaaatacaattagaaatattgaaaattcataattaaaaaataaggaatattagaagaaaagtctagtgtccatgtagaaatttagaaccaattgaataaaaagtaaaataaaagtagagtttaaagtctatatagaaatatcatttataaataactaaaagttaaaataaaaaagaaagaaagattggaagaagagtctatatttcatatagaaatacaatttagaaaatagctagaattaagaactactccctccgtttcaggttataagacgttttgactttagtaaaagtcaatctgttttaagtttaactaagtttatagacaagtattgtaatatttataatactaaattagtttcatcaaattaataattgaatatattttcataataaatttgtcttggattgaaaatgctatacttttttctccaaacttagtcaaacttaaagcaatttgactttgactaaagtcaaaacgtcttataacctgaaacggagggagtaaaaaaataaggaatattagaataagagtgtagtggaatacaattataaaataattaaaatttgaaatttaaaaatattaaaagaggagagtagtgtccatatataaatgcaatttataaataaaaaatattgaaagaagggcttagagttcatataggaatataatttataaatagcaaaactttaaaattaaaaacaaggaatattaaaagaggggtctagagtttatatatgaatacaatttagaaataattaaaactcaaaatttaaaaataatacaatataaaaattacccattggttagtttggttagtttagtacaaaattttaaattatgttaccatttcgatatattttattaataaaatataaaaatatatatgctattacgtgagagaaaatatataataatgctaatcgtatagtttgcatagactatcatgctgcaggtacacatgatataagaaggattcgtgtcgtaagttaatcaggcagtctcaaacctaattgtaaccagtcaatggttgggagaagtcgaaagcaagatatacagagacgtgcaactattttccaagatagcaacaggtcatctggcagcactttacatgtggtgcttccattgcagcaataagccatggccatggtaaattcatgggcatgcattgatggggacacatgtttttagtgatccttttcagccttttccacccagtaccaccctcaccctatgcagctagtaggtaggctttccccgatctaccttcctctctgactctctactttcaccgaaaccaaagaattgcttagaactaagctgttggttagcgagttaattaatcaggatcctagtgctgttgctatgtacggagtagatgtatacttatcttatccattaccttcccttgcaatcctggcaactcttgttcacatgtcatcacaccgtgcctttccactcttgccactgggattggacttgattagagtaaagttaattcgtgctcgcactgcaaatcctggtcctcatccaccttattagtcaaactcctgtgggtgtaaaattattatcccaggcttagagctaaaaaggtatctacctagctctttggaggcttgctttgcgactactaatatactattcgccaatgtcttcctcatgtgcgcgatttgatgcattgttaaatgcggctaattagcatccctaatcctacttcacgtggctaatgtaggtttggggtggcaattgttggtggcttggtgctgactttgtagcagagcacaactcagcaagtatgtatgtacagcggaagggcagtctgagccaggttaggagcggattacggatgtgcatcaagttgcaccaatatactagtaattatcatgtaagaagcgtaacgtctggctgcagctgcttaccaaattcgcctactaccggagatttttaattacttggtaagaagaacaaacaactcgcaaaatacaggcctactcggtcgctgttctaaagaaactcagttgctgttctatcggtccttttcaggatctgtataatccataaaagaggacgaaaaacccttgatcaaaaggcatgggctttgctttgttgaccccgcaataattcgccacctctatatcgatgggtcggtggctcggtgcgtagccatccatcgcaaggagaccgcactggacggtcatggcgtcaaaaacgacaggggcatgaatcgcaaaagcaataaaaacaggggcatgtacaggcagacaatccagtggtagttaacctcgttttcatcgcatcatttccctcaattccaagctccggcggatcgatgcacaccacaactccacaaggagacgcataacgtgaaaccgatcgctcgctattttactctgcaaattatctcggccattcatgagcacgcggtgttcagtacgttcgagacactgagacagcgacaatgtgttttgtgtctatatagaaacagatcgatcgcacagtaacacagacgtcgaataagtaaacggatatactactactacacggctgtaccgcatatacttggagtgatccgtcccgattaaacggacaacttaatcccttattaatcagctagtggcacgtactagcaaggagaatctcataggagcagtaacaatccagctgcaaactataggagctactactacctctggctgacaggggcagaaaaatggacggggcccggccggaccatgggtggtccgcggcctgcgtctcgatgaaagccggcttgattagcgcacgagacaccacagctactcgaccgggtggtttgtgcttgcgctttgtgctttgcttaatcatgccgcgcccgcccgagcgggccgacggcttatgcaccgctcgcgcgcgcaggggccaaaggaggcagagcgacatcagatgcgtgcgtgccgccgtgccgtgctcctctgcacgccacggggaccgcgcgctctgcgtcgctcgatcgggccgagggggttttcctctgcttttctctgaggccttcacgtatacgggggcgcaagcgcaacgcgggcaccactgagagctctcggccgtggtgatgccggcttgggcatcggatgccgttgtcggtatagagggggagagctttgatggagtactgcgccagtgtgccgggcgcgtgatggtcctggccctgtgcatgtggtgctaccctggtatagcctgggaggtgtatccgttctttttacgtgcttgggtttagcatctcctcttttctttccacctttctttctttcggtttatcaaatgcatctgcgcaacgaaacttcaaatcgtgcacaccgctgcaggtcgtctattggaaaaaaaaaaggcttaacagatgctgagtggagatttcgttggcatactcaggggtaggagtactattctagggtagtacgctgaaacgaagagaggacaaatggcaccatcaaacagtgccaacaagtcaatggtatgtgcatactccaaaggacgcgtcgtcggctgctggtgacgggaaaccgaaaagtaaaaccaaacgacggcgcgccacctcctctccgtttccaaaatcgcattgcctgcctagtccacttccccgaaacggcacgagcggttaacactgcctcgcgccgcggccgggcacaacccgctgaagcctgggcccccgcggtcgcggaattttaactccctctaccccctccatccccaaggacaagagaggagaggagaaggagaggccgcgcccccgaaaggccaaggacgagcgtaccaccaggtcaccaacccgacagtaaacagtaacccccggtggtaacaaaaccgacgatgacgacgacgcgaggcgggcagagaggggggaggggaggggaggcgttggcatcaccgcaataacaacgacgacggcaccagcaccaaccaccagtcgcgcagacaggcagcagctgacgcgcgcgcgggggcgagggcaggaacccgtcgcgattgggcggacgacgaaccggtcgcgcgcgggcgcgttcgggaatcgtggtggatctgacgccaccaccgccgccgccgccgccgctcggttgctcctctcctcgccgcgccgtcgcgtgcgtcgccgtcgcctccttgcccctagcgggcggccgggcaattccccgcgcgcctgctcgatctgcctcggtggtcaatgcgggcgaggagatgagcggcgccgaggaggaggaggaggaggaggaggtgttctatgaggcgcgggaccgcgtgctatcctcatcatcatgctcctccacctcggcctcggacgacgacgaccacccgcggcgaggtcgggatgcggcggctgctgctgctgcggcggcggcggcggcgctcgacgtgtggacgtcggagccagcgcccgtgcaggaacgacgccggaggcttctccagatgatggggctctccggtgacccctctctggcgcgcctcgagatgggtcgatcggcctcctacgacgggcccatccggccggagacggtgtcgcccatctcccgatccagatcggatggcagcgtgccggcctccgccaccaagcccccgctcgcggcccggtcgcgccaaacatcgtccgactcctccgaggccacgccagggggagatgacgcggaccccaggtgcctaatccgaaacctcgacgacggcagcgagttcgtggtgaaggaggagtccgcgctccgcgaggtgggcacggggaggcagctcaccatggaggagttcgacctctgcgtcggtcgctcccccatcgtccaggagctcatgcgccgccagaacgtggcaagctccggttcgagcaacggagcgtccgctctcatccagaggtccagctctgattcaagcaacggcgcgacgcgccacaggcggcgcggcagctggctccggagcatccgcaacgtcgctggctccatggtggtcggctcccgcgaccgccgaagcagcgacgagaaggacacctcctcggaaaagggagggcgtcggtccagctcagccacagacgacagccaggaaagtgccagcgccgtgcgccgtggcccggagcgtgtcaaggtacggcagtacgggaagacatgcaaggagctcagtgggctgttcatgaaccaggatatacaggcgcacaacgggtccatctggagcataaagtttagtcacgacgggcggtacctcgcgagtgctggggaggattgcgtgatccatgtctgggaggtgtcggagcttgagaggaaacgggagggaaatggggtgtgcaatcaacttgttgccgtcgtgtgcaatggttcgccggagccgatattggcattggcaagtgttgatggaagctgttgggagaagaagcatcgggctagaatcttggaaactcggaagtctgcgagctctgaccggttgatgtttccagagcatgtgttcgcactatcagaaaaaccggtcaaaacttttgaggggcattcggaggatgtgcttgatctctgctggtctaaatctcaggtaatgttacaaggtttctgttcattcaaaattcctccactgttgatgctccttgaatactcctataaaggaaaaagggtgaaggttgaacataatctcacaacctaaattccactaaaatttagtagtgacagagtgtgcttcttaactctcagttaatttcaactatagtcttaacatctatggtgaaacctcgaagtgcattgttttccatcaaaccatctttgtcataactgttagtccaactgtgtcagaacaagacactggcatcgagtagtcaagggctggtacagttcaatccttatcacactttggtgtagttcttctgaaacatggagcatattgatgcaaattggtgtcctttagctctgaactaatccttctttgttcattggaaggaaggttagaagtgcataagcagcaatctggcgaattgcctgcctatcgattgcatcatatagaagaggcactgcccaaattctgccatagactagttacttaccatgtccaagctcatcaattctattatatctgttacatgatgtgacatgaatactcctgtttttcatttagtgactaaattttagaaatgattcactaataagatacacaggaatgctatgatctacctttcagcatgctgtaatccctaaaatggcgataatgtaacaattagaaaaataagtttgttggattatgtcctatgaatcaatgtaaaatatgttgttctgcaaaatccatttagccttaatataatctcccatactagtactagtagataatataaatatatttgaggagtttcagccttcttttggtactacgttacaggttatttcatttattcatgtttaagatggatataggtttcaataaaggtcccgatgcatgactctggtgactcctgtatacatagatgaagttaacttggtaccatgttatatcattatttgtccaaagtaggactgtcaggaaatccttctagcatgtttcatattcagcatggcatgctgcataacatggatgacatatgttgcttgaccaattgactttgaatttcatgcgcatcagtaacttatggagttatggtctagaaaccaggactcgcatcatcaactatgtattgaaatttcagatgtctattgagagaatgttagttcatcctactagcagttcattgccctttgaaagtccaaatgcatgatcagatgctcctaatttgttgggcccttgttgtaagaagatgttagtatctaattggctttacattgtgtttggctggagaagataggaacttctcccaatgcatgcaaaacggagcggctcattagcacatgattaattaagtattagcttaaaaatgaaaaatggattaatatgatatttaaattaactttttttttttgcaaaaaaccacaccatttagtagtccgggaagcatgctcatggaaaacgagaaagtagaagatgggaagagggagtattgaacacacccagagggtagttaccttttgcagctagttatacatatatggtttctatataccttatgtggctagttacatatccagacttcacatttgtcaacaacagttacatgcttccagcaatgcatccccaaattatgattgctacaattccatgaatcttgtagtggtattcttatggttttgtagctattccagattttaatttctttctttttcaaacatcgtgcagtacttactttcatcttcaatggataaaacagtgaagttatggcatatgtcaagaacttcatgtttgaaaacattttcacatagtgactatggtaagatctcgagttgacattagcagttttgcgtgttctctctctcccccaagcacatatgacgtttctcactctgcgaacatactctaaattttcctttgctgctttgcgtttcagtgacatgcatccaattcaaccctgttgatgatagatacttcattagtggttctctggatgaaaaggttcgcatatggagcattccgggacgtgaaattgttgattggaatgatctgcatgaaatggtcactgctgcttgctatacacctgatggacaggtttctacactatatactgatgtatgtgaccgaaaaggtctttttgtatgttagctctaataccttgtctcatattttctgaagagagcattagtcggttcccacaagggcagctgtcatatttatgatacatctggtatatctcaccctctcatgatcctcatatcttatgagtgtatttctgtatgtttttggcttacttttccttcaggaataacctgtctctcgatcttatggccagataataagcttctccaaaagaaacagattgacttgcaaaataagaaaaggaagtccaatcagaagaaaatcacagggtttcaggtgcttctaacacacttttgaatatgaagcaaactatgtgcagatcacagatcttctcttactgaattgtagttccttgaatagtttctcccaggaagttcttcaaaggtgctcatcacatctgcagattcacgaatacgagttgttgatggttttgaactagttcataaattcaaaggtattaagttttgtgccttggaacttattcatatcagattgtttttgttcaaggtttagtatcctttttctcagatatacaaatactcctgaatgttacttacctgcttcttttcggttgtactaagtacagtcccagtcaaacttcttattcatccataaaccacctttgttacttgttacttttaccactcctttttttgttgcagtgttgcactggaatccaggtgtatagagttatgctaggaagtcataataggtctgcagtaaccaaatcatgctgtgatcatcagatcacaaatactgcaattccctgctcattgattaaaattttgaacgtgactagttaaaactagtttctcctgtcgttttctttcaacaaagtgccaaaactgtcagaatccactttgttgaggcaatagttgtaatgttcacttaacatgttataaaatagttatatccatctttcgatgagtccaatttctgtatacctttccccgtgaccttctatcattggttgttttgagtttaacgtcttctgaattctgataccatgcaccgtttcaggttttcgaaataccaacagccaaatatcagcttgcctgtcttcgaacgggaggtatgtgatctctgcgagtgaggattcccatgtgtacttctggagaaacgatgacaattctgcacagggcagaagcaaggccgttgtgtctgtcacaaattcgtatgaacacttccactgccaggatgtgactgtagctgttgctttgccatctgctggatcagcaatgacgtccagaacaaattccaggaagaccgaggagcaggatagcataccgcagcagcacactcaacctgacaaacagcaagattcctctgatttccaatgcctaagcggcaacggcctaagcactagttcaaaccacagtggtgacagaacatctgcaacttggcctgaagagttgatgacaccaagtaagcagagccctccgtccagtaccagccttcccaacggtgctggccaagcaccaagccggtcggcctggggtttagtgatcgtcacggcaggccgtggaggccagatcagagcatttcagaattttgggtttcctgttcgagtatagcagctattatcctggtgaagatgctgcctgtactctgtagtcgctgcccctgcggcagagataattttttgtgtatagctaggaggatacgtgggcaatttgcacagcggtctgggattggatctggttacttgttaccaaggtgcacaaagctccgttcttcgactaacttactacggcctgggcacacaaggtatgctgaattcatttgcccgaaactgtacatgggaatggcccataaagagcgacgggcgccgggcagtcggagtgagatctctctctttgccatccatcttttctctgttttcccccgctcaagtccgttttagcttttttatccttttctttctcttgctttctttattattatatattcttgtaagaagaaatctcagtggtacacaaatagaaaagcgaaaaaaggagttgcatagagtggtgaaattctttacactagcttcgcaggcttgcagtatttagtgttacgcgggtaaagtaattagaaagagatgaaaattttgggttctggagcttgtagtccttgctcatggacaaggctggaatagttgagttacatttctggtgtatatgttctctcgttcaatgttcaatcgtctactgctcagcattttcttttgctgtttctggcagtgtcttttatcttttgtaatcatgtacgccatatatgctttgcctgtgcgccatgtattgctctcaacttctcgtgtaggtgtgtagaccgtagctgcaagaaaacgccatccagtcatatacgccccctgcgtctcaaggagtcgcgtaccacggaccacggtacgtcggtaccagaagtcacggaactaaggtggtgtttggatgcagatacttaactttagtctctatatttaaacactactttagagtattaaatatagactacttataaaactaattacataaataaaagctaatttgcgagacaaattttttaagcctaattaatccataattagagaatgtttactgtagcatcacatagtctaatcatggattaattaggcttaatagattcgtctcgtgaattagtctaagattatggatgagttttattaatagtctatgtttaatatttataattagtgttcaaacatccgatgtgataggaacttaaaagttttaatcccatctaaacagggtctaaaaagaagccgtccctcattttcgggaagtattcacgtaataatgaatcaaaagcagcaggcatgagatgtcgaaactaatcatttctgtgaaaaatctggtagcgaagagatggttttcagagcggttgttaaattagagaacaattttgaaggatcaagatggtctgcaagaagcaaaagcactccaacacatggcagtgaaacatacatgcgacgactgggtgctccttgttttaagagtaaattgtattatcagcacataaacttagtaaattatattaatttagtatataaacttgatacttgggtgtaatataacgtatgaacttgtaaaatgttgtaaaatgttttgtttgatacacgaactttgatacatgtgaaccaagattaaaaggttatgacatggctagtttgatcagcataatgcaatcttgcaagacaagtgtaaaggaaatctccttggttgttatttaaagtccacatcgtagaagcctcgagtatttgctgcagtttcttacatgcaaaataaaggaaaagactatatgtactaacttttttttactaaatttttactaacactgatgtgttatgctacgagtgtatctagatttttcataactcccatctacctaaatcaaacggttgagataattgttagtaataacaatttagtaagaaaaaaattgtatgtgagcatcccatttttattcaaaccagcctctttgcatgcgaattgaatggccaacaaattagcatggaaaccaaacaaccatgcgtccaccgaggataatgtgctgatcaattttgactatttcgttttacttaggcgtcgatcaaacgtgaacagtggaagtatgtgacaaggacgccggtgaacagtgggagtatgtgacaaggacgccgcatagccatgtctttttttagaaggcataaaaaatcaatgaataatgcaagggtagaaagtaagaagaataatgtacttcctccttcccaaatatagaaaacctagtcatatattagacacaacataatactatgaatctagatatgggatgtgaagaacattccatccaaattcacattactatattgtgcaccaagttactgttttgggacggagggagtagaaaccaagtttacaaatataacatgtctcatgcaaatgtcataattagtgtccaacttggtaaaattaatcttgccatgccatttgccacggctcgatacactggataagttcgtgtatcaaaatgaacattttacaggttcatgtacaaaatcgtattatctaataaatttatttatcaccaatacaatttaccttcattttaaatatggcttacaccagcatttcaaaagaggctcatcccgctttaacatttttctcatcagtccctcctaccttagactgattgtaagtaacgcgagaaagatatacttatagaaaatatatatgatgctttatatagtattaaaagtaaaaaagaaaaatcaaaacatacacccttccacaatgctaatctccgtaggagacaagtttatatttggactttggaccctaaaaatgagggccactctcacggccactctcggccagcaccaggcgcaagcggtggagaaggggagacagcaacggctgaaagtacaagcgacaacaaccagtgaagcacagccgaagttatggctgactggtgttactccccacccgcctcgtctagcttctaaataaagcgtcttgcttctgctcttcctccccactcccccacccctcccccaccacaccagaccagagctgtatcaaacgcccacccctagggtttttacccctacggcctccctcccccactctcccctcctacccgagctccccgccgccgtcattgccgcatcccggggcgccgagcccccctccggcccggaatcggcgaggaatttgaacgccatgtgaagcaaaccaggcaccgtaaagagcacacgcgcatccccgcgcggacgcttgacaggaacagatcccaccggttttacggatctccgggagtcaggaccggtggcgcggaatagattttttttttggacctaaggatttggaagcctctggaaccccaaccggattcgatccgaggacatggtgatgatgatgatcaaatccgtggtttattacgggagcacctccattgggcatgtggaggtgtggcccaagggcgggacggacctggcggtggcggcgtgggcgcgggagatccgggtggaccacctgtcgccgcccagcgagcggtgcccgccgctcgccgtgctgcacgccgttgccgcgggcggtcgctgcctcgtgatggagtccaggcccacggccaccgcggatgagcccccgccgccgctcgtcgccatgcacgccgcttgcctcagggacggaaaggtacatgaattactcccaacaagaaacccacagacaaataataaaagaagggaatgaacgaacgaatggaacatttgattttacatggtcaagtttacccgaacagcaaatagttttttagcacatgaaagaactagtctatttttttccctgaaacatttattggtaatttatctctggacaagtaatttgacaacgatggtgacatgactaatgatactgactggaacctattccagaattcacttttcttcatgattattgtgtgtactggacttgattttattctatctcaattttcaataattgaactaatcgaaatacagaatctggcctgatgctgttgaatgacagaggtttcaggaacagcatttcatgtttcagaaatggagaagttttgatttttgagtgtgacacttttaatggttgttgaaacatacccaatgcagcgaagaatttgcttttcttcaatagttcttgactttggacttgacacacttgctatcaggagttcattgctgcaattgatcatgaaccgtgaactgctgaactctgcgtattgaaagacattgtttgagggatgagtgaaggttacttgaataatttgaacgcattaatctaactcatctgctagcaacttaatgtgtttcttgcttccacttgaattatttgataattacatctatattaagaaacacactattttcggcctaatatttcctttacatagttggattaaatagcatttaactgtggtcaggacagtgctataaatattcctggtattgatttcgctattttaagatttggatggatatagagtttttaatccacacatgccttttttttaacaagtatccccttttttgcatttctgttgtaccttttattttctgtactactttgtggatgttactctgatatgcaggtatgtgaacaaatgtactagatgccatgccttttacatgattgcattttgtattagtgacgaacatttctcctttttcttaatccttttcatttcctttcattctctcctgcttgcagactgctgtttttcctctaggagcagaagagatccatttagtggcaatgacttccaagagaaacttgccgaatcttgcttgtttttggggctataaggtgccatcgggcttgtataattcttgcttgagcatgttgaatcttcgttgccttggtattgtgtttgaccttgatgaaacattgcttgtcgccaataccacacggtcctttgaagacagaattgatgcacttcagagaaagttgagtaacgagattgatcctcaacatattagtggtatgtcggcagagatcaagaggtaccaagaagacaagtctatcctaaagcagtatatagaaaatgatcaggttattgatggtggcaaggtttataaagtacagactgaggttatcccacctttacctgataatcatcagcctatgacacgtccaatcataagattacaagagaaaaatattatcctgacgcgtataaatccattggtatgtatttcttcaatcaacctttttctagagtcatgtgatgccagatgtctgttgtctctacatctgttacattgattaacataaaaatgaaataccacaattcactttattttgcatcatgtgctttgattgagtttaccatcataactcaattaaatctattttgtactctaattttactaattttatttggcactgctttttaaaagaaaaatatagcaaccttttggttttggtgctgtcagttcttaatgtattacaaatcatgtaattaatgtgactcaaattgaattggcaaataagccttgcttagtggttggtactgttgagggcaagttgcattagctggtgtggcaactgaaaatttgatctcctattgcgatattttgagcgctaagcacttcccgtctattcagctttgatacaaccatgttccatgtttccatgctgttatactgcctagttgattttccctttttcttaattagataagagataccagtgttctggtacggttgaggcctgcatgggaggatcttcggagctacttaattgcaagaggtcgcaaacgttttgaggtatatgtgtgcacaatggctgagagggactatgctttggaaatgtggaggttgctcgatccagattcaagattgataaactctgttcaacttactgacagacttgtctgtgttaaatctggtaggtgttagcattactattactttcaaacaacacaactaccaaaggaatatagtgtcatttggtatattttgtacaccgcaatcaatgttttgtgttgtctaatttccttcatacaaatttccatgtgcatgaacataatgtcttggaattttccatcttttgacgttaatgctacaccactcttataggctctcgaaagtctctgctgaatgtattccatgatgggtcttgccacccagaaatggccctagtgattgatgatcgcttgaaagtttgggatgagaaagaccagtgtagggttcacgttgttcctgccttttctccatattactctccccaggcagaggtaaggtttatctgtactttacaccaacacaaatatatattttttagtattggttattgagggtaccttgtcttgaactatcaggcaaacttctctgttccagttctctgctttgctagaaatgttgcatgcaatgtcaggggtggttttttcaagtaaggatatccatctttgcctatgtgatctaagtaaattcattgccatgactcattgtagtcccagctaaatttaatatactccgttctgccacacaattttttttcttgttattgtgccatagaccaagtgtgaattattttgagatacagaaatttacgatttaattgacagagaatttgatgaggtccttctgccacggataagcgagattcactacgaggacgaaataaatgattttccgtccgctcctgatgttggcaattatttgattaccgaggtaaactttgtaaaatgcatgttcgattccctagtaactgccaacttacactcagtctcttcaataggacgagaatgctgccattttgaatgtaaacaaagatcctcttgcttttgatggtatggcagatgcagaagttgagaggagattgaaggtgttcacttctacaaaccattagttcactaccctgttcttcttggttaatattgatgtgaatagaaactgaataccaagatgtacttttcctaaattagatgctgcatattaataatatactctagttattttttaggttttgcacaatgcattttggaacaaaaaaaatacactgtttaatatttcatgtgtatttttttgttcattaggaattatgctaggcacaaaatctcatggtcaacagtattataaaattttgtttgaatatgcagttgcaatagactattggggcattagatcaatctaatgtctcattcaatactttaatatattatactgttcagcatagtgtttctctatttacatgatcttaatctgcataaatcatttatttatttgaagtgaacaagagggtgtattaagttatcctaatccttttcgttggaccagccaattgcgaatgctatagctatgcccctatgactatgttgttactccaatgggttgactggtcgtcttgtgagaaaaaaaatgctgagatcaattacaagcctatattatcatgtttcttagcaatgactactgtttttaccttttacgtatgtatatgcactattttcaggaagtgtcttgcagtgttcaagctgtgaatccaataccaactaatgctgatgtgatgcctgtggcccctaaccagcaacttattacatcatctgttccagaagcaccatcattgggcatgattcctttgaataatgatcaaggtcctcagcctccttcaagctggccggttgctcaatctgctcctgtggatccatcgcaaagttctccagctagagaagagggtgaggttcctgaatctgagttggatccggacacaaggagaaggcttctcatattacagcatggtcaagacacgagagatcctgcaccaccctgtcctgcaggatcacccgtacagacctcagtattgccagtgcaatctcatgggaattggtcacatgtagaggatgagatgaatccaagaagcctaaataggacctcaacagggttccatttagaatctgatgatataaattatgataaaaagcaaccacataatccaccgtattttcctgatgaggataatcttataacttctgatagatataaccgtcggatccatagatacccctcacaggtcagtggtcatccaccagatcgattattcaattaatatatgtttgttaatgaagtatatctggacaatctgttgacaaatgcctgatttattcagctgcctcacagtgaggatcatcatatgctgaatcgttcatctatagcctacagatcttttcctggtatgttttgttttacctctgatggttctaaagttcttctgaagattactagctgcatagggtagtgcatgatctatgtcttcccgttgagctcgctgcattaagcttaagatgttagcataagccaatctactagtctcttgtcttgcatatttctagagttgagtacttgtgtacctgtctaaatgcaacctttctgtcttagatccttaataaaattttggtttgtcatcataactaaagttatatttagtttgataatatgtttgctagtttagcatcacattttggtttgagttgattcagaagcaacaacacattatggcttacacataagtgctggattaatcttttttgagttagtttggctggcttgttatatgccatcaatcatgatttcatgggtttacttgaatccatctaactgccaagtctactgaaatttttggcccagagatgatttgccgtaattgtactttagctgcagaaatgataagttgaatttattgtagctcttgaggtcccattcaaaacacatctgaagctcatgactcattttaatattttaatatctattgtgttcatcatgtcttgtttttcccactcttcacttggtatagtgtaacgttattatgtaaaatgcttcattattcatgacaactaattgaatggttctgtgtgtttcctcgatccagttaatttctgaaattctagctcattgaaatgtcttttattacatataataatattagattggtcttattgccattaacgaagcttgtgggctgcatacatggtagttttcaagcttatacggggacatgttatcaatgggttgagaattaaaactggttaaatgactgcttcctttatttcaatcaattaaatgtgtgttgcctcttgctcgctcaatgttgcccgcccccagtatcatgaatgacccctcttaaacttcaactttaggctttcactttagagcatcttaaactttccatggataaaaaaagtatcattttaaactgtctgctgtctgctatgtgaaggagaggacatgggaaaccgatttggtccttcgaatcatagaagcagtaaaatagaaccaggacaccagtttgtacaaaacgcagagacctcagctggtgtgttggaggaaattgcagtggaatgtgggtttaaggtagtttggatgtgaaataacagtattattatcttcttcctgtattactttgctgttgatgtatttattcattcatttttaggtggagtaccaatcaactttgtgtagtactgcagagttgcaattctccattgaggtaaagtaaaaacttctgcgaattccactctcctttattaccacataaatctctattattataaaaattgaagatgtttttaccggtatttttggtacgccatccgtatttgagtcggtttttaagttcgttcgcttttggaaatacagattcgtgtttgagtcggatcttaagttcgtttgcttttgaaaatataaaaggagtcgtataagaaatctttttaaaaatactcgcatgctaacttgagatgaaagtcagactcctaattgtagcttataatcttctaaaaaaatatccaagcgaattcccacagtgaatttcatcatggctaaaccatataacaataataagattaaaatagcattcacccgttgcaacgcatgggcattttttctagttttatttaaatgatcatgttaatgggcagttatatttgttatcatgagaaattgtgaaaacttgtggacttcaggaaataaccttggcaccaggaatttctctatctctacaaagatcatgtggcttaaggcctaacttacattttcccaaattatttgaacttgttttttcccaaattatttgaacttgttttttcccaaattatttgaacttgttgcttcacgcaaattgttctaatcttcttgcagtcttataagattgcttcatgtttagtcatatctttctttgtgcatgtttcaggttaggattttaggagaaaaggtaggtgaaggaattggaaaaacaagaaaagcagcaaaacgccaagctgttaatatgtccttaagaaatctggcaggtaagttcgttgagaacttcttggtttcttgattctgcgtggcaaatgccaaatgtataactaaagtatggggccatggtgtttaatatttttgttgggtcaacagagaagtccaggttgaattttgttaagacagagaggtacacatagcacatctgacaataatgctgccaacaaattacatgatcacccaatggcgaacacagtactaaaatttagcgggtgctagttaattaaatctaccacacaagattatcatcaaagtaaatggtatttatatgttttgccatgatgccattgaaattaaaaccataacttttattagttgacttatattatcattagcacgaggagtactacttgtagacttaattggaaacaaactatgtaatattgatgtcgccaattgttgcaaatctacgaatagataaatgtaaatgcaataatagtcaatacatgaattagaaattataatgcagttgtgtataattagttgcacaaggaatcttggattaaggaattaaggcaaatgtttaacgcgtgagttgagtctgcttaagcacgaattgcttcctgcttgccaaagtcatactgctacactgtgccacgctgctccttgcccccctggcacgtctcctgctatggacagacttacagatggatttcatgggattggttcattgttggattaataggcttggttgctggaaataatggattatctaccctagcccccgttcaatggaggtgctaggggggtggggttgcaatgggtcgtgcggctgccgggtgtgtgcgaatcccctttgctgccttctgcatccgctactgagatcatctcacgagaacactctcgaggatacaagtgaaaattgcttgatcatggggttattttgttttaagcaacttctaaggtatcatggaggtctcgagatattggaaaacattgttgttctgacttggcatctctgaactattctctgctgaagttgttgaattattttctgcctttgtattatttgtatatatatctgtccttaaccaatttccatttggcctcatgattgatcttttcaaattgttatatagaaaatatagaacactataccaagagaaatcctcatgaaagctttatataagttttggtatctttcccatgtaaaatattttgagcctgattggccaatgatgttcacttgcagaaaaatttctaacgtctgatccggataagatgatgattctgaaggagaatggttttagtagtaattcaaactcattcagatattcgggaggtagtagagatgacacatcaccagttgcaagcacttcaaacgagtctagatacatgggcgagagagttgatactttaagaaaacctgctggttctgttgctgctctcaaagagcttgtaagtggctgccttaattatcagcttttagacgagtgcaatttatttactgaactatgttgtgatgcattgcagtgtacggttgagggttacaacttagttttccaagagcagccatcacgtcctcgtggttcatcaggtaaagaagcttatgctcaggttagtacttcagtgaatgaatgtccatcgaacttctatatggtacatgattaacctctaaagtaggttgtttagaaaactaaaattgcaccaactttacaacttacaggccatcaaaagatctctttgatcaatctgtatttgatgtgatatgatgccctttaacactaatacaatggaagtagtataagatgttccttttgttgtcttgtcaagagctgttatccttttagaactttttgagtttgcatgtttcgtttacctgcatttggtttttcaggtcgaaataggtggtcaaatcctgggaaaaggagttggagcaacatgggaacaagctaagctgcaggttgtaaatagataagatagatgaaatgatttactctgatcacttcaatttgttaaagtttcaaaaccaacaaataaaccctgaggtctgagtttctgccttgctatgagcagagggagagggattgtttcgtttaactaagttcgatttgtggagtaaagaatctttatactagctgtttggactcatagtaactatttaaatgttttcttttctctttgggacttataaggagggtcatttttcaatgtgtacagcaagatgctgcctttctcttgtatttgttttaggaaaaaacatacaacatgtacaacattgacaacatcaaagataatagttatttaaaacttctagtaatgataaagatactactacgttggtagatgcagcaattgcctctagaaaatattaaaagtgcacacatgttaaatgtttacagactcaacttggttcttgtgtagatgttgtctcttccactagacaactttgtatgcgcccatttgtgcattattcctgcactgcttttttacttaatattatgttcttttataggctgctgatgaggctctaggaaatttgaaatccatgcttggtatctttgcacataaatcatctggatttcaaaggtgattttaatctccacaatattagtcctctatttaatctaaattggtttgtgcacatgcaatgccaatgtttataatatttattcttttccacaggtcatcggtatcaaattttaatcgcttcaaaccagatttccagcggagtctacaaaccataccttctggttgggactctaggaacaatggtcgtgttctttgatgttcgtcttctggacatctgaacttgatgggatcaatagcatggaacctgttggcccagaagaacttcaaggactgcaagtatggacgagatggtcatggaaggagaaatcgctgtgcacatgatgcctgcatgtttcgttctgtcgttctcgatttggtgatagaattgtgttgctgtcatttccaatctagtaactcggtaactcccaacaggtgctctgtttgaagatgttgtaacctggcctccgagtgagctcacgccacacggtgctcggctgtgatttgccctgactctgttacccgtgataccccagtggagtgtggatattagaagcatgacagttggtaaaatggcttccttgcgtgcagtagattagccaattgtattgctcgaattaatttgtttcttcagatcttagatttagggtggtagcttgattggacagttttgctacgtagtggtagcttcaattccatgggggtaattcccatggctttgattccagttttacactgcttcctgctgctcttcatggccatgtttggttcatacagcaaccgggttcggctggtgttggtccaaggcttaaggaggttggctatgtatacagattggtgccatactcctgcattgggtgatgcatgatgctgaattgctgattgatgctacagagtatatacctgcattggttgaagatctttatgagaagctcgaatcttggtggctacgtgcacaatgttgtccctctttctgtttatctgtatgcttgagataagcagactttggccttctatttccgtgaggagatagaggccggagggtgtatttcttatcacctcaatcaaaaaagataattagaaaaagaaactgtgatggctcataccaagaatagtgaacttgctttgaatctttaaggtacctcgactacagtggctacaggcatcatgatttttcctctatgcagaaagcattttcgactacgaatgttaagatcggaggaaatacaaggatcatcaaacaccaacacttccgagggtgacaaactgacaagactcgcgaggagagaggcctccattcttgtaggctgtagcagacaaccttcgcctgcgttggatagcctacaaatgaaaacgatgacagaaattcatgacccacagaacatcgttttcttaaaaatggtattattctttttccgtttctgtttctagctatgtataaagtctacttttaatatttctttcaacttcgtattgcaatataaatagttaaattggtataaatgtgaaaactcccgagcgatgaatcatctttatagaagtgatattttcttttaacatttctgattgttttcatcccaggctataacctgtggccatgcttgtagcagatcacctcgcgcattgctaagtgcaacgagtctccttagcccccatcgtgttatgttgcacatgtccaagccttttggtccttccttgtgttcgccagtcagccaagaatcctatcggagttggtaaggacaatgaactggaaatgattctagcagtgaggcggtgatggagggaaggggccgacgctagagcaaagtagtcaagcttgaagaagtggttgatatacctcacgattctacttcgccaacacattccatgtttattcttaatggtgggctgggggcatcatcggagttcaatagaggtgtccggcgagtgattcttgacgagcctaatagttgagtcagtaatgcatggcgttttgatggttgttctataaaagggtggcaacggctcctccctaatcgattggggctattaaagtttgatcggtcagtttgtgaggaaaaaggataggatcacgaattattgttgatggatcgtttggcctatggttgatgaacctaaaaaggaaaaataatttatgagtaaaacttttatatctatatggggttgttcaaattgtagccaaaataaatctaattgccaaaattttggtaagttggtattattaacaaaattttggcatgatttcttatgtactgatcaaagtttggaaaaaaaaactaaatgtatgcacatctttggtaacattacccaaagaaaaggtatggtttgaaatggcataaatctgaacaactgctatgttatccctggtttaaagccaatgctaataataaactatgataaatgtaaaatttggcaaaggcttgtgtaagttaaagtaaactatacttaagtgacttaagacgatgaaaaacattacttccttcgttccaaaatataagaagttttagttggatgggacatatactaatactataaatatagacagattgcctattcagacttgtagtactatgatgtatccgatcctaccaaaatattttaagacaaagagagtatgcacttatatttagaatgccatatatctatctattatattaataaagtaataaaaaaggagtctccacgtttgctctcacagcctagaaattctcacattaatccaaaaaaaataagaaaaaataaaaacagaactcgattaggattagttaaaaactgaaaaaaggaaaaaaaaaaggcatattaagacactcgggcaatatattgaatgagattaggatcagtcgaacggacaggatatattaatcggatgaaaatatgacaagaaaaaaaagcaaacggacaaggatgcatgaaactgtcaaacgggcaaggatatgttaattggatgaaaatatgaatgacaagaagaagaaacaaacggacagatgcatgaaactgtcaaacatgaataagaaatggactctctggtcatagtgtattactgtggaaacgaacaagagtttagactccaagtcaaaataatacaatttaaaatacatgaaattcaaaataaaaactaaaaattagaagaggagtcaaggtagaaatacaatttagattattctgattttttattgaaaaaaaataaaaaaatactgttattgagacaagagttatatggaatttacttaaaaagagtttatatagaaatacaatttaggagagaaaaatatgaatctcgaagtgaaattaaaaatagttaatattgagagaagagcccatgtaaaaaaaaatttagaaacatctaagatttgaattaaatataaatattatggagaaagagttcaagtaggagaacaatttagaaatgttttaaattcagattacaaacaaatagtatgaatagaaaaagttcaagtagaaataaaattttgaatatcttaaattcagttaaaaacaaatattattgagaaaagagttcgagtacaattaggaaaaaatatggtctatttaaaaataaattttaaatatctataattagggaaaaataaagaaaattaaaaaagtgattccatgtaagaaatatgattaacaaaattcaaaatttaggattaacaattacaaaaaattaatatttttgttaggtgtccatgagttcatattgaaaataataaaactaacataaagaatccacataggaaaatcggattgaaggtaaatattatagcagaaagagttttggggaggagtgcagtttagaaatattttaaaattggattaaaaataaataatattgagggaaagaatctaggtagaaataaaatttacagatatcttaaattcagttagaaaataaatattagtgaggaaacattttatgtagaagttgatttagaactattttaaatgtgaattaaaataaataatattgatagaagagtccagttttacaattgaaggctagctcttctattagctttatattaatactatcaagtaaaaattctcacgtaaattagctaaaaaactagcttatgagattggatcttaaccctataccaatgtgacaagagttcgtaaagtccaaactgtgagcaacattaacaaaataaaatataaaaatacccagtaacatagtaatattgataacgatagtacatttttaatttaagtttataaactattatgaatatacaatacaatatgccatctttagtaggtggaagaatgtcattcgaggtagtggaaagatgcaactttatgatttcaatacatatgtaggggaataagacaaacgaatgtaccataggatttatgcatctttgatttattgtattgttatgagaatactaaaaattccatcgtgtttgttttatggacatgggaattactatattaagcatttgtcattttaaagactttttcacaatagtttggtcaagttaggtcaaatctcaaaatcatttgtcattttaattttttttcacaatagaatgtgaagtatatactccctccgtttttttaatagatgacgccgttgactttttctcacatgtttgaccattcgtcttattcaaaaaatttatgtaaatgtataagatataaatcacacttaaaatactatgagtgataaatcaactcataacaaaataaattataattatgtaaattttttgaataagacgaatggtcaaacatgtaagaaaaagtcaacggtatcatctattgaaaaacgtaggtagtatgttattgtacgtggatattttatagagatgctagccgcgcaatctacgcgggccattttactagttttgattatatgacatctgcagatttcgcctgtaaactgcgagacgaatttattaagcctaattaatccgccattagcaaatgtttattgtaataccacattgtcaaattatgatgtaattaggctcaaaagattcgtctcgcaatttacatacaaactgtgcaattggttttttcttcgttcatatttaatgcttcatacatatgtccaaacatttgatgtgacgaaatttttgaaagtttcaaggaaactaaacacagccatatctgtcaaagagcttttacgacaaaataagaagcaatcaaccctttttatctggaccgtggaacgtccatcggacggtcagtactcagtagagacaaaagtggccaaccgggggattaaacaatgtccgagggtttttaggagaaagtaccaacgctctggcccacacgtcactggtcggttgcgttcaccaaaggccattcatcagtgatctactgagccctcctccctccgccgctcgccgccgttctcgccgggttccggcgccttaccaccattcccgtcctctctcctcccggagaaatctgagaagaaatccagcgattccaggggtatccggcatggctgatcgcttcttccccaacaatatgccgggctatgccgacgaaggcgcgccgccgccaccggcggcagcggcggcggcggcgatcccctccacctactcctcctctctccaccacctcctctccctcccctaccccgacctcgccgatcgcttcctccacgcggcgcttcacctgaagcagaaggttaactcgtccaccaccgtatcgctagttcgtcacctcatgcgctgattgagtgattgatattctggtgtgctcctcgtcgatcaggtggtgcacgagacgtgggataagaggcggcgcgccgccgcggcagcgggggaggcagtgggcgacttcaccctctacaccggcgcgctcggcacggcgctcctgctcttcagggcctacctggtcaccggcgaccgcgcggacctcgccacgtgcgcggagatcgtggccgcctgcgacgccgcatccatgggggccgagtaatctgcgcgttcctcagccgcttcgtcgggcgcagcagcgttttgatttggtttggtttggtaaggtggtgactcggtggggtttgggggatttgtgcaggatcgccacgttcatctgtgggcgagctggagtctgcgccctcggtgcggtggtggccaaacacgccggagatgaagctggcgttgctcattacctgagcgcgtttaaggaggtgattaagcgtaaaatgctgctgctgatgatgcctataacgtgattgtgatgattagccttctgaactcgataaatttgtagtttgacttggatgatgctataggtgcaggttcatctcagttaaaactggaatggcaatagaaatgagcattggctattttggcttattataaactagctgggtagcccgcgcaattacgcggctagcagaaaaaaataatatttttttaagtataatcttacttaaaatttattaaagagctatctcaatgttaagactttaaaagaccaaaccttatcatcctcgtgtttctaattacatagtttttaaaatcacaccagttgctacctcttatgtcatctccttctttatttgcttgctcaatctatcactatttctatttattattcttggagcctttaaaaattggattttatagtttttagagtttattgtcacgttgggtttcgtttttataatttctagatgtcccatcaaacgttgccattatactcccgtccactatctcttctctttattgtcattgagattttaaaaatcgaacataattatagtttgggttcatttttactttctagaagtcccgccaaaccgtcagcggttttgccattatgctcctctacggctcgcccgctgcctcccttctttattgtcattaagattttaaaatcgaacatgattatcattgttttttttttactttttagaagttccgaacctttaaaaattggacttgtagttttattttttataatttttagaagtcccatcaaacgatgccactatgcccctctgcagctctcgtccgccgcctactctttattttcattgtgattctaaaaatcgaacataactattattgcaatttattttttattttctagaagttccgtcaaccgtcggaggctctgcaactatactcttatacaccccgcccactgcttctcctttttattgtcattaagattttaaaaatcgaaaataattatcaatgtggtttttttttctttttactttctagaagtctaggcaaccgctttacttgtttgcttcacatcctacctgacatccctccttttaatcgtcattaggattctatttggtgtttcattaacaatttttatataccatatcaaccaccaccaactctacttatttataggcctgttacttaatttatctcgttgtgtgttttagatggtcttttctttcaatagtctttatttttatcacaaattttagttatttataaattttattcctaattgaaatcttttttttctaatttcagaatttattttttctaaaaaaattagttaataccatattgtgttcttttaatgtttttatttcttattttcaactttagttgtttcaaaattgtatttctaattgaactctcttttaatttttctaattttggatattattatatttttattcgaaattttaattaatctcgtattgggtccttatatggattcttctttcaatattgcttatttttaattccgaatttcagctaattttaaattgtattcctacttgaactcttctttattttctttttccttaatttcggatttatttttctttttattctgaattttaattaatctcatattgggttcttatatggactgtttttttaatattccttatttttaattccgaatttcagctatttttaaattgtattcctacttggactcatgtttccttttctaattttggcttttaatttatttttatttcgaattttgattaatctcgtattgggttcttatatggaaacttctttcaatattgctaatttttaattccgaatttcagctatttttaaattgtatttctacttggactcttctttcctttttctaattttggatttgattttatttttattttgaattttgataaatctcgtattgggttcttatatgaaaacttctttcaatattgcttatttttaattccgaatttcagctatttttagattgtatttctacttggactctccttttcttttttttttctttttctccgattaatgtgagaatttctagccctcacagcgaacgtggtgcctcctttcaaagcttttttaataatataatagatagattaattatcaggacttggcttgagctcctaagaaatgaaattgctgtttctaaataagaagccacatatcaaacaacactgaaccatagaaattttactgctgttttattacagtatgcaataacaattttacgtttgatcggttgcactgttttatagaaaaaaaatgttagtcccaagtatgtctctttactcacttgaaagttcatccatctaaacaaagcaatatgttatctatggtagtatggcccatgttcatgtgaca

SEQ ID NO: 66955 - DNA, 8664 bp, Oryza sativa
tgataaccatataagacgaaactcaaaattcatggtaacttacagcatatagatctccacccgtgataatatctccaacacctgcagcataatgataataggagatgattttagagtgccttgcactgcatgctaaatgaaaaaggataacaaaaggtaacccccccccctcccccctgaagtatacaaaatactttacctagtttttctggcttaaaatgccacaaagcatctttgtcaagggcaggaactgagacaccacgcggaatgtacacatctccagatttaatagcaatagttttcagagggcgctgcaaacacgataggaaaaaggacatgacaagagttaacagacaaggagtgcaaggagcttaaaaaataaatgaaattactccacattcacaacttgaagtacctggatcccatcaaaaatgttcccaagaataccaggtcccaactcaaccgacaggggctgtgcaggcataacctttatgtgttaaaaacaagcaaaaacaagtacgcttgacagatcagtttaataaatgacaaaaaagcacctttcgtgttctcaaaacagggtcgttaaccatcagtccagcagtttcctcataaactgtgatacacaaataacaacatttctgatgttagatattgactatggtttcaacaggcatataattgctatcagaactcgtgtctgtatgctgttaaagatagaaactaaagagctgttccacaccttgaattgtagctgaatccccctcaagaccaataatttctccaataagattatcgtgcccaacacggaccagttcatacatggcagcacctcccattccatcagccacaaccacaggtccagagacctaaaacaacccattcgatcaataatgttcatcaacacaatgaaattaagagctaaacatgccatcatacaaaagaaaaagggcaattactagtgcgcatataactaggaagcagatcttagcataagatgacatctaaatattctaccagacagatacgatagcactgagttcataataggatctacgattccaacacataagtatgagaaaactcagtttagcattaacaaacactaaatctagcataaacctatctagaaatacatgagtgacgcaattcattgttgagtggcacggtcagttgaactatggcatttttggaatgatgtgtattgtttctaaatagatactccatccatcccaaaatataacaccgagtactgcgattctagacagatctcctactaggtgatgccaaatcttgtactaggttgttatattttagaacaaggggagtagcaaattcgatgaaattaagcagagagtgagagtgcacactattcgtccagggttcatcattcaatccataatccgggagaggaatagaagccagtgtatcttctagtggttcttaaattacaacaaacgaacaactttatttttacatccaaccacgctaatagcaatgccatccatcagtcaaattgtcaaaacacatctgagcaccgctctagtcacgagttcacagtaaaacctaaactattagcgatacccctgcaacaaaagatcatatcattatatgatggcgtggtacggactggcgatcagaacaccacaccacatgcgaatctcaagcagagccgcgcagcaacacggactctccgcaaaaccccacccgaccaagcgagctagccaccaatgccagactggatccgaaggccctatctagccacccgcccgcgacagatccccaaagcaatccgcgccatcaccaccaccaccccatcccatcctaaccaaatctcggcgccaattcagccccgatccgaccacgcccccgccgccacagagcccgcgccccgtcgggatcgcgcggaacgagcacggtgggatctacattggaagcaatgcgagcagaggagtatagcggagagggggggaggagggggggtgacggaccttgcggacgtagccgtactcgctctccttctcggagtcctcgaaggtggtgatgcggtcgccgaacgccatggccgccggcggcgaggacgagggcggcggcggtggtggtcgtcgtcgccgaccttcggatcggcggtggcggtgtcgcgatctggtcggggagggaaggggagggagcgatttgggcggggcgggggtgaggtggatcctgccttaaatagatgtcgtcgtgtttttttttgtttttctttttgtttcggatctgattatattttggtgctgctagtaattgggttcgtctcgagctctgattggaggacgcctcttcttttctgatacggttgcgagcgctgcgtctcgtgttggtttaggacgctgacatgtgggccggtgggtcatagaatctgtggccttttttaagtgcacagcattgtggcctttcgagatgtgaaaagacatctaagaacatctccagcagtaacccctactttagagctcctaaagatcaaatgggggctgccaccaattctttatgactctaaaaatagcattaactctagcagtagccccctatattttagcccctatttctttttctcttttattttagtataaattgtatgtttgtgtctaccttaacaccataataatttaaacataaataattctagcgcatgaaattcaaccatattgaaatttacaattttaaacaccatgattcaaatttgaattcaaattttttaacatgagaatgacatgtcctacaagaaaatattgaacacgacccatagttgacaaaaaatgcaacgaaacaaactatcgagcaccatgaagcgcccacaaatgttccataagaaaatttaatttccactatctcaaataacaaactagacaattatattcataataatcaaagcctataaaaagaagtgctacatactaaccgataactctactgatccatagcaacgacagttcagtgcagtgctactagtacaagcacagtgtttgagattcttctctaccaccgaagaagtctactactcctacagttctaaaaaatatataaaacaaatcaatatccagcacaaaaagtggtcaagtataatactactacttctctgctagtagtactcctaccacacagattagatcaatccagaaaactctagggggcaaagggcggcgagcagagggcggcgtgtgggctggcttggagtagtggccctccggcagtgcgcaggcggcggccctccatccggtgggccaatggggcagcgtgggggcgggcagccgttggctctcctgccggcgagcggatagcggcatacgggtggacagcggtagggacgatggctctgcagcgggaggaccatggctgtgcggggtggtgtgtggatagcaacgtgcagaccgacggcgggaggtcgtgcgacaccatgtggacggcggactcgtgagggcggcggccggagacccttgcggatgatgggcgacagaggtaggggaaattctcacctttttgtgccaatcttgccggaggtgcaggggaatcgatggccgccggcgctggagcccagatgagatccagcgtcgcggtgccgcgcaggaatgtgatgagagcacgaaagtgaattgtcgtttgggaccagaaaaatgtcaatgggggctgtgctcggagccccaggactaggggcttgggggtggatctgagggcctcctcattttgggggctgggtttagggtctctgctggatctagtttttttatgttaaccctcaaaatttgtttagggactgggtttaaggtccctgctggagatgctcataagagcttgtaatcttgatttacaataacagtgatactattagatgagtttttacatgtcaggttagtaagtagtagcggttttttcctgtataatattgtgtgaagcaattttttaaaataaattgaattgaatttgatatacaactctgaagttgtcatagacacatagttgtaagtattcagaatataatctgttgtgatgtccaaatgttagtttctgttccgtaaatacatttgtaattagcatacaatatgttcattaaaagtattgctaaatatgatatatataaatcttatagtttatatttccataaatataaaacatgttagggtcaaatactaaaatgtctgaagaaacctgaagcgaatctggttaaaggcaaacatgtggtttgtgcgaaggtgaagaaagtgcataggacagtcaatccccaagatgatgttctgcacggatggaagccgccagatcagggactgatgaagttgaacattgatggttcttttcaacctgatacagggaaaggcggcctgggtgtggtgctccgaaatagactaggagaagtcatctttgcagcttgtggttacatccaacggtgcacaggtgctctagaagcggaactgatggcgtgtcgggagggattacttatggctctccaatggacactgctaccgatcatcatagaaactgattggcaggagatgctgaatgtgctccagtccaaggagttggtccgatcggagttgatgtttttagtcaaggaggtgcacgacctcatgatgggaaacagggttgttagtcttgctaaggtgcataggaatcaaaaccgtattagtcatgttttagctaataaaggccgagtggaggaacttactcacttctggccagacaatagctgtaatgctatcgcacaactagtttgtgtcgatgctttgattgaataaagtgatccctgtttcctcgcaaaaaaaaaactaaaatgtcaaattttaccaatcaatatacgttctaattacaattgatgaaaaaatattcatgccttcccctatatagtatttagggagtgtctagatttattaaccgcccggaatttaaaattttccgtttgcttttcataggtatcacatctctccgctgttacctaaccccttgaacaaagcccattctttcaaagataaatggttgaacaatgaattgttctaacctaaacaggacaaactcacaattcatgcaaaattagaaaatccatgtaaaactattcaaatttgtacaaaaaaataaaaccatatatgacaacaaaaatgcagttaaatccacttttctcctttagaggggattgaatttcaggtggagatataagtttcggcagctaacgtggatttggtatttcagatttggcattaggtgcattatattccaccatgcatcttttgtacacacaactttttttattcaaactgatgctttaaattcagataacttgttgtttgttagtcaatatgctaccggcccgtttgatttagattatttatacggattatctatttgattatagggataaattaatttttttaaaaaaatgttaatatttttaaaaagaagttatgtaaataataaagaagaaaagaattttgagcaaccatatttttaaagtgtggagcaaataatctatttcaataatccgatgaataaattaagaagggcagcataaactatcaagtttattcagtcgtcgcaaattaccttgttcaaacgaacatttaaactcaaccttttagcagcgtcggagctagctcccgagctggtcgggtagtcgtccgagctccgcggttggcattttcgttatattctaacattaataccacacataaaatattattgattgctagctactccatctatttcaggttataagtcattttaactctgattaaagtcaaactaatttaagtttgacaaaatttatagactaatatagtaatatttacaatactaaattagttttatcaaatcagttatcgaatatattttcatataaatttgtcttaggttaaaaatgttactatttttttctacaaacttaaccaaacttaaagcagacttataacctaaaacggaacggcggaacgagtaatactcttcgtagttcaggcatcagagtaaatacttgcaagttcgattacctgcacaaacattcagcctaaatggtaaatgcctcagtatgaattgttttttatttttaattgagttaaagtgggtcaatggtagactctcctccatgcatcgagacctttttacctgtctcggtcgtatccatttcttccttgtgcaagatcctttgcgaacttcaatttcattagtttttccctaacttacaacagaagttcagaataatatgaatcaccactgcctttgttcatcttgcaaagccacaaaaggatcccttggtataagcaagcaccttcagttacctcatccaagaaattaaatgttctttccttgcagagaccacacacacacacacacacacacagatatatatatatatatatatatatatatatatatatatatatcccctatctgattcgtgttcatcacacatatggataaaaagcaccccggttcatctgaatttcgaagatcaaattaaaaatggggtgctcgtcgtcgaagaaggtggaggaggaggcggccgtgaagacgtgccatgaccggaggagcttcgtgaagaaggcgatcgcgcagaggaacctgctcgcctcctcccatgtcgcctacgcccactccctccgccgcgtctcgctcgccctcttctactgcctcgccgaggacgagcacctctacttcctccaggacacggcggcgtcgtcggcggcgccgtgccggcaccggccgtgctcgccggagaggaaggttcttgtcatgaactggctgagaccagacgccggcggcgtcggcggcggcgcgccggtgcacccggtggtggaggtggagcagcggtgggaggagaatgatgttgccgccgagaccgtcacggtggacgggttcttcggcgcggatcccggccagctcttccacccttcgtcgtacgctccggtgaatgccatgccggcctcgccgccgccgccgcagccgacaacgacatgggacttcgtctcttgggaccctttctcctcgctccatcacgatcaccaacaatacgtgagctatggcgttgaagatgacgaagagaggaggaggagaagcgatgacgaagatgacgagcagatgccggagctggaagaagaaagcgacgacgccgccgacgacgacgacggcgacggcgatgtcaagctgcaggcggaagcttcgccggcggctgtggagcggccgatggcggaggaggaggaggaagagaagacggtggatcgcgtgaagaacgaactgagggttgtggcgagcgaggagatcgagcagcagagcacgccggggttcaccgtgtacgtggaccggccaccggcgagcatggcggaggccatgagggacatccagggccacttcgtgaagatcgtcgacaccgccaaccacgtctccgtcctcctcgaggtcgtcccctaccagaggaaaggtacacgcacgccattacagcctcttgtagttaatctctcgcaaacaatgtcttcctcttcaggaaggtttttaagtactcgatgaacaatgtctcgcatctaaactaaatagttatagaataattctaaaaattttaacaaaatagattgatgtattacactttacaaatatacaagttaaaattcaacttttacgagttataacaaaaataacaaattaaactgcaaatatagttatatataaatagagaaatatcaagtgaaaaccatcaaataaatgaaaacctgtgaaaaccatatctaaatttttgtaaattcatgaaaaaattactagagatagggacatgcatgaattacattcataccaaatatcacaaatttcgggtgaatactgttatgttactattcacacgaaatttgtcttttttttctctcaaatgaagttgagtttggacttaagatttggtatgaatgtatttcattcctgtaccaatctctagtaattttttcatgaatttataaaacttttaaatatggtttccacgggttttacttatttgatagttttgaccgaatatgtcccctatataaatataggtatactcaatttgttatttttttataacttgtaaaagttaaatttaagcttatataagtgatatattacatataaatatattttgttatttttttaaaaaataaccatttaattaacagagaagaaatattagaatccattccttcctcttcttcttctccatcattgatcattgatgtcttgtagacagtccgaccagctgctccgagcgacggtgatgacgaggaaggcggcggcgaggtctcgccggagccattcgagctcttcaagagccacaaggagagcctcgataggctctacgagtgggagaagaggctctacgaggaagtcaaggtagagaccccgatatcttccaaactctgacgtcatcgtcttcgtgtagctccgagcttttcatttcgttttccatggcggtggtggtgaaggcaggggagcgggtgaggctgtcgtacgagaggaagtgcgcgctgctgcggagccaggaccccaatggcgccgagccgtccgccatcgagaggaccagggcccccatgagagacctcccgaccaagctcgacatctccatcacctccgtcgaccccgtctccaagcggatcgccgccgtccgcgacgacgagctcctcccccagctcgccc

SEQ ID NO: 66956 - DNA, 64164 bp, Oryza sativa
  unsure (1)..(64164): unsure at all n locations
cgaggggggtaatttgtccggtttgtatagttgagggtgaagaatgcccggttttgtggttcgggggggtaattcagacgaccgcgatagtttaggggggtaattcgtactttttcctttagaataaatgttagaggctagaagttgttatattttgggacgaagggagtattactacttagcaaagaagaagcagtaatatggtacgtatctataattctctgcatgatatggtatggtaatacaacatatatatgtccgataatgttaatattgattatatccattatagataccaagcattaagggtgttgcacctaagactaattttagaagacatgaaaattatgagcatggtaattgattaggtggctagtccgggaaaaattgaaagtgatcctggaaatgatatataaacgctatctaatcttatatgaaacttcttggttcgtatcctagcttatctctcaagttctttttgacaggggcatctagaagtataaaatacaagacctctcagaagaaattaagacatcataatctcaatatgatatggtataataatttgtatgagtcataagccgcattgaatcaacttctgaaagatcctcaagagctagctgagctaggcctcgaccatatcgtctagatctagtgtcactgacgacatatagcttagggttttcaccttataccatatactcgttcctgtactcgcctagattcatatgtccacaacatacaaacagctagttttgcaaaattaattaatttactcagattaacagttttttcttctgtttgatccacacaatattaattgtctagtgtgaccacactgcctactgcctccgatgagatcattagaggatcgagcagcagggaaatctgcagctagctcgatctgcaatatcaactggtagctatctgggagtatatcgttggcgcatatgcatcacgcatgcttatcaagccgcatgcaccgcgtgcgtgaaccaggggagaatgatcatgtctcccacctgtatgtttctctccttacatcgtgtgcaaaacttcatttaaaaaaagtactccatccgtcccaaaatataaaaacctagagtcggatgagacattttctagtgttacgaatctggacataccacatgtctagattcatacctgcggtcctgttcttttctccaacaagagttggatgaagattaagattttcgtggcacgtttttcgaactgctaaaggtacgtttcgtgcgaaaactttctatatgaaagttgctctaaaatatcatattaatctatttttcaagtttgtaataattaaaactcaatcaattatacgttaatattacgtcgttttgcgtaaaaaacttaatcttcatcttcatcttcattttcaggagaaatgaacacgagtattaccaccatttgtcaataaaagttatcgtatttgcttagcattaggtgatcaaaatctttatcacacgtaacttatcaagtctgagagaatctttccacacttttttttaagtcatgacgcgtgaaacctagctaatttattggaaggaaatctctccacaactacgtctgaaccaagtaactcttaagttgatcaagcttatctaacccataagcatgacaaactgtaacaaaatgtggctaccagccagacaactcctaaatataaatatttctagtttggttagcaaagattaatgataaggagaaccagtcacctcattaatattagtccctcctaacacttgattggctgaaaataattcgatttcatgcaatgtacttatatagtgtgtatataatttaaataatagaaatgcttgtatttgggagtggagggaggtacatagttggaaatattttgatgatatgcaatgtgcagcaagtgcagtacaaacatcacatgcaatggcattactgttcactggagagtatcctaaattccagagggggaaagatttgacagcacaaagagggtatttaagtgtgggcaggcaattactgcctaaccaatttactgttacatgcgtagtatgcatgtcgacgggaggagaggacagaggattgtggtagagctgctgctcactattatatggctgtgtgtttagatataaagtttggatctaaacttcagttatttttcatcacatcaatctgtcatacacacacaacttttcggtcacatcatttctaatttcaaccaaaatccaaactttgcgttgaactaaacacagcctatgtgtagtattcacaagtgctattcctatacctagctattactccatgtagctagctagggagcttgagtaggagtatgaagtaaggaacccacataataattaatagccgtttgtggtttttaaaattaattaatgctactaattaattgaacttgtttcagtcgtaacagtaatctccaccaaaacaatccttttattattttcaagtaaagagtgttttgatatatacatatttcccaatttcaattttgcattgtgcattctagaaattaaaacagaggtttaaagtgagaacaataatgaaaaccgtatcaacttattgggcacgaaagctcttttttctccaccgagaaaactaagtattcttcacttaaaatcgtgttctgcactgtaatttctaaatgtttttccataaactaatttatttttaataaataaataaaaatttagtggtgtagaattcgtggaatgctcagatcacttatgctacaactcgatcctaccccctcatgtcttaagcgttgaataaaagtgtttacaactttttatttaattgaacctaagacaagatttaaattcgagacatttggttctgatacctattaaatcgcctacatttatataagggttaattgaatttataccattataaatttgccatttttaataaatgtcattactatattcatcgatgtgtatccatgcctcctaaatatgtacaaaattagaacataccatcacatcatattttctgtcatcatatagaccaaaatatctctagatgtgggaccgacatgtcagttcaattttcttccttcatcgtcccctctcctctcttccccatctcgttgagctagatgcggtgggcggcgagaagggcactgatgagggaggcgaatggggaggtggcagccagcgcggtggcgcaagtgctggctccaattcacacgtagaacatctacgccgtccagctgccaacacgtggccatctcggtgcagtacagggagtgggagccagctcctgcaccgacttcacggcgacggggacaaccaccacacgaccgactccctatgtaggcaatgacggggcgatggcgtaggcatactactgctatggccggccttcccgtgtccccacgcctcacggtcaccggcgtgtggggcggcgatagcgtcagcgccgctgctgtggccggcctccccgcgtcctcacgcctcaccatcaccgacgtgtggggtggcaatggcgttagcccgctgctatggcctatggccggctagcaggagggaagggagagagggaggaggagaagaagaaattggggatgaggacggaaaatatgatggtgatgatgatcgtaatcctattctaatgacatggatataaatagataaataataatggcatttatctaaaatgacatatttagcatagattcaatttaatcctttatataattaagcaccaatgagtttaatcaaaagcttaatacgatgaactaaaagttgaagaggtaatgacagacgattcacttgctctgacgctctcgatcgatcgttctttttcttatttatttttcaaattaaagaggactacatagctagaagcaagtatgcaacagctaactaaatatcgtgcacattacgtggatcttgctttagctagggatcatatctgtagctgcgtcattaatgtatttgatacgaaattacgccgctgtcgatcgatgcgaaggagttaattaatgtgcgcgaggtacacttgtacgtttacgcatggataccgacgcccacaaaacgcctgcgaattcactaccagagcttgtgaagctgccgtgtgcctcaccctgttaccgggagtttttgctagtactcggtgacttaccgagagtagcacgttgcacccggtaacattgcaaacataccgtgtgttagcgacgaaaaaaactcgggaagacaaaaatacgctatgccatgccaaaccgctcggtaaccatgggacccaccgtttctaccgtggcttggcgcagattttttttttgcttggcgggcggtgatttccgttggcgtaggtggatggcgcgcggtgtttttttttggcacggggtgtgttttttttttacgacgcgtgaaatttccattggcggggccggggtggacggcgcgtgaaatttctttggcgcccgatgatttccgttggcgcgagcggatgacgcgccacgatttttggctgcacagtaaattttcgagtgggccagtaaaaagttggcccaaatagcaccacaaaaccctacccctgaactgctcccccttctcttctccagtctccccctccgccgccgcctcgctctcctctcatcgcctcctcacatttcccctctccgccggccttgtcgcaggcagccatcccagccatgcgaccgcgcgtccctatcctcatcccttcacacgggcggcgagcacggccctgcacgtccacgtccatccattgcgatttatacgccattgtctatccgttcaacaaggctcccaatcatcatcgagctaggcattgaggcctgctgcaactgcttcctcccaatctgtgtggtatgcgtatgttgagtggttcttgcatctttatgcaaatatggttcttgattttggaaaaatacacttcattttctctttggatctagtaatatggtgacatcctaatgggcgctatgctgcatctagatccacgacgccgtgacgtgccccatccagttggaggctgcagctggtgccgtgcatcccctttcctcccggagggacgcaacatttttcaggttgtactgatttctctatgtgcctgcaattttaatttatatgagagatgctctgagcgacacaactagcagcacaggaatgctgcggcggcagcagtcgcgaggcttgccgactggctcagggagttgatgtgagcagagcaaagagaaagaatgcacaactctggtttcttaacagcaaagaaggatgtaattcttttccacttttattttctgttgcttaatctttggttaagtgtttccccggtcgccaagtttagaaattgtggttagaaatttcttgttctttagtgcacatatgtacttcaattatcacaagtgaagttctgaattctagctcatcctatttcttagttaatactcaattattatttctctgtcatcaaaagaacacagttgagataatttgcaactaaaaaaatattattacaaaaaaaagaatagtttatttttcacccatatcagaggcttacattctagatgaaatcttaaatttcacatccatatactttggcctagtttagttcccaactttttcttcaaacttccaacttttccatcacatcgaaactttccttcacacataaacttccaacttttttcttcaaacttccaattttagtcaaacttccaatcctttgttgattgagtgcggacaatgcataatcatgtcccttgatacaaatgtcactgcttagcctactggtggctgtagaccatgcatatcctcatatcatattaggaaatctagctagcttcagttctgaaactctagaatagtaatgcaaaccaattaattacttgataactttagttctgaaactcaatatttccataataaacagtgccttggtcaagaacttgacaatgattttgagaaggttgccattagcaggaatactgaagaaatttgcaatgacaaggacttgaaaattctcaatgaatcatctgttcaacatgatgacaatgactgcaaaatcctactgttctaattcatccatagaaatatcttgtttgacgaatatttctaaggtacacacttcacttagttggagatcacaatgcaaaattgttgtaacctgcctcccaagtcccaaatgaaaatttattttgtgaactacccacaaatagtgacctctaaataatctagttgtgttgtaatcttatttggcactaaacatgtttttttataatttcaggcatataacaatcatggcaaaacactaaagagttgatctgtgatgtcaatgaacacatttggttagtcggccactagcatttgtctatatattgcctcattgggagaggttgtaagaattgagaatcatatattctactgcatcatgtgcagtgagtttgtagattcattaatattttgttattgtaccatgatgttcctattaatactgggagaatttgcagctaatgtccacatgacatgttcctgtgatgtatccttgcgctctgcttttcatgtttgcctattgctgcgtttcagtgttgtacgataatgaatttatgaaatttctagaatcacgtattcaatattacctagtgttaatagctctcggtaagttatctaacggtaccgtgtgtttgactacaacacacggtaacattttattccttcccgtgagttagtacctctcggtaacacccccgttccgtttccgcaacccatcctgtgccggacaatacattgttaccgagaaagtgctttcacccggtaatttttcttgtcataccgagtgtacaagcgtagtctcacgggaaatattgcacggtaaaggtgtcaggccgctgagtgtctgctctcgggaagctctgttcccgtgttttttcgctgtgttaccgagagcttttggcacacagtagcttccctctccctggtagtgaagttgcaatgcgtttatgcttccctattcgagctgtgtttaggctgtgtttagtttctaaaattggggagaagtttagaaaagttgatagtttggaaaaaaagttgggagtttatgtgtgtaggaaaattttggatgtgatgtgatgtgatgtaatggaaagttgggagttgggggaaagtttggtgtgaaataaacagagccttagttcacgtcaaaattgaaagtttgattgaaattggaatgatgcgatggaaaagtttgaaggttatatgttgtggacccccgtttttataacaggaatcaatcgtgtaaacagtatcatttccctagatcaagtagtctggtacgcacgaactcatagctgaaatatcaagtgcacatacacgagagtctagtacgaattattacatcataagcccgcaggcacagtcttaaatcatcggaccgagcggttcggaatacattccaaaaacagaagtaggtaaggcagcggagttaaagcagcggcacgccattgccacaggcaacgaccgtaactaagacctactgagtgccatcgtcttcatctccctcctagtagtaggcatagggatcctccgaagcttcatctcccgcttttgattaattttatatttgcaagggtgagtaccaaccgtactcagcaagacaccacagcaatgatgcacatgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccaccattgagtcgttatggttttctcaggacgtccacattcccgcctctcaggaagtggctccatcagcataaaaatcatcatgcaatatcccatcccacacaagttaaaggatttagagtctagccaagtgtaatacatgtcccggtgctcaataaccgcgagcatggctattcgaatagatttggttttactcacactgcagtggatgtacactttacccgcactccgcgactgcccaacacatgagcctcgtcccaacacatgagacgcgccacggcaaagccttttgataacctcgcattggcagtacccgctccatgaacttaaattctcatgcactctaggcgtccatgtttctagcagtgagaggagttctggcgctcccgggaaagagaagtctcacacacatattaaattatggctcaagttaagttctctctctcacacactcatggcagtcctaccaatggcgacaccgatgtagggcacgcctctcggccctacctcaacggctatcccaccgtagcgcacctgcctcactcaggggtgaaccatctatgcagggatactgcctccgctcggctatctactccgctaggtctatacccatacgagaagtacggttgtacgagggtcgtttcatgcttaacttcatggctcggtccttaattgaccggggacggtactagccttttccagataccacccaaatcctccgtccgccccagtcgaaaacagttatttagtttatttctcctttcacaaatcatgtcctcaatatcatggcaatgtggcgctcatgtctccacatgccgcatctcaattaccttcccaaagataattgcccaagcatatagcatttgacaaatatgagtatgcatgattctagaatagcatttctaagcatttttcatagttgactagggactcatacgtaaacatggttacgaaggaataaggggcaaacaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttggccttcacttggatccgcaactccctcgggctctatagttacgtgcgaaaattgatttgaattcggttagaattcaaataaaaatccaaataaatccaaatggaagtcgaacgcgtaagtcgattcttttatattaactttactattcgcgaactagggcaaacccaatttcgatttttatatcctaaactattttgcgggtataaatattttgttatcataagtttttaatttaatctacccgagcattatatccatataataggttggaaatttctatcgcaagctaaatatcggacggaatcctaaaattatcttataatattatacgatttaatttttgtctaggactaaacgactaaatataatatacgtctaaaatttctagtgattaaatccgaatttctaacgtgaatcaattacttatagagattacccaaaataatctataatagtctataagaattcatctaatcgtttagttcttaattacatttaaactactaccgcgaattgatttcctgtagaaattacctagaataatctataatttatattaaatttcttaattctacgtctataactagtctataaccaaatgctaattattttaaattttctaaacttccctaatctccctctaatttcctatctatttcccttttctttttcttcccttctttttcttttttccttcctttctttttctttttttttctttctctctctcttttcttttctttttccttctctctctcccttttcttttctttttccttctccctctccctcccggtttctctcctccttccttcgactttctctccctcggtttctccctctctctctctctctctctctcggctctctgctacccggggcggcgacggcggccgagcaagtggaggaagcggcggcttaccgacggcggtggcggcaacggcggcgacggcgacggtggcgacgtcnacgcaaggtgtggcgcggcgcggcggcttcgtggcggcggcgcggaggctctatgcgatggcgaggcggcgtggaggcggcggcgtggtggcgtggtaaaggagaggaggtgaggatgaaagggaagagtgggagtaggggggcttatataagggagggggagagagataatggggaagaggggagaggggcggtggcctcatggcgtcgacggggtggcgcggcgcagggctcgacacggcgatgtgacgaccacgcggcgcggtagggcgcagggcgcgaggagaagcaacagcgcggcagcagcgacggcacggggctcgagggcgcggcgcggcaggtgatgcaacgcgcgatgccgatggcgcggcagcggcgacgcgacggccgaacggcgatggcgcgcggcgatggaacgggtggcgcggcgcggtaacagcggcggcacggggctcgggggagcggcgcggcacggggcgcgaggcgacgacggcgacggctcggcggtagcggcggtgcgcggcgcaaggcgatggaacggcggcgcggcgacgcgacggaaacgacggcgacggcagcacggggttaggggcggccaggcgcggtgatggcgacggcgtcggcagaggggaggcggatcagcgcgcggcgcggggggcgcgagggcaacgcggcaaaggaggggctagggctaggggacctcgtcgaacactttaggtgcaatgaacagtgccgttttctaattaacccgatgttggcccatttattatttaaatttgattctttaattcccaaattttgcataaatgaagtatactcaatatttgtgccattctaatccatggattcattctagattaatttattccatgttttatatattattattgtaatttacttgaacttaattagagttaattctcattccattgcttttaaatttgatggatataaatatggtcgtaataatattttactcatttctatcctcaccaaatcttattttaaattgcactttaattatttactttgtccatttaccttttagggtttattcttaaccaattatccattattcgcgatttataaactccgaacccaaactccaataaaataatcgaataaaatcggcatgatgcaatttatttaaaaagtttttgaaaatccgcatttttagagtttagatttttgttgtcgaattttcagggtattacatatgtgtaggaaagttttgatgtgatggaaaagttgtaagtttgaagaaatattttgaactaaacacggcgtcgattcgatttcatatgcaaaacgcaacgcacgcacgctagcttagctctagctacatgtgctactatagccacacaagtacgtgccatttaattacgcgcccaattcgatcgggatcatcatttcattaagacggggagtcttgtcgtcgcgtcgtacagtgtaaactaatgagggggggctgtacgtactactgttaattcgatcgatcaatggcagggtaacttggttaattaattctccccatgtcaatttattggtgctttgcatgtacacatatcggtctcttgccctgttgcatgccaatcgttatcattgttacacttaatgtatctctgaagaatcatcggttcatctaggacagtcctagggcaagccactgtgggtgggtttataagatcatgtggttaccacatggttatcgtggttatctcgtgcggtaatcttttcggtttttgaaatcttacagttttttaagttaagttcatggatttgacggtaactatgcggttactgcgttaaccgtgatacaaccgggtagaaggtaaccctcaccaaaagggtaagaaattaaatacatattgtctataagcatcattctattcgagattcgaccaactcaaactattgtatgtgtccaaatatacttctcaactccaaaattgagtattgagtacctctcgccggttccaaatcaagatagttaaaaccctatatggtgcttgtgtggtggtagttcagtcatccaaaaaccacccccaaatatcgggaaattattctaatccctcgaggggatattccctcgtttccttaaaaaccatttaaacggttataaaaaattctggaaaaatttgacaacattcatatatacaactacacaaaatcttaagttcaaactcaactcacacatcgagatataaaaaagagaaattcagcgtatgaatagtagcgtactgtttatatctaaatttatctttttttgtttctcgatgtgtaggtcgaatttgaacttgaattttggtggagtagtaggtatcattatactccacattatcaatttttttcagaatttttcactactatttgcatcgaatttggaagaaaaaggtatacgaggggatatcccctcgagggattagaatccattcccctaaatatctcccccccccccctaccaaaaaaaaataccgaattaattctaaaatcaagttctaaataccctcacaagtcaagttctaaaatttaaaattaattgattatggtttataagccaaaacacaaatgggcaagacaagtagttattactataagcttactgctacatggcatatataactcccagtattcaatatctgctgatgtcctggaattaattgcacaatcacataggcaaaagagctggtgttggcacatgattaatattattttatacacacaaaatataatattttttccatgtaattatttcaaagcctagttttgcataaaatggcacataaaatcggacattttccataaatttagcaaatgtttttttctaaaaagttatatattcctatgcgcatggcacagattaacaccacacgacatatgtccggttgatcccagtcactgtggcagtctgccagcaggaaataacttattacaatgtggttttactctgcccaatcataagtaaataaggcagcacccgtacaaaaatttgcacgaatcccgacatcgatcgatcgaatcgagactggagaaatcatcagaaatgtaatgcggcaaaagtgaaaagccgtacgttgatatctcgagtctgaattattaattgaccaacggtattgcttctggatagagaggccaaatcaattctcttgcagttctcctcagctagctatcgtcgtcgatcgatctacaccacgattcatctgctagctagccgcagctcaaatcttgtttaaagctgctctcttcagtcttcactgctactgccacacacgcattattccggtccatattgatcatatgcattcatcagtttgcagatttgcagttgcgcagaattgaatcaattttaatcaattcatctggatcatcgcagcagctgggagagctatgggtgtatttagttcgcgaaaagaaaatttttcggtgtcacatcgatcaaacgtttgaccggatgtcgaaaggagttttcggacacgaatgaaaaaactaattttataacttgcctgaaaaccgcgagacgaatttattaagcctaattaatccgttattagcatatgtacttatggctaattatgaactaattagattcaaaagattcgtctcgcgatttccatgtaaactgtgcaattaatttttttatcaatatttaatgctccacgcatatgtccaaagatttgatatgacgtgtttgggcaaatttttttttttggaactaacaaggcctatatgagctaggctgcatacaaatgttcatcgtcagaactgttcagagattaattcagagcttactcgagtccaaattggcgattgatatcgatcgattgacttgtagatatataaatattaatttcctccgtttagaaatatagcaacttaattactgatcaattagacacaatctattactacgaattcgatcggacagtggtgatagcccttttgcagatttgcagtggcagatcgaattaaatcaatttaatcaattgcagcagctgggaagctatactactccagctatgtatatagagccaatcgcttagctatgtatataggctgcatatgttcatcgtcagaactgttcagagattaattcagagtttactcgagtcgaaattgacgatcgatccacaacttgtagatataaatatattgctagatgaacagtggctgtagcccttttcaaaggcaatcatctttttgctgatcgaaaaaagaaaacagttacacatatattgtagcatgtgtaggcatggtaccatggatatggcccaatgctgatgtgacatatatatatatggtgtcagggtgttttacacatgcatggtcgtttgcttgtttggatcgaaggtttcagttactactgctatacatgaaaaagaagtcaatactgtagcaaatggatgcatgcatctgcattctagctaggtgatagacagaagagttcttcttcagaacctgcatggaatagcctgctccatgagcaatttttttctgactctccttatttgctttatggctaataaaccatgaaaaaaatgaatggataaataaaaataattcatagttaattaaaactgttatatttttgttcctataagtttaaaagctaatgctagaaaataaattacgatgaaaaaccttaaagtaaactctgaaactaagttttaaaattcaaattttgattgcgtcagataaaccaacaagcaaatgatggagcattttgtttttgaatgctataagtaaattgaggttgtgtttttctcccaatgggttgggagaaaagatatctcattctcaacacgcatgccttctgaactaaagtaaattgaggttgtgtttttctcccaatgggttgggagaaaagatatctcattctcaacacgcacgccttctgaactatttgacagtacgttggttgcaaaaaattctctataggaaagttgctttaaaaattatattaatatatttttaagtttaaaataataaatagtcaactaattatgtactaatagctcacttggttttacgtatcttatcaatcttcttttcccccttctctcacagcctcatcggttgcccatattatctaatataagttgtttattagggaataaaaaataatatataggtaaaacttttgtatatgtgttcttagcgacttaaaagccaatataaaaaaactgcgtcaaaattgtcttaaaattaacttcaaatttaagtttaaaattttaaattttgactttatctttgattaataattaggtcaacagtcgaaacccctcaattctccaacacaattaggtcaacagacgaaacccctcaattctccaacacaacctgagactattgggctttatttccattatgtgacagagccaactgaaaggcccaaaaccaacagcttggcccattttcaagacagcccaacaggcctctcgcaatttccgttgaaagtagtagtaacgttcgttttcgcatcttcttttttcttaacacagtttttttttctttttttttaaaaaaaaacatgctcttgttggtgaattgaatcggttgtctctgctgcagggtgtaactcaggtaggatagtaaagccttttcaagttggctattcttttaggtttgaagtttctgttttcctttgctgcaaaaaaataaatacaaaagtctacaatggctcacagctggtcagaaaattagaccaacataatgaaaacgcatgacctgttctgatcaacagcagcacatagaaatattcttcttcttcttaattttccagccaaaaaataacctaaataataccctggaatcaatctacatacgtgcaagcactttgctgctttcaaaaaaatattataattttctttatgtacgtatgggttagctgcggcaaaccttgaatcagtacttcaacagattttttttttttgaaaattttattatatatgaaattgacgtgaaacaattcaaactctggaacaattttttttccctctttgtttcgccagcgcctataaatttgagcgacaaatcccatcgtttctcctcaattccctccaatttttcccccaccggagttcaccgccggtttccgtttcctccccggcggcggcggcggcggctaggatcgatggccggcggggtgtcgtccgtggaggtcgtgaaggacggcgccactgggctggagaagctcgtcctgcgcgaggcccatggctgctccgtccaggtcgaccccctctcctcaaccctagctttcagttgcagtatttctagcactggatcgatctgttcgtcgccaatcctccacaaaattatttgtaattgagatgtaattagttagggggaattggtgggaattaatggagttgattctggtggtggagaaaatgtttgagtattactgtagtttagtttgttgcgatcatgcgagggaaggtagcaggtttggtcaaatgcccaattggtgtttgacctttggcttgtctgtggaggtggatgttcatatctacgcttaatttagtatcatttgatttcattctttaagatgtggataaattgtttattgggggtggacaccatgatgctattgttagctgtggttttgattggccttttgccattattttaagtattctcggcaacggtatgtctcatctgttttagacccaatcatttggacatgtttgttgtaaatattgctctaatgaataaggcaagttgcctttcgttcaaacaaaaatcacttggacatgtttgcacattgctcatgctttgtttttttatgacctttttgttgttgttgttgttgttgtttcagttatattagataaccttacaggttccttattatctttttttttcctcagaaatggtcaagtacgttatttttcactattttcaggtatttctgtacggaggccaagtgatcttttgggaaaatgaatatcgagaacaactgctctttgttagtagaaaggtattcagatcttttaatgttcagtaagggcattatttctgccttgcaggcctatatatcgaatgcatttttacatttatgcactctacagatttggcagcaaggcttccttttcttagataagtggttgttttaccattcttttttttggtcgtttttagtttttcaggaaaatgagatatgttatgagtgtcaaacgttttatcttccaattacatgaattgacacttaagccatttacaattacccaataattccacattttttaaatttcttggcaggcttatttcaaaccaccaaaggctattcgtgggggcatacaaatttgctttcctcaagtatgaccctgggactgttcattcatagtccagttatgtttttcaagaattttgtctcccctgtaatacccaaaatggacgatccatcatgcagtttgggaaccatggagttcttgaacaacatggatttgcaaggaaccgattatggagtgttgatgaaactccccctccttttccagctaccacttcaaactgtcatattgacttgatactcaagcagtccccagaagatttgaagatctggccgcataggtgtcctctagtaaatccttaacattatttgctatggcattggtagattagaatgttccatttttgaattgatatatcctttggctcctgctaaattgatgaagttgattatccatatatttcagttttgagtttaggctgcgagttgctcttagccctacaggagatctgatgctcacatctcgaataaaaaataccaatgcagatgggaagccattcaaatttggattttcatataacacatatttttcagtctctgacatcaggtacattttgtcgtggtaatttgcttgtattatgtttatatgtaaaattaggcatttcttacattctttgactgaggcatatagctcataggatatgcacttctatactaagtcgtgctgatttttgttgacaaaagttatgttcggacctcttttggattttatcactccaaatattattcaaatgtacagaatgaatgatgtactatatgggtacttggcttctacattgtatttttcctccataaaaattgttttcacattccagtgaagtacgggttgagggtttggagaccttggactacattgacaacctgcaatgtggaaaacgttgtactgaacaaggagatgccgttgtattcgaatctgaagtaagcttcataattcatttgcaagtttcatattttgcagccattgcagtaagattgtgtttcttgttaatgctttgattgctaaggcggagaaggtatatttgagtgctccacccaagattgtgatcattgaccatgacaagaagagaacttttgagttaaggaaagagggacttcctgatgttggtaagatgctaatttctggattacacagcacggttgttctggtccttttgttttgcttacttttatgtgtgtgtgtgtgtgtgtgtgtgtatttgccgggtcaacaaagaagccacccacaaggggccttctgtatatatatgtctcgtcagtatacttttttttatgcagttgtttggaacccatgggacaggaaagcaaaaacgatactggattttggggaggaagagtacaaatgcatgctatgtgtaggggctgcaaatgctgagaagccaattacattaaggcctggtgaagagtggcaaggaaggcaagagatatctgttgttccatccagttacagcagcggacaatgggatcctgaaataattcatcggatacaggacatctgaatttctcagggattgcattccgtcattttcgcgcaagtattatggacttcccttagatctttttttttatatgtgtaaaagaaataagtgcataagtaatactgtttgctacttacactgaaacatcaagttttgctgcaggaagactcaccaaacagtcacagttggtagtactcttcaataaatttatctgaatgtctgtctgctccattccaaaatcaaaagcatatgctgtggttttcctggaggagtcaaagtcaccatcgtgtttttatagaaaagatggagaatttcaggttcaatatagatatgtaatcctgtactggatggtttactgtattacaaaaagtccaatttgacactgtgggaaagaaatgtacagaatgatgattttcgttgttttacactactacctaagaggctaaatcaccagaagatcatttagctctcatcaagagctgctcttaattctgacgtgcaaattcaagttgttataaagtggagagacaggaaatcgagagcttgaaagcttgatttttttttcaagattttgaaatatgcagtctgctcaaactaatctctctcctttccattggtaatttacaagtcacaacctggtatttttggtagaaactcactgcagattcagaaggcatcaagaatgcctggcctgttgctcccatcgctatctgaataacctgtaagtgaacagtcttatctgtatatttcctagattaaaaaagaagtcaaattacttttagtcattgtccactaagttgagttcgacctcgaaatattttctgcatctctcactgggctcaatctagtgctggctgctgggccgtcgacacagctaagcctgatctttcctttggttaaatgggcttttgattttcaaaaacattgcaaatatgtactccctcagtccaaaaaaaaccccaacctaattaaggatgggatataatctattacgatgaatctaaataattactaggttgggttttttatttggacgaatggagtacaattgtgtaacccctctcatcattgatggtccatctctttaccttcgatgattcttcatttcatctcttttgccttttgttttaatctaaaaaaagatggccagcttgccctggcgcgttattaccttacctttgccaaagaggaataaagcgagctccgcgtgaatgatgcaaacgcagctttcatcttccccagcatagcccaaactggaatagtgtgcatctggataagatttaacccctctgtttcgaaatataagcagttctatcgtttaaaatttatactcaaatataagcatttcttgtgctacatattcttattactactactcatctcatcaaccaacttctgtttattttttctccatcttactcataaccatatgttgtttaattgtatgaaaatatttttcttgtgattttaacatctgctaaacatgttagaaatgcttgtaccataaccatctcttatttaatgagatgtatcaaaatattttctttctgattttaatctctgctaaataatctaaaaatgcttatatctcaaaaccgggggggggggggggggtctaaagtgctagcaggataatgcagcctgcaggacctgacgccgatctgctaataatgacaatgtgtgtgcaaacaccgggagcaggtgtaaatagcacttgcaaactcgtctaagtaaacactgtcatgataggataattatatattaaacatgtgtattatatgacataatcttgatctaccattgttacttttcactagatggcaactgttgtagttggtgatcagtaatgtcgtacgtcaggtgtggtcggatgtaatgcatcatggatgatcaaatcgaattaatgcgcgattatattagttaacgcaacctaactcccaatctaacctgcagctactgctaggctagctagtagttcgcttgatcgcttgatcgaggcagatgagctgcatttctgagccaggtggattacccgacttaaacctatttgagacctaaatgtatgttctgagaagcagttaagtacttaagtatccagttaatcagaatctataagctgagtcgatggctactaaattatttttctcttatgtactccaactgtcctataatataaaggattttggagaaatatatatgttatttaaatttggggtgtgtttagtttatgccaaaattgaaagtttggttgaaattggaacgatgccaaaattgaaagtttggttgaaattggaacgatgtgacggaaaagttgaaagtttgtgtgtgtaggaaagttttgatgtgatggaaaagttgaaagtttgaaactaaactcggccttgtagtattatgatgcctcacatccctctaaaattacttatattttgggacatatgaagtagttactaagtgtccaaatcgaaacaaaatttatatcttttaaaggagctagcgatttttaagtagctatagttgtcaaaagtacccaagtactcctactacctccgttcgtaatttttaacgttttgaataatgacaccatctctaaaatatatctataactatagctttttattacaaaatatatacaataaataaatacaattttaattttatcatagtatactttgtgagataaatctatatatttatattttgccttttaagctagataatttataatagtttagccttaattttatctaaaacgctaagaattatagaacaggaaggaacaggtcctaaagctattacgcatgcgaccaactggcctgcatgcaggaggctttctatcgatctatcggccggggacctagcatatgcagttgcgaaacactcaagctaggaataatctggctagatatatagatcgatcgagttgcttgcagaagcagacagatagaaaaggagatcgatcgagagctcatttgtgattgcccgagaaatgccagggattcctgactgctcaacaaggtgacgatgggcttagttggctgagttcgaagtctagcctcttctatttatttaatattaggttacttcctaatattcgcgttatgtttttttcatttgtgattgtccatttgcccttacatatcaaagagaagaagacaagatactatctttaattataataaagcgatttttatatgtgtatctgtacttattaggagattagtttttattaattgatcgcttttacaagtgcaacataatttgtaccgtagctgttttgttgattttttttttgttgcgatgacaagtgcaagcacttgcgctagtggagctgttgggggtcaagtagtgcatgagaaacttatcccgtagggaactgaaaagctgagttcttatctttactttctcaccccacatctcttgttttccacacgcactcttttcaaactactaaacggtgtattttttaaaaaaaattatataaaagttactctaaaaatcttattaattcatttttttaatttattttagttaatacttaattaatcatgcactaaactgcttcgtaaccctgctgcttcgtaaccctcgcttccaaacacaccccaagatttgttaaatataacgttcatccgtacgtcatgtcgcaggtaacttagcttttcttcttcttttttttacaagaatgtaatcaagggtatttttgtttgagcttaagtttacaagtgacgataattttgaattttaactatgacttaattttaagattaatttatggcttttaatcatctctttttatgagttagcttttttccgatgacatggtagacacgtacatacaacactacacatgcacgtaataacgtactcacaccttcataaatacacccttaattaacctacactcaagggaaaccaactgattgtatgactgctaaggcactgtttgattctacttaccagctgcctatctagctcctagtttttttagcacgcttttattttttaaaaatattttctatgtaaaactttttaaaattaaataaatttactttttaagtttacgatagccttaatcaagctactgattggtctctttaaacatgcggatgatatcctcagccaagaagctgaagtcttgaagactttaaaattgccttcggcttataatccgcttcccaaaaattgcacaaacaagcaggcttaatctaccatcaaaggtatatactactccgcccatttcaaaatgtacgacgtctcgcataatgtttaatcattcgtcttactaaaaaaattgtaaatatcatttattttgttgtgacttgttttatcacaaataaaataaattataattttaacttatgtttttacatatctatattaaatttttaaataaaataaatgataaaacattatacgaaaagttaacggaaatatatattattttggaaaagaggttgtatgtactggtccctctcacccgaaactcactcctcacacatgggttgtgtttagttcccttcaaacttttaactttttcgtcacatcaaatatttggacacatgcatagagtattaaatgtggataaaaaaccaattgcacagtttgcatgtaaattgcgagatgaattttttgagcctaattacactatgatttgacaatgtgatgctacagtaaacaattgctaatgacggattaattagacttaatagattcgtctcgcagtttacaggcgaaatatgtaatttattttattattaatctatatttaatacatttgtaatgtgtatatataaaatttttttttaccaaaacaactaaacacggccatgttctacgttcgttcgatcttcccctaaaggcttatcaaagtcggccgctttcggccacaaaacgcgtgatggtaccgagaatctcgaccgttccggcagtgtatatcctttgtcacctagatatccaaaaaaattgtaaagtgttttaacaatgtagtacaggttaagatcgatcttatctatatcacttcacaaaataaaatacttaattcagtttatacggagaaacataagagaaccaaaacaaaataaacatcttgcatatttataaaagtgaaaaaataatataacttttttttagaaaaatgacagtttggatgccatgcacaaataactaaataagagtacgtgtgttcacgttagttgatgatggtttgaacatgaatatgtagaccattttttaaagaaaaatgttgataatagtttggaactttggatagcacacgcacgaaatgagagcatgtgcactggcactgcgtgcaggaggatggctgcttgaacctggaaatactcttttttttttttgagctatcgccttcgggcgctttcgttctagcttgttacaataaatgtaaaaattgagcattgaaacaaatagtttaagcgctcagttataaatatttaatatttaatatgatatttggttaaacttgaagaattccaatcattaataattcaagtgcttagttttaataaaatgctatcagtatattttgctcaaaaagtactattattatagttgctaaaaagtactatcgtaaagttacagatttcattactctattacaaaatcaattgttttaagagttgtaaaagttcgatacattctttctcctaaataataaatactatgagggagattgtcgacgtttgatgtcacgattccggtatttacatagtatggggatcgttgataccatggtatatgcgagattgaggtaaaagagatggagatgggaatttttatacatgttcgggctcctgaattgtcaggtaataaccctactcctgttgaccgaagccagtcgttactcttattcaccataatcacaccaatacaatatttggggtagcctatctaacatttgtcgacatggtggcttgaagtatcatcacgtagtcgacaacagggtagccttcctcctcaaatccgtgtccagcgagatcaaagacagcgctatgtctctcctgacagtatctatagacatagtaggggactagccatgcttatctttgaagttgatatccggcggcgtgtcttggcgtatgttggcttgttgttgatcttgtgtcttggtctattgttccatgtcccctctcctcctagggggccttgtatttatacccatagatgtctccttgtctaaatagaactagagaaaccaatatggatataatccaagtagtccttgtcgtttccacgtagaactctaatcattcttccttatgcggaactcctcctgtattcgaagtttgtttccgtataagacatggtatgtaagtgggtcctgccgagatttagtcgactactattaagtatgtggtattcataaccctgacagagatcaatatacaatatagacagataacaaaacaaacataatcccatatatgtcattattatctccaccccacacttcgctagcttcatatatgccttattagagcacctctcaccattgttttttttaccaacgtgtctgtacatatataacatattttttatgaacttgataatagctataactttacatgtacaagataaattaccttaggccatacacaatgcaccaaggtgcaaagcaacctcggacttccacatcagttcgcgtacgccagcaaggccgagattgtcccccgtgatggcacttgtgccttgcagagggcatgggtgactagttgtggtgcactgcaacccccgtaccactatcttgttgtgcgtcctcgtgtagtcgtgtctggtcctcacaagaagaaggtgccgtgagagaggagagagggagagggatgaacaatatggtatagattgggggaaggggtgattttataatagttttagtttccttattggcgtttagggtaaaatttgagtttatatgtcaattgaaagaatatgtgaacgaaaatttaaaatattagggacggacttgtaaaattaaagccacacttaagtcattttgcactacaatattagggggtatagtcttagttcacgtggtgctctctctcttttaaatcactcctaaggccttgttcgatttggatggggttgaagaggattggaagggattgagagagaatgatttcacaccatgtggaataaatcccctctaatccctttctaaaggggattaattgaataaggcctaagactaagactaagagtgtgttgcaacatgaatgtcttaggctacattcatttctgcataacaggaagtgctatttctttacttaaggtgagcgcacgcacgagtgctttccaaacttaattattataaacttaaaaaataaattcacttaatatttttaaacttctatatagaaaatttttacgctgagacatatgtttcagcttggaaaatgtaggccgtgtttagttcctcctccaaattttttttaacgtatacggacacacatttgaagaactaaacatagattaataacaaaacaaattatagattccgcatgtaaagtgcgagacgaatttattaagcctaattaattcgtcattaccaaatgtttactgtagcaccacattgttaaattatggcgtaattaggctcaaaagattcgcctcgcaatttacatacaatctatgtaattatttttttcgtctatatttaatgctccatacatgtgtccaaataaatatttgatgtgatggaattttttaaagtttgaaggagctagatacagccgtactcaccaaagagtgagtagttcatgttccattcgaaggaaacttgcctgaaattgctccgggtcgtctcggagaccgagatcatggacgccaggtcaggtcggttagctagccgcacaaatgcgatcctctgccctgacgacctatctatccctgggccactcatgcatgttctactttggtcaagtcatcgatcaatacctttgcaaaaacataggcatacatagcgaatgaagcagcgcggaaatttctggcgaaaatagcgaattaatatactccctccgttcgaaatgtcgatgccgttcatttttttaagcatatgttcccgttcgtcttattaaaaaaaattaggtaactattaattcttttcctatcatttgattcattgttaagtatattttcatgtaggcatataattttatatatttcacaaaagtttttgaataaaacgaacggtcaaacatgtgctaaaaagtcaatagtgttaaacatttcgaaacggagggagtactatatattgcagtgatcctgtgcttcataagacaaattttgtatatgtagacatgtagtattgcataagacaaaatgtgtacatagatatactctcaaatatgctttgagtgctcaaaggggtggattgatcgtcacgacggcagaaaagctaggtcgttacatttgtcgcaaggttcgtctacgacatcagacaaaagtgatagtatatctttaatttgtgatcgatctgcttaggcaagcttatatgcatggttgcaataatctgccgcccaaccgatgatgaacgtaaccgctctagcttagctgcgtcattctactcttttactgatctgtatacatatcaaacttaatttcgaacattaatatcgtgcccgtgcatgcatcgatatcttaattaatccgtgtgaatgaatgatttagcgacgacattgtgatggatctagttgcaattatgctcgatcgagcaactagatcaacgagtaaaaagtagcaaaggacggcgacacggcgtacacacatgcatgacatccaattgtgttccaagtttccaacaatttttttttgcaaatataaaaaacgaaaaattgtgcttaaaatactgtagataataaagttagtcacaaataaaataaataataatttaaaaaatttgaataagacgaatggtcaaacgttataagcaaaaacttaaaatcccttatattatgggacggagtaagtaattagtagtagtactgcatatgaaaagtcggattaattagcatgagtactaacgacctagtcaattaagctactgcatatgaacagtgggattaattagcatatatccagttgcaaaagcatgcgaacagcagatcgatcgagctctacgacaccctgcctgccaaatcatcgatatatacaggtcgggacgaggatatagatatccatctcctccaagatcctagctagtcagtatatgtcagtatctgatgttgctgctgttaggagagattctttcgttggtcgtacgtgactctttagtacattctattactactaattaagatcccgtctacaactccccctctctccctctctccctctcgtgtatttacaccccagtgtgtagtactccctccatattttttttatgttggttagctcaaaattaaactaatcaacgtcgtatatttgtgtaagaaggtaatagtattcattcaattcatatatatcaatacgtgaagtgaatataatcacgccgttattaactagttgagccctactcgagctctagacttagaaaacttgcactgcacaaattaaaaaccataacggatatgtagcgcaaaaaaccgtatacttaacagttaacaccgttcttttcttctctctctataagagcaggtacaatagcagactataagccagctataaacatattttaaggagaaaaaggaagagaaagaagaacagtgggctatagatctgtagtcagctgcagcacggactccaagacataatgtgcgtatgtcaggtaggaccaggtattaatagtatagtaagtaactattgtatgaattagctattacattggctatagatgatttggatatagctgatttggagctagcagttggctatattgttaaacttgctctaaaagagcagagcgatagcacaaggtgagagcaggcaggcagcgatgcaaatgcgcaaaagctagctaccgacatacttataaagcagagaggcgctcgatcgcttccttgttcaccgccggaagcaagcgttttgtgtctccactctctccagtaagcccctttaatttggacggatggagctagcagagcgtgtagccgtagagatcatctcatatatgtagccaaattaaagagggcggcgtgaaaaaacggtagctggtggcctagttgagcggcaagagatcgatcgatcgagagtagcaaggatcggagaagctagcttagcagcggcgcgcggcgagaggaccggcggatcgagcgagcgagctaggaagctctcagccgaccggcgatcgaatcgtgcttgattgtttggggttgtgagctggttttcactctgtacgccgctcgccgtcgtcgtctcggggcgcgcgcacggcggatcgatcacctacccgaggtacgtacgtatatgcgtttctctcgtccatttgcacatgcgcccgatcgcgtgagctcctttcgcggagaggaatcgtacgtgccttcgacgcttacatgaattccttttcttatgcgtaattgtgcggctagcatccatataatatataatctatatatatataattttacttgaaattattaaatatagctatattattatcttatgaatttgaatgaccaaatcttaccatgcccatgtttcttttttttttagagttctaagctctttctaatagagtagtatttttttcggggagggatagagtttgtatagccaccagcctcctccacatacagaatcctttaaattccctacaacccacccctttttttgagaaaaaaaaattcttatatgtgatggtttcttctgcaatattttcttaacgcacctcttaacttgttgcgccatatccatttatttttatactttggcatcgcttcatccatatacatacccaatatcactaatctcccctactgttgcatcctctctcccttacttgaaatattatcgtactcaatctctttggggccaccataaacataaaaaacaacagctaatgatgtgaagtggggaatgctcggagatgaagaggataaagtgggggaagtaggggaaggagacatttgattcatttggtttggcagatctttaggtttgaacatatgccaaccaaatttgttagaagaaaaaaatgaatgtttcggatcggtttttttggcttttgtaataaacagatcgaatgtggattaccgattgatgcaatggtcgaatggtaggagccttactaacgagagtcacaactcaggagattacagtgactaactagacgacgatgatgcttctaaaattgatggcttgtggctggtgtgggatgtgacgtgccttgtgaacttaatgtataggtctggacatgaattagtgaggctaaggtggaattacaattaagtacggtattttccgggtttcaatatccttcgcctacaaaccaaactaactagtcaacaatttagcattgagatttagtaaaaaaaaaaaagaaaaacccgacacaacgctttagttgacaggttttcaagaaatttccgcccccctattcttatagaactagaatgtaaatatgatagagacaaaaagacaaagtaaaaaaaaaaagaaacggaaaacacccacagtcccagccacagcacatttttggtagcttgtcttttggctagttggcctggctctggccgatcgagaggatcaggaaaacaatcggacttgaaaacaaaaaccagctacagccgacagggtcgtcgctccgttccaccgttggttcgcaaccgaaccaacgcgtgcccgcacgacgccgtgcgccccagatacaaagtcgccaacgcgcaatttatttagcccagcccagccaagaccgtcgcgcgtgccacgcacccagcacgtacgcgtgacggagacaccgagccaatcgcgccggttcgatcgagcagttgggctcgttaggtcaggtcaggtcacccccgcgtcgtccgaccgcgacaccattcatcacacaagtcacggtctcgaactcgactcggccgcgacgtcgacgacgagttcaccactagcccaccaccaccacgactacactctcccggctccgagacccgccggaaaatcccccgggaacttcggcgcgattcctctccgagttaaagcaaaaaaaagcggaagccgaagcgcccccgcctccgcgtcgtctgcgtgaagcactccccctcttcaagcgggaaaagcgggggagggaagcaacgcggaaattaaagagcagagcagagcagagccctgagccctcgattcgcttcgtttcctacggcggacgcccattcctcccccaccccctccccccactccgactccgccgccgccgccgccgccgccgcctccggctccggctacagctcgccgccccccaggttgctctggatttttgcgcgtgtcgctgttggttttggggggcgaggggtcgggggatgggttgggatttgtgcttgttttttttttttgtgcgtgtgtttatgctgttgctgatgagggtggtgtgggaatgtgcgtgcagatcgggggcggccgccgcctggtggtgtccgtgtcatctctcctgaggaatcatgccggtgggagtgcaggcgcccgaggcgtcgccgggaaggtaccatcggcggcgggacgacgacgatggcaacggcaacgactgcagcgacgtgctcggcgtcgacgtgctggacgagggggccgaccccttcgacatccccgccaagcgcgcctccgtcgagcggcttcgccggtggagggtgagtatgagttcctccccttctctccgctaactgctacattctactgctcatgcttccatgtgcaatgctgtttaattccgtgcgggatttacctttggctgccacttgcgcttttaagtttttagttatactccctccgtttcgtaacataagtcattctaatattgtccacattcatataggtattaataaatctagacatatataatgtctagattcattagcatctatattcatgtgggcaatgatagaatgacttacattatgaaacggaggaagtattgaactattattatgatcctgtatacctttttcctattttgtggctcctgtaaaactcaatcgtggaactgtggttctctaaagcttccgaatgatctgaggattgccaattttactctaggaaacaatactacgaagtaagaaccgaatgttgctggtgttagtattttgctctgttgctaccacctagaatctaatgagatgaacactgactgtgaatatgaatggtcggttcttagttctcttcaggtactgtgaaatgttaaactatgttagtgaataggtatgcatgtataggctcattcatgacccttggctacatatgcaactgttgcgggctgagacattgtaatgaacctatccctcatgtacagagacattgtaatgaacctcgtacacagatgggaaaacaaatgtcctagttttaatgttttgaagacctattgatcatttttttaggtggatcctattgaacttgtaaaatcgttagaactgaatttacaagttaaacaatctcgtgaaaattattttaactagcaatgcatatacaatcttgactaatgttgtatcctgctcattatttttacacaatacaactatgttttccattggcagcaagctgctcttgtgctcaatgcctctcggcgattcagatatactcttgatctgaagaaagaggaggaaaaggaacaaataaggaggaaaattagggctcatgctcaagtcatccgggtatatgtttaaccttatatttgtgatatgcatatcatgtcatggtatcttgtttgacggtttcagttttgaattcaatcaggccgcattacttttcaaggaagctggacaaaagcatgatgttgatagggaattaccaggtagcttttgtggactcactttcaggctggagacataattgttagttgtgtttttttctcttgaataattgttagttgtgtttacctttgttgtttatcaatatgcttgctatctttgtcgaggattaatagttcacatagtaaaggactgaattgcattgtgatatatagctgtgcaaagagaaaaagagagaaaaccttacacattcatataatgcagaaattctccctcgcgggttcggaattggagaggagcagcttacagctatgacaagggatcatgattattcttctctgcacggatatggaggggcatgtaccattcatactgcaaatttaacttgaatatcatttttagaactactaattaaggcatggaattcttctttaataaacattaggttaaaggactcgcaaatttactgaaaacaaacacggagaagggagtccatggagatgaggtagatttggcatgcagggcaaatgcttttggggctaacagataccctcgcaaaaaggggagaagttttttggtaaatttatttgtccatttcaactagtaagcgtgtcttagtttcagtactgatatctctctctctctctctctctctctctatctatctatctatctatctatctctctatctgtctgtctgtctgtctgtctgtctgtctgtctgtctgtctttctttctttggggtccgggggttaacaggttttcctctgggaagcttgccaagacttgacactagttatccttatcatagcggctgtaatttctctggtattgggcattgcaacagaggtgactcctataaccatcctcctttcttatatttcttatgcactgtatgttatctaactattggttaaatattattttcccttctgatcttgaaatccaatttcattaatgtccacaaacgatggtttagttgagcaccctcactgccagcaaaacttttgatcagtgttttctttagttctaagttctgtcttaaaaaaattcattagggcatcaaagaaggatggtacgacggtgcaagcattgcatttgcggtctttcttgtcatacttgttactggtatgctattcttcgcctgttcatctctatgctaattgatcttctctaagcagttcaatagttgagatattaataggtgaatacaccatcattatactttacttagatgcaaaccattgttaaaggttctttaactttttctgaagtttgagtcatgctttaatttgtaatgataaaagactagatgttttttgtgttattctttggcaaagtgattgcagtttatcattagctcttttaaatagaacaccacttctatttttgtcatgtactttttttgaacagtaacaaataatactcaattactgcaataatggagttatgatagacgtccccaaataaattattacacataaggcttgtacagaacttgttatgaagattcaaacaatccaagtctaaatatctcaggcacccttagttacattatgcacaatacaacgaaaaggcagctagagagtgtagatgctttccctgacaacaggcccagtaacccttcttcacaaatcattacctattgcttgtttggttgagccacttccatatgtcagctagagagtgcaggtgctttctctgacaacagggcaacaggctcagtaacccttgttcgcgaatctgctacacgacattattacctattgcttgtttggttgagccgcttccatatatcagtatcagacgaccctctgatgttcccaactcgcctatcctgattctgttaactgaagcctgcacgctattccaacgcctatgcttgaagagtctcagctctagccacaatagcttgcttcacaacattcttttgctgtccgatatttcattaagaacacactgtatgcaattttctcaacagatctaatcaaattgttctcaaagcatgctcagtttttagtttccacgttgtttgtcatttactaatgtttctgcagcatgttttgtttttcccccatatccttcatttttcaatgttcaacatttttttccttctgcttagcaaacccatgcaagacactctagttggaataatttagttgctttactaaacactcattttgttttgtattagctgtgagtgactacaaacagtcccttcagttccagcaccttaatgaagagaagcaaaatatacaagtggaggtgcgccatatgaatatacccatttctcagataattagcaacaatattttagtcctctaatggggttgtatttgtgttacacttgtcaggttattagaggtggtagaaggattgaagtgtcaatatttgatattgtagttggtgatgtagtggctctaaaaattggtgaccaggtaagattatgtaaatccatgcattctgatttgatttatgttctatgctgtttgtatttctgagattataatgaaactaaatacaccttttaggtcccggctgatggtgttttggttagtggtcattctcttgccattgatgaatccagtatgactggggaaagcaagatcgtaagcaaccttttcgacccctattgtcctatataggactgacttccccatcatatgtaaaccctgtttcttttattaggttgtcaaggaccataaatcacctttcttaatgggaggatgcaaagtagctgatggttatggtaccatgttggtaagtaaccatatcttgattcaatggcctcactcttccactttttttcttatgaaaattgcatgcctgttaacaaaaagaggcaatttgaggcccatctgtcacctctgatcatcgatttaagtactgctgtttagtccagtaaattaattcacaagctagagtaaaccaattcggtggactttttaacagaccctagtgaaatgatatgaaatttcacccctacttacacgactgaagtgcaaaaatatcaacgtcattactttgtctcatgtatgttagtgccttataccctcaagaattaagtttgtgacgttttttttctaacatttgtaatgtggtgtggaagtcttttgtatatgaaattttgcagtttcttttgtaggtaactgcagtcggtctaaacactgagtggggcttattgatggccagcatctcagaagacaacaatgaagaaactccactacaggtttttctccaatccctgtgctatgacctgaatgggaattgtgggctggtttggttttgcactaccaacaatttggcaacttcaatatgtacctattatgtgttcgcattgaagccaatatttgtcaaatccatatagttgaggcacctctatcctatcgaaaatttggtagggtcaaaacttgcccaagatttggcactaccaaataaccaaaacatgatagggtagagaaccaaacttgccctgcatttgaacagttgcccatgccatcatttacatcttatgattcattcatgttcttctcttttctgttgaaggtacggttgaatggagtggcaactttcataggtattgtggggctttctgttgctgcaatggttctcatagtccttgttgcaaggtaagcaaagtgaatggctatctatgcatcttcttgatgtaaatttagtatagctttggtgattaacccatacaagcaaaaatcaaattgtcggcatgacactttttaccactaaacttatgcgttttgaattgtactggaacctggagtgcaatatggcatatcattacactgcttggtaaagcaataaagtgctcactctgcaatgattatcatctgaataacttaaatataaactggactatacatgaaacagatgaaaagagacactactgcacttgtaacaaggtttagtctctttgcatcctccccccatccccgaccaacccccaccatgatgtatgatccccaccacaatacatgcacacacgcacaatgatgtatatgatccctatattgagaaatatataagatactataattaggaatcgccatcatgattgtgtatatatgtaatatatgatgtttgttgcccatgtatccactatgtacttagaacttctcctttgctcccagatattttacagggcatactacaaatccagatggctctattcaatttgttaaggggcaaacaagtgtgaaatctacaatttttgggacaataaagatactaactatcgcggtatgtagtggtttagtgttcagtgtatctgaagacccttctgttatcccattcttatattacaaagtaccatgtaggtgactattgttgtcgttgctgtacctgagggactaccacttgccgtaactctaacgtgagttgatataggttgatgttttcattcatgtttaactttatttgaatcattcaacctcttgttttattttatcaggctggcctattcgatgcaaaaaatgatggcagacaaagctctggtatatatttctcggttttgtttatgttgtacccttttggttattacatggttccactcatgtgattttcaggtgcggaggctttcagcttgtgaaacaatgggttcagctacaaccatttgtagtgacaagactggtacactaacactcaatcaggttagttgtttttgcatagtaatggatatacaatttactctaatactcagttgtaaattaccatggtacctttgtgattatttgactctgaattttggttgcttaagatgaccgttgtccgatctgttgttggggggataaagctgaaatctccagctgatattgagaatttgtcgcctgttgtttcctctcttatacttgaaggaatcgcacagaattcttcaggcagcgtttttgagccagaggtgatgccacgtgtttattactactgcagtttacatacctgaacattgttcattattctaaattaggctattcagtagctggtagatttggtagattctagttatctatttggtaggtatttaacatcctggtctgatttttttatgagttgcattctcttgaagaggttcttctatgctctccacaatagtgtatagtgtgaactttaaatcatattgagtgtctgtttgcaacaacacacagttccactactaaggatgctgcttgcctgcttcaagatttgtgcaaatgaggaagcacatgagcactagtcagtttattaccaagttgataccattttaaaaggcatgcaggggaagcgttttaaatttgatctctaatgtgagacatatgtcttttttcgtacttgtgtactggtgccattgctagtggtttcagtgatctgcattctttacatgcattgtctcatattggtacctttatccttctatgttatcctgattcttgattcatcaggatggtagtcctattgagataacaggctcaccaactgaaaaggctattctttcttggggtgttgaggtaagtttccttgcattctcatactttgcttctcttttggtggctacatttttacttatctggctgatgcctcctgtagcttcatatgaaatttgcggaggagaaatcaaaatcttctattattcatgtctccccattcaactcagaaaagaaacgtgccggtgttgcagtgattgtggtaaatccatcttttgtcactaatgttatttgagatctagtttttggctgttagtttgttcgtggcatcctatttcttgaaatgatttcatagacacatactcattagatacacgagcttcttcctgtgtcgtcaatatgtacatgtacttcgatagcgatgaaatggcaatgggccttatctcaaatatggctccctagaatttgatgattacatgctttatttttgttggttgattggcaaaaggttcatttctttttcaatttaatgttatgtatattcattgcatctccactattgcagtttagtttttttccaaacatcttcttttacttgtctaatgtctatgataatatgatataatatcggttcagaacattttttttcgtgattttagaatgtaacaaaaaggatcttatgtatcagaagttctcctatttgttaacagacattcttgttgatttgtttgaacaaaaggtcttgcactgaaatgagaaaaccattctttacatagaaatactgcatggcaggttgagcatgctctgattactcagtaatctgaaaaacactatgcttggtttatggatctagtttagctagagtacaaatattttcatgatttgcaagtgccttctatttggcatgtaacacgctgcaaccttataatattgtttgcattcaggatgattcagatattcatgtgcactggaaaggggctgctgaaattgttcttgccttatgtacaaattggcttgatgtaaatggcattagtcatgaaatgacacctgataaggtattaaccacataggaaacccttctcaggtttatttaataattctcatgtctcagctgggtctttcaggctaatcagttcaagaaatacatagaggagatggccgaggaaagtcttcgatgtgttgcttttgcttatagaaatcttgatctgaattatgttccaaatgaggaagaaagaatcaactgggaattaccagataatgaactggctctcattggaatcgtagggatgaaggtacatgcaaagcaaaccatgatatctgaattatgatatctgttatatttaaagcaatgttaaaagaagtttctacatgtctaaaacaatgtgttgaaaagcagtaagcggtttcgtgtggtcaccccaccttgtagtgcttatgtggcataatcggtcacttatatggtataattgaccactcatgcagtttaagatgtacaaggttgggacaaatgttccttgtatgcagccttgtaaaccttttttaaaaaacactggtgtaaaggcaagaaattaacttgttaatcagaggaaaaagaaaaggttatacaaaatttaatatggtgggtctagattacagtataaatttatcggatggttattagggccttatggtcataaaaaaatgtattctttgcaatatgcatgagtgatctagtaaatacaactctattttcaaatacaagcatgcattagtatctagccatgcgattgcatttgtgtttggctagttatatattatagctcacttttcctttattactgttctggtaacattgtttgtctttgtttgggacatccatattttttgcaggacccctgtcgccctggggtaagaaatgctgtagatctgtgcaaaaatgctggtgtaaaggtatgtagtttgttgaattcatgtgtactggaggacataatgggcatttttacaaacattacagtcccattttccttacagcgagtgttgatacttgaatgttccttcaaatattgactgttatatacaattatagaaaatcagatttagatgtacaattacgctccagtgaacataagatatgtgactttcttgattttcttgcctttagaattcatgttcttttacttaaggaactaaatctgtttatttgttcatgttggatgtgtaggcataaaactatgagcactagtaatgttggcacagtgccacttgaatagttgtagctcttctcatcactattacctgacaaactcctgcggtttttgaacaagcaggtacgaatggtaactggagataacctacaaacggccagagcaatagcacttgagtgtggaatactcacggactcccaggcatctcaaccagttataatagagggaaaagttttccgggcatacagtgacgctgaaagggaggcagttgctgatcagattagtgtaagaacaatctcatttgtgcttgcaaaaatattaaagtgtgtaccaagtttatcgatgtaaccttataatggtgcttttagttcttaagctggttcattgctcattgtgtatgttattttcccttgcttttttggtttggcaaaaaatggaaccataaacctatagctcggttgcagaaattgctgcagaatgcctaacgatttatttcatgtagtaagacagatatatctggagtacatactttcgagtttacacattaccatgttcagtacttgtactggctgttagctcgatcattctaggggaagcaacctgatgtcaacaatgcattgtaggtcatgggaagatcttctccaagtgacaaacttctcctagtaaaagcactgaaaaagaaaggcaatgttgttgctgttactggagatggaacgaatgatgctcctgcattgcatgaggtacatacataattgggaattttgttttgaacaaataaaaggataaacataatggttttatttcaatcagatgaagacaatcgatcatgcatgttgatgcacatttctaattttgatctcttattcctcctaatttaggcagacattggtcttgctatgggtatccaaggaacagaagtagctaaagaaagctcagatataattattctggatgacaattttgcttcagttgtaaaggttagggaagttggagcttaataatcttacacaattaatttaacaaatgccttaacatttatccatatgtaacgttctaggtggtccgctggggtcgttcggtttatgcaaatatccaaaagtttattcaattccagcttactgtaaatgttgcggctcttataatcaatgtggttgctgctatttcttcaggaaatgttcctctaaacgccgttcaggtttgcaacaacacaatgctcttagaattttctttgagaggaaaatactcttagagttactgctatgtactatgccatattagtataactttgtttattgatagtttaaaactcaaattgttagccatgcctgaattgccatgactagttcggccactgctctctgtagtaaggccgcaaaaagatattgcgagataaactctgttgctttaaactcttttttgttttgggttggtctgtttgctttgggagttgcgaagatggattctttgagaactttgtttctttcaatcttaatgcaatgatgcacaagttttatgtgcattccctcaaaataaaactagtttgtccacttgctgctgtgtctgaatcattacattggctaatggaaataactatggagtatgtgcttgttactttagtggcaatgtggcactgtacggagtttacttcagtatattatcattttttgctactattggggactgtatcctgcttgctcactgtaccattctttaatcacatgagggcttcacttggaatctggaatttggcggtgtcttgttgaaagcatacctaggatgcaaaaccagttaggacatgaatacgttttctagtgtattctgatatgttaaatcttaaatcaatcaagtttgttgaagggacatttagaagatgtcctgtaaataaagatggggttgaaaaaataattttaccatgggctaaggggaaattgttagtgaaaatgaaattaagatacttaactgtattgatttgcacgtcggcacatggctgaatgttttacttccgtttgttgttgatttagcttctttgggtcaatctcattatggacacacttggtgcacttgcattggctactgaaccaccaacagaccaacttatgaagcggccacctgttggacggaagttagtacacctgaaaccaacccgtgctcactataattcttgattgtcttaaatttgtaaaggaataacaaaattctaacatgctttcacatttaacacagagaaccacttgtgactaacattatgtggagaaacttgttcattcaggtaggacggacttgtcatataatgcttctgcattgttaatccaattattttttacttggctagttgctgagaatttttttttctaaccacaggctgtctttcaagttactgttcttctgacactcaactttagaggccgggatcttctgcatttgactcaagatactcttgatcatgccaataaagtgaaaaatacatttatatttaatacatttgtgctttgtcaggtaatttgtcttcggtgggcttcttgcaccttttgaaagcatgttactgatttttgttaaatggttatcttttcttttcatatatagcatagatgtgcaccattttgcagcttgagaaaaatcctaacttctccatttcttttacaataggtgtttaacgagttcaattctcgtaaaccatatgaactgaatatatttgatggggtttcaagaaaccatctttttttggctgtagtgagcataactgtcgtgctgcaggtatgaaagggtggaaatactcaatccaccttcaaatgctgattaaatagttcggggagcagataaaatttaactaacatatctctgatactcaggtaataatcattgagtttcttgggaaatttacatcaactgtgagactcagttggaagctttggcttgtttctgttggtattggttttgtgaggtgagatacttgtccactttgtagaacgtggtgcttctgttgcagggatgattaatacttttccaaaattatttagtgaccttttcttcctccaactattgatctgatagcaatcgaagaaaacagctttagtttgggatggataaattataacgattgactgtagcttgcttactgtgagctaactattgccttgttcatgcagttggcccctggcttttgctggaaagttcataccggttccccgaactgaattgaaaacttacatctcaaggtgtttaccgggaaagaaaggtacccactatattttagccagctgttgtaaacatttgaaacatatctgttctctagcaactatgtttgcttctatgttttgtttccttcgctgctgtttatcagaacaccggcagtaacattatttctttttagttttaccaatttaatcaccttcctttggcccaatttacagataacgaaggatcaactccacctccacctccacctccacctgtgtgattgtgcatgtccaagtgaccaaaattatcagctctgaaattagtggtggtgcacatagatgcttgtataattttgaaggttgacttctaaccatgctacctcttaggctgactgtatactgaggttgaagccaatccgacagatgtttcatcctctcttactcatgaattgggcctgacgccgatgtaaacaaagattaggaacttagacatacacttcactagttggctagggatgagtgtgggctgacccgtggatactcttttacccacactagttcaactaaatgaactaaatttcacttttagaatcacaaaaaatgaaatgtagttcgtttatttggactagagtgggtcaattagtacctatgggttggcccgtggccagtcttggccgcattcatgcatcatagtacgctactgagcacatcttctttcaaagtattacacggagatgtctaaaaatttgagctaaatgactgggaggtttattagtgttactgcttttgatttttgagagctgctcatatttttcaggatcaacatacattttgtacttgaatgctgtacttttatttaggtatgttctggcgcaaattatataatcctttataggcctgttttgactttgatagtagcttgtttgttggaggatttaagctaatctggctagtaaccatcatggcaaactgaccatccagctgatagcttcattacacatacctggtaagtacatatggcacatgataaaaactaggatgttccatagcaaattagtcctatgttttgcctctaatactgatgtatggagtatttctcttgactgaacaaagtgcaattgctagtcgtacaatgtttgcctagagttctatcactagcttgccatttcggtaacttttctagtaacatgcccatctttcagtatatctccttgctttggatctatgtagggttgatgattataaggctgcgtttgagcgcaggagaaagagagaaagatagttttgttttccgcgcgcacacttcccgaactactaaacggtgtgttttttgtaaaaaaatttctatagaaaagttattttaaaaaatcatattaatccatttttgaagtttaaaataattaatactcaattaatcatgtgctaatggctcatcttgttttacgtatcttcccaatctcctcaatcccctccttctcaaacacaccctaatgctttaaggagtcaaatatgacctttcaccaaaaaaaagaaaagaaaagatagcaaggcaatgcatgctatgcttggaaaaaaagggagaatagctaatatagtccctaaagtttcgctcctgggtcattttagtccttaatctttcatattatccaaacaagtcctttaaatttgtcatgtgggctaatatagttcttggtcccaccagaatcgccatatggacatgccatgtcaccttcccatacaaaatctatatgatttgtccaatttaccctttgcataggaagataaaaaaacaaaaggaaaaaagttacaaaaatatatggtatatgtaagagaaaaaatatacctcagaagggtgaaaaaaagaagtatttttttcctatggttatgtctaattcacccttatattttttttatgatatatgtaagggtagattggacaattcatcatagattttgcatgaatgatgatatagcatattcatatgatgattttggtggacccaaagactattctaggccttatgataaagtttaaggatttctttggaccatttataaggttagggactaaacagatcctacagagaaactttagggactaaagtagctattcttaaaaaaaaaaaacaccccctttttcatttgtttacggaggagtaatctaagcatgtcgccgagccacacaataagtaggccacatgcccgtgctcccacccaaatcatggtgcttagtttgcgtgctccctgcattgccctttcccctttacattacatgcaagcagccatgaaaatattacttgtagtactagttacatgacttggtcgctttccattaccgggatcgagatcgtactgatcagcagtactcctgttgctaatagcgaggcagattagcatcggtcgtatcgacgtattgcatctaactcggggtgcttagattaattaagcacaatcgtactacgtactgctccagtagatggttggttcttggatctcgcactggatggagcatatgcgtatgcgtgtctcccggtgtacggacatgatatctcctggtgaagtggtgatagagctagcagtagctctaaacatccggatcaaatgatcaaaatatgggtttttgagacgttctcatgcattgaaaatatgataagccatagaaaaattatggataaaacttttaatcatgtattacgaatctttaaaacctgaacaaacctcctatctgattttcacaataataagatatgttttatctgattttagatcactaatgttgtgcttagatccaggggtgaaaagttttgacgtgtgacatcgaatatacgggcacacatttgaagtattaaacatagactaataacaaaacaaattacagattccgcatgtaaattgcaagacgaatttattaagcataattaattcgtcattagcaaatgtttactatagcaccacattgttagatcatggagcaattaggcttaaaagatttgtctcacaatttacacacaatatgtataattagtttttttcctatatttaatacactatacatttgttcaaatatttgatattcgatatgacatggcgaaaaattttgctaaatagaccctaacatgcgtacggagattttactcctactactctttataagttcagaaagcattaaaatcaccttataatgtatgagtaacatatatcgctacacgtgcttgtcagagccgctccatacaccagcattaatttctagagtatttttcttcaagtatattaattggccgggaacgcgcatgcttgcaagacacgcagattttttttatgttgcaactaataacgaacatcgatcataaatgcaagtcaagttttggattttctcctcgcaaaataggaaaaatgttttggctttcttggatccaccacacaccgaattttaatttggtttcaaaacaaattactccctccgtttcaaaatatttgacaccgttgactttttaacacatgtttgaccattcgtcttattaaaaaaaattatgaaatatataaaactatatgtgtacatgaaagtatatttaacaataaatcaaatgatatgaaaagaataaataattgcttaaattttttgaataagacgaatggtcaaacacgtacttaaaaagtcaacggtgtcaaacattttaaaactaagggagtaagtttgtaaaatacaggagcatgatactaatatataacaatataacacacacgcattaattaatctggttttgctcattaattctgtgttaaccgtttgttttagattttttttccggaccattttctttgaacatactatacttatcatcttaattatgggggaaaatgacatattgtatcgagtatcgacatatatattgcgcgtgcttcatgcgtgacggccggcatgtacataaaaataattcggatatggccctacgtagccttgggattgggcccacacctgacagtggtccagggagagaattggttgagaaaatacgttgccgggcccatgtggttatattatgctacaatggaggcaacgcgggttttcattattataataaaaaattagtttatttgatattgtagagtagtttctatataaaaaatttttacacgatacacagtgtttgacggtttgaaaacatactaaaaaaatcgagatagaatctacatcttaatcagaaaataacgatatataggccatgaaaccatagtttttttttccacttagggactgttcatttgagcaaatggtagtggtaactttcttgttatccattatcatgcttactaaactgctaaacaattttctttacaaaactatgtatgtagaagtttctttccaaaactcaattgaacttattttctaagtttataataatttgtactcaattaatcatatactccctccgtttcaggttatatgacgttttgactttggtaagagtcaaactgtttcaagtttgattaagtttactgacaaatatagtaatatttataatactaaattagtttcatcacatgaataattgaatatatttttataataaatttgtcttaggttaaaaagttactactattttctataaatttagttaaacttaaagtagtttgactttgactaaagttgaaacgtcttgtaacctgaaacggagtactaatgacttgtttcacagccaacagcggccgagaacacagcctaaaggcatggtggacctagaaatttcatagagcataaaaacgttcacaaaatggctagatgttgggatcgtcaaacactgataatgcaattttcccgtcctttggccgtgccaactaacccgggcaactgctcaaggtcgccatacattggatcgactgctgattcgggtggtcttaccatgaactagtacatacaattgacactcgaacttattgtttcttttaacttgtattagttgaaattaaacatgtatgatcgtggagtgatatatgttatattaattcatcttattaaatatttttagatttatgatatataaaacaagaggacatccctcgagggacaatcgggctatattcgtttgcagaagaaatatcttgttatccgtttgcacgcttctcggactgttaaacagtataatattatagaaaagttgtttctaaaatcatattagtccattttacaattttaaaaaatgacatattaggctcttcctttctcctcttctcaagcacacccttaaactttcatggtctcacaaaaatgcactatactcatgatctggatcacacacttaatttcacatattcaccctacattggtgacttaattaaggcaagatccaacttagtttaaagctgagtactactaaactaacaaaacctaattattaacacactccaacctagacagcttaaatctgatcacccccaaagcccaaagcttaatcaccatcatcatccagccccccacttcattcctctcacaatcatcagtatcacctctatctctagctccccctctctcttctctctctaaccttttgcacctgcctgcagtctgtctccatagaactctctctctctctctggatcgccacctttgccatcatcatcactgccatcctctccacgcctgctccccgcatccatccacccctctttaccccaccattgccgctgcttccctcctccatcgctcactcgccatggcggcgagctacttaagtagagctcgagcaaccctaccttgcttcttcttgcctcctatctaagcttctcttcgatcttgtgtgacacacacatgggcctcgagctcgacctgctgtccgctcagctcccgccgatccgcaccacggcggcggcggcggcggcggagatgccggagttcgaggaggtggtgctgtgcagcacgccgacggcggcggcgagcgtgctgcgggcgccgtcggtgtgcccgccggcgccgaggaagccgccgaggccagccgccaagaggaggaagaaggacgctcgctttagccgcagctgctactgctgcgggcggcgccgcggcgggagggcgccggcggcggcggcgttcgtcgccgtgccggacgatctcgccaaggtgttcgtcccacggcggccggtgccgtgccggccgccgctggacggcaagaagatcggcgtgcacgtcgtgggctgatccatgtatccaccattgttggtctcgtctgagcttgaagctgtccatggcgagtggcctaaaatactctggctatacgtacatacgtgcatggccatggagtggtgttggttgcttgcaacgagagacggtttagtttagtaattaattactcctagtttagcttaattagcttactttaatctagtttttttactacagggggttatttgaataacaaactgtaaatgtagttcattattatatcattaccccctagctagctagctgactggatgttcagctaattcaggtaccaattgaatggtcatcactcatcactcgattgatcatgccattacttactttgacaaggaatattgtgcttgcattgcataatatatactgtatgtgcaaaagttgagcaatattatttctttccttacttcattttgagacctcctttcgggaattttacagggatttagttcaatttctcaaaaaataatttctccatcccaagcgtgtggctctagcttagagcttaaactaaaaaaaaagccaactaagacaccatttgatttaggttattgagtggattattctagtagattatctacttattttatatatggaatgttttaaatattttaaaaattaacttaacaaataacttaaaaacaaatgaccttggcaatgtattagaagataacttttttgagaaaacgaatttttcgaaacgtgtactattgcttagatcgcttattttaagttaatttgaagtaaataatctgaaaaaatcgaaaattgattattattttttaataattcagtaaataatctaaaatacctccctttctctcactctgcaaattcatgaatgttgcatgcttattagttaaatactagtagatgcatggtgcgaaatgagcgtaactcaactagttagatttcttttggtggaatcaatccatccggattcaggtcctagatttgaccggatgctcgcttttacgactatttattttttcagtggtaaccgacgtacatacccgtcggcagcgggacgtccgtaataacttcgttaatatcaagagatatcgacacagtcgtccggagatgctaatagggaatgcagggtcagctgattgagagggagatagagagcaggtaatggctggaggggaaaggagagtgtgcactgtgcagagcttccaaagggtgaccccccccttggtgtacctggctggtccttttgatacctaaaaagggatgcatatatgcatgaggcagagagcaatccatgcagaggagaggagaggaggcatgcagcagtggcagaacatactactccagatctggggaggaaagctgcatggttaatgccactcagatctgaaaattttgtgtgtgtggggccgggccattgcaatttgcaagaggggattcaatgatactgtccatggtgaactaacagtactgctgctgtccctgcatttctccctggacaataagctagcgggtggcagaaaagatgagcggcaggcttccaaccccatcatatatgtccctaaaaatgctgccatttaagtccacatggtccatctgatcatgattatataaaagttgttttagttaaattgcaaggtgtatttttattttttaatagaagtttttattgctaattaaactgtggctaatagtttgtcgtcaaatatattctcaatagtttcatatgcacacataagaaggttaattagagatgcacttgatagtacagtggtaagtaatgtgtgatttcaacctcaagatctcgggttcaatcttcaaccagctataaacttcatgtctcggaattaacacgatattctcttttctcatatttttataaagataaaatattgattctcctatcttctaagcctctcatcatttggtagtttatcaaccacagtcacagataaaatttaaacttgaaacttaatttctgaagttgatttttggatatatattttttaattgtggtctattttttagaattggcttttaaatttctgatattaatataggtataaagttattgtcaataaaaattgctttgtctttttctttttcacggtttatctataaatgtgtgtaagaacatggagtacaacagttcagacgaccatcacctacattatgtcttcacatttatggcctacgtgggcgcgtagttgaggtttaatgtgcttcagttcagcttgatcaaacagcacacgtagtattaattggacgcccactcgcgtatgcacgcacgcatgtactctccataaaaaaaagtaaatataatacaagacatgatgtatcctatgaatttagataaatagttatctcgttctataaaaaacaaatataatacgatatatcattatgaatttagataaacagctaatctagatttataattaatattactataatgtatcagacaatatcatatcttataccagattttttttatggggcggaagagtgccccccacccaattaatatggtatttttgtacattttctgcgaagaggcatatgcaagagggcagctagctagcaacaatttttgccgtggctaataagtaaagccatttccctttgcggcctccctttttttacttccttttcttgcatgcccactatagactacaccatcaaccttttactagttctacattcttacacacctagcaccaataataatgatgctggttttaccttttcatttttattttcaaagagaaaatgaagcaaacatgcacttgagagctagctttgctctcattgtactttagttaggacaaataagaagtataaaccatgcactttctaggtatcttaggtttattacatcttattgtgtgcaagttattgtgtccaagcaccacctaatgacatggctacatcataatggaaatattgtaatgcctagggccctcccacgacgatgcatgtttgaagcaaatgtattgtattaataattccctatcttctaaagaaaagaaatacgaaagcaaatactcagaataccaactatattgcagccttgccgtgacagaccaaactgctcctggcaggctagcatagcaggccatgctagacatggttgaaaaggaaaaggaataagttcacattaggtctcttatcttgacgtcgagtttgaatcacatgcttgaattgtaacaccagatgtaacgtttacctcaacttataaaatcggatcactcgaggtcctaggacagtattttgtcaggttttagctaacatggtgagttgaatacagtcaacccagccgagttagcatgggacccacatgtcagtggctaagtcttcttccatctctcttcacctatcctccccatcttctccaaagcgacaaccgatacagtaaagggtagcacgtggcgggaagaagggcatcggccgatgggagaggagctagggggctccgcttgttcgtccctgagctcgatttaatgatagccgaccttctcaccttcttccgcttcatcaagttacgggcggagcacgtgaaagccgttaggcttcttgtttggggagtccatgggcggggccatctaccttctcattcacctctgcacatcgtcggaggagtgggccggccagcacgtcctggtggtgccccatgtgcgagttcttcaccttcgttgcatggttcgcgccgacactccccatcatgcccattttcgacctcaccgagaagtccgccaaggcaccgaccaagtgccttagctgtatgcaacccaatgtactacaacaactggccatggattgggtctttggtgcagaccgcagggcacccccttggagaatatggggaaaagagaggggagatgggaagagaggaagaggaaagcgccggccgtttacatgtggggtttgttgttggctccgccaggttaaacatggtcaattatccatgttaaccacaatctagtacaatactgctctagaacctcaattacaccagttttacaagttgaggagcacgttataactgatattgtcgttcaagaacaccattcaaacttaacgtcatgaggagccaagaaatgaacttagaaaaaaaagaacacaacgcccaaatattttcctcgtaggccgaacaatctagcccaaccagggcccaaatatattccttcatgggccgaaaaatataggcccagcatccactggccacagcccaaccaggcaggttgacccgtacacacacgacgtccaccaacaccaaagccgccgcttgttttctcgccctcctcctctcgtcttctcctccaccttgcttgtacccgcatccacctcctcaccctttttctctctcatcaatctctctctctccacatccatccaaccctacccacacccacgcgaccaaaccctcggcgcggcggcggcggcggcgaggaggcgaggaggaggcgtagcagccgccgcgttggcaagcgccaggtgcgggcggatcggatccggggggcggagcggaggtgtggtggtgggggggagctatggcgtacgtggaccacgccttctccatctccgacgaggacgacctcgtcggcggcgccgtggggggcccccgcggcgcgcccgtcaaggagatcgccttcgcggccgcgctcctcgcgttcggcgcgctcggcgccatcggtggcgtcctcatggccgccaacaacgtcggcggcgaccgcgcgcacggtgagcgccctcctcttaattcgcgcgtctagggcctgggcttccatacaatttccccccaattgatgctgtggtagtagagatcttgcgggattctagcttggggggtgtggtttggcttcagtgcattgggttgtgaggatgaaattaagggggttattgtttgactgcgcaatcatccattttggtaatttctcagaggaaatttattattattagtaatttacttctggtattctcatttgattttgacttggtcaaccacatgcattttactacagctgggtggcaattgggggaaataatgtactttatgtatgcattgcaatttggtgacagttcgtagaacatacatttattttaatgctactagtttgttgtcaattacattcattcatgtatcaagtttttgtaatatactggcattttatatccaaaagctccagatagcaatcactggaagcaacagggcttgactgctggagtagtgtttaagattcgaatgggttctctagtttgacaactttataggctaaaaaaacttttaacatttttaagtgggtgggcacaaagtgattcagtcatcaagttttatgtttggtaacataacatttgtttagcatacaataggtagggttccccttgcatagaagatagaacctttgctgttgaaactttattctttctttacctgaagccatttcccttttgttggaacaggaatcttcttcatgattctgggtattgtgatgttcatccctgggttctactacacaagaattgcctactatgcttacaaagggtacaagggcttctcgttttcgaacatcccgccgatctaaagaaagaggtgtatcatacgccgacttggttcatctcatcacgtccaatggcgaacaccatttctcattttcatcttgtctatttcttcttctgctgcccccctttgtaggatgaacttctagacatgtacatataaaatgctactcccataatgtatcattatggtgtggtgagctgaaaggttgtccattgtgtgattatgttgggttactatgacacatgtctgataagaactttatgatgttgtgttgctctcatgctgtctgctgtttgtgttaagataactgaagttaccgcactgtcatgacagtttggtccccttatcagataagaacaccattgtgtgaataaacgttccgttagctttggtgtttcgctcattttactgttgatttaccttcagttgttttgtatctgtcaactgctgttctggaactgtggtctgttgtgcctgatgtgttttactgcaaaaagttgcaccttactcgtctttggaattcagtggattcttctcttgtgtcgatctctgataatctcaaatccacaaatgaaaccgtagaatgatccgagtaatgttgacacagaaaagtggcaggacaacctcaaatcaacagacaatggcaggtgaaagacgatctaaacaatgccttgctttagttactactattacgaaaatagaaaatagggttaacgcttagagatttcagtttttttaacgaacttacagatttcaagtttgaactttaataatggtttaacgcgagaataaagaattgtttcattcgcttgatgaactatggagccgtgtacagtactcgtccatgctaagggtgagttcgaatatcgagaagattggaaagatatgcaaaaaaaagataagctattagaatatgattaattaagtattaactactttaaagtgtaaaaatagattaatatgattttttaaaaaaaaattgcaaaaaacgcatcgatgtgctatctcactcatcattgtccatggaacgaacgcaccctaactccctaagtgtccatccgatcaacaagaaatatttttaagatgggcatattttatatggagtacccattgtccattagagttttacagaaatcatccgcctagattagtccctcagttgcacaagttttttcgatccgcagtgactgacagcaaaaacaagcaatcgattgaaacaccaaagcgagcgaattaatgaaaaaccggacagatctatgggatacagatacaatatttccgcttgaaatttggatggatctagaaaggaaacacccaatcgtgttagcggcctgcgtctctctcggcacttctgcaaagggtggctcgcccatggaatagatcggcagagcacccgttcgtctgagagccgtccaaaacatacaaatcaccatacaaaaaaacagcaagaactgaagaaaagaaggcgatgttttcgattgggggatgatttgggtttgtggccaggtattgtggcttggaactaaagaagatggatctccaaacaatcttctcctggcttaggcatcgatctgggctccaagcggcagacagggcaccattgaaacggcgcctgctgttgactcataatatagagccctattattctcaccaccaaatcatttgcatcccaaacacgattcaaaaactatatcaacgatgcgatgaattgaaatcttcaaacaaacaaaatggaagcaaaagcaaatcaatcgttcaacgagaaaaaaaaaagagagaaaaacacggaagcaattaccactcggagaggaaatcaagaaggaaaaccaagcgaccgagatctgaatgcgcttgtgctgcggcggcggcgagagacaggtgggactgatgggtttagggttctgaagcgccccgtgttttatagacgccttcctcgatgtccagcctataagagtatgacacgtgtcccgtgcaaatctgtctcttcctgggccgaggcccaagcccaacaacaaattggttggatactgattatttgtatatttatttattatttatttttgtgtaaaaacgtagtatacgtgattatcacgtttcacgtacgcgtaaaaatcgttatcccatccgaatacgatttactagcataatataacggtatatctcgagggattaaatactctctacaggggcgtatatatacgtacacatacgtacgcgcgtcgatcgccgccatggctaagaagaaagacagcgacgacgtcgccgcggtgtacaccgccgtcatggaccacgtcgtcggcgaggtccacggcgacctcgtcgcccagggcgtcggcgacggcgttaagctggccggcgtcctcgcggcggtccgcgctcgctgggaggccaagctggcgcggcggcgcggcggccccgccctggatggcgacggcgacggcgacggcgcgccgccggagtacaagccggcggccggcggcggctactgttgcgatgcgcctagcagtggcccgcatcatcacgatgcagtcgttaaggaagaggaggaggtagccgcagccgtcgacgacgacggcgctttcttcccgacggcggcggcggcgccggaaacgtcgaacgacggccccgcttctcgggcggtggtcaggcgtgatcttcttggcacgcttggcgcgaaacgcaagagggatacgtgtaactaacaacgtgcatggaactgctcgaatttgtgataaatttgtaacactggcagtttgtgatctatactcctgcgtttctgattacaagttgtttttgacttttggttaaattcaaattatatcaagtttgatcaggtttatagaaaaaatattttttaatccaagacaaacatattatgaaaacatattcgattattgatttaatgaaactaatttgatgttgtaaataaataatattatatttgtctataaacttagtcaaacataaagttgtttgattttcactaaagttaaaatgacttataatctaaaacggatggggtactaccaatgttgtgtatggagaattactaactgcagtactataagataggtggaggaagaaattattcgtaatttatttgataggattgggaaggaaaaaaaatcatcggatttgctcttcagtcggaatattcgaagccgttcagaaacaggttttttttaaagaaaaaggccatcggaatatttgaacttcactaaagagattgaaattggcagttcagaaaagaaaacgatattgaaattagagaaaatttgggaagtagtcaagtagaagaggttttacagttaggggagcgaggagagatctgtactgtacggttgaattttaggtctgatgcatggtcagcaaatgactgaattcattcttctaatgacttctatacgtgatcaacaattgagcatcatagatgctccctttcttcacctgcttggcagattacttttcagttactccctccgtttcagattataagatgttttggctttagtcaaagtcaaactactataaatttaactaactctatagaaaaaaaatagtaatatttacaacaccagcatagtttcattaaatctataattgaataattttttataatatatttgtcttgggttaaaaatattactactttttctataaaattagtcaaacttaaaatagtttgactttaaccaaacgttttaaaatagtttgactttgaccaaagttaaaacgttttataacctgaaacggagggagtacataatttacactttggagttaattttgtaccacatgagagttatttacagatttacagacattgtttgatgatattgcttgctgaacaactagtggttgtgggcctagctagctagtatgctattcacatcctatctcaattgtgtataattgagctaaaaaaaattgttgcgtatacgaaaaattcgtagctgggcccatccaatggaatctgtctaagctaaggcccatccaatggaatttgtctagggaaaaattcctgaacttggccacttcagttgttcagttcttcaggataataatgagctatggtccggtgaacttatcatacaacttctgtaaaaaatgtagaatttcatttagcaatttgtacattgcaactcctttggttcagatgactgatctactttcacagtaatttttttttatacgattacttttgccaactcggattttatgaacctccatttcagtgggcagttaaataaatcaatctcgtaccgaatacgacacatcttgtatgattatgtccagattcattgtatcaggatgtgccacatcttataagatgttggtttattttggaatgaatggagtactacataataaatgctatagtatcctctaggatacaaagtagctatccaagaattatctggtcctagaaagtcaagtacccgaaaggagagtaggttctcttctgttttatgccggcctttttcctccttttgttctcaccttttacacccccttttccattgtttagcttgactagaatctttctactagctacataaactgctatactcctgaattatcaggagtgcttttccggtggtctctactagaagtacaaacggacatacggtgatgtaaatttccggtgatcgagtatcatttatataactggtcgtaccgttttcgactgaattttattatagtcctataaaattttgattttttaagtttctgttagaatcatattaatatcaccgctaaataaataaattgataaatatgaaaaaaatcactagatatgacatcgtgtatgaccattttcattcccggtcagataatgattatataattaggagggtgtaatcgtttctcttggtggtacgataatgaatcaatggatcgaattctcgttaatcattgacccgttttggtagtctgacgtgttaggttaggatagtgacgtcagcagcaggcccatgacgggacgaatcgttgaaatcatcatgacaacttggtggtgatgctaagcattccctctgatccttgtggctaaagttgatctcgtctgtttttgtttgtccatcctgtttaaatgcacttagcttagttcggtatacccaacttcccatgatgcaccgaaagatctctttgaatgaacccagcaattaacgccggcatactatgattctattagggatgaaaacggataagatataggtatactatatcttgaaccatactccatccgtcccagaaaaataaatctagaactagatgtgacatattctagtacaatattctagtacaataaatctggatgtgtcacatccagtactaggttggttttttatgggacggttaagtatatttttagcggatatggatataaggcagattttttcggatgtcagaaatggtgtggactcaatttagaaacagattaaatctgttggacgttacattattgcaatcaatataacatcgagttagcaatgggacaacaataaaatgatcaataaatgacctatcgtaataattatatacttaagtgctaaataatatgtatacaatgtatacataatataaaaatacagcaatgcaagtgtgaaatgagatgatgaaagccccaaactaaaaaatctaggttaattgatgaatcagatcattggatagtctggctcatgtcacatgcaatggatagagtgattacatagattgataattctggattattcaacaaacggcttattagataatctgatagatatatcggataattcacatccgttgaattttagagataccacgtttgcatccatatccacattatactatctgtatttgcaactatatccgttagatttcttaaaacccgtaccaatacgaaagtcctaaggggcgatcgatcgctccaagcgatcagtccccctccccacatcgatcaccccctcctccatgtggtttccttttttgcaccgcattacttcactattttagtaaatttatacacctaaagtttgtacacatcaagttttcacatctaaagtttatgcacctaaagtttagagacccaaagtttacaagtcaagtttatatatccgattcaaatttgaatttgaattcaaatattttttatatatagtatttctatacatctaaaaattatacacctaaagtttatagacccaaagtttataagtcaaaagtttacatacccgatttaagtttgaatttgaattcaaatattagtttatagacctaaagtttataagtcaaaagtttatgtacccgtttcaaatttgaatttgaattcaaatatttttttatatagtatttctatacataattttttctaactttgtttttttttaaaaaagttatatggtgtagtaggaagagaagaaggggaggaggaagggggagagagagtgtatagaggatcgatcgcccattaaccacacccgtaccaatatcctttgtttcggatggattcaaagtggatgggatccgttttcaccactacatgctatcgtatttacgtattattcgacaataattgatctgttaaggtcaaactaaactaatctgtcagagagtaaaccaaaattaacctgagcaacatgaaagagagagcttcctttcaccctcgtggcagtaataatcaacataatgatagatcttaattgacatagcaaatattgttttgtttgcttcccaggacacacgagatatatatgagtaagtgataagtactgtcattaattaactattgcattctccaatcaccattatattgacccaatgcgctttcaacaagtatatatactgtcatggcggctggctaattgacgtggggccatttgatttgcaggcctcaggtttgaaggataaggattgctcttaacttgtccccttccaagtgatgctctcactaaaagcatgggttttatgtgcttcaagcttcctctttttttgaaggacaagattgtgacttggcatggatgtcattgtcgaatcaatggttttattaggtttttgacgctttggtttgttggaaaattgccaggtgcttgacggctaaggcaatgaaattcggtgtctcctagctcctgtcatgttcctttgctttatagttcttctttctctccctctctctttctttctgtgaggatagctctccttcttctcgtggagtttaattgatatcaagtgatatagcagtgatggacgcatgtttaaaatatagatgggacggtagagctagccctaattaggtgatggcacaacacacacaaatcttagtcgctggttcacggcattggcgcaacaatgcacggcacgaacatcgagaaagttaacaacgaggattggtagtcgaacaaacgtatatgacttatatgtagagagataaaagaaaatgagaaatgctgttagacaacaaggggaaccactttcaatagttcgggggtataaaacgagatgaaaaattatttaggggtttaagtgcttcgtcaaaatagttcaagtgagtaaaatggatttttttaatatatttacctatttactgtagactgtattatgcactaaagaaatagaaagaaaatagaattttatgtacggccaaaatcagaaacgatcaaaatggtattacttatacacgaattttcataaatgtttttgttcctacttaaaatacttgatttatctgattattcaatagtagactaatgactaatgttggaaataggactaaaataaggtttcggggtgtgggacgacacagatcgtagttgggccggccgacccaccctgcctaatgggtgtgttcgtcactgagtgataggttaattatattataatactcttgtaggatgtttgttaaattgttactaccaaaattagaatcatgtttcgataaattcgagttacaggtggatcgatgggctaagtatatccttttgtatcacaaattcatatcaatcctcaacacaaaatatctaaaccacctttgagcaacacactttttttctagctactttgttcaaaagttttgaaaaggaagtgcctttcgtgaaggcatgcacaacaagcacaagacatttgggtgcaatgcaaagttgcaaacgtacatggatatacataacggcatccaaagctgcaatctcttcctttttcgtgtgcccaaacaactcttcccagggacaaaaagccaaaacgccaaatgaaaaacgaatccaggagcccaccccacgagagctccacgtcagcgctggccccacacaccctcccaatccagcccagccgagacccacgtcatcatgggccccacacgacccctcccctgcactgaatgcctcgcagcgtgcagaacactcgcactactcgcgttccataaaaaaaaataatgtactcctaatactaggaaaccgaaaagtatcgattcgtattaataaaatatgtcatattcgatactagtttatttttttatgaaacggagaaaatactacacatggcggttcctttgttcactttcttaactctatctttctttttttacatgttttttaaaccactaaacatgcttactaaatagtatatttttatagaaattttctttataaaagttacttcaaaaatcatattaatttattttcttaattttttaatactactctatcagtcccggtttagttgtcgctggggtgtagagttatttcccagaaagaaggtcgtttagctgtggggcagctagcatgctagccactagcatgagtacttctattaattttcttccctatacttgttgccgacatatcgaaatgacagacgccgtactagttttgtgttaattcttaagcattgaaatgattaatgtaggggtatgtaggttatttttccaataccatattttgtcatctcctttctagaacggctagtaaaattggacggagccaataatacttaattaattatgtgctaatgaataatactttttagaaagatgaataattttgtactcacaagtcacaagtacaaatatcccctgctattctgctcgattttttctcctctcctttctcgcaaacgccttttcttctct

SEQ ID NO: 66957 - DNA, 66405 bp, Oryza sativa
gggggggggggcgctgcggcgtacctcttctccggcgcggacgaagaagcgatcgaggagcggcgcggcggagagcggagacgcgcgtgagccacctcgaacaccaagccgccggcgagcggactgtccgccggccgcaatttgaccgcattgccgcaccacacgtcggatcggcggcgatatttcacatcgttatggacgccgcccgctaggggtgaaaaacggtcgaaaacgtcgggatcagtagcatgaaacgacgatcatttaaactactccctccgtcattaaaaaatatttagaactggatacgatatattctaatacaatgaatttagatggaggtatatctaattttataattttataggacggagggagttctcatcggtatcaaaaggtaccaatactaagcagaaagaaaaataaaaaaaattaaatttatactccgtgaccactttatataaaaatgatgagagatggaaatgataacttttatatagaaatggctctcgatccacggggaaattccgtgaccattttcacccttacgaggaatgcggctacgtcctgaaatgcaaagtactagggaaattttatgttctttttgacctgtttcctagagctctaacccctaaacctaattccatgagcctcaaatttaacagtttgccactcttacggatagccactcttcaaatgtcattcttctagacgtatttaattttttttccactgtaacaatttgaaatatctcttttgcccgtccgatcaccttcttctctctcccctctctcctagagaaagataagttggacgacagcatagctcggtgccgacagaggtggagctcaggacccacaatggtggcagtggtggagtgggggcccttcctatcactgctccaatctcattgccctttcctttcgcaaacttaatgttggtatttcttacaatcacatataaattcgtaagcgcatgaatactgctgtaacatttcatccaggagtattccaaatgtatcgtatttatatttctatagggaagacgacgaagattcatctaataatggtacactaggcagtggagaagaattatagaaagctaagattcatatattcttctatattgctaatgtttactgtacacttagcacatacatgtttacaatgctaggacttagttctatatacccagatactaccgagagaccactccctgttggtccgccagtatggttatgacattttacgaactctttcatcataccagacttggaggagtataaaggacagacagggctgtcaccacctaccgcctatctcattttctgtgggacatacccgcatccaactacatttaactaacctaagcatcatacttatgttaataaataatatcactaattcccctttgaaacccttcggatgaacaagttagaactagtgcagcccattaagatcattagatcgttatcgtaacgtaaatcgactagtctaatcaagtgaatttgtattaatgaagtataatctatttctggaacacataactagtgaactagtatataaactacgaacacaatataataaaggagataattcttttattgcaactatagtaaagtttgactaagtttatagaaaaaattaggagtaaattgcattggtagtacacaaacttaataggtgggtacaatttaatacataaacttgtaaaatactcgttttggtacacgaacttgtctagtttgtgcgaatgaggactaaaatagcttcacaatgttaattttgcaaagctggtgttgattaggatatgatgtgcatacgtgtaatgagtatgcataagacatgtaatatttataaatttgatctatactttatccttcatcacggaagtgatgaatttcatatatttataacccttatatcattgctcggtttttttttatcattttctacgatcaccatatcccattctatttttattgaagatgtgtttatctaatagcaaccttattagatatatgtttacatagtattctgatgagcccctaagtcagtaagattagccatgttatttccttttcgccttcctccgcacgcaccagacaagtttatgcaccaaaacgagcattttacaagttcgtgtactagattgcacccacctaccaagttcgtgtatcggcgatgcaatttactaaaaaattagcaacatctcaattatcaaattagttaaactaaatctagcattgaatatagtttgataataagtttgttttgtgttaaaaatgctactagatttttctataaatttagtcaaacttaaataagtttgactaggaaaaaaagtcaaaacgtcttatagtatgaaacggaggaagtcctatatagtcgatttgtgatttgtgtgtgtgtgttttatgtgtatgatttttttatttagaacttatcagggagggagtatatattttacaaaaatacttataaacactaatttcatattatgaaagtgtattgcataagtttactaaaaatttcctagttctgttggagtgtttatcctggagaaaaaatggtgacgttcttttccaatgaattgaacataaaggtagaatatggaaaacaaaaaaaatgctattagcacataatttattaaatttaattattgtaaattttaaaaatgtatttatttgataggttgaagcaacttcttttactggacgcgtgctggtcatatacttaatactaagaattgaaataacatcacagccatcagagtggcgcagcggaagcgtggtgggcccataacccacaggtcccaggatcgaaacctggctctgatatttttatttttcctactttcgttttggatgcagatgggtcgtctttttccatttttttctatagcaataagatcattttgggtccctttattccttacttttgttttggatgcagatgggtcgtctttttccattttctattggaataagtttattgtcggtccttctcttcatccttgaactgaaaaatatgtcacaaccaatcccccaacttacaaaactagtgcaatataggtatcaaagcgatttggacagtggttttagctaacataacacctacgtggctaatttgactcagtccatctaacgagccattgacgtggcacatgaagcaaattttaacaattaaaaaattaaaacaaaatatgtgggcccatatatcaatgaaacaataagattaaaaaatagtgggatccatgtcaatgggtccacttcctccacctcatcctccctcttctctatctcctcccttctccttctcccctcttcccctcctccttccccacagcaatggaggatagattggaggagctaacccaagcagcggatgaacgctagatgcgcatgtccccaacctctctcgcccccgcgcacggctgtggtggactggtggtggccgtcggtggctgctgttggcgactggcgaggaaggggctccaatgtcgacgaccgctgcttcaaggaggagcgacctctttgcatgttgtattgccaatcacccgctgagcctgcttcatctccttctttagtgacagggcgggaaaaggagcggggtgcggcgaccgtcgggggtggagcggctggtccgagcgagaggagagggaggacgcggggaggccgacgagcaggcgggcaggccagcaagcgcgcacggagagggaggcggtgatgaggccgacgagtgcgcagagagggaggaggttaggaggccagtgagtacgtgcgaagaaggagggttgtcgagttctctatcggatctagcaacgatggccacacaaagggcattgacgtcaccatgcctagcggcagtgcactctctagcggatccagccctagctacagcggcggcagggaaggttgctacggcggaggggaagaggggtcacgctgctcgacgcctgcaacaccatcaccgctcaccttgaccggctccaccaccgccgctcgttgtgccagttcgtggtccacctcctctcatcattgccttccttggtctgtcgcccgcatgccgtgcttgcggcttgccgaccatgacgagcgggccttagtgtcaccttcctcgccgctcccttcgaccagccccgcgaccgagtctccggcgccgcgagcttacttctcgccgtcaacgttctctcctcgctcgcagtggcagccgcaggcgctgtcctagctctacggtgacgaagacaaggaaagggggagagagaaagaggggagagaagaggggaaagagaggggtggccatgggtcccactgtcattcttttatttttaaccaaacactcgatgacatgtgggttccacaatttttgttttaattttaatttttacattttgcttccagtgccatgtcgtcgccacgtatgacaaggatcaagtcaaactagccatgtagatgtcatatcgaccgaaaccaccttgggaccttattagcaccgattttgtcagttgaggaacctattgtatttgatatagggcgaaagcaacaaactattgacaggctccaacttcgacgggaccaaaggggaggaggggcgtggtaggaggcagatctatcggccgcccaccaccacggccgattgtcattgccgttggctgcaacagggtcgagagacgagttgccgagaaaaagagttttggaactggaaaaggaaaagagagaaaggaagaaggtgaggatggagggaggtcgtgatgggagggaggcgccgccggcggcaccgccagcggtggcgaggtggtgtgcgcgtagggggagcgggcctcagcaacggtcacctcccaagcgacacgggagtcttcataatatgtcctcaagcgaactagctggcggatacattatactagtttttcggttgagggatgcgattcgaccaagggaaaagatgatggagataaaataaacttattccttttggtttggttttggttgcacgtggccagtctttctttagtaagtccactttgactcccttaaccagtggccgaatcttattcgtatctctcaaccataataccggatatctcgatccccgaactattaaaaccagtgcaatttgactctcatgacggttttgctgatgtgtcggtgttgaccatgtcttcatcccacgtggcattgacgtaacgcttatgtggcattagaattatgggacccatttgtcattcctacaaaaaaaaattgtgtggaggatgtggcggtgttgacctagttttcatcccacgtggcacttatgtagcattagaattagaattatgggacacaatttttttatgttgacctggtcttcatcccatgtggtgttgatgtgacaggacccatttgtcattcacacacaaaaaaattacgtcagcaaaaccaccgtccaaaaccaccaagggagttaaattgcaccggtttcaatagttcgaggatcgagatatctgaaaattgtggttcaggaatacaaatcagtttcggtcactagttaagggagtcaaagtggactcgagtccccctaccccgctagatcaccattgatagaagaggagatgaaaggggaagaataagaagaaaatgaagagtatgggaactacagaaggaagaaggagatgaatccccccttaaatcttattctggatccgtccctggttagcgggcaaaacttctttacacatgaagagttagggaaggatactatactccttggaggaggcgataacgaggtgaaactttgcgaccatggtactttacacataaaccttttcataccatatattttacaaaattcataaattcatttcgcaagaacccttacagtatgaatggttggttcagattgctaacataccaaaatggtaatgccaagacattcataaggtagcaaaagtaaacaccctttcaagattcttatcaatattttggtaacaccaatccatccagctcagaaatcatctggcattgaaccaagcaccaacaatagatacaggggcgggtggcgagtggcctagccccctcccacaacttttttcacccataaccactaaattaattaggcaaataacctctaaaactcttaggcccctttcatatcaaaatcctggctccaccactaccaagtactttattttcaatctaaagtattagcactatcaacacatttggttaggtaccattggtttgaccacaagttagcttaatccaagctctactaccattaaagttgtgaatcaatcgggaaaaagttcatttgagcttaactttacaccgaatcccattttcgtctttgaacccaaaaaccagatacaaccggtccttgagctgtcaaaattggtgcaaaagaggtccctcggtggtttgaatgacggttttggttgacgtggtgccaacgtggctggtttgacttggtcgtcgtcccatgtgacatttgaagtggcgcttacatggcaattcgatcccaaaaaaataataaaaaccatggccccacatgtcagctacacacaaaaaaataattaaaaatagtggggcccacatgggccccacatatcagcctcacctcccctcttccctctcccccctctctctccttcctcatcctcactctctttttctctctcccctctcttcatcttcttcccgatggcagacgggcgtggccgttcttcttgatgtggtggtagaggaagtcgaataggccgccagcgacgtggaggtagaagtcctccaccgggatgaggcggcggatctagattttttttttgagtctgagcaagaataatattatcgctaataattttgattttaaagctagggcctgtttggtacagctccaactcctaaatataactccagaagttgagtctagagtggagttgtggagttgccaaatcccagctccacaactctagtacattttgtgagagagctccacccaactccactcccagttttggtggagctgaaactgtttggctgagctccagctccacccctcctgtagctggagctggagttgcattttgatcgtaatacttcattcgatatatttttatagctagcgatgacaatgtcaagagctcagttctaagattgtttgcgcgcaggcaccactactattctttcttttcttgttatgcatccggtcctataaatcttttttttctgaccagaggaagagaaaaagagagaaatgtcgataagttaattcctgtggatgtctacttgccgggctgcccacctaaaccggaggcggttatagatgccctaacaaaacttcataagaagatatcgcgagaaatagttgaggatcgaactcctttcttttctatttcttctattggctggtctggggaaagcggatcacacgaagatctatagtgtttaagtccatctttctcttcctgcaatctactgagatatgcctcagctgcaggtgctttgtatctctggtcaagagttggcaagggatacttaacccatgccatccctttcaaccttggaaagtgttatcctagaatctatcattctccaaaaatccctaaaggccccccgggcttgacaagttcagcaaaaccgtagagaaagcaggttacacctagcttagcctatccaatatccgattcaaaaagagcttggattgctgcctcccgggggacaaagcaaagtcaaagcgcttgatcctttgccccatacttttagatcttcctccccaacaagcaacgggttgagcccggaagaagcagggattgaaccagggcttgttgacagagcagatatcaaaagcctatgttatctcattttcagggaccgagcaagggatgagcgccctctgatctaacgaccaaacaagcaactgcctcaggttttgaataaatcactgatggacggaagggagcgggggccagctcccttcctatgaaagacccgagcttactgggatgatacccctttacatactaatgggtgtaaacaaatagtacgcccctctactaaagtgggttggaaagcctgtatgcctaatctatgcagggtaggtgcgccgctacttatttctttctcactcactacttttttctattttcttttgtctatcgaaacagcctaggattcaatttgatttatcctagtggtgacagcttatgcttgtccttggaaccgggcgcggccctctttccgctattatgagcgggttttgggttagccagagcgggccaatagggataaacaaagtatggaagtagttgtgaggtaatcagatggctcaagataagttggagacgtacttgagatagataatttatgtatttcgctatttcgaatacctaaactcaagcggtgctaatttgctaatccaagccttatcaataataccaacacgccgtctgatccaagattagcaacctctctttctctcatagagggaacctcactgacgcattcagggctctgcagttgaagcgttccttcggaatacaccacaaatacactggtggatgtactgatggacacgacgagtacttcttctggggggccttccgtgaatcagtcggcgcgtgttagcgcattcggaaccacacatttttatacgattttcggatcatttgattttcgttttgaaaactttaaaaccttatcagagaggggccaccccaacatgatcaataggctgatggccttaccaaaccgctctgctcttgagctttctttcctcccttatggcggcgcattggggcactagaaatcaaagaaatctgctatgttatgtgttatgagtttgggacccagctgctgatgttagagctcttttcgaaagagcagcttatccaagtagttagtttccagaacagagcgagaaagaagagaaagagaggtacgcactgtgaaagaagcccacgttcccactcttctttcccccgttgatcgggttgttaaaagggttagtcctgttgttaggaagagttagcggtgtttacaccggtgtcatgtgtacggggatacgtgtattaagaaaaaaggcccagaaggcatgttttcgaagcttcccccgaagaatcgtcaccaaagacattcttccatgggttttttacatgggggggggggctcggttttgcacgcaccctcctttcgttattccaccttgagcctagtgtagttggggagaggagacccctggggtcaaggttgaatcaatagatcacagtcttggatcaaagggataagccagatgtcagtgggaaggcggattttgcatttggaggctttcttgcataccttttcgaattctttttgtatagcttagttacttcttcagcgtagcaggcatgcccacgggaggcaccctccaaatcactaaaagcagcactataccaccacaagtagaggcttcgcagtgacaaccttgatcgaatgtgtaggataggtgggaggtggtgacacacaacgaccaatcctgaaagaccactctttcgtctaaggatgcctaaccgccgcaccctggatccattctgacctaattggatgaatgaagaagagggcgagcagatacgacggatggtccaactacagaacttcttctttttcattacttccatggtcgtgccccgtggcacggaacggctgtttggagttgaagccggactagaattgggagcaaattccggcaacgaatggatgtcctcttttcttcttgtacggccctggtctgcatcgggagaatgggaataacgatcttttatatgatacggaaagcgaagagaatagactgctacatactaagttggttattcgtagatttttaatcgattagttaacatggtggttaaccgtattatgaaagacggaaaaaaatcattggcttatcaaattctctatcgagccatgaaaaattttttcaacaaaaatgtgaattaggaaggattggtcgacgaaatatgaatcgaagactgaatcttgatatacctcataacagcaccttcttgttaccgcgaaatgcaataggcaatcggctagatggcacatccaacctgttcacagttttatgctgctggcacttcagaaaccagagctgggattggtagcggttccacttctcaagtttgcatattctgatcacacaatggaattcaggtggaccagggtttgggacactaatctttaaattatagatgcattataacatgtcaagggaggcgccgagatatgatatgaccaaaggccttgttgttgttgcgaccactgagtatctagggtcattccctttaccaaacattggagttgctgctcgctcgaaagcttttgctttcttcggtactggtacttcggtcaaagtacctaaacctcactaaacctatgctctagcttcgaaaacaggccttctgggtcttttttctcaatacacgtatccccgtacacgtgacaccggtgtaaacaccgctaactctccctaacaacagggtatggggaggggagagaagagtgggtatgagggcttctctcgccatccatagccccctttctttaaaatgcaaagtggacgttcccgcacgaacggcgtgaactctgattcgatccgggtattcaatcccaccgctgagatgctcagttgactccattatcgaatggggcagacactcccatgagctatttcaaccacttactaacacagggacaccaccattttaaagctgaactatgatcttctttcgtgcacatctcgctttttttttcatttatgcgaatgaattgcagaaccaaactaaaatgggttgatcggagctattctctagaatttcaaacttgagatgacttgcttgaagcggctgaggctcttcctaatggaagaaaggacatccaatgttaggatggatctaattcaagaatttctagctctatacgcgaggaacggatgctgttttgacttttttcttcttgctttaatccagtcgctcgataggacttcccgtaacccgaaaaggttggttcttcccctacaacccctacccctccaaggcagtactcttcatcggcaaatccgaatgtctcgatccgagttgagacccacctacagaaattgatccatcaaagaatttcctgctgctatcatataatactcatctctatttggtgataaataaaccacctgtctctctttttttttctttgctttctcagatattttagattgaaagccatagtactaatacctaaagcagtgaaccaaatccctactacaggccaagcagccaagaagaagtgtaaagaacgagagtttttaaaactagcatattggaagattaatcggccaaaataaccactttttcaaaacctatcattaagggcgtgacgacgatatacgagaggaataaaaaaaaactcgtgattggtgtggaggggaagatctgcttatgaaattgttcaagaaagagtcgtctcatttccttatattgaattccttctatggttccacatgagaaaccagtacgaatataacctacatgtccaatcgaattatgagctagaggtcttttgactttcgttagattatcttgaacataggtgcgagtaagttgtattgtttggtctttatagctacagtttgatggtttggtcgttgcttcctcgttttctatttattcatctaattaatctccattataacctacgagacaaagtgattaactatatgattaacgagtaatatgctgcatatgcattggagcattgtggtgttgtacgcatggagcccgggcaattgcccatggtggccaggcgctgcatccgccaccaacagtcgacgtcgcggctgatgagcgtggcgtggagcgcaatgcggccggctctccggcccatgagcttggtgaggccgacgccgttcactgcgccctcggtctccacgtgcccggtggcgatggcatgctgcgccgcgtccaccgccgtgtggaacccgaacgagccgccgctgctggacctcacggtggattgtcgccgcgccgcgcatcatgtcgtccccaccgccgttggggtgggacggaggaggagcagaggcggcgcagggggacgaggatgcaggaggtgggccagcgagggaggagcctggaaggtgaggtaccggtggcggtgagggcggggagaggaaggcagcggctcgaaggtggagtgcggtggtggcgcgcaaggtcgcctcctactgcccacctcgctcacctgcgggaagagaagatgaagagaggcgggagggtagaagagagaagtgaggatgaagaagcagagagagaagggagagggaagaagggaggtgaggttgacatgtggggtccatgtgtgcctcatcatttttaattattttttaactgacatgtggggctatgatttttattatttttccgggatcaaattgtcacgtaaacgccacgtgggatgacgaccaacctaccacgtggcgccacgtcaatcaaaattaccttctaacccgccgagggaacttgtttgcaccggttttgacagttcagggatcggttgtatctttttgggttaaggacaaaaatcggattcggtgtaaagttaaggacgtcaaatgaacttattccaatcaattggtatgtctcatattttggcgcagaaaacccaaacttaggcccatattttggtacctcgggaatgggccgggtacagtgtgaacacgttccagccatatataaccccttcgtctccagtccccatcccccccttccctttcctccacccacgccgcgacgacgagtcgccgccgcggcctcgccggcgaccaggtctccggcggccccgccgcccgccgtgacggggctccggccttccgccctcctccccgcaccgcccgctatctcggctccccgactcctgcattcccccgactctcccccggccgccgccgccgccatttctgactctttctccgcggcgcgtctctcctccgagagcacgccgaccgcctcccgaagcggcgtcgcggccgcggcggccgccgccttctcccgcccctgatggctggcgattcccgaaatgaggcgggttctttctcctttgcctttttttactgctcggatgaaatttgaatctgtgtatgcttgtggttgtgatgaaatttagcttgttctgtccccgcagccgatgttttgcgaggaagggagcagtgaatcgggctatgttctatgtgttattgattcgctgaagaagaaaatcacatcggaccgctttgtttacatccaggtgatttgatttgatttgattgtttggagctgcaaatctcggtcattttcttgtattttctttatttaccagctgattagttttgttccccgtgatctttttttccagaaaagggtagaggagaatagcattaagcttagcccgattacactgcactctcacaatttgtcaaaaaataggcaaactagtacatccaacagtacagatttagtctcgaatttgctcacaaagaggaaagaagatgccctgtgtgctgtgaatagtcgtgagtcatctcctgatgaaagtgaaggtgccaattgccaagatgagtgttcatcgactgttattgtgggtggaaatctatccgcgaggaattctgtccgtccgattagactaccagaagtggcaacactccctccatatacaacttggatatttttggacaggtgcattttcttgacatccctaagatccctgcttaaattacatagttatcatggaaagttatagcgtatacactttattatccattagcaacaacatagcaatactatttcatttctcttgctaaacagtaaacacacgctcatttgtggtctttagttttttgtgcaacaatctattcagtcaaacatagtttttccgacctaatgctttatgtctctggtgattttttttctcttcatgtgtaaatgtgtaatggagatattgcctttcgttcttactataagcttgggaaatggtatagtataaaaatggaacaagtccttatgcggccccttgctacgtgccccacctctctcttaatcacatgcagttgcagacttgcaggctgggagtgtgtgttaaaacaagagcagcaaatgccacattgactgccttgaattcatcttcttggctttggtagcaaagctattgtgccagaaccattggctttgcctgctgcagtgtttcttttgcttttgctgtttcatccgctttatgcttcttagtgttctctttgctattgcgtgattttgtggagcagcaagcaaaaaatcagactgaaacatgtttttgatgaattgtttgttgatatgaatttaacagtatatctcatatgacaaacttctatttttctaaataagtaatgcaaaacatgcatggtcacagttacaatccagcatacttttagtttggagaggtagggcatcttaaggtttgttgaaatataagattttacaatctttcgtgcaggaaccagcggatgcaagaagaccaatctgtacttggtcgtcgaaggatttactatgatacaaactgtggcgaagctttaatttgcagtgatagtgaagatgaagctgttgaggacgaggaagagaaaaaggagttcaaggattctgaagattgcataattcggtaaatatgctttggacatgcatttgttttcttttgccttgaacattcactaaggatgctcaacttgtttgaccgttacaggctcatgggaccaagatacaggtgcagttaccatagcacctggagcttgggctcagtccatagaataacagatctgatgactctgtagtaatagtttcatggagaaatgctttcttctgtaagcattttgtcatattctctgtttttcttttgactgggaaaactaccaggactttgcctagtagtgtaatttcattaaagaataaaaaatagtaatattctctttttgaagtcacaatataacatagtacagaagcaatagagaaatgatattaaatatactggtcaagtaacatttggtatgaaatattcccaagagattatttagtaaaactacattattaaaaacttgtaagaaaaagggtttggttttggggcatatgtcttatatcattaaatgaaatggtcattaccagttttatctacattgttccaggggaaaaccttgagctggtcacactgcatatttgacctggttttgttttgtgcaacccttgcacaagcaagaaaagtatggttacagcattaatctgagttgtttgtggattaatttagaccttaaacatcatagatcacaataatttggtttctcctgtatggaattcttccacttaagggtgattttgtgcaatgattgccaggatgaccattcaagaatgtggcatgtctgatgctgtgcttgaaactctagctcgagatatcgaaagggctcctgatgatataaaggttcatacaacatttattcaatctcacgtcacatttgcatttgatccatttgggattttcctcttccaacttattgtttcatttctgaaaaattaaattacgtgtctattttccaggccaggtatgagatcctacaaggggagaaacctgagggttcttccaagaaagtgtctgaacttaatgtcaaaatggaagacgtgtacggtgataaagatctggatgcagcattggattcctttgacaatctcttttgtcgccgatgtttggtacgttttctgttaattgtcatgtgtgttttacataatatctctggtttactgatgaaacattctgctcattttgatgttggaaggtttttgattgcaagctacatgggtgttctcaagatttagtatttccggtaattttcaaaccaatgagttatttcctaaacttgtgtgttgttctaattagtgtccttttcgtatagactgaaaagcaggcaccattgtgcagctcggatgagggtacaccatgtggtattcactgttacaaactggtctgtattttataggcatatgactgtggaaaagcagctcttcttttatgatgatttagatatccgaaacataagcatatgccgttttgctgatctttacctcatttataatctttttgtcaggtctctaaaccagatgctatcatggagattgattctcatttgcttgttgatgttgaggagccaacatcggacaatctaaaggatcagatagggtcaaataagaaaaagcttggttctagtgggcagaaaacaaaatctcaacaaagtgaaagttcttcaactgcaagggtttcctcagaaagcagtgagtctgaagtacaactgttaagcaataaatccccgcaacactctcctggcctctcaaaaaataagcttggcgcaaaaggtggaatcaagaaaagtactaacagaagaattgctgagagaattctaatgagtgtgaaaaaggggcaacaggaaatgtcaccggactctaattctattgttaatggatgccattggcctagggatatgaagcttagatctgatactaggagtggaattaaggattctgttgtatcctcacagtgtaattctccaagcacaaggagttttagaaagaagggcacacttcaaatggagaataactcatcttttgtggatgctcagagtgattcaatggaggatacaaataatgaacattcagcaacagatggttgtgatagttcaaggaaagaggaatgtgttgatgagagtatatgcaggcaagaagctcatggcaggtcctggaaagtgattgagcaagggcttctattgaaaggattagagatttttggaaagaacaggttggtcccttgaaatgatcagcttcatatgaattatttcactaccttctacttcatcttaatatttgtatactattgcacaactaactgctgtatctgttcaggacagagtaaacgttaatgtgtctaatccctccgtcccaaaatataaggcgtgctttgacttttaattgtcaatttctcacaagtatactgtctatactctatagtggaaccaacatcatatgaaagtacattcaaatatgaatctgacaataccatttttatatcactaaacctatatattgtcagactagttgtgagtcaagatttgtaaaatttgaattttaaaatgcgtgcacaccttatattttggggtggagggattaacctttcagttcagcacaagaaactgactatgctttcttttaatatatctgtattactaaaagtattcaacacaaatgtctatatttaaagcaaatgctcttgcatcataattagacatccccgaaactatattcttatactactacatttcaagtaaaagctgtaacatgaagatacaatctacaatttgtcatgcataacgtattggaatgcggaattaactggaatttctaatgtttgcatcatttagtatctagttgtgttagttatagcgtttcatgtacaagaaattctgatgtatgttcatttcaaatgccttaaaaactcattcctgttttctttggatgtcttgcaagcatattggaaatgttctttatcctttctataatgagtagaataccttgttttccctaatttgaatagtcatactgagcccttgtttttcctatgttgaagttgtttaattgctcggaaccttctgggtgggatgaaaacatgcacagatgtttttcagtatatgaattacattgaaaacagcagtgcatctggagctcttagtggtgttgattctcttgttaaaggatatatgaaggtaggattcatcataaagctcatttacttgtattttcccaaggtttcatcttactttaatgcttgaactcccagggtaatgaattacggacaagatcaagatttgtgagaaggcgaggaagggtccgccgtttgaagtacacctggaaaactgcaggctaccattttataaggaaaaggattacagaaaggaaggatcagccttgtcgacaatacactccttgtggttgccagtctgcatgtgggaagcaatgtccatgtctcacaaatggtacctgctgtgagaaatactgtgggtgagctacttcaattattcatattgcagactccgagaacattttttcttctagatattaataatgttgcttatgaaaacaaaactgtgtagatgtatacaatttcaatattgtttggttagtgccgaccaattatgtcgtatgatcacatcttagttttgcaatcattgctgcttactgaaaaggaaaggaaaataaaacctaggaggaactaggcaccctttcaattaagaggaaaacaggcaccaaatttctagttgaagaggacttgaaccttgatggtgggagagtgagggtgtaaactccgcatttctcacccaaatggtgaatcaaacacatgcttctcttttgttctgtgtgctcttttggctattagctattacttattttgataatttataattttaattggaataaatgatgcaaacacatggagtgcaaatgtttgctgtccgcatcctgctgatgcaagttgaagtaatcctttctgcgttgcaggtgcccgaaaatgtgcaagaatcgcttccgaggttgccattgcgcaaagagtcagtgtcgcagccggcagtgtccatgctttgctgctgacagggaatgtgatcctgatgtgtgtagaaactgctgggtagggtatgtattttaaattctgatgaccctttgaatgattttgctagttaatgcacatttgtatatcttagagaaaggcaccaactataatgtgcttttcattctttgcacttctccaaccttacatctaccttgaaagttgagaaattaccacctatgcctgcacttgaaggatggaattttgatggatgatggatttatccttaagtgcaggaagaatcttgcatatgtatattccagtatctgaagatacggagttctgcagtaaaatatcttaatggtagaattgaatttaattaatataatcatatcaattgcttgcccaacagtcccaataggcaatagctacattccacaattaaaaaaatggtgcaataataataatttgacatttccttctcataccatttgctagcatacttgatagtgtgtgccagcacattgacaattgatattctatatctaaattatttataacaatatctgagttttataggagtgtttaccaggagttaatccatgaaaaatgtatcaatgatgggggagtttaatttgaatttgttatgaacgagcttctaatggtaggaaatgaaattttagatactgtaagttgttaggcaaacaccaaagatgagtatattatccggccagtgtgtaaatccaatcatgatcctttttcactccatggaaccttaaatatgctttctgttattcattgttgaaatagtctgttattcaatttcaattactgtttcttcatccctaatttttctagaacaaagcgccagtacattgaacttctatttttctacctgtactttctattgtgcaggtgcggtgatggtacattgggagtccctaaccaaagaggtgataattatgaatgccggaacatgaaactgctgcttaaacagcaacaaagggtaaaccttttgcactttgatttattcatgctattgcaccttggttataatttcgtcaagcctatcgattttttatgcctgcttggcccttccatttgcctttattcgatgctttgatatttttgtgtgaggaggcttgaggtctaagttaattacccagcagtacttctcaatagttttattctttttttttaatatttttcacgtgagttcaaattccagttgtctaaatacaaaagatcttaagtttaataccaaagaaactagttagagtaactatattccaaaacaggcaatgaactatgaaccaaaaaacttcccattagcaggaaaataattgcataaagtatctatcgattatgttggtgaatttatgaaacaccagggggtgttacttcattttctattacaggtcctattccatctctaaatatctgtaaatagtattgacttgctatgtgcactcttcaggtcttacttgggagatctgatgtttctggctggggagctttcctcaaggtaagatttctctattgacccttttcctccctcataggacgtaccctcatctaactagtccttttcctaaatcttcagaatagtgttgggaagcacgagtatcttggcgagtacactggggagcttatctcccataaagaagctgacaagcgtggaaagatatatgaccgtgagaattcatcgttccttttcaacttgaacaatgaggtgagtgcaaagacaccccgcaaattacggtctgcaagcattcaggattgcatactgtactgatttgactagcctaatgtcatccttttgcgtgaaccgagttgtttacatccccaacccactgttgttcaatatcgcgcgatttatgatccgctgcagtgttttcgctgttttcgccagtaccggatgctcactcactcactttaccctctcgatgaatgcagtacgttcttgatgcctacagaatgggcgacaagctgaagttcgccaaccattcccctgatccaaactgctacgccaaggtcatcatggtagcaggcgatcacagggtggggatcttcgccaaagagcggatcagcgcgggcgaggagctgttctacgactaccgctacgagcccgaccgggccccggcgtgggctcgcaagcccgaggggcccggtgccaaggacgacgcccagccttccaccgggagagcaaagaagctcgcccactgaagaagaagaagaagaagaagatcagccgttgattcttttgttgtcttggttgattctttcgttattggtgagggggaccgagaactctgacggtgattagcgccgtaaggaaaactttcctgccattcgttggccccctcgattcgattcgttgattttccctgaattctgtaactgctgcacctgtcgccagttcaacttcaaaagatttttctgattctggatcagttgttgtgttcttatgtgttacttttcgaaaatacaatcaccatctaaaatgcatgcatgacactgttgacttttcggataactttggcccattcatcttatataaatatataaaagtataaatagttttttattgataaaacaaatcataacaaaataaatgatatttatattttttaataaaataaatgatcaaatgttttgaataaggttaacggaggagattaccgagttgtttccttcgtgaaaagtcggcgagagctggaagccagcgatggctgggaatggcgtggtggcgttgttgccaagggcccacataccatacaccgtgcgaacgccgcggcaaagcttgatgcgaggcttgtttatctcgtctagcagtagcaggcatgggtagggtcaatgggctaatctgcgtccggcctatcctgaggcgttgtttcaaaagatctatacaacaaaactaacactccgttttgtattataaaacgctttgatttttttcaaacctttttaagtttgatctttgtaaaaaattaacatcttaatatcaaattagtttaattaaatttaacattaaatagattttgatagtatgattattttatgtttaaaatattataatgttttttataaactttgtcaaacttcacgaagtgacttaaattaaagttaaatcgtcttataatataaaatggaaggaataaagagtatattacatttgttgtacacaaatttatttaggtgggtataattctatatatgaacttattatgaaacattcgctgtaatacacgaactcgacatggtcagggtggcgaggagctccgagtgatggcagatggactctccatagatcgaccccctgtgatggtgcgggaaggtgcaagggtgagcagccacaccgtacgccggtgaaggagctccttttcctcttcctcctcctcttcttcttcctcctcctcctcctctctctgcccttcccttctcgatgaacaaaggagccgaagttgcagcctgtgagttatatccctccttccccgaccactactactttctgtccctccatccccagctccctccctccctccgctcccttgacatggattggagaaggagcaaggtgctcgcagcggacgcagggctcaagctcctccacgtgcaactagcctcggtaggtgaaacctctctcactttatcgatgctcagctcctccttgcccccaacccttctcactaccgctcagtcgacgttgaccgcctcctttgcttccgaatagaccacctcttctgccaccaacctccatcttatttagatctcattggcttcgacatagcctaggcagagctcctagatgtcgaggcaacaaagctcggggctcgcgaggaaggcggagcttggtggcagtctgacgagatcccatggagagcgaacccgttgagttctggtgagatccgttacccttgaagccttatggagctttgcctcttgttggcgccgtccttgaagccttgccaaggcctgcctctcaccaacaccgccattgaagcctcatcgagctctcttaccaacgccgatctaaagcttcacctctatcggcttcggctcagcgacggaggccacaccatggggaagagggaaagaggggacacaaagcagaaagaagatgtaagtagcaatgacaggtggaccctctctcttatgcaaccaatgtggatctattgtataggtcaataggtggcatccacgtgtagtacaatcaccgtaaaatagctcgaaggtggtaaatcatcttatactaatagttggcgtatcatatctggttttataatttctaagtatattttagaccaccatacgatttcaagagagtaaaatggataatcccccataataaatctcactagttgtgtgatatagcggcgtatggacactaacaaaacattaatgcagccaaagcaaccccccatcatatctctcttggccccccatgatatatgaacagaagttacagaacagtagcagtgggggtacaccctataccctccctgggggacctctgaatacttcgatcagagtaacggtgcggtgccaaactgatcagatcacacacttcagactacagtcaaacagagcccttgcttgctttgcttgtgtcttcaacttcagagaccccctcctaccctcaaaaaatttcccctttcttttcctccgtttcttgcagcgacaagagaaatactaatactcctcctcctactactgctactgtgcaaggggaaggacacgacgacgaattggagagcggcgtcctctctgatccttttttttcctttattgcatctctctctctctctcgccatttttcttctaggttggtctctggatcaggccattgagggggaaagaaaaggtgcgggttttggggggaggttgttcttgcgggaggccgttgatttcgccgtgtgatcggaggtgaggttcccagaaaaaaggtttacaatccttcttgtgtttttctagcctagtagttcttggttcttggatgctagtacgcgtgtccgtcatcttcttgttctttgtgtgcgccttccgaggatttttattttccttccctttgttatttaatggtgtcagtggattaggtttatgtgtatctgtgttagtcatctcagctcagctcagctcagccttgttgctttcactgactgactgtacttacatttgtttaagtgagattaggtcgaataaattagtaggattccctcaaaagaaccatcttttgtggagttaggtggatttggtgctcatccgtgctactttctcaccctagaagcttttgttcaccacccagattttggtcttcagggagtgaaaaggagatgaatgagaaggacgccactgatttggaggagaggagtgaggccagtgagcacggccaagctctgagtttccatggtggtgccatgttcttgcaagaggctcagattgcttctcctgcagctgcaaataatgcattgacctccatggcgaatcctttccctatccctcctgggttgtggaatccaccttcacacaacatgggtttaggcgaaaccagtttttcatccttgttggggatgctgtcggccggcgcgccgccaccgtttgtggctactcccgggtttgtagattccacggcggggtttccttgctacaatggaggcaatcttggagccatgatcaatcaccctttccctggtatccaccagcctttgggtgatttccaaaacggcgtcgagccatgtagggagattgaggatattgagattgaaggatccaagaatgtgtcacaaactggtgagaagcagcaaggggatggtgagacaacgcatgccgtcgattcctcctccaaggagctaagcatgccagggcgcaatggtggcgctggccatgatgaggggactagggtgtcttgttccaagaagaggaaaagatcaggacaggtatttgcttgatgtacacatatttacagagctgaatctccgcatatttaggtggagctaagaatatgaaattttcttgattcttgaaggatggtggggtgaagcatgcagaaggtggtgagcaattagcaactgtcggttcagcgcagaagaatgaggatgatgaaaagggtgaaccaaagaggtcttctgtggcgtccgggaaatccagtgggaagcaaataaaggataatgcaggttcaccaaaggaagactatatacatgtaagagcacggcgcggtcaggctacaaacagccatagtcttgccgaaagggtaggtcctttttttcttctctctaatgatctcttcataaaatggtgtatctagccatctggtttgactgttattgttcgggatgcaggttaggagggagaagatcagtgaaaggatgaaatatcttcaggatcttgttcctggttgtagtaaagtaagtgcttcctaactgtcccctgcctccatactgaatgactgttaatctgttatgacatcaattgtgaaatgtaatctaggtaactggtaaggctgttatgctggatgagataattaactatgttcaatcattacagaggcaggttgaggtatgatgtttgtaaaacttgtagggccattttcagttttacttgcatagtcctgctgcgatgtaatctggtatacccaatgtgtgcatgttgggcagtttttgtcgatgaagctagcaagtgtcaatccaacactggacttcaacatagaacgcattttatctaaagatgtaagatagttctcacctggtctttatagattttgaccctttagatttgtctttctcatgatgattgtttcatccacacagatttttcaatgtcgaggcactactgcatcatctgcctttggcttcttcccagacattgttcatccccgattacacccaccaaaatatacacaagttgggatgcccagcattgtgaaccccactgatgcatttggaagagtaatccatgctccattaggaactaacagtgcattcaaagaacctaaacatcaggtttgtaccatcacttgcatttggctaaatggccattttcatttcatgctctttataccaaatactgtgttcatgaaaaataggacaagtttctgcaagatgttccaagacctaatttagtgttatatggcttggtgtttcgagaatactgctccacagatagtcgttgaaaagaatgtccacataatattttaaaccaagaaaagctagtcccctttatatccttttgctgggtcttgcttcactacccatctttccaaaaagttcgtgggtcttaaaagcaaagcaaactagataacataactaaactgagacattttagacaacaaacaaaattcctactatctgtttttcataactagccagattgtgcctgattcttttggccatgcaagctgtttgaacctagtccatcaatcagtctctttagcttctgactcattaaccctcttcaacctgattttagtgggaagagcattgttgatgttaaccgacattgtaacctcagtagcactaaccatttcactagtaaaccaactaaaaatgtacaaatgcagcttgttatatatctaattgtatcttcatcactacatatttgccttcacagttatctaaaacatatgctttcatattcataaacatttttttggaaagcggagtaccaaagcactgttttagtattttgcaatcctcttattacttgtgcattggacagatgcccaacaatttgaatggagagttccaggacgtcattgagatgccttttactcatgaccatcatggatcaaatgatcaaccctgagattgattccacaactgaagcaagagatcaatatgtgccatgggctttcagcaaaactgtgatatatgagcatgttgatatcatggtactagctcacagctgatcactgaagtataagcatccaaaatgcttagttagtgctatttttctcatgttcatagcagcaattgacctcctgtggaagcctctctttggatgttccatttgctgttatagaaagttgggagataaaaaaaaaaggatgttcacatggagatctcaagcaatttgttctccactgaagtagtctacagtcttgaaatggcgagaagcttcattttgcaagaaggtgatttttctgtggtctcgtcaaccccaggattattacatacactagctagcattgtgaggctacagaaattgttctttgttgtacttgcttagcccatgttccatctgacaagcaacataggcagaaatgcagtcactgattttgtatttgttgaaaaaaaaaataaatgggcttggcctgatgtagcaagcatttgaattttgcaacgggtgcatattggcacagatgtttttattccagcaaagctgtgaattctgaaagagaagaaaagagaactgtgatctagtgttactggtgaccttgtgtccttgttaagacataattcactacacactggtattggtgaccttgtgaagcgataatcatctgatctgaagctgatggtcatggcaaaagcagccaaggaaattaatctcatgaaactcttgctcattgtttcactgaatctgataaaacatgacatggcacgtttctgaagcaatctgaggtctgaacactacatttttgctgcatctatatgcaaatatttctttctccaagcaaaaacaccaatccacaaaagacaatttctgaaacaaattatacatacatgaagaaaaagaaactactacctatgtcaaagagcatataatcttcccctgctataacaacatgtactagctacattgcatctgcagtgttctttcttttcttcttctcttttccctgtgaacttgttcagtatagttacaagaccaaaccaaatacaccaagcccatatgatgtagttctagtagttacagccaagaacatggcaagaaactatggagatgaagatgaagatgatatgctacaactcgacggagacgtaggtggcggagtagtccggcatccggtgcaggctccggagcacgctctcggcgacctgcttcgtcgcggcgtcgcccttgtggaacgcgctcaccagcgcgctcggcagcgcgcggtccgccgtcacgtcgcgcacgcaccgctcgccgccgtgcgccaggaacctctccacggcccagaagcagcgccgcgacaccgcgccggcggtgtcgccgccgacgtcacggtgctgccgcagcgcgcgcaggacgtgccgcgcggcgtcgtgctcggcgagcacggccacgccgcgttccacgtcgacggcgtcgtccatgagcgtgcagagcgcgcccagcacggcgtcgaccacgcggccgttctcgttgctctcgaggacgccgacgagggcctccaccgcgccggcctccgccaggcagaacgtggtggccggggagcacacgccgcggtgcaccgggcagaggcgtccctgcgccggcggcggtggcggcttccggttgttgtcgtgcacccgcccggtgtgcgcgtcgcgcaggcgccggaggatgttcttcttcttggggcgccgttgctcctctgatggcggctgcgagaggttcaccgactggtggctaaggttctcgaggccgaccgccgcgagccgctgcacctcgtcgctgcccgctgaccgcacgagcagatcggtgagcaccgccgtgaagttgtgatccatggccgccaggagcacgtcggggtcgtacagcgtcatcgtcatccggacgagcgcgccgacgaggccctccatgtacgtcttggcatggcggctcactcgcatttcgccgcgctgcatctcctctatcttggccagcaacgtcggcactgctccctgctccagcagcgccaggttgagcgtgatgttctggtacggcagcctcgccagcagcgtcgccgccacggcgtgccgttcggtgacacgcccgggctggccgatgctcttcaccagccttcccggctgccctggcgccttgcagagcttctcggcaatggtgtgccccatctgaggagacaatgcaatgagcagcctcgtcgcgctgatgcctaacgcctccgtcttcgagcccatgaactcgatcacggtcaggctgctgtcctgctccttcatgacggacaccaccgtcatgagcggctttgggagcgcagtgagcgcgagcagcacacgtatgatgctcaggttgagatcatcaggcatggagcacttgagcatgtgggtgaagttgtacaccgaatactttgaagtgatgacatggccttccttgttgacgacgatggtgtcgggatcgagaccggactcgacgatgttggcgagcactgcagcagcctctgtcttggaccccataggctcgtcgtcgatcttgcggatgaagagctcctccaccatgaccggaacagcaccggcgtcgacgagagtcttgctgttggggccatctgaggagatctggacaaggacatcaagggccgccttgcggatcacagtgttgccgctatgcaccatcttgatgaggatctctgaagcactcccagcaatgttgatggtcatttcctgcttctggaccagctcgccgaggtagctcaccatctccatttgaacatcttcagaccctgttttatatggtgtttcatgtcaggtaatggactaatggtagtgtcatggtgttaagttcacgctagcgaatttcatattagtcatcagagcaatattactatatctagttataactgcttgttctttgttaatgttcaccctgtactgaagtacatgtattcagaaattgattgatctaatgttaagcacactatttacacaaataaataagttctctattaatagtccacgatgttgacttttggcaatataaacttccttatttgatattatatatgataattaacacatcaaagaaagtcgtgtatctttctgcataggcaaaatttttaccttccactaaatgtctttggagaggatccaggtaaccactttcagccatgtacttaatgttctttgggcagttctccaggttcttgagaacctccccagccttctctgcagcaaccggatcatctgaatcattgaatttcattgtggtaagcatcaatatgcttccagaagttgatccgatgttttccaacaatagctccgatttcgaaagctctagcaagaaagagatggctgcatgtctttcatcaggactattactagaaagcagctttattgttcttgtaatggctctggtatttgctatgacttcctgtacgtcatgaaggcatgaagaagaatttcagttttgaacaaacacgcagggtaattgtttcagcatttaaataagtttcacacaaccaggccagcgaaaacattgaacatgataagggtcaaaacgtttcaggcttccttacctttcctgtttcatcctcagccaataagcaaaggagatccagcgaatcacagcgtatcagaccatccttgtgctccaacaaacgagggaggaacttagttatcccgattttgtgcatctgttccctgttctttctccttatcttggccagcagcttcagctcttgtatggcctcaagcaacattgcctctgtggaagccatggagagcgcggttcgtgcaatcctgacccttgtggcttcatttctcataatccattctgcaattgtgctcttcagtggaacattgctcctcagtgccttgctttgcatcgacatctttgtcacagggcataccacaggttcagaaccatcagcaaatttctcaaagtactcctcaatggctttcctatcatatgtcacaccactttctgttgtcactggatcaaccatgaccttgtttgtcaatggacagaagaacgaatcatataatggctcgacatattctgcaacttcagggagcgaattgaatgaatgtgcaccgatatcatgtgattcatggtacattccctgcaggaagtccaccagccttggcatgtcactattgtgcaatgttcttctccggggcctgctgtttgccgggattatcgacatatcggcctcagagtaaccatcgcaggaattctggtcacaataacgcggccgatgtcctgcaatctgaaggtttgcatctgctctgccatctggaaacctgctgctaccaaatgttgaagcaggtatcctgctgagctcatgcccaatgttctttatgacactgtcaaggtcctcggtcatgcccaggaggtcatcgttcttgagctcccgcgcaacggcgctgcacctcatgacgaggtccttggcgaggtcgacattggcagccagatactccatgacgtgcatcacattaaccgtcgaattctgcactctctgcagctccatcgtgaccaggggtgcatggtagaggtggctgcctacatccatgaagttctcatgctcggcatcggctgccgcctctggcggcatgagctcagagatcgcggcctctatggactcaacgagtgacgccttcctcgcctgcgctccgcttcgctgaacaagagtacatgtcaatcaggcacccaagcaaaagcatccaaaaacacagataacacacagactgttctgttgtgatgacaactacagtccaaaattcatacagtccaattataaagcaataatacaggctcccttggctgcaatcaatctgaggttgacccaaggggttgagttctacacaagcaaattgacttcccccaattccaaatttttaacagtttgttccaagaactactagcatcttatctactgtacagtgaaaaaatcaccaggaaaattgaatagaggacacaaataacacaagggggggggggggagtacatcaagaacagcttgatgcacattctacctggaaatcaacatcgtttctccgttccatctaaccaaagtggcaaaacgtactaccaccaccataaatttgctcacttcaagcagggttcgccatctctagcgcaaagaccccccatgaatccatgattcctcgccttaccaaatcacgaaatacaaacagaaatggcacaagaaccgaggaatttgcgaatcacagcctcactacccacctttacaaaaaaaaaatccatgaaatctaccgaaatttatggcagcactacgaattagcagcaagcgaacaagccagcttcgtccccccaaaagagagatgcagcaaacagcaagctcaactcccccacgcttacctgcatccaagaactccaagaacttgaccgcgccgctgcttctcctcctcaccttccgctccaagctcctcctcctcctcccgagactgagaggacggagacgctacgactggggtagcattctcccctcctccaccaccgcccccgccatggcctccccactcctcaaacttacagcgccaccaccaccccaccaccgctcgagccgaggaataataccacctcgctcgcgtagggaggaagagacgagaacaaaagagggagagagggagagggaaaaaaaatacggaggaattacggaagaacgcgcagtggcagcgcagcacggagactcagtcaagtgaaggtcagtttgttaatcgttataagcaacctctccctaatctttttttgttttttttttcttgaaaaatgtaaacctcctgttttagactttagagatcggtaataaagcgacgttttctttttggatggataaaccgataaagcgacctttcttttaacaaccacctttctaatggcgttttaccttgggagatgttgactttttctttttcttttttttcttttttgtttttacagtgatggtgcttagcttagctgcaggagtcaagacttgcagtgcacaccaatgtatgtgtcaaaccacagactaggcgtttaaatttttttaaacttggcccaaagattgttttttacggcaagcttaagcagatgttttgtttaaagaaggtggttagctatgtgccaactgtcataaatttttttaaagtataaactgatggtttcttccctatttccaaacagtttctagctggtatgcaatattcggtcaaaattcggctgagtttggttagactggaggatgtaaaatatatttttggttgctgtattagattttgagcctgggctactgtttagggttaggggactcccatgcgaaggttaggctgagtgtttgggaggcctctctcccacacgcaaaacagtgtatgcattaactactttctccatctacttttgatacttatattttatcttggcacacagaccaacgataagtaattatacttatcatccatttaaacatgctagtcattcctcgtaaacaagcgattcattaatatttacatttctcgatgcccatatagccaatcttgtgtggaagaatggagagtcacgtattaaatccgagaaagatattaagaggataggttgttggattgaaatatgcctatcaaaaataaatttttcagatttggaaatatgactatcaaaagtatatggagggagtaattaattaaatattatttattttgtaaaaaaataggactaatatgattgtttaaaataatttttgtatatttttttaaaaaatacactgtttagcagcttgaaaagcgtgcgtagaaaattagataaatgagttgaaaaggtggagaaaagagctcagccttacaagatatttctggtagaagattttgtttgattaattggttatataaattttgagtttatttatctctttatttgaatggtgcggttactcctacacctccaatagatataaatatatatatccacaacactcgaaatataatgtgagatagtgtggtctatttgcactgaacaagtactccttccagtcacaaatgtatgagacagtgtggatcatgatatggttaccaatatacggagtagtattttataagagctactatgggaaagttataatattttgaaactatttttaagataaatctaaccatatcactttcaaaagttagatcgaaatatttaaagagaataatgattcaaatttaaccatgtttaccgcacacattccaaatcgtcacttatttgtgaccggagggggaaagcctaaatatcacaaggtcaccctcatcatttccatcgcccttcgttgcaatcaccattgagctggtcaatgcgttcttaccacgagtccaagggtaggggtgggcattcagaataaccgagaaattcggttcagttcctcaatcttttggaaaattcggtcttcagaatcacaataccgatcggttttcatgaaaactcaagaacgagcactttggtcttcggttagttcggttcgttctcggtcatagaccgaactaactataacaaaagttttaaaagcaaaaaaaaataaatactccatacaagatcaatgaatcaaagcaactcgcatgaaaaagtacatgatgccactagaaaatagagcacgattcagaaaaaaaaaggaagaatatcaaagcaaatcgatattgccatgacttggatcctgtcgctttcatccccgaccggcctccatcatcgaggtctccggcacagcctctttcgccatcgtggtgcggatagccatgagcgtcaggttacagcagggtcgccggaaggagcacgatctcttccgccacaccaggcgaaagggcggctcggcgcaatgaaggtcgtcgctagtggcgccgttgcatcgtgaggaggcggagggcggaggcggtgccgacacggtggagcctggaagcggcgagatggagacggaggctgagcgcgaatgcacgatggatggatgcggcgctgaagatgagataaggatgcgggagatagggtggctaatttacagggtttagcgttttactgggcttattggtcctcctagatctattgggccacaattcggttttctcgattaaatttggtcttttgatggctgggactgaactactaactaaatttctcagtcttggtcttttcaattcggtctaatgctgcccgcccctacccaaggcaactaaatcttttcaacgtcaagcttcttactgtttaagaagttacatactttctctgtcaaagaaacaattcttgaattgatttgttttatttttaggacagatggagtacgcgtgaactatatagttgtgtttgctacatacattttaaatcgttatttatttgtgaccgttatggctactgatcggtcgtaggtcttgcttctgttgggcctagagtcggtcaaggtaatgctgcaggggtggttgcataagacagttggtttgatgcaactatgggtatgtttagttccacgtcaaaattggaaatttgattgaaattggaacgatgtgatggaaaaattgaaagtttgtatgtgtagaaaagttagatgtgacattttagggttcaaagtttggaactaaaccgggcctatatttgggagagaattttaagaatcatatatgggctgtgtttagttcatactgaagtttggaagtttggatgaaattggaacgatgtgactgaaaagttgtgtgtgtatgaaagatttgatgtgatggaaagttggaagtttggaaaaaaaaacgttggaactaaacggggccatggtcatagtacctacatggtctctcaaaaagtgggaaatgattgaataacaaacgatttattgaaattttgtaactccatgcaggaaatggtccacgttttctttgaaattgagagccgacacttccctttctatgaaatttatgcaagatgtcatgcaccaaaacagcatgataactgtttgcacattattcatcattagctctacccttggcctgatcaaaatatgatggaggttgaaggaaaacattattcatcattagctctacccttgacctgatcaaaatatgatggaggttgaaggaaaaggctagctactactactagagatcgagtagagacaaaattatagcagtagtattttttgagttgtcactcaccctgattgttcatgagttcttcaatatcacgtctcggtcttttaattctgctccatttccctcatcatgaaggcgtctaggcattgatggcctcaggctgctgctaaatcactttgggaaaaaaaaaaagccaggtatgttcccttcaaacttctaaaaattccattacattaaatatttggacacacgtgcatagagcattaaatatggatgaaaaaaatcaattgcacagtttatatgtaaattgcgagacgaatcttttgtgtctaattacgccatgatttgacaatgtgatgctacagtaaacatttgctaataacggattaattaggcttaataaattcatctcgcagtttacatacggaatctgtaatttgttttgttattagtctatgtttaacacttcaaatatatgtccgtatatttaaaaaaaattggcatacgaaataaacacggccaccatcaagaactggtccagtggaagctcattaataagttttctgatctcggtctgaattttgttaggtggtactactactcctaattaagaaagccagtgatcaagggcaccttggtagtaccagtttgttagggcaacaaaatgttgctgagatttcttttgcattgtgttagaattctacgccattaattcttaactaacagtacttcattagctgtacttcttggtagtgttagaagtacaatactaagcatgtaccctagctctcccggttaacgcagagcacgttaaatatgatagtatcaacttgttaattatatctatagtgtctcaatatatatattttttgacttgcaataaaataaatcaacactttttgtataatagaaacattcaggcctctacatccagatgtgtacttgaaaaatccaaaaaaaaaaaacaatagattatttgcatgctatcatgattctttaacacgttataaattaaagaatacttcctctgttcttttcttgtattgaactaaccatcgttatatattaaaagatagagatagtataatatataaagattaacgcgtctatttttattttaactagaatatgagcaaattacaaataaaaatgacatattcgctccttaccattacaaatgactactatgttctttaaaaatataactactgttgacagttagatttggtacaaatttagggtgtgtttagttcacgctaaaattaaaagtttagttgaaattagaacgatgggatgaaaaagtgaagtttgtgtgtgtaggaaagttttaatgtgatgaaaaaaattgaaagtttgaagaaaaattttaaaactaaactctgccttagaaaggagtcagagccttttcgcaaaggtcggtcggacaacaattcataccacggtctgactggatgccttgtgatttttttttgtggggatctgaccagttgcctactgcagttgaccaagggtttgtttagtttccaacttttttcttcaaatttttaatttttccgtcacatcaaactttcctatacacacaaactctcgatttttctgtcacatcgttttaatttttttaaacttttatttttggcgtggaactaaacacagcccaatatggtttaaccagcagccccgagttttaggctaaggccttgcttagattccaacttttttcttcaaacttcaaacttttccgtcacatcgaactttcttacgtacacaaacttctaacttttccgtcacatcgttctaatttcttcaaactttcaattttggcgtggaactaaacacagcctaattgccttttgtttgtgtgtgtgttttctcgcttgggattggatttctcaaatcttaatgtatatctccaagcctaatagagctgtttcaagagcaaaaccggcctccgaaatacaattggcaagcttgatcttgaccctgtctagcaagctcatccattaccatgctagctagaatgcactaaaccttgctctgattgatacaactcagcacagatcattcttagcagcgctggtagaatattcaaaataaaaccgtagaatcattctaatatgtccataaaataaacaaattaaagcataattgcatggtagaatcattcagatttctgtaagcacaaattaatgtgtaagttctcaactcgaaatgcagtgtacacgtactatatataaacttaaacatcatatatcgatggagatagctagctactcctagatacgtacggaggagttaattaatctgattgggggcaaattaaaatcattggcatgattgttcgttgttggaacatgggcaccacatgcaattgatgatctgatagcaatccatataaccgtgtagatatctagctaacaggggtttaatcaaccgcaggccggtacagaatttaaaataaatcaaattagcaatgtggtcatctaatctctggaccctggcaagacatatatttaatgaatcaatggggtcacgaagaaatggagtactgtgcctgtatgtgatcttaaaatgatgtttggggagcacggaaagcatgcatgtttggaacacatgaatatgaatgaatgaatagtagtacaagtaatggccttgtcgccaaaaatgactcaaaccgtaccatttcatctgaaactaatgcaatttaatggtcggtggtttattaactcatcgagcaaattttctgtccaagggcccggagtatatattgttaacatttcaaaacccaatacaaggatttttgcaggactggaactcttgttaattatggcggaataggagatttaatttccatgtaaaatcttgtcgatttctccaaaatttgtgtgtgcaagttcaacaatccagttgaaaattgatctcatatgttgtctatactcttttaaaagtaaataatcgtggtgatgagtggcgaatctatcaccactctcatcgaaaaatgaagctagagggctcacatgtcattgcacgacaaattctttacttttgtggaaaggaaaaatgattgtctgaaattagatggctcacatatcagtaacaaataaatgtcgaaactaagagatgatatatacatatacagaaaatgataaaatgatactaataacggattaatgacctattgtaacacatgtgcaatatggtagtaattttaaaatattactgacaagtcgatttatgctataataaattttggtactgccatttttttaaagtttcctcaactatattaagtcaatactagagatactattgaaattaccaagtgttcactgttccatattttattactagatgttttgggttggtctcaagtcagaaattttaagtttgatcaggcttataattcttttagcagcatttgtaaacaaaaacaaatatactataaaatatattaaatggtggatttaataaaactaatttagtgttatagatattgctatatatactttttatgaatttagtcaaagaagtttgacttaaaattaaaaaacatcttataatataaaatgatggagtatatttttagcaacttatgttttggtgttaaatcaaatcagcattgtgtcaagctctatacgctcataaatatttgacattacgataagatttggtaaaacttttgaagctttggcccattaacaatttcccaaatgcttagtttaattcataaaaaaagatgtatgtatggatttgccttaaaaaaatactaacataatgacataaatttattgtttcattcgtttcaaaatataaattaaaaaatatattagtacataagtatttttaggcacagattctaatacacgagaatctatatattttcagctaaaatgatatgcttaggtaggtaatttaaacaattcaatttgaccactaagtcgattaaaagataacattttttctctatcttagttttttgctaaaaatcatagaaatggttatatttttaacaaagggagtagattttgtaaactcgtttcaatataaaattgatggttaaagctataaaaagtttgactaataaatcggatcattggaagcgaaatatatatattgaagctgaaattcgtttgtcatggatcggagctgaccgttgcaaattctctatctgaaagcgttcattcgaatttgagtagctagaaacagagggaagggtactttattatcaggcttacccaaattaagtcgagacaagaacaggaagtagacggagaagaagatggccggagagtggagacaccgggaaaaatacaaaggacgagctaccgccgccggccagcacagcgccgcaatgtactggaccagcgcgaggcgacgagcacagcgaacgacggcgtaccttttttgtttgggaactcgtcccggattctcttaagatttggagcagctccgtcaaagtttaatagcatagcaactgttgaattaaatttaaaaatatattgttcattcaattttttctcatgaatattcgggatgcaaattttttttataaatataccgtcgatctcgcacaaccgttgcgcgaaaccgagatgggtgtgacgtcatgggcggtatcgcgcgttgaaagtgcgagagcgcacggtctcgcgcggcgaaggcacgagagcacgcggtttcgcgcaatggaagagcgagaccgttcggtctcgcggaatcaaacagcgaaactgttcaccggttccatttaattagtgcttaattacttaattagcaattaactaataatgattagtaactaattatcctaattagcgactaattaattattaattaatagttaatcaagataattagtcgctaatcgaatcagcatggcaccggtctcgctcagtgcttgtgcgagaccgttctgtctggctgtaccattccacgagaccgcgccgtcgtcccgcgagactgcgcggtctcgcgccttcgccgtgcgacaccgcccacaacgtcatttccacgtcattctcgcgcaacgattgcgcgagatcgactatatttacgcaagaaattttacatcccgaatatttgtaagaaaaaattgaataaacagtatattttcaaatttaattcagcaactgtcgacaataaattgtgtgtcatatcattttaaaaatgtacacaaaaatagagcatataatagttaactattaacacaataagggggtgtttgggaactagggactaaatttagtccctctcacaaaagcataagtccctatgtgagagggattaaagtttagccccactttaatccctccaaccaaacaccacctaagcaatacacatattttactaatacattttaaacaaaatctctctttccatacacaatactcaatcccatgacttactatatgtgttactattggatctcactttcttagagctcgtgtgtagttggctactagttttaggctgtgtttgtgttcgggaggaggggttggaacccttcctcttggcacgcaaaacaaaacatctattattgtgtgattaattaagtatttactattttttaaaaaaataaattaatataatttttaagcaacttttgtatagaattttttttacaaaaaccgtaccgtttagtagtttgaaaagggtgcgcgcggaaaacgaggaagggaggttgggaaagtgaggaaacgaacggagccttagttgcccactctctctcctccacatgggcattcaatactacatgacatctggataaaacactatgatagacattagactatagcttagggtatgttcggtagagttctaaggctgaggggctgtttgtttggaggggctaatccataagtccctccactctagtcccttttagcccctaaaataccaaacaagagggactaaaagaggctaaaactacctaggtcataagtccctgcgggaggtgctaattcggactaaaggcctatagcgcacctaccattaaatggatgaagcatgtaggtgctggataaagtgctactagataggtcatttaacgaggttttagtcacttttagtccctccaaacaaacaggatagaactaatgaggacttatgttttagccctggaactaatttttagctctaggacttatggaacaaacatgacctgagttatttcttcaactttcccaactcacattcctcgtgttccgtgcgcacgcgttttaatctgctaaacggtgtgttttttaaaggttgctatacgaaagttgcttaaaaaatcatattgatctatttttaaaaaaatagctaatacttaattaatcacacgctaatgaatcgctccgttttccgtgcgcagaaaatgtcttcccaatacaggctgcagaacacaacctaacttctaaggccgagtttagtttcaaactttttcttcaaacttccaacttttccatcacatcaaaacttttctacacaaacttccaatttttccgtcacatcgtttcaatttcaaccaaacttcctattttagcgtgaactaaacacactctcagggctggccctgactttttggtggcccattgtggatcaaaaaatgaaggcccccattcaccataaaaatacaagataatatttaaaaactcattgtcattaacgaatttcacactaataagtttaaaataccaaaaagaaatttctctagctcatttaaaataatttcttctaacagttctacatgcaaaattagttatgatagtgtcaataataatctcatctatatcttctcaatgcacaaagtagcctatcagggtatatatattttggaggcctctaatttttggaggcccagtacggtcgcactacccgcactgccctagggccggcccttcacactctaaatttaacttgaagatttatgtctggtacgggcgtggcggagcagcctcaagcccactcactttgattcagtttattttaatagcactttactctcctctgttttatttttagatagactctgagacccggtttagatgggactaaaacttttaaatccctatcacatcagatgttcgaacactaattataaatattaaacgtagactattaataaaacacatccataatcttggactaattcgcgagacgaatctattgagcctaattaatccatgattagcctatgtgatgctacagtaaacattatctaattatggattaattaggcttaaaaattttgtctcgcaaattagttttcatttatgtaattcgttttgtaaatagtctatatttaatactctaaattagtgtctagatacagagactaaagttaagtccctacattcaaacaccacctgaaaccagagtctgaagctgaagctataattgtgacaaacagatttcagtagcatgaacacgagggagggatcctgcatgtattacatagtactccctccgtttcaaaatgtttgacaccgttgactttttagcacatgtttgatcgttcgtcttattcaaaaacttttgtgagatatgtaaaattatatgcctacataaaaatatatttaacaatgaatcaaatgataggaaaagaactaataattacttaaattttttgaataagacgaacggtcaaacatgtgataaaaagtcaacgccgtcaaacatttcgaaaatgaaggagtagtcggtttcgtgcgtcttatcttgggtgtcgtcctgtctgcctagcgcctaccatgacaccgtcagaaacagtgagacaaacacgatacaagacaagcacgtactgtaccgcgcatacgtacagcaatacagcagcacatgagacaagaagacgacgaaatgaaggaaattaatcagccgcgttccgttcggcgtaggccacgcgtgtgcgttgggccacacacaactaactccttcggctacagacgtactctctctctctctctccgttccctaatataagagatttttatattttatttgtattgtttgactacttatcttattaaaaaatttatgcaaatataaaatacgaaaagttatgtttaaaatactttggataaacaaataataattctaaatttttctaaataagataaatggttaaacagtacagctaaaatgtgttatattagggagtactagcggtggccttttgttttgtgtacactaccaaaccggggtgttcatttctctctctctcagccgcacaggcgcacagcacaatcacacaaacacaagatcagctttcgcaaccgttgagtgcgtggagaccctctgcgttcgataaacatcggcgccgggggaaaaaaggcgtgcttcgccttgtctcgtccggtcgcggccgctgctccagccagcctccaggcagaagcaaccggtcaacggcgcaggcaacgccaccgaccgaccgaccaccggtagtgctcgtttctcgccgagcgcagcagtcgtggaggagggcctaaaacgccgcgcttttgaagagttttcatagaggcaggcggcggcatgggctttcttggtgccgcacacgcgtgcgtgactgcacacgatggagttaagccatgaattaagttcactttaggtcccttgatttgttgccgaatctgatatacgctccctgaaccgcagcgtcagatatggcgtgtccctcaactcttcgaaccagtgctaataagattccaaaatgatttggactgtggtttcggatgacttgcgctgcccaccgcagagctgacccttctccttccctacctcgtcgttgacaccacctcttcttgcatgtgcttcccacctacatccttcaccgctaagcgagcacaaataaaaccctatgtctttgagctatatagggctgcctacttgccccgatccatcttcctctcttgatttcttgctcctatgcaggttcaattcttgtggtacgagatttgggcgtacgagataaaaaaccctaatatttgcttggttctttcacgcccgaaatttctatccaaaattccaaacgcttacatgtgtataaatcctcgtccaggaatcagccgaggcacacaataacaaattgataatagagtacaaattattactctaatcaataagcgaacaaaatgtcattacagaggtagatagttcctctcaatcaataaagtcctaagcagcggaaaaaataaaagaaacagcgcagacgactcctctccacaggcagcttgaccagggctacgcctaatcatcaactccatcaacatcactgtagaactcctcctctgattaatgattgcaaggtgagtatatgacatactcagcaagccacacagcaaatatgcaagtgcacaggataacaaaggatggcatagtatagtctcatttgcataaacaacatttaataaatatttcagaatttcataaaacagtagagtattaaataaacagtattaaaccaacgctatacaacataccctgttgtataggcccaaccatcatgcacaaccaatcccggctgcacaagtctatctccaaaccaggaattaaccattccaaatcaggagctaaacaagttaataacatcatcatttaatatagtgtgggggtgagactaatcacgaaagacattgttagacccgcccataaccgcggacacggctattcgaatagtttaaactctgatcagaagtgtaccactgtacccacaagacacaacctcaacatcatgtcaaccatgcgtcgcgatacttgacaagtacccgaatagagagattgtgacaataccctctatataatacaattcaaagcagtgcaccgttcccggatcataatcacccccttataaacaaggtatggactccccagtgacccccgtgggcttatctccgccacttcacagtctggtgctctactatgaaccatactatacagaaagtaaagccgttgcccacgctggcttgtggttggcacggtaaatgtttcacaaccgaaaatcgtgaaccgatccttaattgtcatgagcacaaccatcaaaaccatatgctcacaacccaccattatcatattttaattgtcaaattaattaattaaccaatcatgattaaccatcatgagctatcattaagccatcattaaataatagtgaatcttaaattatcccattagtgaactaatgtttctaagcatggctaagcaattatacctaacatctagctgaaccattatatgaagctcaactagtcaaattataatagcccaaggtatcaaagaataaagtaaatatgtacaaaagggccataacaaagaataggttacttccacccaatgacattcgaaaatagatgcaatagttgaatagaaacaatagctttaaataggatcaacatgctcaaagggttgtttgggatctgtgtgacttgccttgctggccttgaaaatcctcaaagtcttctcctgcaaaatcggactctccgggaacgtcggaatctaaagaaaaaagagcaaaatcaccaaaacagcacataaacaagcatgaacagtacatgtggatatttttaacatgtagatctcaattttagaaaaatttagagacttgaaccaactaaatccgagctaagatgaattagttatgaattttcaaagattaaatcgatttaaatcatttatatggattttaattgaattatgacgcaataatgaattatttttgaaaaggaaaaaggggtttattgcgtcagcgggctcggctcacggtggaccgggtgcacagcgacggttcacgagattggacggctgagatctatcctatctacaacggacggccgagatcgattggatccaccgcggctcacggatggacgacgacgatgacgtcagcgacgacgtcaccaccagcggcgaccgaaccgtgcgagcttgtcggcgaaccacggcacgtgtaacgccccgattttcgttcgggtttaaaaatcattaaataatgcattttctagaaattaaataaaagttaaatcaatttaatcaagtgaaataatgggagaattaaaattttcccttaaaaatcattggccgggaatattttgtaatattctttgtgccttaaaatactctccggatttttccgtgaattttcggagttcaagaaataattttaaagtcacaaagttcattaaactaatttaaataaaaagaaaacaaaataaacttccccttcctccctttcgggctcggcccaaaatcctctctccttcccctcccgcggcccggcttgcctccccttttggcgcaagtctgcttttcatccctcccggcctctcctctcactcaggccgacaggtgggacccgtgggccccacctgtcatccccaacctccagcccgggccggcaactgccatggccgcccgagccgcccacgtcgccgcccctccccgcgcgtcttccgattcccgcgcgcgtgtgggcgcggtccaccccacgtcatccccttcctccaccatttcccccacttctcccctccaaaaccggcgccaaactgcccccactcacccatgtcgccggcgcccctttcccccttcaaatccgtcgccaaccggcctccccgtcgactctcgaggctataaaaacgatccccgggctcccctcatccatttcccccattttccccaagccgccacgccctccctcgctctccccgcgccgagcccttgcaccgccgctctccggcgaactccagcagcgccgcgccgccactcccgtccaccccgcactgcgccgtcgccctccccggcaccgcagccgccgtgcgcaccccggcatccactccgttctctccttccacccccgcagcaccattcccaccgcgaggccgagcttccaccgccgttcgccgccccagccgcccgctactgccgccctaggggctgcagcgccgcgccgtttgtgtcgtcggcatcgcggtgccgagctctaccccgacccctagtccttttcccctccccaactccgaaacaccgccaccacgtgcaccacctccctccgccgtcgccgctcccgcaccctgccaccaccgcagccggcttcgccgccgcgaggacaagcctgtcggccgctcccctcccccaatcgaccgccaagctgtcacctccactgccaacccgaggccgccgccgctttcgccgccccggccaccgtttaccgccgctcccggccgtcccgagccgcacccgtggccatcctcagcgtcgccgcgtcgtgccgcacctcggttgccgcccctcgccgccgaaattccacgggagcccgcttttccccgttcaaggtcccggaggcccccggccgtcactcgtcgcccgtcggccgccgttggggcgccgccgtcgtcctcgcccggggagctccgccgctacctcgcctccgtccggtgccgtgccgcttggtgagcatcccctttcctcctcttctttccgccgcccttcgcgcgccctctcgcgccgccgctcgccgccggtggccgtgcgccgccgtgcgtcgtgtctcgaccgggccggctctgagccgtgcccgtgctctgggcgccctgcctcgtggccgcccgatcggctcgagctgatctgggccatcggttcccgtggaccggcggtggaccaccccgtggtcccggtccacggtggaccgattcccttgacccgctgacgtgtggggcccgcctatcggcgccggcctttttgatgacgtcagtacttaagcttttcctttgaaaaaataattaataattgcgcaataaatcgagtttaattctagaaattcatttaaatggctcaaaacttctaaaatccatatctaattcattcgaactccgaattgagccgttcaacttgcaaaattcatctaaaattgagctctacatgtttgtttactttttatgtactatttccttggtttttattagagtttttcctcgttttgcgtgccagcgtgtagtttccgtcgtttcggaagtccgcggtcgcgaggaaaagagttcggaagatcaaagtgaagaagcaaggcaagtcacacattccccttgagcatgttgatcctaatttacaaatgttttactgtttgcaaataaatatgcatgttttgctaattacacgggatcagggtttacctatctgctcgcttgtgccatgtttacttgatatctatcctttgtcaacattgggtaataaatcgactagctcatgttacttatgtgacttagctagaactatatgcttagccatgcttaattaccactagctcagttgataggataattacagtattagacctttttagtatcagagtgagctgcgtgctcgagacatctggccatgcttcatggtcgtaattatccaactaaaatacaactgaatggtgggctgtgggtgcatggttttgctggtcgcacccatggcagttaaggaccggttcgcgggatgccctggaagaacttatcgtacttaccacaagccagcgtgggcaacggctaggcttgtagtgtagctttcctctagtcgacgcatccaggcaagggtgggcgtgatggagcggggcgggccctgcgacggcctctgtcgcttccggattcacctaggcacgagaggggactgcccgctgccttgcgaggagtgggggtgaaacctgaggtgtggtgtgcttgattagagggggttatgcgaagggtcctgtcacggcctctttccggtatgtcgtggtggcatgtcggcgcacggaaacgtgtcgtggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagtccaggtgggttggttgggcctgttcaacgtggtgtagcgttgatcagtggagatttaatgttactttaattactcaacagttttactgttttgctcaataaaatgttttacaaccgcctttatgcaaatagccacaaaccgtccttgtgttacccttgcacgtctgcatcgttggtgtggcttgctgagcatggtggttgtactcagccttgctattattcccccttttcagaagtgtagtgcttctgagttgaagacgaagttagaagaccaaggctcagaccccagttgagttttgcctgtggagtggagctgaagccccgctaggatcgcctttttccgctgctgtcgttctgtttcagtgtgaggactaagtgcctcttccgtaagtattttacgctttatttacgtttggaactgtatattacttgtcgttttgtgtaccctggctggtcctggacagggatttaatacgcaaaatagtctggaaatttgggttaaatttctgggcgtgacagcacgacagcgcgaacggaaagcacctacgggttgcgggcggcacggcgaactcaccggcgaccaaagcgacggcggacgatgaccggacgacgtcggcgacaaggaagaagcggcggcaaccttcggcttgacgacggcgacggtgctccggcggtcgacagcgacgacgaaggggcgaacgagaacggcgacgagacggcgaccacgacggcgacctccccgagcgacggtgacgactggagcgacggcggcgcacggctggagcggcggcggcgacggcggcgctagactgcacggggctagggcgctacgggcggcgagggacgaaggcgagggtggcggcgggtagcggcgggcttgggggtcaatttatagcggctaggaggcggcgacggaggcccacggcgaccggcgacgagaaggaaagtctagggttcggaggagagagaccgatccgattcaaccttgaatccacgaatttccaaacgattttagccgatgattccaaaagagaaaagatagaggagatcgagaagatcatttcccctctattgatttcatcggaaacggaaaggatcggccggattggaatggcggcggcggggcgcggctagggtttcgccgggaggaagacgacgggccggccccacctgtcagcgggcgaacgcgcgcgcgcgggcggctgactgggccgattgggccgagggagagagagaacggtttgggccgactttcggcccaaagcctaaagaggattttaagaacttttttcaatttaaattattcattaactgcaattccatttattaaaaatacttctttagctcaaataaatcccagaaaaatctaggaattatagaattaagcaaagtatttaataaaattttatctggccccattttatattggaatttatttattaaaattagatcttctcttctaggctttttaaaataaattctaataattccaatttaacaacaatttataatttggagatttttagggtgtgatagttctccctatcttgatttggctttcctcaccgccgataagaggatgttgggggatgggaaggagatgctcaaattgcggggcagggcggggatttcaaaatcaggcactatattgactgggacctcgagtacatcggttttataagttgagagatgcgttatatctagtattgttgttcgaggatgtaattcaaactcgccaccaagacgagggacctaaagtgaacttattcctttgacggctacaacaaatgttgctgctatgggaagaattaagggttaattgaattcatgtcactataaattttacaattttaaattctactattattattcatgtaattaaaatcatgccatcacaacaaatctaatgcccctatctctttgctttaatggatgaccgacatggatagcgctagtggaaacactgaccagcggcgatggtggaaagatgacagcgactggggaccaagacatgcacatggtgaggagggagtcacaccaaggattgacgaaggtaaggtagaacgtagaattggcagggatggtggccctttccttctcggtcaccgctaccaccttcaggatagctgcatcgatcaccacccacggatcctcctgcttcgctagtttcggcgccgtaacaaacgaagactagttgttgcctcaaccatcagcgtagaactgtgtcgaggcaaccgtaatagagctctaccaccggttgtacacaactatgcctaaacctgcccgccagggatacaccagggccgtttctactggagtggtggtgcctcttggctcgagcaccgccacaagtggcttcgcccagatttggagagagcgagagagggggccgccggatttgctagggccgaaccctagcgccagaacaagattcgagccctagcggcattgccgttgtttggccgtcgtccttgcatcattagcgtcttaccatcctccacttgcccccgcgtaccgacatcctctgctcattctccctgcgccgctagaatcaggctgtgtttgaggggaggagatataggagattgggaagatacgcaaaacgaggtgagccattaacacatgattaattgactattaagtattttaaactttaaaaatggattaatatgattttttaaagcaactttcctatataatttttttacaaaaaaacgcaccgtttagtagttcggaaagcgtgcgcgcggaaaacgaagcaaaactcactcacaatcacccagatcacccaggaaagaacacagcctcagtcttcattctcgcatcgcatttggctgccgtcatcctcgtgatgtcctcgtcccaaggctgacaactcacatgatttgcttggacattggtgatggcaaggacagctacggcatgagggcagggacattttagtacatacaaaaatattgcctaaaaattatttgaaacttgtttcaggcgtacagtgtggtatggatcaaattttgtgcttcttatgatggtatggtttcagttatataaatagtaatagattttaaaacctcaaaagttataatattttataatgatatagatcaaattaacgcaggattaagagggcagaaattgactcggcacgtttctgcatactgacacgcaactgtctgtcagcgtcaaaattaaacatattctttttttacgcaaaattaaacatattcttatgcagcacgtggtatcactggcaaattaggctgttgctttctgaagcggtgctgtgtgttggaatcttggagaggaggtggatatgtactaaaaaactgacctcttaatatcgtgctcatttagaacgtagaatctgatatagaataaataaataaatgctgctactccatccaattttctctactaggggttatcagttataaggcgtgctcgtagtaaaaaaacaaccgtaaaatttgaatttctttagaagacctaaaatttaaattctattaggtatatactcgactgcaacggattcatatgactatatcattgtgaataggtgcacaaatatgattactccctccgtgttttaacatatgactccattgactttttaataatgtttgactatctgtattatttatttttttgcaaatataataatatttatgacatacttaatgaatatttgatgataaatcaagtcacaataaaataaacgataataacatatttttaataaaacgaataatcaaacattggtcaaaaagtcattggtcaaaaaatcaacgacgtcatacattaaaatacagagggagtattttctttaccatcacgcgtgaggggaggcaggctaatgcgacattatctttaaaatcgaatggaagtaaaactcaaaatttacaaagtagggcaggtcaaacagttctctttcaataaaacttgcccaccaaagtttaagttctaaacttgacatgtgtggtcgtatttgtcgattaattatttttccagtagagagcgatgaacgatacaattatgacaacatacttatagggtcataaagattggtagggtaaagttacgctgttcaattaaatgtggtttttattagggataatcctaatctacgttatatgtaatatgagagagtatgagcctctgtggcacgaattgagatcctctgcctttaaatacatcatgccttttattactgacacgtgatcccatatagtttatcggtttcacatgccaatgacaaacacattttgaaggtagtggagcctgatccccgtggcacccctctggcatcatgccaaacttgccaagcgagaaaagcgatcggtacacacatcgtggtgaccacgaaggaggagccagccacgtggaccgcttcaacgccaggagatccgcgcgccacgtcgctgccctgtggggccatccctcgagggcatctcaatctctatccatcaatccggcccggccccacctgcagttggagagagcgcgtggcagcgtccacgtcaccagtggggccctggaacgtactacgccagatgtgacctgatgaggttttgctaccctcctctgtcatctcgtcattactgacatgtgggcccacgcttcaccttggcccaccggtcattggcgtcctggttaatgtgcgaaaatcaaggagagtggccatcaacaggcaggagccatgagctggcccccacgagaagttgttggtgttgggattgggaatctgttggctattgcttgggatgaaaattaaaggaaaatctataaattttgttctcaaatgaaatgaagggttgatttggtttgtggcctaaattggtcttaccaattcgtcaatgtcaaattttggtaacttttagcatggctaattttggcaaaagtaaaattatgtttggattgaagccaaaatagcctaaattaactgttaaaatggcatatttttttaggtatgtcaaaatttggctccaaaccaaatagacaataaacactattgaaattgccaaatattggtaaggccaatataggcctcaaaccaaaccaacccgaagttaacctgtgatcctcctcctgatcatgtgctcacagaggttaatttctctgagctcagcaaaccatgttcagttaatcaatttttgccatcaagttagagtgaaaacatggtgaaaccctgaatacacttggactgggttaacgagatgataatcgtcccatgacttggaacaaatggccatcatgacagtcacatcaatatattattagcactacatcatacacctaccaaataataacaaataaccttaagtccttaacaaataataagtgcacaaaaacacggagaaaaaataacaaaaaagatatccactcgcaaatcaaagaaagactggcagagtaaggctgtctttagatcacactgaaattttggttgaaattggtacgatgtgatagaaaagttgtgtgtgtatgaaatgtttgatgtgatggaaaattggaagtttggaaaaaaactttggaactaaggctatgtttagttcagcgcaaagtttggattttggttaaaattggagatgatgtgaccgaaaagttatgtgtgtatgacaggttgatgtgatagaaaaggactaaagtttgaatccatctaaacacagcctaaacaggacctaaacaaattcctaactactctagctaaaatatcgcagaaaccctccccacaaattaattgatctgcttcctcctcccctcctctcatgtcattgtcctgcaatacacgaggagcaaagagttgtgtgtaatcctcctcctactctgggtcagctcttaatcccttcaacttccgtcggttggacgccaccggaagccaatccctgtttggtgttttacccccaattttgtcagattttttggagcgaaaccacgagctgtttgaagtgttcggcttcggaatctctttcttggagttctaggaatggggttttgatacaaagattgaagcctttttgttagcgttggtgcaaagattgtattgtattgttttttttttctgcgatgggtggaggcgtcacggagcggctcccggagggcagcagcgagccgctgctcccgacgaagcgggagggcggcggcggcggcggcgagttcgccggcgcggtgttcaacctgtcgacgaccatcgtcggggccggaatcatggcgctgccggccacgatgaaggtgctggggctcgccccggggctcgtcgcgatcttgctcgccgcgctcctcaccgacgcctccatcgagctgctcgtccggtccagccgcgccgccggcgcgccgtcgtacggcgccgtcatgggggacgcgttcgggtggtgggggaggcggctgctccaggtctgcgtcgtcgtcaacaacatcggcgtcatgatcgtctacatgatcatcatcggtaaaaaaaaaattcgatacaacaacctgaattttgacttcaatattgccttcactatttagttgttcatgtgactctagaattgctgaatatttcattttcttttttacttataaccatttctctagaagttatatcatcagtatcggttcgtgtggaatgtagagtagattgcaaattctgaactaactcaaatgcaattgagtaatcgattgaggaagtttggccttctaattgtgaactgtaggatatgatgccttctgaataaactcggcagttttgcttacatgtgagatttaagttgcgttctgcattgtgctgtagataatcgtaactgtttatttgaggccataatttcgtgctgaggcatggcagtgtatctgacatacacattggggtacttcactctaggtgatgtgctatctggaacctcctctggtggtgagcaccattatggtgttttagaaggatggtttgggccacaatggtggaacgggcgtttctttgtcctcctggttacaactcttgttgtatttactccactggcatgtttgaagcgtgtcggtaagtagtctcttcacttagccttatactttcgtgagattttattttgtaccattttgtcgtactgccaattcatgacatcgctatgtttttgtttgtttcttgcagattcactgagttacacatctgccatatccgttgctctggcagttgtttttgttattattactgcaggaattgctattgtcaagttgataaagggacaaattccaatgcctaagttgtttcctgatgttcccgacttggcatctatttgggaacttttcacagcagtgccagttcttgtcactgcttatgtttgccattataatggtatgagacaaattgaagttttgacttgttggtgcattataaaattttattttagtagggaagactttctttcaattttcttttagataatgtcctgatgtcttataaaagcccgaatagggttgcttacttctaagttttctaaagagatttgattgatattttgcagtccacccaattcataacgagctgaaggacccttctcagattaagccaatagtacacacatcattggttctatgctcaactgtctatatcacaacaagtttctttggatatctcctctttggtgaatctacgctgtctgatgtgctcgccaacttcgactccaatcttggtattccatacagtcagatgctaaatgatgctgttagagtgagctatgctgttcaccttatgcttgtgttccccatgatattccatgcactacggcttaatttggatgggcttctcttttcctcatcaagtcctctgtcttccgacaaccgaagattttctgtaatgacagcggtacttctcctagttattttcctatcagcgaatttcattccgagcatctgggatgccttccaatttactggtgcaactgctgctgtgtgtatcgccttcatttttccagccgcgatcactctaaggtaagttaatggattaatgttcattgtgatgcttttattttgttccacctctacatatattatgaaaaaatggctgggatatttattccgttatctcaaaaaaaaaaagtgttatagtacttctgctaacatgcacgaagagaagtgaagaattctacatttgcagatttccacactgtagtaattgcttgttttgatatcaccttttcaatgttgtgatgttatggctgtctaatttattttgcttctaattttgcagggatccacacagtatagcaaagaagtgggacaaaatcctgtccatcttcatgattgttcttgcaattgtatcaaacgtagtagctgtgtatagcgatgcatattcaatgttccacaggaaaagttccccttccatagcctgatattccaaaatcctattggcgagtcagtggattctttatctgaaagatggcttgtacattagctagcaaataaaatcattatttaggcaagtatttacgggatttattttacggtttatttggcaaacaacccttgactcaattatgttgagttggatgtatctataggatgggtgtgtaaactttggtccgaagtgttttagtccaatgtacaattcaagatcaatttgaatcaaatgtgaattatggagttattattgtaacaaaagataaacaattattttttcgaatgtaaatcactgaaatggcaactctgttcatgcatttgcacttctgtataaacatgctactaatctggtttcttggatacaataaaattggtgctttttgttgtttcttgttgaaggtgtcattccagctgtagccgttggcttagcagaacagccttatccgctaatgctgcgtttcgttgcagcagattaaaaaaaatcatatttatctatttttgtatttaaaataatcagtactcaattaattatacactaatagctcatttgatatcttttgaatcttctcctttcttgagacattgttttggagatggagatgaaacactagctgactttatacgacaactgcacacattcgtcgtatgcttcttgagacattgttttggagtagttgtggaccttttttccttagatttgtttcggttattttgattacttttctttactgaccgtgtgcatcctaatagatacagaagtggatagtgtaatttcatttctcaacaaaatcttactattatatgatggaaacgaaaaatgttagcaacagatgatgaagtaaaactaaagatagtagctgcatttttttttgcagccccatcgtttggttgatttgaggaaaaagcgaaacgacgtatgtcggtgatatgggcctggcggtatgcgaagtatgggggagtcaccttcccgtccatccacgcggccctacagcctggccctcccccaacacctcgggcaacgcagaggcagccagggggcctcggggtgccacgtcacgcccctcgagccctcgcgttgcctcgcctcgaggccctcgcccaaccgccacgtggtgaggggagcgagtggggcggagacccaggctgaaccatcatcaatgcgcggcgcgccaaccgtccctcaccgcatttaatgcagtaagggcggacgtgcggcgctgcccgattgacccacgtcaatcgggcgtgaccagactgtgaccggcctgtcgccggtcacgtctgatcggacgggcggtagtgcccccacgttccgccctgtacccggtggagtgggggcaggtatgccccgtcccatcgaagcatcatctagagccctctccacatgagatggaccgccacaagtctccattcatttaagagggaatgacaagggtgtcccccgtgtcaggcggggggcggcgttgggccccactcgaggacggacggctgcttagcttccgggcgaaggcacgaatcgtggtccggtctaagcggagtgggtccccctttcgtgaaggagtaggtagaggtggtgtatgtggtatccccttgaattataaaaggaggaccttgcccaccgaggaaagggacgactctcggtgagcctaaacctcaggggaagaagagcgagagtactctctggagtgtaggaacctttgtaacactcagccataaatcccacacacaggagtagggtattacgctccatagcggcccgaacctgtataatcccggctctcgcgcgtggtctcagaaaactctaggctgatacatgatcttgatcagcgcgccctttcccccggtcgaactcataaaaggggatctctcgatcacccgctagagagggtcacccctcgataacgtatttgcaaatgaaaaatagtttgcgaataaaacttttatatacgtattcttaacgatataagagcaaagaccaaaaatatactacaataaaaaaaaatcccaaaatcaactccgaatttaaaattgaaaatacaaaatttgactcataagctttaagcgaaaagatgagccgttaatcttgattccggaccgctggttgggagatggacggcgtagattgcccaacccgcaccgcttagccaacgccccgccgacttggccgcgctctcgccgccttcttcccccttgtcgccgtcgccgagccgcctccgcctcaccgtgccgaccaccacctctcccaacctcgccgtcgaatcctctctctctctctcgtctccccgcttcgcttccacctcgcactcacactcccatggacccctccatgcctccgcctccacctcgaaaccctaacccctcctccgcctccatgccgccccccccgccaccgcccaagttggagccggcgtccaagcccgaatccactaaccctaactcctccatgccgccgcctccgcctccactcccggtggagggtgcgagcactagctcctctatgcctccgcctccgccgccacggcccgcggcgccgccgcagccggaggtggagggggcggacgcgtcggccgaagggggcactagcgctagcgattccgaggcggatgaggcggcggggaacttaggtaggggctccagggatattgagatggcggaggcggcggcgccgccgccatcacagcagcagcagccgaggccgcgtgccccgtacgccatacccgagtggagcgccgcaccgggccaccccttcttcctcgaggttctcaaggacggcaccatcgttgacaagcttgacgtgtcagttgctgtctctcttcacccttagcatgattgtctattgtctatagaacaattgccactacctctttgctcgtagcctcatattttggttagcgctcggggttatggattgaaaatggcatgaatgtgtctgcttttatattcatgtttggtgttacatgtgacaggtccaggaaaggagcttacatgtttggtcgaattgatctttgcgattttgtattggagcatcccactatttctcgctttcatgctggtatgttactatgctttcatcattgtcttttcaattatgacataggtaaaactgtagaagaatcaagattcaaaatcctggtgtttaacttagtggctagcttgcatgttccgaatggttttgcattcttaaaaattgtcttgtccttgaggggttttgttgctgatgttagaaaaggaaaatggcattcagtctcaggaatagctttttgcatcatctttttaccaattgatcatatatgaaatgttgacaaactggtaaccagcctgtccttgttcttttcacattgaggagaacaaagcataattgctattcatgatgctgtgatttccgtgaacatatatgaaatagcattgcatgaggaaccgatgaaacttacccagtaaatttggcttgaaaggttaaactttcacttcaaactctacaacttgtgaataccttcagccctaaatagcagaaaaaaaacacaacaaaattcaagaatttgagagaccaggttatgagattttcttgtgcagagctctattatttttaacttacaaaaacattttatttcaagtgtttatgtatgagcacttgttgcctttcttgggaggtatccgtctttaatattcgaataatctctcaactccagtgtcactatcatagtggacattatttgctagctagagaaggaaatgaatggattaggtaaaattggtactattagtttgtaatatagaatattttcttgtttagtgcttaaagcaagacattcatgaactgcttttatgctattttagttttgcagtttagaaatgatggggaggttttcctttatgatcttggaagcacacatgggtccttcatcaataaaactcaggtaatagtcttctgtcatatatcttacttcagagaaagcttcccccttatcaaagctcaacatatctttataccttaaagctttataagcttttgtcatgagtgcattctgtcgttgctcgtgctcttttatttaaaaagcagtgatttatgtcagtagtttcttatcctgttgcgttttagttccatcatttatctcaaccttattgtatcgcattgtaaattttaagaagtcacctgccacattaattatttatatggaacattgcagtaatatttacaatttgttgttcatattatattctctgatgttatttgtgaaaatactaggtcaagaagaagatatatgtggaaattcatgttggagatgtaattcgatttgggcagtaagtgatcttgttaattaattgtttaatttttttgttgcctaattctatggaacttactggcccttctttccttaaatgtttctattttttttattgagttggtgctgttgttacttagtacaattggactaatcttctcgtcgtatttgccagatcatcacgtttgtacatattccaaggaccatctgagctgatgccccctgtaagattcatctgttctttcatattttcgttaccttatttggatcgttcaaccatccacaattttgtcagtgttattgatgatgtagtatgctgtttattcttatcaaattctgcttttggatgtcatattgaaatgaagatttttttctaccagttaggcatgttcgatttcttggcagtgatcttgtaatactttctgaagtagtgccaattgagtgtggctagtaaaatcatagcatgctatatcagatctgtgcttatgttggatttctttggagctctgtttctttttgagaggttcctttatgcaatgggtcacacctataaaagcttctaaaatacttatttttttccagaaatagttctcagagaaattcatttcaatacgaagatatattatcatgtaacaagcaaacatacatgaagttgaactagttattcttcattctaacttcactttgataattttaactgttaaaaacctcataatttgatcatgttctttgttattacgagggacattttcacatccagtgaatagtccagtgaatcaaattaacctatcctgttgtttaaagttgcttgaatttacgtatttggcaggaaaaagatatgcagaagcttcgggatgctagagttcagcaagatatgcttgatcgtgaagcttcccttttacgtgcaaaaaatcaagcagctttagcagagggtatctcatggggtatgtctgaggatgcagtcgaagattctgcagaggttagttgtttttgcaagaattatattttgtatattgataaatttacataaatatttgtgatgcgtgtaatcacgtaaactgtgttttattgaaatttccaaagttcatatttatatttcagcattacatcatttgttgcatttatattaggatgaagctgatgagatcacatggcaaacctacaaaggtcaactcactgatagacaggagaaaacacgaagcaaaataataaagcgattggaaaaggtaaacattacttgtgctgactactgagatttgatctctatgcaatgttctttgtgacttagcttaaccaactttcttgtggatttataacttcattttatctggaaaactattatttgtgaatctgaaatgtgtgcttcttgttacatggactgtcaattctgatttctattgttctttaaaaagtaacttcaacaagtactgaagaccattgattaataatatctggatgctggaaatcggggatatgttgttgaaatttggggggtggtctagactttttccttcccatggatgcatatggtttgcacctctgcttgtcttacaagtttatctttctgtctttgtttcagattaccaacatgaagaaagaaattgatgcaataagagctaaggacatttctcaaggtgggttaacccaaggtcaacaaacacagattgcacggaatgagcaaaggacatctcaggttagtggatcaaatgcttcataccttcttgcactaccttttcatatcatattaccagtccaccaccaacgggtatcataacaaaccttttttcctcagcttatggaggagctggaaaatttagaagaaactttgaatgacagtatacgggaaagtcttggtgctcgcactggaaactcaaatcgtggtagtcataaagcaagtcttgaggaagaagatgacattcttaggtttgtcttctaataaattttgcctagcctgttatgcattttttgtttacgatatttgttggttgttatttgaaatgatattccttttcttttaatttaaatctagttagatatgaactgcactgctgaatttggttgatcaagcttggctactaaatttcctttagatagttactgcaaactagaacacggataaatgtactaggaacttctaccttgcaacctattatcaaattatttatattttatccaattgcataagttttgtcctgtctgctggtagacgcttatatagctgtacattgttcataagtatgatttaagaaatttatctttatatatgctcattgtcgtgtactgattaatggattctcaaataatttagtgacgaagatgacttctatgatcggacgaagaagaaatcttctagtcataaatccagtgagcagcaagtggagactgctgatagtcttcttgataaaaaagataccataaccagcgatattgaaagtaaaaagaaattggttgaagaagagaagaataagttggcaaaaagtgagaatgcggatgttggggacgaccttgatgcttacatgagtggattatcatctcaattaggtatggtgctgtagtgcctacaaggtttatcatctcagaattttgacatgcttcaattttccttaagagttccggtcaaaaaattttccttaagagtgtagtctatggtatcatgtcactaagaatctgttgctgcctgttcacctcggtgtttattgttgagtcattgaaatttgttgagtggtagttttgtatgtagttctttccatggtctgtaattgcatctggggaagtagtggtgaatgaaaataaggtaaatgagcttcatatagttctggtttgaaagttcccgtgatctcttttggaaacttgacttgctatttggtaacgacactggcctcaaagcaacatttgcaactgaaatgactcgacctctctgtacgatttgataatcatcaactctattttgggacaatcaagttcatctgagtacagttgcaattacccttcagcaatatgtcttgtcattttctctactactaaaaagaggagttgatggtggttgtttgcctatgcatcctcagtttagatcatttgtattgtagtatccattttctaaaaaatcccattatttacacgtgtatttagttgcctgttgttttgataaagttatacttgtatgtaatatgggtgcaatcaattagattagagataactattttttttacttcatatttgtggtgtgtttgtttttagatttggcataatgcacaggtactgtctagaacaattttaatgtagttgttaatcatttggtttggtctaaaaaacatggtcacattaatatggatattttagcttgtttgcgttgaggaactatgatcaatgttatttcccagcaatacttttagcttctgtgatagtgggaactatgaaatatttcccttttctttgttttcttctttacttattcttgcattgtacttggcattagttgataacttaatataaaccacgaatccatgcaacacttgaagttcatggtatgcaacaatttccttctaattatatttgtagtgctattttctgaacatattgatagatgtgtgagtagatatcctacagcactgatgcatggaagagattctttactctgattggacgttggagcagaggatacatatgctccattattaattttcccttgtataatacttccaacactcaaattattacaaaaatgacatgagtaaagttactaccaatatgctttcatagtagtattacatatctgaatatatagtaataaatattggtcattaataaagtggtgatattgttgactttgaagtgtagggtagagcattcaatgaccgcaagctaagttactaaagtatacgtcattgaaatatgactttcatttacagaacaatctgatattgcatcagtttttgtaatatttactttgtttaacccctgattagttttagacttcactcatggaaaaacaaagcttgaaaatgatgcatgtctgtatgcttgttttccatatttatgttcagttttatgcttgccacttttcttcactcactagtttgaactgttctgcagtacatgacaagattgcccaaatccagaaggagctttctgatcttcaaactgagctgggcagggtggtttacctactgaaaatagctgatcctatgggagaagcagctcgcaagagggatctcaagcccgagaaacaaaatctccagcatctaatgatagtctaagaccagagtccagaaagcaaaacaaagttgcacaaaacaaagcctcaacagaggag

SEQ ID NO: 66958 - DNA, 26529 bp, Oryza sativa
  unsure (1)..(26529): unsure at all n locations
ccctgccaaccaatcacagctcacatgcacccatgggctagcaagctcctcatgcacacatgcatgtcttgcgcccgtgcatgacattcggccatgtgcacgcatgcacaaccgaagcaccactgtccatgcttgcatatgcacatgccagtgcatgtatacaagctcctcttccattctccattctgttcgcgaacccggcacttgcacttgaccttgcgaagtccgttgcgaagacctcctcacacggtgttcgtccaccgtgtgcaaccttatgtccaatcttgtcacccggcatccttgatcgctttggacctcaactcctccctgagtctagtcccgatccgccgttgaccaagatcgaccccgatcacctgcacacacatgaaccaaacaaccgttgtcttggcacagatgtcgcaatctgaccaatgttagtccacgcacacacttcttgcacttccggtacttgtcaatttcccatcacaaaagaactataaccacacatggtttcacaaaactaaggtcgtgttgagtctgaactatcgcaaaagctcgatttacctccctctagatacttaaataccggaagttcatgactcttcaacttttcaaaccaaacaagtcaccccaataacccaatccaaagtggttttagttctatgtggcatatacattgtctgcctcggagcacactttgtgacaacggcatgacatggtagctgtcaagaagagcgaaggaggtccctacatcttctccatggtgccaacggagaggagtgcaggcggcaacatagtcgacgctaagaggggacattgaagtacgtggtctccttctagatctgaccgatgacggtcctcattgggtgtgcagctaacctccctccatcgtcactgagccaagcaccacattcccctcgaggacaatgatgagctcgaacattgtcttgcctcacctcctatctccctctgctctcccaccctccttgttgccaccaaaacccactcccctccttgctcggtcttgtgggccctgggccctgcttccctcattcctaacgatggtggcgatggttcctcgatgcgcggtcaagagaactggggcaacaacggttctccttgttggtgttgaggtagtggtcgtgtcctcttgcttggatcaagatttggttagagggaggggggaggaagaagaagatagtgataagactgacatgtggggtcttatatactttttaaaatatatcgatggccttttcattggttggacagccgcatagcaaaactatcgccatatgtaggattaaaaccactttagattgggctaaggggaactttgtccagttttgataagttgaagggtgtaaaatgtctggtattggtgttgagggtgtaaatcaaacttttgcgacacttgaaggggcatgtaggacttaccccttatatcttattgatgttattttataattcttatgctatgaaatgtatctaaactttatgtgaaacttgatgttactattgataaataacctatatttattttttttataacttagcatctgtaattgcactcgctatccacaattcgttacctatacactactccctccgtcccataatataagagatttaggagggatgtagcgcatctagtactacgaatctagacagatagtgcatcctagtactacgaatctgggcaggctcatgtctagattcttagtactaggatgcatcacatcccttcaaaatctactccttatattatggaacggagggattagtccaatgtcagcccactatttgctatttaattattactaggagtactttgtttacaaggttaatatatatatgcaatgtggattgattgatcttaagcaattttagagatataagatgaaaactaatcttcctatcctatcataataactttggggctcgcaagaaaaagttgttgccttagcttattagcagcacccgtatcgagataggtcactaatgcgtgtttaattaagaattccgtagttttaggatgtgtcgtcccatccatctaagatcctttatattttgtgacggatggactacctatcataaacataaaatctagatttgttttatttttaaagaaacttttatatagtgattttttttaaaaaaaaacatttaacaatttagaaagtcctcacgataaaatagaaagtagccaagcgaatcccagatcagcctataaccatatatactttaacaaataaaataagtattccctatacatatatgtcatttagtgattattctaagctagttttgggctagagttcaccaaagttacaccacacttacacaccggctgagaataatcacaaaatgatctggtgccaaaggttgatgttcttttttccttcttgcaaggaaaataaactctataaccctccatatatatatggctgaactagtaccaatcatctcgaccaacagcagcagcattgcgctgtcgtcctcctacatctacggtggatcaatgccccagtacctaccactactgtcttctttattttctttgagaagaacttcacttcacctctagtggatggatggtgcaattaaatgatgctaatcaaacacccgtagctatagctagtaaatgcaaaaaacagttatccaccatgaaaaaaggctctcatcttctgtctcctgaagaagaaaaggaagaagacgaagatggaatcgatcgaattcacaccaaaattggaagtttgattgaaattggaataatgtgatggaaaagttagaaatttatgtgtgtaggaaagttttgatgtgatagaaaagttgaaagttggaagaaaaattttgtaaatcgaccaaatgtcaaaccaaggtctctgatgcctggctgctactccatcagttgactttgcaacgggtagccggccggtaagccatggcagtagctaagataggaggcggcagcaaagcaaagtcactgcaaaaaatgctttgatcggtgtgcatgtccactgcaaaaatgctttccaatttaggcgccacataaactggtagcctttcgccgtcctaggctctgcatggtccgtgcctttcatgtccagggacaccaacgcctgaaaatgtggattgcagtaataatggaggaaaagataggacggcaatgtactactccctcattgtaacgtttgaccatttgttttattcaattttttttgtaaatataaaaaacgaaaagttgtgcttaaagtattgtagataataaaataagtcacaaataaaataaataataatttcaaaaaaaattgaataagacgagtggtcaaacgttcaagcaaaactcaaaaaaaaatttttccccccccccccttttttaaaaatttaaattttttaaattggggggggaaaccgggggaagggggngaaaggttaaataaccttaattttgnccaagnganccatttanaccatcaggcataaacccaccacaagaaacatgtagtacattcatttgattaggaatttgtgattggagtatatctcttctcttctctcctgtccagttcttcagaatacattgcaggttggatgcaagaacacaaggatttcaggattcacctaaattgtctgtatgtattgatgtgtacatatatatagattatagagtaagttacatggactgattggtctttcagcactacaaaatatactgcactgagtcttgagtttgtggtttgcttgctgtgtatctacttacatggtaacatatctgcactatgctatattcaatgaaattggcacactctgtgccggttcgttcaaaaacatatctgcactagagtatagttctatgtaaataattcaggtctttgccaatgaatacaactgtgaaggctattctttgttcctgtgtattggttgttaactagtagggcatccttgccggaccagaggatgttctgacgatttcagaaccaagctcttgtattttacgcaacaaagccgctttctcccgctcaagctgctgtatgtacatgtcttgctcatcctggatgctttcaatctctgtcaaggccagtgacatggcctctgtgtcgccaccctcatcaactaaacctgtgaatttcttcaggctatctctcatctgttgaaaaaaaacacatgatgttcatcacaaaattgtcatgcataccaaagaggatactgagaggaatgtggcaatattgttatgcagagacatcgttcaaacaaaccaacgaagcctctcacctgcgatgatatcttgtgccctttgccaagggaagatgcatcagtctgaaagcttgttttcttctccaagtgtggtacttttcgcgtgatctttacatggacttctccgctttttactccttggagtggtatccattttacggcgggctgatttggaggaagcatgctgtattcgacagtgcattggcctatactagcagttggaaggactgcattatggtccttgacatgtaaaatcaggggttctcctgtttctggaaactcaaatgtctggttccaatctggagagagtgttttgtaaacaacctgcatggaatgagttactcagaatttctgatcaaatggattgttttttatagggtgattcatagtatctgtagaacagaatgaccatatataattctccagtctccaattagcgccaaaaaaggttttgttttttccttttataataacatactaaaactaacgagctattgctctataggtttcctctagtatgtgaggaggtaccacattttcaagagttaattcgtagcacctcgtagaggacctttgaaaagcccattttcctattgaagttcttatgttattctaaaccaagcacggactgctacaggctgaaagatttggactaatctgaattgatcatatgcacaccatctgaagatgccaagtgctgtactgtgtcagcatatttgttcatttctattacttcaaaacgccaacaaattcacatttcgcatgtcagaaaagcaatgcatgctgcatttcctaataaaggcatagtaaataactaaatacagaaaggttcaccaccaaaccttagttcgcttcttcttgctcccataatgcaccctgacataaggatcactagtgcctctgagatcagcagcaataagatccctagcttcaattatcactagctcaatccaggtagcttcaactctaccacttgaagtctgcttaagaagaacaatacagaatccagagaaacatcagtagacaaaatggtacaacagagcaaacggtataaaactaatgtttggtacagaatcaaggatatagaacatgttgctggaggtttcatgtgtagaaaaatagttgtactcaacatcccaaatttaaaatttttactgcgcatcctcttaagaaaaaatgtttctgacgctgatttcgcaaatgtatatatttttctgaattaagaatcctcgcaatattaaaattcaatgcttaaggaaggcaaataccttcaggataccgttgaaatcactctttattggctctatttgaagcctgatctctcctgaatccaccttttcaagtggaacccatacttcacggctatcaccatctaaaagtccttctagatttactcttgcgctgccaatgctttcgtctccaaatgtatctgcactatagcatttgatcttgagatattcaccaccagtgatctcatcaaactcgaatttatcattccaaaccggtcgagttgtatgagatagtgtttttgttttgtatagagcctataaaaagaatatgggattagaataccaacttgtataatagtaagtgaagctaaactttgggcaaggtaacaacaaacctttccatactgcactttcacatatggatcacactttccagatttaccgttaactgcaagggctttaccctcaactactgcaactctgagtttccgtcctgttctggactgaagcttgggcgatacatcaaatgaagagtgggatccgttgctcagagaattgctcaacgtaactgagccatcagagaattgccattcttttagcacaagagtgacagttaactgcaagggaaagagtttggaacagtattacacaactatccagaccaaataaactagaaaaggagaaatggcacagttaaccagttcgcagttgaataggtaggtgaaaaatgggcacattattgttggaaccttcatgaatgtcacggtagaaatgataaaaggaagttctccactaaaattgttaacttgggaacagaaacatcataattcatcatcaaaaccccacatttctggtcactctatcagtagtctatcctttatgtattatatctccagagctctcaagcccaactgaatgaaaccattgttacttccacaggttgtttctaaaaaaaaagggctgaacattttcctgatcctctctcttccgatcttgattccaaaagcgctaccaattcaacaggtcgaacttactcttttgtaatttataaaacaacccaactgtaaataaagttcaacagaaaatcaaatgtaggactatgggtcattagaactttaggctatacaagtagctgaggacctgaggtcctaaactcctaaaatctgttacttcacagtttgtatcgagtatatcaaatatggcataatttcaaacctgataggctagtgaaaatttgcttcggtggcttgataaaactaattagcacttcaatcaattgggaatccatttttctaaatgttacagcatatccaaaacaggttttggatgcaagagaaacagtgacaacacatcagtagttactatagagatgtacctcgcccctgatgtcctcaaatggaacaaccattccaacttcttgtccacaaagctcagtacgttttgcaacagcaccagaattatgtcctatagcccaaaatattgttgaatcatctagaacatacttgacctgtttacattactttcatcagcatcctttagatgtgttggaagaaccacaactgcatcatgtgcaatggaaactgactaaaataataagtttaactgtcatacctttatctcgcagcttgtcaagtaggtgaccttaacaccaccagagtccaattcatacagattgaacttgacaacacctgtctctccatgcaataccaggttaaatgtgctattccatgcagggtttggacccttgcttgtacttgtttttctcactaaactaccaacttctacctcaataaatgtctgtgataccttgttatcagcaattccagatgtagaacctccacttgagctttggcggatccctatttcattagttgtgtttctcccaacgttactagctgaaacaactgtgactgaaagaacacctccaactgctcgtttccttaaatctactggtggcaaagaaaaacacaatctgcgaggctcaaccattgtcttcactatggtttcggtcaaaagcttaacctgcatggctcatgaagcatcacatttagcattcaaatttcaatacgcaatggccgtaattgcactaaaagaattgcaaagataccaaggactaactaaatggcacacacaaacccaccagccatgttgagacaccgggtagctccataccaggaactgcttggcttccaccacttccaaatgccactcctatcctgacttctggagtggattcaaaagaataaagaatagcttcaccatcaaggatgggtaacagtagaagctgcaaagatatagtttaaatcgaagaaaataagagcttaatctgatgagccaactagaaaatgcgcttagacaagaaaataatcgtcaaatacagatataatactcaggacaagaaagcaaataaaagattttaacgtaagtggtgatccaagttcttatccacacaaaatttattgtgtttcaacaaaacgctaaagtgaaatagctcaaaataaggttgccactttatcctatgtgagaggcaggttaactacatcataatatcctatgtcaaccattaaggacaggaatgactccgaaaagccaaaaccatttttgttcatcatgattgttcattatcagctttgcgatctcagtgagcaaagctggcgacaattcttgcttaccaattcaaaagaagtctctctcaaatcaagataaatgagaaataacaataacaataacaataacaatgtaacagaatcaattgaaagagcaaaggacatacatctcccttgatgtgaatgctgtttataacaattcgagcagcgccaatcagtggttttgctaattttgccaaaaacattacactcatctcattgctgtcccaatcaaaacccaagcgcatgactttctgcatgttcaaaaaacgagagttgaagtgtgcaactgtacaaccaacagaagtatttcatctgcctctcctacttacaacataatattgttcaagatggaacaactaatgactaaggctatgcaggatcaggaagagctgcagaacatgttatatattcctaacagataatggaagaacacatgggttagttacagataatggaagaacacatgggttagttatacagatgcatagttataatcagaaaaggtgaataaaccattgatgacactgcattcgttagtgttttcaatgatgtaaggataagttaaccaaactagtacccaaaacagcacaactcggaatttatgaagcagagcaaataagctaaatcaccgctgttataattctgtagaactaaaaacagcataagcagttctttcaataatgatcagtgcctgaggcaatgatttcctccctctctaagtttaccacaggtgagtatcccatacacagtacagaatattaatatctgacctggtcacctgaagtcatccagcgcatcccatgctcccccaaggtaggtggacaacaaccaagtgagaattcctgtaactctattttatcctggagagatataaaagcaaatcattagtactacagtcagaatagcagcaggagaggataaacaactttaagagaacttactattagttttggttttcgatgctttaaacgtttctgcaaattcagagaacactcactggtcagctggttataaaaaaagcagaatagaagccagtgtgcaccatatcttgcaatgcatattgactatttgactacaacaaataaataggagcaatggagctgagaaaaaaaaatggccaggccggcagcgaagaagtgccccagccaattttattaagattggagaaggttaaaacaattgggcaacaaacatggttgttgttttacaacaagctgagaaattttctaatgaattttattttgagataatcatcaccaaagaaactcaaaaggtatatttccaaaagcttttaaaaccaataattattacatccaagcaaaaactattagacgtaatagaaactttcacaaatgatagcaccttcattttctagcatcctagtgctcaaaagattcataaaattatctagcaaatgtgcagaagctgacctcaacagtagattgaaacttctttgacagttttggttccatataattgggccaaacttctaccaaaagtttgttcaaccactcgcaaggctctattggcgtcgtaggctacaagagatacaaaaggggtattgctaaaagttcatgtataaagagcaaaacaaaaaaaaataagtgaaggaatatactgttgtattcagtataagatgcttccatcgtttgttcaaatcttctatggctgacctccttttaaacctcccatactgcattcatcattaaaataaaaatagtaagaagacaaaataaactctagaaagtggggcgaggtgtttctctgtgttattcttttcagaattatgaacactctgcaactcaaaagaatagatcagcacttccaaaccaagcaacaagcaatacttgcagtaaattagtactatctcaacacctagaaaaggactatttgtctgacaattcagcaggacatcaaagaagccaagccaaattcatcaaagaacaactttatccatatgaataccatgggaaggaaaaactacctgaattgttgcccatacagcagccaacaggggaacccagtttgagaatggcacaacccatcgttcaacaaaccatgcaaacaagacaagagggaccaggaaggggagcaagggctgctccaccatgacctggttgaaaaattctagtgcatccttggcatgcaatttcttcagcttcttcttcgccatctctcctccctgctgctctgtgaattcagcaaagctctcttctctgataaccacacagagcttgatgcagataccttttgttgttttttttggcctttgtttccactgcttcccgagttcctgtcactggccccttttgcactgtgggtattggatacctgtccacctacaattttggttccaattaatggccacagcaagatagacacctaagataaagcatgtatgattgcgacctattgctcccagacttgcgagatatttcaccacttctagaatggaacaatgaagagaaaacctccaaatttttcattctttcaggcagcgtgttctattagcacgaataaacaagaaattgacccaattgatggccctaacaaagtcaacagctggattataccactaagattcgttctagttctggaccacataaacgagagagagagagaagtccaagccgcagaaccattacagtgtgcgtacacatctggccaagaaattcttgtgaaaacaaccaagcagcataggagccaccaaagcctgaaacgtcacattcgaacaggaaaaaaacacatccatgttcttgacaacccaaatgctaacctccatgaaacccaaatagatcccctgtaaactgtaaaaaaaaatccgctaaaaaatctgcaatttaacactgactgacgtgtacccagcgagtagaataaactgcatgctccaatccaacccagtcaagaagaactcctcacccgtcgagtcgccaacgctatggccaggtccctgcacccatggagattgattcgcgcagagacaccgtgaggccaagcagacaggagatcgagaggagcagagaaggagagtcgcgaaggctaaccggaggcggagaaggcgaggtggctccactccacgcacgcaatagggaggagttgaaaaaactgcagctttcccccttcagagttgctacgaattccacgaactgcttccaagatgcctcctttccgatccaatccgccgcaaccgcatccggcgaaatcaccagccttccccgccggcgactgttcttccccgcctcctccaagaggggaagttggcagaggtcaaactttgcaagtttggaatgattctataaactccaagaaccaagaaccagggtgggacaaaggggggaaattttattttttgtgagttgaggggggctctgatttgttggaactggaagcgattgggcggcagaatcaagtagtagtggatttcagtgtgctgggacaggagggaacgaacgcgtcaaaatcgggctcgtgcgtgttcgtcaatcgtcagcggcgcagcgctcttctgtgccacgctggctctcattggtttgtactcctactccgtagtaccttggaatgcgactgatttttttgatcgatctcttgtttgtttctttgggttaattggaaccatgccattacaacttcagctatttggaaatatgccattacaattagcaaaaccggctgggtgccatcgcaatttcttccaaattggaaccatgccattatatacgtctgaattgccatccatgccatttgtcctcgcacgtatttccgtatggacgcttgtgcccctggctgagacgatacaagccaaccatcccggtccggctcaaccatctctgttccccattccctattccccattgtctgcaaaccctagctcgccgacggcgatctcgacggcgatcggtgcagcgccggcgacgacgacgggggctagggatacggcgccggcgacgacgacgggggctagggatacggcggcggctttaccgatagcttctcccggcgtagacggatcaacgcggcaacgagtttggaggcgagctataccagtggcagtggtcgctctgcaatttcgagaaggtgcagagtcccatcggtggctccttcaatcccagagctgaaatgtgcttgtgggcatgccgctgcggtgcagacatcgaacacaccaaggaatccaaggcggcggtggctgcagtgtcctggggaggtgagaatccagtcctacttgtgcatatttgtgtgtgattttctttctgaatccaatctggtttccttcttgtagaattgtagatgtgccttgtggatttgggaagatctcaacgaatacgttgaggagatggtcgcttactgtcatgctgacgagtacgactatcttagagagacatgcgacagtttgcgccagtttatagcagatcaaagacatgcatatctctcagttgtcagcctaggctgaggcaaaagagttgcagttgcaagccaattacgaagctttgaatcagtccaagttggggtgtgcagacttaaagaagaaattggagtgcgagaaggcttggactcgcacaattgtgtccatgatgatcttgttctatgtgttgttagttgctgtaatgataaggcaggtttaggagatgttctgtgtgatgtctggtgtgtgaaatattgtgatgtaccttaggtgtgtgaaatctggtgtgtgtatttatgtttgtgcaagttggggaatgcaatgcaagggctatattttggaatctggtgcaaataatctgctgcctaacatagaagctgtttatgtgcaatggtgactgaaataaatttgctgacataaatgacataaacttactgacataaatgacataacttgctcacataactgacataaacttgttcagaagtgtagcaactgacataacttgttcaggagtgtagcatagaccaacatgcagcacacaaaagacagaacatttcaggtttggagcccattaccatggccaatatctaacaagtccaaatggccatctacaagcagcaaaataaacaagtttgggtttttacatcacagaccaacctagtctgataattttctaactactctagcgggtggagcagtagaagcaacaagattcttcctcttctggggagttttcttcttcttaggagtatttttcttcttgacaggtgcagatgaacttgcttcagctgcagctccaggcactcctttcttcttaggagggtttttcttcttgactggtgcagcttcggcctgacctgcagcttcagccacttgtctcttcctgcacacagatagtaccattagggaagttttgaggtagtcaatttgtggactaaatagaaagaagtccaaattacctttttttggttgttggctggattgtttgctcatcttgatgaactggctcagcaagtttgcatatcttttcaaagtgaccaaaaccctgacatctcttgcatgtaactctcttcctgccaggttgttctaaacaatctcttattctttgcactctaggtcttccagcacctctcttctacctaggtgggtataccttgaagccaagatctacatgtggccactgagacctatcagtcattgttgccactctagctgcataagctgctctaaaggtctgaacactatagtagggactgacaaaatcttggattcgacctctgttagtgcaaatccaggccaatgcatgtttgcatggctttcaacttgccataccctacatgagcagttttggttctgtaaatcaactgtgtgccttctagtgttgttgtcagactcaacaagtgtcacttctgcgaaaccttcatcgcttctaacaacctttaccaccctgagacagacagttgcatcattcaattctttcattacatttggcaggatgccatccacaagctttttaccaacttctctcctgagggccatcttctccatgatcatctccctgatcccatccacaagttcatgcaacaacagacctttaagcttcttgatctggttattgaaactttcagaaacattgtttgtgaggtagtcacacttgctagactcagaaaagccacatctgtaccaaatccttgagtgatgcttctcaagatactctattgcatcagacctcacttggtatatttgttgcatgtaccacctaaatccatcctcagtataacttcttgcagttggatacaggtgatcagtgaaggcaggaccttgaaacttcttcatgaagttagcatagagatgcctcatgcattctctgtgctcaactttttcaaatgcagcatcaacagctttttccaaacccttacaagcatctgttgatataactaggccctctggattatctatggccttattgaggtgtctcatgaaccataaccaattttcatcagtttcagagtcaaaaattgaataggatacatagaacaaccaattatgtccatctacactagtggcagcagctagttgaccagtatatttacctgtcaatcttgttgaatcaacaccaacatagggcctgcagccattgaggaagccatctatgcaaggcttcagaacaacaaacatcctcttgaagcacattttcttccctatcttctgtacatcaatctctacaatagaccctggggacttcctctccatctcagatttccaattaaaaagaaattggaagctctcttcatatttaccatgtatatgttacaatgcacacttgaacccagaccatgccttcgaatacttcaactttatctgaaaatcttcttcaagcttgtgccttgcatcactagctcccttttttgggtttttcttgacccaatccccaatcctgtctgcaacccaaccttgagttgccatcttgttttcttgcaatttggtagatgcacatgtgtgctcaaagggaagaactttgatctgcattaaacatgtataattaacaaaattgcattacacaaacataatcaaaagcctaatcaaaataaataaatgaagcaaaccatagcacctgtatgactttggtcccaggtagctttgatgcatgaacacgccaaggacacccttcagcagcacaatgggctagaaaacgtgttggatctgtcttcaaaccagcaaacacaaaaccttttttaactgcatagtgccttattgcttttctgaaagcaattatatcaggaaataatgcatctttctctatttttggattctcagggtcacgtatgacattaaagacctatggatcttcatcagtaacctactcctcaggagctctcacccctgcaacaggaggctgagaagactgaccagtgccagtgtttccatcgggttcagcaaactgtggaggctttttaggttgtgagggaacatacaaatgctcatcatcgacacccacatattcttcctcattgtcaaatatgtctggttctctaacaggttcttcctctattgcaggcttttcaacaccttcaacattgggagcgggctgttcagaaccaatgatgggagcagagttgtcaggaggcacaacacatatgggttctacttcattctcgacaagggtggataaaggctcagatgtaccatccatcttattgtcaagcactgaaacaataagattgaattggctctctgttttgtacatttcgaataggtcaggtagctgactattgtccacaagtctaacatcctcaccaatcgccttgtgcaaaaaccagattgaaggagattgatttgttccccaggtgaactcaacacttaaagtattcatcagaaattccatggaaaagctatctgaatccacaacccaatgccgagtagctcctttcgtgtaagatttcctaccatctgtttctatcatgacataagctccaaccctaacctctactgaaaaccagtgcctaccatgaaaggagagaacatcaactgaaaatctacatgtaaatacgatgaaatacccaatgcacttctacatcagctatccaaggagtatattcgagttcaagttactcacggtatcgaggaaataggaggaatcgagcctcccagatccatcccctccatcggcaatttcgctgcgcacgatgatgtcgcaggtgaacttgcgatcttcaggggaacttctacatcgtgggtcgtcgtcgccggcgccgtatccatagcccccgttgtcgtcgccggcgctgcaacgattgccgtcgagatcgccgtcggcgagctagggttttgcagacaatggggaatggggaatggggaacagagatggttgagccggaccaggggggcctcgcccagcgcctctcagagatgaccggggccctcgagcgactccccgaggagctcgaggagacgatcaagtcatcctcgagggacctcgcccggggggcggtggagctcgtactggcaagctaccaggccagggaccctgacttctccccgtgggcagcgctggaagagttccctcccgggaccgaggacggcgcgcgcgcgaaggtccgggacgccaccgaccatatcgtccacagcttcgagggtacggcccctcggctcgcgttcgcgctcgacttcgatgaggagggcagtgacgacggtgcggacgacagcgacgacgaggccgacgtcccgggcgcgtcggagtgagcccccaggcccccgccaatcttaataacttttgcttcttcttccgaggccttcgggcccccttcttgtatagactgatttaatctgtaatcaaataaagaggaaatttctgcgtcagctctgcttgttgtgtgtatgagacgaggatggtctgtgccgcggtccttctttgtcttggcttgaacaagggctcgtgcccaggtcccagcctcaaacggcgcgggtcggggctagtgcctggggagatccacgtgtcgagactggccaggccgggagcgcggtgaccaagggttatggatgacccgattgtgggcctttgccgattcccccccgaagttcaccacgccccggggcacggctcggttctgggccccgtttggcgattttagctggcccgggccgccgagggcaaggtcgagcacgagcgtgctaattcaagccaagattcttcaaaaggaaaacgatggcacagacacagtcctcaagaaatcgaaaatgcttttattgaaatacggaagagaaaaaaggtaagtatatgcatgtggtagcccccggccaactctgcacgcccggggggtgcggggttggcccgagcccgagacatgatacccgacccccactaggggtagaagcgacgaaggtgctcgatgttccacgggttaggcagctctgtgccgtcgcccgtggcgagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggatctgctggtagcgcgcggctcggagggccgcgcgccgccttcgctcttccaaatagtcgaggtcgtctcggcgaagctgatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagctcctcgatccacgagtcgccgtgcttcttggggatgttgaaggtcttggttttgaggcccttgaggatttccgcgttggcgcgctccacttggccattgcttctggggtgggcgggggaggcgaagcagagcttgatgcccatgtcttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcgacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgttgagagccgtcggccaatagaaaccctggcgaaaggccttgccatccaaggtgcgtgaggcggagtgggctccgcactcgccttcatggacatcggcgagaaactcgacgccttgttcccgaggaatgcacttcaggaggactccgttagccgcacgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcggatcccgaggcctggactccgacgggcctcgggggccgttcaggcgcgtccgtctcccctagggggtcgggtcgcgccgacggctgggcgagcctttcttcaaaggcgcccggtggggtctgggctcgcgaggaagcgagccttgagagttcgtcggcgaccgcgttatcccgtctgggcacgtgccgaagttctatcccgtcgaagtggcgctccatacgccgcacctggcgcacgtaagcgtccatctgcgggtcagagcaccggtactccttacagacctggttaacgaccaactgggagtcgcctaacaccaggaggcggcggatccccagtccagctgccactctgagtcccgcaaggagtccctcgtactcagccatattgttggtcgcccgaaagtcaaggcggaccaggtatctgaggacgtctccgctcggcgaggtcaacatgacccccgcaccggcgccctgaagagacagggagccgtcgaactgcatcaccaagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatttcaccacccgtccagtaccctctcggttatgcaagatttggccgagggggtaagacgtgaccaccgtgacccgatgcgcctggaaataatggcgcaacttcctcgaagccatcagaatagcgtaaagcatcttctaggcctgagggtatcgggtcttggcgtcccggagggcctcactaacgaagtagacgggccgctgcacctttcggcggggccgatcctcttcgccaggggccgcatctccagggcgctcttcgtccgagaggccacgcggggcgcactcggcttctgtgccgacgacctcggggtcagagggcgacaggcgcggccttcccgcagtggccccggggccatcctgggggtcgggggcgcctggcaccgtcggacaagcaggcggagggccagctccggccgtcgggggcctcgggccgccgttcggctcgggggcctctcctgcctgctctctcccgggtcgagtcgacgcagggtggggatgcgcggagtgagggttgtcctcgtcgcgctccacgaccaacgccgcgctgaccacctgcggggttgccgccaggtagagtagcaacggctcatctggctccggggcgaccaggactgggggagaactgaggtacgccttcaactgagtgagggcccgctcagcctcctccgtccaggtaaacggcccggagcatttgaggagcttaaataggggcagtgccttctctcccagcctcgatatgaaccgacttagggcggccatgcagccggtgacgcactgcacatccctaagcttgctggggggggcgcatccgctctatagctcgtatcttctcggggttggcctcgatgcctcgggcagagaccaagaacccgagaagcttgcccgcaggcacgccgaacacgcacttattggggttcagctttatgcgggcggagcggagactttcgaaagtttccgctagatctgagagtaaggtctcttggttgcgcgtcttcacaaccaagtcatcaacataggcctcaacattgcgtcctatctggctacccaaagaaattcgagtagtacgttgaaaagtaggacctgcattctttaacccgaaaggcattgtcgtataacaataagtttctatgggggtaatgaatgcagttttttcctcatcctccctagccatgcgaatctgatgataaccagagtatgcatctagaaaacacaaaaggtcgcaccccgcagtggagtcgacaatctgatctatgcgtggcagggggtaagggtccttaggacgtgccttgttaaggtcggtgtagtcgatgcacatccgaagcttgccgttcgccttgggaacgacgaccgggttcgccagccactccggatggatgacctcacggatgaatccggcctccagaagtcgcgccacctcctcacggatgaaggcttgacgttccggggcctgccgccgcactttctgccggaccggccttgcgcccggccgtacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccgtcgcccagggcaacctccttgaccggaacctcgtcgcacgtgaccatccgctgccttggggcggccgggacggaggtggtgagcctctcgtcgccacccgcgggcttggacgccgcggcgaggtggtccgcgcgctgctccatacaagcaagcgcgactttgaggtcgccatggacggtgatggggccaccggggcccggcatcttcatctggagatatgcgtagtggaccgccgccatgaacttcaccaacgcgggcctccccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgttgatgtcctcggcggtggccttctgcttggcctcacctcgccggttgccggcgggagccgccggggtcttgccctcacggcgctcctgcctcttctcctcctcccacttcctcgtccgctcagccaagcttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccacgaagcgccctcgacggcgaggacatgaccctcgtcgtcggaacgggccggccccttcttcctcctcctgttccgccgctctgaccgagtggcggacccgggggcggccggagctgtcacaccagagccggaggagttccaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacaaaaccgctgaatgtacgagcgaagagactcatcgtcccttcgctgtaccgcatgcaagtccgcttcttcacctgggcgcggatatatgccctggaagttcgtggtgaactgctggcacaaatcctcccaagagtggaccgacgcgggtggcaagttcattagccaaccccgcgcctgacccttcagggccatggggaagaaattcgccatgaccctgtcgtcgcccccggcggcctcgatcccggtcgtgtagatctggagaaactcggcggggttgacgcttccgtcgtatttttcggtgacggtgggccggaaccttgggggccaacggacgttccgaaggctcgccacaaaggctcgacagccggcaccgccaaccggggacacggggggccggcccccgtgcccggaccgaagtggcgctccggacgaggaagcgccctccattgcgtgggcggcgtgacgagcgtcgcgccggcgctcgatatcgaggcgggcatccggccccccacgcatatctccttgggtcggaggcgtcgacgagggaatggcggacgaacggcgggtaacggccgccgctcgccgcgccctccgcctcgacgacgtggagccggcggcgggagcgccagaggtctcggtggcggaggaccgcccgccggcgcctaggcgctgctgcgccgtcatgaccaagtcggccacatcatccagccaacgccgagctggagtctctggatcggggacgacgggcgggtgacgcaggagcgcgcccgcagcctggagcgcaccctggggcgtgccgccattgccgtagacgaggcggcgacgcgccccgtctcgccgtcctcccccgtcgcccgcgggcggcgaagtcgcggatcctccggcctccccgagcgcctccccccgcccaagatttcggcgagagggggacggtggggtgcgagcccgacggcgcgggttctgctccccgtcgtcaccgctagcgttcggagagaggctgtgcgcccctgcccgttcgcccattgggctgagcgggagaagcttggcgcacacgaaagaggacgagggcttagaaagacacgcgcgccccctacctggcgcgccagatgacggagcgtggggctcctcaccgggagactacgcaggcccccctttgccggttcggccgggggcgctaagtgaggttcttcgccctcgatctgaggaacgtcagcgagagaagaaatgcgcaagacacgggcgacgtagacaggttcgggccgctgagaagcgtaacaccctactcctgtgttctggtggatctgtgtgtgaaggaatccagagactcgagagcgagagagagagttcaggttctagccaacattcgccagagtcccaactcccctttcgtcctcccttttttttaggcctgggcctcctttttatctggtcaggggtcaccacatgggcctctagctacctaagaaaggaaacatgcttttacaatgagggctagtctacagccggaagtgacctctgacaagccgagcgcacgtctcttgctccgctcgcccctcttccggtggacgcccatttcaaccttcatttaatggccagcgacttccttgtcatacttgcgctgaagcctggaatgaatctgaccgggactgacatacccactcctggagttggcacgccggctccggctagggacgagagctaggaagatctcatcattccgacgggacggggcgaggcgtgtggcaggccgcctgttgccacctaacccgcgatctgaccggtctgtgaccggtcactcaccgcgatcggtcacggaccgaataagcgtgcgctgcgccgcattaaatgcggcgtggcgcgctcgtccaacctgctataaatgcggttaggtgagcccggtgtgctcacctaacccacacacgtggcgccaaaaccacagggggtcggggcaccccagccctcggggccgaaacgggagcggcccgacccctcggggagacagagggaggggtggccacgtcaccttcgggcccgactcccccgagggggtcaggccacgtgggtgaccgcggctacccaggcctctagtcacgatacccccggccccatgtcaccgacacggtccttaattgaccggggacggtactagccttttccagataccacccaaatcctctgtccgccccagtcgaaaacagttgtttaattttatttctcctttcacaaatcatgtcatcaacatcatggcaatgtggcgctcatgtctccacatgccgcatctcaattaccttcccaaaggtaattgcccaagcatatagcatttgataaatatgagtatgcatgattctagaatagcatttctaagcaattgtcatagttgactagggactcatacgtaaacatggttacaaagatttaagggtaaacaataatcaaggcatggcataatcacaagtaggatgttcatcattgcatgcaattttatttgtaaataaaacaatttcgcaattgggatcaacatgttcaaggaatagtgatgacttgccttgctcaggatagtccttattcttgatataattcttgatcaaccttcacctcctggaagttgctgacgttgcctcacgactaaccgatacataaattctataacacgcaagaaaaaccaatattcaaataacaaccaaatatgcacaacaaaatatactattcatgtcttctaatggattccaatcacgctaggggctaaggtttcttaatctttctattgtcaacgtggcctatttaggagttaaccaacatagcatttataggatacatatatatttggctaatcggtggtttagtctatcaaatggctatggaaggattatggctaagcatgcatctatctacataggacggttatttactagaggttctgttgttagatggatttaggatcaatcaaataattacagtgaatcatttgtattatttattttattgatggaagctttactttaattatgaacatattttacttgtcacaataaattataaaaggttaataattatccatgctttgtatgttagagttgtttaggttaatcatattatggttacagattatcccatcacataattttacaatgaataatcctaatttacagttgaactataattataattatatgaggtcaagatttataactagtatttatctaatatacatgtttgtcatacactccctcttaatttaatatatgcaacacgcaaattaatactataccgtaccactataatgggatgtatagtatatgtgtaagcaacaatatcttattattggatcatatatttgagtagttgctttttactgtaagctatacaatacatgttgattttaagatggctctgtttggttaactaatggatatcaaccgactatatacatatattctacttcacatgacattgtatcgacaaatttttaagtggtccaaatacaactagctctatgattactctcctaaacaagttaaagattcatctatgtgtgtttatattttagttacaaaatatgaggctaaactttatgtaaacaatttataagtcatggatttagttatatttggacatagaccagtaaatagcactaatattttcctatacacccattaatttgaaggattgattataactaatttatttagttgctacagtgacaagacatgttaaagataattatgctactgtacaatatccatttttattcattggcacactatttaggttaactattatctaatcatttgatattaattaatttataattataaatatattttgttaaatactgaattatatatcattggaaagcttatgaatttagatgaatttaggttcaagtttcactcaaatccaagttaaaatgaataagttatgctagtgtaaagattcaaatttgaattaatccgagaaattgcgaaaagctactgttcataaatgatttatttttaatccaagacatatccacagccttgtccaactgacaagtgggaccccgggtttatttctttttcctaccgaattattttctaaagggaaataggaagagctaatgacaagtggggcccacatgtcatagactcgagaccataaaacttctataattagatttttaaccacccggacctacatgtaatagacactat

SEQ ID NO: 66959 - DNA, 1260 bp, Oryza sativa
cagtttatgtttcactcataatcccaaaattaggaacataatatcaacatctaagcatcacaacacgttacatgtgcatattgctttgagaactaaagagaacagaaaatatccagcaccaaacatgtcaaactagctaggaatgccaatatctacccatgcctacctccctcggtgtgcccacgggcatgcctgtttaccagccaccacaagtagtgagacaatgttgaaaaaagaagtctgcaagcattataagttcaatacacatgtacgtagcatatataattgagttgtaaagtcatcaccaacaagcccgtaattacaaatattaagtgttcggacctttggaccttacatccacaacacatcacaaatataacaggatgccacactagtggtatggtctgacaatcagaccatatcaaggagatcagagttataagttttacccaaccgaaatctgagcttcaagactgtccattcaccaataccttagttattgccggcaataaaactgatagcaaacaaattccaatagccagccatagcaatcgtggggctaatacggtgtataaaccagttgcaaatgccacagtagttgccatgtatgcaaaccacatgagcttcttagtgaaggacctataatgaagcaagaactgaagatcctcccaccttgctatgatgcaaatgaaggcgacaacaagtgaggaacacattgccaatgtgtttgcgatcaagaatgacaaatgcaaattttcttgccaatgggaaatcccaagtttccagcatcgctgctataccctccaggtaaggtgaaagcagcaacaaatgtaattgtagcaatgattattgcaactaaagaagtgttgctcgtatatgtctgagtcagtgacttagcatctttcattgataatttatttaatttgtccttggccatcttatgaagaatataaacggacattgcactttggggatcaactttgaataaaagcatcaacacttcattctgcatatattaaaagagaggaacaaatgactaaatgtgattggtataacataataaaaagccttgatatctgtgcctttcgagtataagtattagcaaaacatgaaacacctttgtaatttttctttgggaaaagtgagcttgtaaagtcatttagaactcaacacgtggtgcaaagaaaaacctatttatatgcacctacaaatagcgcactatgcatagctaatttgcgaccataggtattatgggacacc

SEQ ID NO: 66960 - DNA, 764 bp, Oryza sativa
gttttagaaaaggagggtcaaacaagcccacttcaaaaagtagggtcaaattggtagttagggtttaaaacggggtcaaataagcaattgcccatatatatatatatatatatatatatatatatatatatatatatatatatatatatatatatatatatatatatatatatatatatatcttttcaggttctcaaattaattggtcatcgtttcagctgagtcaaagttcagccaaagttttgtgacatgcatgccacagaaaccgtgagccattaaaccattgacatataaagtcaaaacatatgccatgccatccgagaaaacaaattcaagcatgactaaatgaaggaacaagcgaccagctgatcaccgcaccaattaggtccagagatttgtttaaacatatattagttctttaattattactaactacagctgcatcggccaaagaggaggctggctttggcgtatctatccagtgtgtgttgggaggtctcgaggagaggaggatgaaggcaaaccttcccacacccaagaaagccaaaactgcctccaattagatctatacttttaatatttgctttctttgttatgcaagcaatgcagagtcctctctgaccacatggaccaaacgattcccacaccgtggtcaccacgcgccaattgcttattttatgcaggggaatggttcaataaactttctatatagcacagtgacgtgtttgatgggcatgcaccagctgttattatatgatctaatt

SEQ ID NO: 66961 - DNA, 6679 bp, Oryza sativa
  unsure (1)..(6679): unsure at all n locations
tggttaggggtaacattaggtgaaacttaaatgagagggacggttgggtaagagaatagtattagaaacccatataattgctaacatatttcaaatactanngaatcctttatantttgtgtacatatgagtgatcgctaactcatggctagctaactcatggctagctagtggtgtactagtatagtttattgtacttgtgtaggtttctttcaaagttacatgtttatgaattattgttagctttatcgtgcttctgttgaaaaaaaggccgcaaataaaagagagaactcccttttttttttgagaactcccttttttttttgcaaggaagcatataaaagagaactttgtgagtaacgatatgatgatgtttaatggaccaaaggttataacttagcgtaaccaattgcagatacgctaaaactattatgcgagctagtgtatgttaatttcttcctcatttacaattattttctctaataattaactaacatatatgaaaaagagcaatgttcccgtgctctaaaagagaaattaccaaatgatcataatcgttcattattaagaataaattagtaatttaccaatacaatgattagaggtaactttgttatttatgttttttctagatctattatttggtcatccattccgctggcattgctcacacctatattccatcgaaaaagccaaaaaaaaagttgaaaaaaaggtctagtcgtcattgctaaatgttgattatatccctccacacttttttttataataatgcacctccacatttctaataccgctaactgaagtggtagtacaaataaatctaaacccttcaaccaaatgagaacaacggttcatattgctttttactaccaacagagagcaccgtagtatggctcatatgagaacttacacgtactagtgctagaattactcgatccgatcacaaatacgtattgatttagacattggtctggtctcacacaaacattatcggaccacttatttatatcttaatatatttacaaattccaataaaattgtatttttcatgaaaaatatgcatggcttaggctttattcgattttttttgtttgcaccattaatagcaagataacaagaatgcctacacttcatctatttcctatacatgttaaatatatcatgcaacaagtctattgtaaattattcacttgtcatctttttgacatgtgtgctcaaatcctatatacttatatagttcatccccactaagtatagttaatgctatttctctcttctctcattaagccacatcaccctaattatttctagcctttggctgatagatccatagttcaaattatctcttctttcttctctcataacaccatgcaatctcaatcatttttaggctcaaaattcataagtatcaatttgttttagttttaataattatattgcatcttatttatacatattatgtaacttaatttccggcagcaacacaacggggtattcatatagtataattcaatgacctttcaattgattatatgtttcaaggacatgcatgtttgaattgattcttttccaacttaacagtgactgtacttctgaaaattcggtcaagggaagccgcaaaactgacactttagatgcggcaaatattaagattaattgcaagtatttgactacacaccatggtatgcatgcaactgtgccaacatcacgcacaaactatttaagctaaacatttgaattgaacattttaaccggtcggcatgcagacagttaggtcaagaatcattaggtcctacgaatattttatatgattatcctaggaacttatacaggcattcctacctaatctttgcttacttaccagggtgctgtctccaaagtttagtgtttcattggcttttcgggagaaagaactacaaagctatttgctttgcaagcacaagtctcgctgattgattggcttaattntccttnttttggncnttntttggggaaaaaagggtttaagggnnaaaacccccccgggggtttttaaacccccttttattggaaataattctagttcaaactggtagtaaataattaattatgaaacagataattattctgattgaacgcatggttaagtgccataggcccataggcaggtagttgcatgcgtggagacacatttgcatttcactataccataaagtgtggtagctttcgaaaacataccaatgatttggtgtaatatcaataaataaaaacccatgcatgcatatgtatatgtacatgtctctatttgggatttgagcttatcacaaaaggataatatatattccaaaagaaacaaaaagaataacgttttgcattactgttttttttttgcagtgcaaaaggagatcgtggagaggtgtgtggttcaccaatgtgtgcatccaacaatttggtcatctctccatcccactctccctctctcgtctaatcctaacacagtgctgcaagagggatgacaaattgttcagtcaaacacgcttcatgtaggagagaatctaaagatcagtactgggcactatttcttctctcactctctctctctctctctcattccatagaaaaagatggaagctttgacagattgccctgaccttttggtgtgtaacaacgcacttggctttctcctctcctcttccttctcttctcccccaagaagctaattaacccaccaaattaaaatgtacccctcttcttcctacaagtagtagtacttttcagtcttgattaggggcagttgcatgcatgccccctcaaaaattcccttcatatgattgccacaagtcattataaaagggatatatatatatatatatatatatatatatatatatatatatatatatatattgatctcaagcagccaccaataataacttaatttagctctctctctctctctgcagctaggccatatgcatctctcctccctcttctcttgtacttacttgtgcttgctctcttccattcttttcttccctaattgatctcctagagagttgagagttgagagagtagttaaggggcaagctaattaagctagtgagagctagtggaggtacatggctatatatatggttgtatgagttgcaccctccaaggggatcatacatcgacctcatcatccaatccaccaactgaccaacaacatttatactactagtagtagaagaagaagctctagatagctatatatcccagctgctgcaaaggtagtagacagcaatgtcgcagaggagagttgcagggcccatgggagtgatgagcaagcagcagcaggaggccatggcagaggagatgatggagctgaggcgaggaccatggaccctcgaggaagacaacctcctcatgaactacattgcctgccatggcgaaggccgctggaatctcctcgcccgctgctccggtgagtcctccgtcactctgcaatcatcatcgatctaaccatggcatctaggtcaagtacaatcaatcttgaacaaatttgggttaattaatcgattagggttgaagaggacgggcaagagctgcaggctaagatggctcaactacctcaagcctgacataaagcgcgggaatctgacgccggaggagcagctgctcattcttgagctccattccaggtggggaaacaggtaggtatacatattgatttgatcaatctgcacatatatatcaatcaaaatcaattatctctgatcaagatcgattggttaatttgattgatcaggtggtcgaggatagcgcagcatctgccggggaggacggacaacgagatcaagaactactggaggacgagggtgcagaagcaggccaggcagctcaaggtcgacgccaacagcaccgtcttccgcgacgccgtccgctgctattggatgcctcgcctcctcgagaagatggccggagcagccaccgaccccactccgccgccgccaccgccactccaccaccacgccgccatggccaccgcctcctcctcgccgttcgacttcgacacccacctgcagcaagcagaagcagcaacggcgtgcgtcgtcccgaacaacgtgtaccaccaccacatcgacccgagcccgagcacgtcgacgtcggccggctcgacggcggccgcggcggcgttccagccgctgccctgcttctccgagctgagatgggaccagcagatgcagtcctccggcgagctcgacgacggcgccgccggcgtgttcgtcgactcggcgtcggcgctgggaagcctcagcctcgacgggctggaccttggtccggccgagtactactccgactcgacgctcctcgactacctcaactccagctgcaccggcagcgccatgatgacgatgatgaccgcctccggcaacgccggcagctacaactactgcggcggcgccatggacggcggcgacacgtggaggtccgacgaggtgtgccaagcggcggcgagaaagctcggcgagtggggaggaggaatctagctagctagctaggtagctacgtatccagctgagcttagctgtagctaaaggctaagtggatggatggatcatggatagatgagatggtaagttgcttcttgtgatgtctctccattaaagcgagatgagatgatgatcatgatgatgatgttgatgatgctgtcacattagctaatggatgagttgttccatcatatcgatcaagatagaagtactagtgatcgatcaagcaaaaatcaaaagtagaagatgatcaatagcgtgatgattccgatcgatggagagaatattattgagatgtgtttaaacatattagctagagctagctagcttcttgtagtggttgatcgatcgatggtgcatgtaactattgttagtagtagtactttgttaatgtaattgtgtacgtacgtatgtgtgttctctctttgtttgttcttgttaaaaggcgattcaattagctttgatttgttgggtttgtgaaagagatcttgttgttatatgcattgatcatcgaaggagaggtcgttgtctccaagtgatctcgtttatgttggtggggttgtgtgctgtaattgcatctggagatgggaacaatatgggtcagaatcaagctatagatgtgtgtgtgagagtgagatgcctctctctggcttgctagctttctcttgctagggaaagtcggcaatgacatgtcgctttgagatggctatctcgatctcgatctacatatatgtgtggttgccaataaaacttttttctgcaaacgcgcaaaagaattgcacgtcaatatattagaagaagagaagagggttaccaataaaactcaaattgagttgtgcaaatttgggaaatttaacaagtagagcacacaaacgcgtcgccacgctactttccagaagaactcaacaatgagctagagggttgttattgttatatatgtgtggtttgctatcacaagttgccacactagatagacattctgaagtatatatagctaggctagtgatacaatttcaggtacattttgtccatatatgttttttaaacaaatgaatatacatgagttcgatcagttattcccttcagtcatgaaaacatgtcattttacacatgaacatgcatggtgtcccacgtacaaatttgacctataaaccctgataaaattatcatgctatatatgtacatgtctacaaatatagttttcatacatctaactaaatatttttaaaatattgatgttcacattaagtttgacttgaaacatgtttttatgacatggaaggagtaaaacttgttttcttttgatgcgtacattattgagataatactaccatgttagataattaatgatttgacttagaatttaagtttgttgctctatataacctaggatgtagttattaaatatatcttttccaatcatgcttctttctgagaaaaattgccagtcgtactctagatggaaaacgacgatggatgtaacatatcgtcacatcaaatctaacgggccagagagggaacaattttacaatcatatggatatctcatccatttctcctaaatatatgttgtatatatttatatggatggagaaaggtggagaaagaaagtgctatagctagagatgattccaacttgaaatttttgctttgataagactcctggagctttcaagggcactgtgctagtagacttcctcttaaaggatgtgggacatggcatttgatagagaatggccggcgagaaaaaaaaattaaaagcgttttgatagaatgggaaaggaagagcgttgataggtgcatactaatttaagggagattcttttttcctctccaggacttgactacatgaatcagaacacgtgatatagaaattaagttaatctaattaattacgtggggatcagatagttttaaggaaatatttaataatatttcgttaaaactttgtaacaaatatatatatgtgatacagtcctaaacaatattgatgtatatttgactaacattaatatttcccatatcattaaaatacatttatatattaattgctgctgctgaaaacattactttttgttgaatttaaaccttgaaaactaacaacaataatcatatatacatcgaattaattaattatgtataatcttttctgagcttcacttcaga

SEQ ID NO: 66962 - DNA, 3323 bp, Oryza sativa
ctccccctagccacctcagcatcgccccgccacgtcggcagggggacggcgccaaagaggctggcgctgtcctgttgaacgacggcgccagccactctggcgccctaaaaaggataatttttgggataagtttttctaggggtctagttacgaaataagtttttcaaaagaaccaaaatgtgaaaaatccagggtagctagggtggtacttgtcgttgaccttgacataatttggaattattgggcctttaatagatgtcacaagtacatgtgtgcaaccttgttgtgcatcataacagcagcagagatcgtgacagctcaagttaaccgcatgccccctttcagctttacaattaaatctgagggtccctttgaatcacaggaataagaaaacggaggaataggaaaaatataggattctgacaggaatgtaaatgtaaaatagaggattacaaaacacaggaaaaacataggaatgaccgtttgattggaccacaggaaaaacacaagaatttgaggagagataaagacttaaaggatttcttccacgaggttctacctcttgttaaaattcctccaaaacttatatatgaagaggcattctataggaatttcataggattccatagggttcattcctttgattcaaagggatttgtaggaaaaattcctatagaaatgaaatcttctaaaattcctatgaatttcctttgaatcaaaaggggcctgaaggtttttaccattcctgtagttatgcatgctgcacacctaatccctgttattccagatcagatcagggtgaagttttggtgatcgatccaggaatttttttggatcaatatgattaacaaacagaagatatatgagctatttgattcgaatgattacatttgatcctacatgcccatttttcttttggcttgcgcaatagaatgtaatagtcccatgatgtatcgaccgtctcctttggagtttggaacaaggaattttgcagaaattaaacaagtttttgtaaaattgctgcgttccaaaagaactattgttttgaacagctcaaaccacagcctattcacaggaaaatacagcaagggcttgttcggttttgaacggctcaaaccacacagcctaaggcttgttcggttaatccatataaggaagacattagaggggaattaacttcacatgtggaattaatccctttcaaccttttgaaccttttgggaggaattaagaagggattagaggagattgaaggagatctattccacaccttccccaaattctcctcaatccttaggtgaggaattaacggaacaaggtctaaagcagatgcacatgttactgcagttgaaaaaaaatctaaccctcctacagttccagttgcagtcagcttactgtcacactatgcaaaatggtaaaaggctgttactgtctgaagctgttttcttcctacgatgtcctggtccaaggaatggcatgtgaaaatgaagtgttgagaaaaagatgaaagcatcggccctgaaaagcatacagatgctacagctaaaataaaaatcatatgtgaattgaatcatattagtgtgttgtcaaccacaaatctatgatgaactatgcatgcaatcttcatgaatggtatgtttattgcctttttccctgatgggtaatctaagggtgaaagcatggtgtaacataaagcagtcaaggtacaattttttataacatcagagctgcaatgctctaccaaaataaatcgaccagtctaaaggttgtgatttgtgacaagtcggtccatctgcattattgttgttgtagagtagaaaaatatacaaaaagaaaaaaaaacgtgctaaaatatatttataggattaaaaggacatctagtcatgatcctgaatgagttgtttgctagccctagaaattcctcccagaaacatataattaattataacaaatcgctcactaattcgtttcagtgatagacaggcttgagtatttcgccaaatgatatgattgccctatcaatcacaaccccacaagtagtcgtaaagttcaacagaaagttgtttttgatttcttgatttcgacgccttagggtgacaacatagaaaacacaatatatatatttttgtttccataataaaaaaaagtcttacagttacatgtacagcatagtttatatagacagggtcacataacataacataataggcaataatctaccaatacaatttacatcatgaacgtagcaaagacggaattaattagtatttaagcacaaatgattccgagcaagatgcaacgagttaagctaggctattggtacaccatacacaggtagaaaaaagtgtacaacgatcaacaacataaaaaaaaaagaaagaaattatatcgcccaatgatgaagtacgagagggacatttcaaccaaaagtatgatgttgcatgtaacaaccaatagaaatggacctaggtttttcggtattgcacaaggcaggcaggcagcagggggcgtgtgcccacaccaaaggtaccaacctgaacttgcagacaagcgaaagattccaatacgcataaaaaagttgctttcaaacaaatctgtaaaatcattcaccccttgaaacttttgcaatgcagaaagcaaagaattattgatggggagttcacattattcaatctccatctttacatttttcctttgacaccatcgtacaaaagtcgggcatacttggttgttctgagacgacatgatagctgctaactatttttagcatgttgttgagatgtatcactatgcctttgaatctaaaacagaaggaagttggctgacatctagaacatatatactgtacataccatatggaattggcaacatagaactgtatcaagaaatgattaatctatctgtattgctgtctattattagggttccattttattacgatgtggtactgattaggagggaaaagactttatttagatttagggacacaagaatgagagcacaagctacactgagcttgccaaataacaaaaggttatttgagacactgacaatgaaacaagctgcaaaccacagaacagaacacaaggcaaacatggaaatctcagtttataagcatatgccactggcaaaattgacttgttgctccaactccatatcgtactataattcgctcgcaccttgttttcctcttctggaaaggagagcatctgtagcccctggttagaaaaactcaacaaagcgttcatagggcatactccctccgtttcacaatgtaagtcattctagcatttcccacattcatattgatgttaatgaatcta

SEQ ID NO: 66963 - DNA, 2900 bp, Oryza sativa
ggggaataagttctgcttgagcggtgaaaacgggtgtcacggtgtgaggtttctcgggggtgacggttagtatttaaagcacggcagtaacggtcggaaaacggtaaagtgcgaaacttgctcggagtcgatttacagcaaatccgaaacattaccaaatattccggacttggggggcatgtgttaacaaccgaatttggtaacatcagcgtcgggagagaagagtagatcgaagcaaagtcggaagcggaaatcgggtttgaaagcagagcaggaatcggctaaaatccagatcggctacgataagatcggctgggtatgagtcgtgttgggtaagtcgatgtagccgattccgacaatacgacttgtacgcgacatcgggttcaatttaatgtacttcaagatgattgccacgcatggatagagtcctgggaaggcaattgtatctattaattaggatattttatgtaaattccttatagataagtgtggggcaaaagtctgccgtaatgacttatggtatcttagagtttgttagagataatggtcatgtccgctatgggcatatcttgtaatcctcgggtataaatagaccccgagccctatgtaatgtcacaccctaaaaatcctaaatatataaattgttgtttaattggaattattagaaataattttaaaagcctagaagagaagatctaattttaaataataaattccaatgtaaaagtggctagataaaattttattaaatactttacttgattttatagttcctggatttttctgggatttatttgagccaaggaagtatttttaataaatggaattgcatttcatgaataatttaaattgaaaatgttttaaaaatcctccttttggctttgggccgaaagtcggcccaaaaccctctctctctcctccccggcccaagttggcctgcagccgagacgccgctcgcgcgcgcgtcccactcgctgacaggtggggcccacctatcggactcgtcgtccacctccagccgtcgcccggccgaaccctagccaagccgcgccgccgccgcccttccaaattcgctcgtccctttctcgatccgatgaaattgtttgaggggaaatgatccccgagatctcctctactttttcccttttggaatcatcgcctaattcgcttttgaaatcgccggattcgagtttgattcggattcgttttcttcccctgaaccctaatgtttccatcgccgtcgccggccgccgtgggcctccaccgtcaccccctagcccctataaaggacccccgagctctcctctacccgccgccaccctcgcctcgccttccatggccggtagagctctagcaccgtgagctcttgcaccgctgtcgctgccgcaagtccagccgtgcgacgccgtcgctccggtcgtcatcgtcgcttgggaaggacaacgccgggttcaccaagccgtcgccgtcctcgtccacccctccgtcgtcgccgaggatcgccggaagaccgccgtcgtcgtcaagccgaccgtcgccgccgcttcttcctcgtcgccgtccgccgccgttcgtgcctcggtaaggatcgctgcatcgtccactacgcatagaggccctccgtttgcgccaccgcgccgttgttcgccggcgagcatgcgcgcccgagccgccgccggtggtgacgtcatcgccgacgtcatcgtcgtcgtttcccgtgagccgcggtagaccgattagatctcggccgtctgttttggatagggttgatcccggccgttcgtttccgtagaccgccgctgtgcacccggtccaccgtgaacccgagccactgacgcaataatccccttttccttttaaaaaattattcattattgcatcataattcaattaaaatctatataaatgatttaatccgatttaatctttaaaaattcataacttattcatcttagctcggatttagttggttcaagtctctaaatttttctaaaattgagatctacatgttaaaaatatccacatgtactttttatgcttgtttatgtgctgttttagtgtttttgctcttttctctttagattccgacgttcccgagagtctgaatttgcaagagaagactttgaagagttccaaggccagcaaggcaagtcacacagatcccaaacaatcctttgagcatgttgatcccgtttaaagctattgtttctattcaactattgcatttatttttgaatgtcattgggtggaaataacctattgctttgttatagcccttttgttcttgattaccctattctttgataccttgggttattataacttgactagttgagctttatatatatggattcagctggatattagatataattgcttagccatgcttagaaacattggcacactactgggataacttatgcttcactattatttaatgatggcttaatggtagctcattatggttaatcatgattggttaattaattaatttgccaactaaaacctgataatggtgggttgtgagcatatggttttgatggttgtgctcatgacaattaaggaccggttcacgatttttgattgtgaaacatttaccgtgccaaccacaagccagcgtgggcaacggctttactttatgtatagtatgggtcatagtagagcaccagactgtgaagtggcggagataagcccacgggggtcgctggggagtccataccttgtttataagggggtgattatgatctaggaacggtacactgctttgaattgtattatatagagggtattgttacaatctctattcgggtacttgtcaagtatcgtgacgcatggttgacatgatgttaaggttgtgtcttgtgggtacagtggtacacctctggccagagttaaactat

SEQ ID NO: 66964 - DNA, 8771 bp, Oryza sativa
cgctctcccgtctctgtctctcgcttctaaggaactgaggaggggagttagggttaggttgatttagtgggccttgggccaaaatttcagaggtatatctaggtggggggtccattactacacggcccacgacctggttcgcggcccaggttgccccaggcctgggtccgcccctgcaattagtgatggtggcatataccgtggccaccttaacttagtcatatgttcccttgatgccctttagaataggacaagagaagatggagtatatcaagatagtttttttttatgtttttaagtacatttgtggtacagtgtacacacagtttgtttttggtgttcatcattactactcaaattttatcatttagataaaatactctcttttgaaaatgagtgaggttaatcatttcatgatacttaaaaaaattatagctaaagatacatagcaccttgataatatcgagaacaccatattattgtttatattttgacaaatatatataatttagcgtttagtttgttttccactcctattgttcatagtgacatgaggcaattttactaatttgaagaatgcatttatttttcccaaatttatatatactaactaatccattggagtacacttatagtcacgtcaatcaagtttatggcatatatctatcaattatgcctgacatagtgaaattccttaagtataagaaaatatgacatgagtagtttattagcatgttacttcattgttcaaaatcatggcaaagacaaaaatatgtgaccataaatctattgatggattgtagcaaaatcattggctggaaatattgttgatattttttttcatatctatgtatcatgtatgctgcctacttcttaaataccaatcaaatagttctgaaaatatccaaaaaatgctttgagaatcttaatctcaaacaaatcctatatacctatacaaatcatccccactactacaattctctgcttcctggtgcttccacgtcacccctttttgtccccaccgttagattcgcatcgagcccttcctccgcatcgctcctctcctctcccctcccgcatctcgctgcggcgccggccccacgcgcatcccgcatcgctcccctcccctccccgcatcgctcccctcctctcctctcccgcatctcggcttcgccggccccacgcgcgcatcgctcctctcccgcatctcgcgccgccgcccctacaccgcatccacgccgcgtcccgcttcgcctcctccatcgcgcgctgcttcctctccccatcgcgcgtgtgccagacgcggccctccgccgacaccctcgcttcctctcctggtctcccccatcacgcgcgccagcgtgggcccgctagccggccacgatcgcgtctcctctcattcctagcgcgagccagccgcgggcccagcatcgtcgccgcgtcgcgcttcccccatccctccccctgacccaccccccctccccacccacccaccctccccctgaccgtcagggctgtttcccttcctcgcttccacccaatctttcgctaattcgtttcaccttccccattccatctccctcgcgtgaaactgatggcgcatgccctgcctcctccacttctacaaatggaaggagcattcaactcgacgctcctgcactttatcttcttttaacccccctcactcgatgccactcttctctgacctctatcatcagatttattgccaagacatgataatggagtacttcaaggaccttgagtccttacctctctctctccaatgttcgtctgcggcatcaccatgcaccatggatcccaatcttgcctttttcttcttgctcatcggtggccaatgcaagatcaatgatattattttgtaaagtactgcaccatgtagtcaccaggcctggcctatggcatatctgatcttagatgtggaccaaatgtttcagttatccggtaagaaagtggtaagaagaacaatatttttggttgatgatatgatgcgatttgctggtacgttcttatgggtggtatttgctgcttttagcacaattttatacttctgcatacacaattgtttttctcctaatatctgaaggtatttatttaatttaagtgggcaaatgtctttatagtatgcagatttctgaccagattgtacccaaggtatgatagagatctaacattcttatattcatgtccttgagacaaattgttgcaacgagtgaatcattttctgctctatggaaatttgctcaaatccttcttaattgtctctctgctgtgcatatatagctcatgttactgccttgcttccaagatattgggttcaaatgtaagataacactaataggtatctgttgttccaaccataatctcgatctgtttaactaatgcagactctgtttgcttttataatgctcattttatacatcatatgtttacggaccattaattaggttcacataagtatgtgtctcactagacgctaccttccattgaaatattatttgttcatatcttatctgacatttccatcttataccattttcctttagtttgtcacattttaaacttgctgctgtaagtttgctaactaaccatgtgaaacaggtcaacattccttagtctcaatacttcaatagtgcaggttgcaattcactacctgaaatgctcatttcagctcaaagttttctaggctatcgtctgctacataaaatccaactgatatgtgagagtcctgctcctttaggtgtgtcacgttctgaattcagatcagtaaagttttagcgtctctcaggggtggacccaggcctggggcaacctgggccgcggaccaggtcgtgggccgtgtagtaatggaccccccacctagatatacctctgaaattttggcccaaggcccactaaatcaacctaaccctaactcccctcctcagttccttagaagcgagagacagagatgggagagcggcggcgtggcgcgacgccttcttgctcgaggctcgctcctacggtcctacccagcacgacagcacgccggcgccgccgcccgcctggcacgccgtctcctcggctcgctcggtcgctccctacctgcctctgccttgctgcctccttactcctcagcctcaactcctctcctcatccggctccctggcggacaggcggacagcaccagtgcgccatcactgggaccggcggtcggcaacgagccgacaacccccaagggccaagggccaaggcgcggctttgtgctcatgagcggagcagcaagtacgggggtaagttttccatctctattttcttctgtcaatttgttctttacttcttttctcaaatgcctaagtggctaagtgcctaaaatactgcagtgtctatagatctattgattccaatcaatttatttaacttgcaatagagatcagaagatgaagaggcctaggactacattgaaatctttttatgccccagcaacaccccaatccaatttagacccaaatcctccacaaacagcgggaaccggaggtagtaatactcagcaagcagcagctgttgttgaggcagccataggagaaactggagctagagctagtaacattcaagttcaacatgcccctagtacttgtgaggcagcccctagtattgttgagacagtggggagtaatattccacaaccagaacaagaacctcacaattcagagacagttgagcttaatccggctgacatagttgctgatcctgggcttagaaaaccaattgagcaatttcatatagacattagagatgctgttagaagggaatacttgtcaagaggtccatgccaaccaattggtcataaatatccacagaagttaatgggaaatcgacaaagaagctttcatgactcgtggttcaaaatgcataattggttggagtatagtattgccaaagatgcagcattctgtttttattgttatcttttcaagcaaccaagacctgataattttggtgttgatgctttcacaagtaagggctttactaattggaaacatgcaactggatcttttaatgaacatgttggtaaagtagatagttttcataatagagctagaaaacattgtgaggatttcaaaaatcaaaggcaaagtgtatcatataagatggatagtggatctaagaagttagagcaacaatattatggtcgtataactatgatattgggtgttgtgagatttcttttattgcaagcacttgcttttcgtggtcatgatgaatctcatggatctagcaataaggggaactttctagagatgatagaatggtacaaggagaaggataaagatgcccaaaaattacttggaaattctcctgggaatcatctattgacttcaccaaaaatacaaaagcatttgtgcaaggcttgtgcaaataagacaactaaagccattctaaaggatattggtgagagaaatttcgccattcttgttgatgagtctcgagatgcatctattaaagagcaaatggctgttattttgaggttagttgctgtcttttgcattttccttgttcttatattttgaaactgaccatattaacaatggtattattctatgttatgtcacataggtacatcaacagcaaagggcaggtgattgagagatttcttggggttgaacatgttcctgatacaacatcagttgcactgaaaatagctttggatgccatgattgttagtcatggtttatctatgcataaagtgagagggcaaggatatgatggcgcatcaaacatgagaggtgaatttcatgggctgcaaagacgggtattggatgaaaacccctatgccttttatattcattgttttgcccatcagttgcagctagtggttgtgtctgttgcaaaatgttgttctcctgtctcagatttctttaactatacccccatgattgttaacactgtcaatggttcttgtaagagacatgatcagctggcccaagaacaccatgataatcttgtgagtagtttagagactggggagatattttcaggaagagggaaaaaccaagcaactaaccttgcaagacctggggatactcggtggggttcacatcacaaaaccttgtgtcgtttgcagcacatgtggaaagcagtcctagaggtattagaaaatatatgtgaggataaccccactacaaaaacaactgctacaggtttgctaaaacagatggagagctttgaatttgtgcttatcatgcacctaatgattagactattgggtaaaactaatgatctgtcacaatgcttgcaaaagaaagaccaaaatattattcgtgctataggattgattgggaccacattgcaaaaaattaaccacataaggcagcatggttggcaagaactctttgaagagacaaagacattttgtctcaagtataacatcattgtgccagatatgtcagatacaactactactaggggtcgttcaaggggtcgtggaggtcaattgataacttaccaacatcatttcaataatgaaatctttaatgtggtacatgaccagcttattgtggagttaaacaatcggtttgctgagagatctacccagttattgagatgcattgcttgtcttgatcctaggaattcttttgccaattttgatgaagataagttaattgagcttgctagaatgtatgctgccgacttctctccatatgattgcatagtcctaaaggaccaacttgagacatttatagctgatgtgagagcagacccacatttcctaagttgcagtgaccttggtaatcttgcaatgaagatggttcagagtgatagacatacagtttttcctttggtttatcggctcattgaattggctttgattttgccggtggcaacagcaacagttgaaagggctttttcagctatgaatatcatcaaaactgagttgcggaataaaatggctgatgaatggctcaatcatcgcgtggtctgctatattgagagagacatatttgcaagcattgataatgataagatattaactcattttcaagaattgagaaccagaaagatgaagctacctctccctagtggtatgtcttattcttgttctgaaatttgtgtactgttaactttgattctcattttctcaatccatggatgtaatatgtgattctttttccaataggatcaagatctggagctacaattgaagaattcaatgaggatgatatagactccgaggaagataacacgtagcaaggtatttgaaaatgtatttgtacttctttttcgcaccgcaactaaatttgtaccatacattttgatcgtgcattagtattagtagcaaactagcaatgtagcatctattattgtatcattgtgtgcggtggcaataagatttggccccgggcttagcaaaatcctgggtccgccactggcgtctctgtccatatatacagctacatatgccagacacgaaaagagatatgttatatcaaataaagattcggcataatttatctttgcttttactgctaacagttattacttctgtacatacatcctttggattgcgcaattgaggccgaatttctcctcgaaaaagcttctctgtaggaacacaatttctcctggaaaaaacttctttgtaggaacacacatggcactagctgttgatgcatcaaatccaagagatcctgcatagctatgggcctatggctcagtgaagctttaagctccattgcctttttggtatttattatttttaatcaattttattttttcattttactacaaatataattacatatattttcagtatggtttattcaattcgtgagttaaaaatttactgcattggagttgtatgttcaaaatttttaagtcgttagtcataaatatttttagcatgctaattgctataaacttatatttttatctagcaatttccgcagcaacacgcggggtatcatctagttacaattaaatatcagacatacttgaaaaaaaacataacaaaactctgaatttgtgatgttctctttttttttacatatgtagatttaaattaatatagtatatttgtgaagcgatatttcacaccctaaaatatgatgtgaatttttttaaaaaaaaattatcatatagctaactattatatttaagaccacaatataacttttataatttagtttaaagaatacaatgaatcacaaattagatatataatctaaaaataatttaaaatatggtttagaaaaggttggttggatattttatatttttattgtagatcttagtttaacgacatatttatatttgtgtagtaatatattttttatcctattttaaagaccgttaattctttcccgaaggtactacatacgtatgtttttttttgctttgtctttttatctatatgctttccttcgcttccatcaacggtagttaagatagttatattgtagaaaaatcatattttaaagaccgtcaatttttttcccgacggtaccacaaacaaatattttcttaatctagaaataatttaaaaaatagtttaaagagcgttgattggatattatatatttttattatagaaattagttttaatgcatatttatacatatttatatttgtgaagtaatatatttttatctttatattgtagaaaaatccttttttaaagaccgtttttaatttatgttttttttggctttgtcttttaggtgttttccttccggtaacagtaggtaagatctttatatattgtagaaaaatcatattgtaaaaaccgtcatcttttcccgacggtaccacagacgcatgatttatttttttactttgtctttttttttttatggacgtgctttccttctggcaaggcggcaacagtatgtaaagctattgttttgttatcaatagtatacgtactcgtacgaacgtacgggagcagtagttccgattgtatcatttatacatgaggaagttattagtttttttataatactagcatgaatgcccgtgcattgcaacgggaagaaaaaaagaaaattgacttaaaacatagtaaatatatttttttggaatatttgggttttttaagtaggtaggtttatagttaaattaatttataagtaaagtaagtgctagaaataaaatgatacggttggatttaatttttattaaattctccatattaattacactctttgaaactttcttgaaaattacagagcttagttgctaattttgataatacaatcatcatttcagcatttatttaaataaaaatctatataaaaaatccttatttctctataggccattttcggcccattttcctcttcagcccgcaaccgagccggcccgctttcctcccattccacttctctccgcctcagcccaaaagcacccgtcggcccaaagaagtctaagtacgctccccttgctcctcctctctttgtgtggtgggccctaaccgaaagtttaaccacgattcggcctatcaagcccgcgcggcccgtcgatggatgccggcccgaagcgggactgatctgagccgttcattttgatggacgactcagattggttccgaatccatcaaaactcccagacaaagaaacctaaacctaattccttttttgccctcccatacccccaccgttggccgcttctccccttttgtcgatccctctccgccgcttcccctccccctacccccaccaacggcgcctctccctaccggcggtgccactcccatccccccaccgcgagctcctcct

SEQ ID NO: 66965 - DNA, 9893 bp, Oryza sativa
gttttagggttcctgctggtatcggctaaattgccttactagattagattaattaaggcatctaccatcttgaaaagctgttaattccttgattgcttagactttaggtttctctacttactttgagatgcatcatccctagtcttgtttagaaccctgaaaactaacctggaattaatcataattagagaaagtatcggagttttagccgatcttacctaatatacatgcttcttttctggttttatgtatatttgccacttatatagacagatcatcctatataatcgtatcaagtttgatcagtatcgtctcggctatttgaatttctaactgatcatgatttgatatgctcatatagattgatttgtttatataagtttgtactagagtattagctactactttatcgttatctacatattcagctctaaatatttttccattggctattttcataatattgtcttaaatcttctttcttaaacctaataggcagtgttacagccgatgaggcatgtttagggtcttttattccctgatctatcccgtccatagccgatttggtctaactacatcggctgagaccaccaatgatacgctatcggccatcgactgactaattatgcttttgtctttcttgttgattgcatgatcaaatcagctggcacgcctttgacacactcgaggctatccttggacctgcactggagttaagtagatctcccagtgtaacgccccgattttcgttcgggattaaaaatcatttaatatattcatagcatagccgatcagatagatctagcatgtatcggttaatactccgatactactttatataaagatgttaaagcaagtagaatataccaaacagaagcccaatatacttaaatgcaacaaaatcttaatgtaaagggcagatttaacatatcgatcaatgtgggacacccaatttaggcttggtgccccgaaaatccactcgtgatcgtctaggatttcgatcacgtacaaattgatatacagaacagctttcgattaattatacaaatttggttatacaagctaattatacaattgttaaaaggtgaaaagatccaaactaatatatccttatttgaaatacaagaaaatccatagtactaaactactaaactcctaagctcttcaactactaaaactacagccaataaactgcaaagaattcaaagaactccataggcaaaagctcgagtgtagactagtctagacaaacttgtcgatgccgtagatctcgcttccttctaatctccttgttagcatgttttctctatatgtcaaattatgcaagggtgagtacttatgtactcagcaagacatattataaataattaaatgtgaagagatatgaataaataaaacaataataaagtaaaggaataataaaaaccataaatcatctttatcctcaacattttaattttaaaaatacttatacttcaggagtaggaatcaccctgatgacacaactccagaaccgggagtacggcacattcgaatgatttaattcacctctgcagagactgtccagttttaaccgcacgatgcccacagctagctaggctgagaacaacagagccgtttgaaggtcccacttactactagtaagtctaggtctgtccccattctagaagctgcggtcgtactcgttcgtttgacataagtacttggtaaacttatatcgaccaagacagtactagccacccggaaatcaaccaattcctgcgtactgtcccaatctaagttcattgtatttttatgcagtctaactaggcagggctaagcaaaagctagcatataactggtttgctatatgttcagattatgcattcaaaatcatgaatggctaatgcatagaatagaatgtagaatataggataattatgctcaaaggggaggaataataacttgccttgctccaacgcaaataaatacgagataggcaacctgattatccgattctcgaaataccataggttgccatccaaaagacaataaactctactgagaaagaggaagaaccaaatttaataaaagccataaaataataagaaaacgataaacggctaaaagggctagggtttaaggtataacctatctcttttatagggtatagggattatggggctagtatttgctagcggtaggtttaggtagtataatagctagggttcagttatatgggagttgattgtggagtaggatagtatattggttaggctctatattttatgtggaggctctcgtggtttggacgataggaaatatactagatagttgatatggttaaataggcatgtggctaatatgggtccaggttggctttgatagaatagtggttaggatttagttgtttaggccgatatcgaggtaggataaatatcggctagggttttaggtgtttgctagtcgtcgctagagttggacatcatgacgactaggtttagtatcatttctagccgtgtcgatagacaacatatcggctagaagaataggaggtgggtgcaggtttagtggggcggaagtgttactccgacaaccgtgagtggcggcggagcggcttggatcacacagagcccgagagctaactgtgcggcgtgcaatggaggtcgaggggatagtgaagctccgaccgctatacgcatcaaggcgtggggtgccaggagcagcacttcaaccttgggtttggtttatgccgagctttacaaccaacggtccgacgttgaggttcgtagaccgcgcaaacgtccccatggaaggcgtaaagttctaaccggcggctttttagtggctacagggtattttggaaataaaagaaaatatttggaaagcaaatataagtttaagttgtaaattcaattaaaagattaaatcaaattttattcaaatggcatttgaataaattaaagaaattcaaataaaatcttaaaatagcaaatttgatatcaaaatgaatagtttgaatttatatgaatttaggtccaaatttcactggaatcggatctacggtttaggagatataggcttctaaaaattgggatttgaattaaatctaaaaaatacaaaaagttactgttgatgggcccacctgtcaatctccttttctttttctctctccttctctcgtcgtcgtcttcttctcttctctgttccagagagagagagccgagagaagagagaggagaaggcgagcggggcggcggctctccggtggctggagggcggcgacgtcggcgtccacgcgtgttcccgagcaagacatacccggggagggcggtggctggcggagagagtgaaggagttggccggaacggcgcagtcaagagcttgtcttcggcggcaaagagaggtggcggtggtggttgctatggggtgggggagaaggggaaaacgggaaaaatggaatcaactcgtcgaggcgaactcgatggcgcgatggtttggcttgcgaagctccggtgagggagatcgggtggtggcggccatggggaggagagagaactggaactcgattttgtatggaatagaggaggggtggccggctatttataggggtgagaggcggtggtgagaggcggttcggaggaggagatcgagaagacacggcgacggtagcgtgaagaaaagaatgacggcggccggcttcgtttgcttagcggcgacggaagaggagttggcggcggcatgcgccgtgcacggcacgcgcaccaggaggaggaggcggctcggctggtggtgtgggctggtttgggccggcttggcttagctgggccggcagcccaagaaggaggaggaaaatagaaaataaaagaaaagggattgggccaaaagaaagaaagaatggagtttcggcccgatgacaaaaagaaagaagtctaatctgaatacttgatttggataactaggttttgcaaaggatttgaattcggagagaattcacaaaagagatttcttaagttatttgagtgcaatatttacagatggagtttgaggaaatttatttggaagcactcaaataggaagggaaattaataatattcctcaaatatttttggaatatagaagggaattagttgaaggcaataaataggatttgaactctaaaattggtattatgtatatttgtggctaaaaggggaaattgagtgaagaatataaattggaattttcttagcacaagagctattattcataatatttgtaataatacaattcttatgccgaagaggaaaatcaagccacaacgattaaattggtggctagatcaaaaggaggaaaatggatatttggatcgagaatcaaaggatgggtttaagatcaaaggatggattagcaattaattccaatgagattggaattactttggtctaggttcaaggacgaaattggaggatttcttggaccataattcataatagtaaaaatggttttcaaactaaatttgaataaaagagttttaatcgaaagaaggtttaatattcgaaaatagaattccaacaagaaataccaaatatgtttttaaatgaaaaacacaaaagggattaaataccagagaggttttatgcaagttaattttaggaagtcccgctaagtatattttcctaggtttaaaaggttattaagaacataagaatcagcatgatgcaagattagaaaatgacatattttcaggatgttacagcaaggtatctatatcgtcacactttcatgaatcccactgttgtgaaacactgctgcccaaactccttacgcaagttcaccccaaaaccgctcatagagccacccaacagtctttcatatagtgggacaatgtactaggctaagttacttgatcgtgcggatggacgcaactatgtcatttcccatgggataagggggtaattataatccggttaaaccacccaaaactttccaaactccccacaccaacatcacaaacttcatcattcatcaacattcataatcacaactcaataatgcccattttaaccggattcctaagtttgtaaagatatttaaataataaaccacataaaatgatgtccaatgcatctttctatgatttcatgtggcagtgctcggaagcattaataattaccacaatgttattctgaagtataacatctacccatgagatgttaaaagagtaattatcatgcatcaaatttaaatatgaagattatctcaaggtttctatatgattaaaattttagttatgtcttgccttgcgccttaagatttcccgcggcttcagcgtagccatctgggtccacgtcagttccttggatgtcgacaggacttgttgtacggtctaacgtacgaatacgaaaacatagcaaataaagcctataagcaaattgctacaagaaacgataaagccaaggaataaaattggagcgaggcgagaggacaaaggaatgggtttaaaataagttttaatttgaaaataaaagagaggtgttctacaggttggagattgaataaaatcaaataaagaataattttggataggtggggtctatttggtggattggtttttagtcggtgctagaatagggcagcacgacggctagatatgtggagttggttagccgatgctaaggatgggtagcatagcagctaaatgtttggctcgtctagtcgatgctacagttaagcagcacaacggctagagtcgggaaaatttgtgggggtttgcaagatggaaagtgttactccattgccgtgagtggcagcagagcggctaggatcgcatagagctcggaagctagtgtgctgtggaggtcgagggagaagtgaagctccgaccactatacgcgtcgaggcgtggggtgcgaagagcaacacttcgaccttaggattagattataccgggttttatgaccaacggtttgacgtcggggtttgagaccacacgaacgtctccatggaaggcgtaaagtttccacagcagttttttggtggctaaaggatggtatatgagtggtttaaaaagaagtattttaaataaatcaaaggaatttaaattcaaaaaggggttttaaataaattgaaaaaataaaatttaaaatggtattttaaaagaaataaagaaaaggtaattaaataaataaaagatatttaaagaaattaaaagataatttaatttaaaagtttttttaaataaagcaataaatttaaaattaaagggatttaagataaataaaataggtttaaattaaaaaatatttaaataaataaatttaaataaaattttaaaataggaaatttggtatcaaaagagagggtttgaaattagatgaatttagatcaaaagttttctggaattggatcatcggttggtgagatatggatgtctaaagtttgaaattgaataaaaagaaaaaggattactttataaaaggtgggggccactgtcatagcctcttctccttcttctacctcttcttcttctgttcctgtttttgccgaacaggtagagaggagagggaggaggggcgctagagctccggtggctggggatcggcgacgttggcggcaacgtgtgttcccggacgacgcgcatctggcaaggatggtggccggcagaggtagatgaggagttagccggaacggcgagcacaattgcatgaaccggagagagagagagaaagctccggtgaggctcgattcgaaaggaaaaagaagggggaaaggggtaaaatgggttcaccagagggaggcaaagccgatggtgcaaggaaactaggagggaagctataggggaggagatcgaccgatggcggcgtcggccggacttggcaggagagagagagctcgaggagctcggctatggggaaggaaacggggtctcactggctatatataggcgaggagaggcggtggagtaggtcggttccaatggagaatagcgaaggatgcacggcaacggcgacgtggggaagaggagtacggcgccggctctgtccgttgattggccggtgatggcggttcggctcggcggcgtgacgtcgcagctgacgttggtgatagatccttcgcgtcgacggcaagacaacggcagcggcgcaaagctgcgggcgacggcagcacaaagccacggcgacggtggcggcggtgtgccacgcgcgcccacagagaagagaaaggagccggcttagctggggctgggtcggcttgggctgaggagggagatgggccgaggggagaagaaaaaggaatttcggcccgatttgaataggaacctttgggaatttttgtgtagaggattttaaatggaatttaaaggagatgaaatctataagaagaatgtttgtggactttttgaatttgactagaattcaaaggggaaaaaattctaaaggaagatatttgtgaaccttttgaactttggacaaggaatttaaatagagttaaaggaattttaaactagaggaattttgaaggcagggttttaaataaattaataaattttaaaggagataaaatttaaaagaggaatgtttaagggtctcttaaactttataaaaggaatttgaatataaggtttttgaagcaaaaggagtttaaaatacttataaaataaaatcaagatatttatttttgagatataaatttgaaaaggataaacattaagatgctccaattttaaaagaattcaataagaaccaaatataaaacttatcacaaagattttctttaaaaattaaattaatcaaatgggaaggaaaggaaataatttaatttctaactttggataaatttgggatggtggcaaaaatagatggaggtaaataactaggattttagcctccaaaatatgtggtatggattctcggtgaattatttgtggctaaaggaagttggattttgagtagaagggattggaaataagtttcttagcacaagagcaatcattcaaatatttgtgataatattattctttgtgccaagaatgtgatcaagttataggaatcgaattggtgcatggatcaaaataggaacttaaccacgggatattttggaccgattaaaaggagacaaatgtttttggggataggtttagataggggttgatccaaaataaattccaacggaaagggagttatactggtttagccccaaagataaaaatggttattaggatataacagagaatcgggtcaatcggggaaatattggcctaagctaaatagtagactttgaaatcttgaatggataatttagatgaacgagatttcaaaggggaaatatttgtgggagtatagaactggattcggaagtatatgtggatgggaatctttataggaacgaaattggtggtatgttgataaactctaaaggatgggtatgttgactcaaaggggaattgaaaaggatattttatggactatgggaatatttaggtggagatccaaaggaaaggtattggttctgggggaaaaaataagaattggtatttcatgtgttcgggtagagatcaaaggggaagtatttgatggaagataaaaatggatttggtggtagtatggtaagctctagagagattgatattttatgtgctcaagagatggttgaatgggaattgaaagggtattggttcgaggtgttcgggaatggattccaaggaaatataatttagagccaaagttagagattacagaaaataaatggaaaggttttataaaatttaaaagagagcgattaactttgcaaataaagtttaaatccaagttaaaagaaattaacagaaggcaagatcacttcagaagaatcgagaagagtgcaactaaaatatttcgcaaaaatttttcccaaaattttgagtccgttacaatcaagcatgtaagataaaagaagttagatcaggtaagatcggctgaaagtccgatactactctaatcggcaaccagaaagcagactagggattgaaattctaagcacgacttaatagatcaaactcaactgatgtagcattaagtatgaaaagaagaacaatatctagacaatcaagccgctggatgtttcatagagtggtagatatcttatataatctaagccaacctcactatttaacataatcggccgccttctactaacagatgttagccgattatagattagataatgataatgtcagagattatatagaatatatggtaactcgacgaattacataaacaagactagagtatcataaagatggaagcactaatcccgagaacgcaagccatcataataagttttacctcttgttgaagatcgaaaccgatgcagctcaaccttacatatggctcggggtctatttatacccgagaaatacaagatatgtccatattggacacgactcttatctctaacaaactcttagataccataagtctttgcggcagacttttgcccacatttatctctaaggaatttacataaaatatcctaattaatagatacaattgccttctcaggactctatccatgtgcggcaatcatcttgaagcacaccaactcgaacccgatgtcgtacaaaagtcgtattgtcggaatcgactgtatcactcaacccagtctgactcggacttagccgatcccagtcgtagccaatccggactccagccgattcttactctgtttccgcaacaatacatattagagaacagcggaagcttgactacccaatcacaagcacccgataggggtttaccccattaagttctcatcctagaagaagcaatcggaacccgcatcactcaaagaataagtctaaacctgcaaacaaaaggttatatcaacagcaagagtcagtacattaaacaagttaatgtactggcaagcacaagtcaatcctaccatactacatg

SEQ ID NO: 66966 - DNA, 6973 bp, Oryza sativa
aaagtggatcctctcatcaggatctacaacttttggtcaaaaacaaagttattttggtcacttcttcatccgacaaagttgtttagatttgtaaataaaagttgtagatcctcatgagaagatcaactttgtttttgaccatatttccatttgaaatcatttagtatttacaaatgctgtttagatttgtcatattgtcaaaatcaatttcaagctgttggaaacaaagttatatagacaaatgaccaaaataaaagttgtagatcttgataacctctacaattttgttgttgaccatatttccatttgaaatcatttactatccgaaaatgtattatgactaataaaataaattaatatacagcagctatatattttgtactcacaaatataaagacttatctggaaaaatggaaaaatagtcatcggtgacgggccttagttcaagcccgatagagattaatctatctctatcgggcattatctttgggccggtcacagatgactcatccgtgacgggcctgaatgtcatctcaatcgggcattagtatgtagcccgtcaccgatgagtcatctgtgacgggccctacggcaaagcccgattgagatgactcatcactctactatatctagggtttctcagatcggatcgaaaatttttctaagtcccactacagtttcccgcctccttagaaccctaactcttacttcgccgccgtcgtcctccctcgccgccaccgccaccgagaccgccaccgccgccaccgagcccgccgccgccaccaccgagcccgcctcctccaccgagcccggcgccgcctccaccgaccggcgacgccctccaccgagccaggcgccgccaccaccgagcccgccgccaccgccgtcgtcctcccacgagcctctacactgaccggacaggtgttggccttccttgtcgtcgccgcccgcgtcctcaccgacgcacgtcgccgacccccaccgagcccgatgccgcccgcccggcgccgacctacccgaccggcatctccaccgaccggcgccgccctccaccgagcccggtgccgccgccgcaaactcctcctttgccgagcccgccgccgccgccatcgagaccgctgcctccaccgagcccaacgccgcctccaccgaccggcgacgccctccaccgagcccggcgccgccgccaccgagccccaccgaccgtccttaggtgagccctccatcgcgccgccctatgctaactgtgaatgacatgtcattcaaatgtggatgtggatgatatgtgattgaactgtgagtgagatatgtcgatgttgggatgaaatgtggtgcatttatgaattttgtgatagatgattgtagtgattgatgaaatgtggttcatttaactttatttatacgcaatgcggttcatattgggatgaaatgtggtttatttatgttgggatgaaatgtggttttttatgttgggatgaaatgtggtttatttatgttgggatgaaatatggtgcattaatgaaactattgtgaaatgtggttaattttattactgtgagatgtgcaatttcgtttatttatacatggtgcattaatgaatttagtaaatagatgaaatgtggttcgttttattactgtgagatgcgcaatttagtttatttatatgtttcatttatttttctaagtgacattaaattcattgtaatagattgtagcactcaattgtgtatttttgttatttaaaaaaaaagaagacgatgtctcagcaaggcaaaccaatatcgacgacaactagtgggtcctcaagggcacgtactcctaggacagggaacaaaatccctaaggaacggttccgcataatagcggtggacgccgtagggttgccgacatctccaaggaaaatattgagccgatttaggtctatctgcggggtcatagggaggcagaaattcagtattctgcaagatgacatcaagctcgtgccggccgcagagaaggacattgcttggctaacgttcaaggagagctttgattatcctgcggagcatgaggactatctcaggcgggctgctttcaaggttatgggcaatgcttggaagaacttcaagactaagctagtcggcgagttcgtctacaacccggcgaatccagatccaagagagaaatttccttggatcacggaataggtctgggaggaattccatgcgaagaagttgacccccgagtctagagctagaagcgaggcatatcgcttgctccagaccaggaaccagcatccgcaccggcttggcaccgccggatatgctggtaaggaagaggaatggcagcgtgaggatgaagaagcggaggaatcgtgcacaccactcgtgtttggcgatatcccacaccctcgggctaggaactgggccagggccaggtaccagaagaatgatgatggcacaatcttcatgccaaatgcagaagatcaacgagtatacgaagctacagtaagtgtctagtcaaactagatgttcgcattgtttcccatcgtgcagtttatttaaccccactaaattgtaatgcagaaggagttggttgtcgagcaacaagtctcgcaagaggcctgctctcaaagacgcgaggacgacctcctcacgaaagcgttgggcaacaaggaacactatggacggacacggggcgttgggtcttctgttccctggaagtatggatttccagactacgcgtggcagtacaagaagcggacttccaacaaggcggagaaagatgcacgccttgaagccaagatccgggcgtcaataagagctgagttgacatctgaattcgacgaaaagctcaagtcgatgagggccaagattaggcaagagatccgagaagagcaacagaacccctaggccgccgctgctgctgcgcacgaagagttaggaagtcccacctaaaaacgcagcagttgtgcatcaactgagttggcggaaaatccaacatcggtcgacagcgccgtcgaccacataacggtaactgtgaacttactcaatacatgaaagacttaacgaatccatatgatatataatattctaaaaaaattgattaatctatcgcaggaaccaacgagctgcaccctcacagttagggtgatgccgaccttcacggttccagcagccgagggacttgcgtacaagccgaccccagagacaagagtgcatggagcgcaactcagggccgactgtgcaaaagttcaagtcgattcggtgaagcccgaatacgagctgttccctctgaagtatccaccgaacgacgaggtcctctcactaggaaatgcccgtggtaccttcatccaatggcccaaggacctcattgagatcagggttacagcgaggccaaccactgcaccaggcggtcgtccaccaaagagacccgcctctgctccttcagcccctcctgctcaagatcgtcatgcacaatcttacgatgtgcagttgcagtacgacacggattttggggaggaccgaacggaggccgacagcaaggcgattcatgaacccccaccgatgaagaagagcaggaaggcacactcttccccttagagaattactctcgataaacccgaagcaaaggggagaggaaggggaggaaaggtgcaggcctcgcttctagctccaaggaagctagatctgggcaagggctaggaaaagactaagggcaaagaggtcaagaagaaatacatcgctccacaggagttccaactaggcatgccattggttggagatgacgtgcttgccgcaatgggcaccgcttgcaaggaccttcacttatactacatggagaaatctaacgccaggaagccaagtaaagttaccgatatccttggagagcacgatggaaagccattccttggtccaacaaattatatcgtggtcgacttcaaggatcttttcgacctctacaggctccgagcggtggacacaagcctccttaagtgctactccttgtaagtattgtcgcccaactcaatctggtaataacaatcggtttaacttgcttacaagatcgtttatcctgtgtgtaggttaagttggcaatggtgtcagaagcatgcaccggaagttgccttccttgatccacaagtggtcactgtcacaaatctccagaatgaccgtcaaggaatggtcaactacatctacgacaccttgtggtcccgccgagacaaggagtacattatgtgcgcctataatcaatagtaagtgtgttaactaaatatacacaacagcatgacacattccttgagtacttaattaagtttcactatattaatgccgtagtgcccattggatccttctggtcataacacctaagtggagtacatgtcactacctgaactccagaattgataagaacgcatatgattggaccccaattaaactagcgatagatgaagcgtgggcccaatacgtgcaaagaggaggcctcaggaagacaggacatgacaccctcatccacaaaaaagacttcccggtgaagcaacaaataggtgaccagtgcggattctatgtgtgccacaacatgcgcctcctgtatagagaaaaggtgaagactttggctgagtttgaggtcggtggtctcaattgtgatagactaactacattttagtacttatatatgatcgatcaactaatctggaattatgacaatgtagggcacaataaccaagtctctgcctaccagctttgaggacgttcgcgaggagatagctagcttcatcctctgcgaaataattaaccccaaaggaatgtttaggcttaaactaaaatgatgaacaatgttgaacttttatgtttaggcaatgatgaacacttgttatgcaactgtgatgatgtaactgtgatgtttatatttatgtatatatttcatatgtttatgttacgacttgctaaataaatatttgatccaattaactcggttttgcaggtgaaacatgataaatatttgaatggatgtgaaatatgtgaatggatgtgaaatatgagatggctgtgaatgtgtggttgtgtgaaatatgttgatgtctatgtatgtgaatgcatatgtatatgaatgggtgatgctggggagctggggatattagatatctgtgtttgtttctgtcatttttgcagcgggcatggctagcaaaagcctaaggctagccaaaaaacaaaatttattttttttttgtattatagtcatctgtgacgggtcataactaaatgcctgattgagatgagatcatttgtgacgggctctagtttagccccgattgaggtcagtagtcatctttgacgggctatagtttaggcccgattgagatgagtatcatctgtgacggggtctagtttaggcccgataaaggttagtagtcatctgtgacgggcgctagttgtggcccgatagagataggtcatctgtgacgggctgtagtttgactggtcgtctgggacaaagctatctgtgacgggctttactcagggcccgattgagatatattcattcgtgacggccgtttgcccgattgagataactcttcacatcagtgacttctagcctgtgacggacgctgtgcccgattgagatggggcttaccgctcgattgagatgagggtatccgttctagtggttgtaattatgttgcttcaatgtcaatttctcatcgaatggaacttggtagtttaatattgaaggactatatctcaactatgctacagattgaattaaatggggtaactgcacacggacactttacctgcacatttgacattgactcttaattctgaagtagttggtgttgcatagtttacttatcattttataaagtagtatagtccatatttccggctctacaatattattgtcttattgataatttgactcaattttttttttgctgatgctgaatatatcatggcgatcacaagatattttggtgtcatttctgtacaaaggaaatgctccttgcataagtagatttgccatctttttgtgtcatcaggtagaatgtacggttcctcttttgtaagtggattgtatagctatcctatatatgtactatacatggcatttccaattagatggagatggtatattgtcgaaacaagaattcggcaataataaaaggggtagcgcacaagacctgaaagtggatggatgcggagacaaggatttagacaggttcaggccctctcgataagaggtaataccctactcctgtttggagatttgaatccgccgggtgtattatagatctgatgatctagttgtgtatcatgccctctagagggcttcctgcccaccttatataagatgggggtcaggattacaagatagaaaccttaaccaatatggtatcggttttctaaatctactttacaatattatcaaaccaggactttaggccgttccataatacataaggaaacgtaatacctaagtcatgatccgttatatttcatagatataagttatcccctataactagtcggataaccacgccgtgtgggtatggggtacctataatctccacggtagcccctgagaccttcaccgtcgaaaagataatcttctctcgaactagattactccaaagccgagtgcttcaatcatcttcgccatggtttcctgagtacttttaccaaatccgaagactatggagggctgaaaaatagctgaatgtaaacttaggtgcatcgactagatgcacctaataggtttagcccccgactatacggttagttgagcaaactgaacatatagtcaaggagtaaataatccaaccaactgagtggtttttgataattatagtcaactaggtgatttgatagcatatgcaggtgtgaatcctcgaataacatgatccaagtgatataccgactgctttgtaaaatatgacgtgtaacctaaagttgacttcatcattgaaaatccacatagcaacccagctataaag

SEQ ID NO: 66967 - DNA, 1503 bp, Oryza sativa
ttttactggttatgaccttacagggttgtaatcttataatttttttcatgctatattaatagaacttcgcaccatctcgtacgagtcgttaaaaaaatagtacaattttgcacacaattgacacatattatatctttttggcaaatacatgatacatatattagaggtgccctgcactccttcagggcccctttgaatcaaagggtttatgtaggaatttcataggattcaaatcctataggaaattttcctatttggccctttgatttaaaggattgaaactttccaaatcctatgaaattcctatggaatagtacattgcatgtggattttggaggaaatttagcaagagctccaacctcttggaaaatttcctttgagtctatctctctcatccgattcctgtgtttttcctgcgctccaatcaaacgaccattcctgtgttttccctgtgttttgcaatcttctgttttacacttcaattcctgtcaaaatcctgtgttttttctattcctccattttttctaacatgcgattcaaagggccctcggaatcttagaaatatgaaaaaaattcaccggttctttttgtttcttcttgagtgagagatacttttatagagttgattgatatgagtaccattcttttttgctttgatctttatctgtagatgcgcatggatgattgcacacacttttgccaagtcacgcacagatcagttccggaccaaaaatcgcagtgcctatctctgtctggcccaagtgccggcaccgtgctctctccttcgctgcccggcctctccatgtccgcgtcagtgtctgaattattggagcaacacaacgctggagtagtagttgtttatctcctcaggttagcaaatcgcacatctccctgacctggacaaaagaacgattcctcgcctcattcgtattcgtatccagagaaaaaaagaagccacaaaagagacgagaggaatatcatgtctgtgcaacttgctgaagtggtgaatgattattaatcaattattataatctccggcctacctctctttcgatcgaactgacgtttgttcgctgctgacttgccgtcgatcgatcatgaacaattcttaagaggagagcgagatcaagtaggtaatcttaagacgtggaatctgcccccctcgagaattaaaaagtcacatctctctctctctcttctttggtcaagaaatatatgcagatggaattgtttgtggatgacttgttggtggtggctgcttagccgtgggcgatcgatgaagcgtacgtatcagtggacatgtgctgcgtgtgacgacggcgtcggttagaacatggaagaagcagcgactcttccactcaacaaatggttggatttatgcattattttttcgaaaaatgcacgggcatatacacatcactacactacacatgtaccccctctttcccatataaaacgaatctaagaccgaatgtagtacgacgaatctgaatatatgtatat

SEQ ID NO: 66968 - DNA, 11315 bp, Oryza sativa
gcatgctgccgtgcgcgtgagagagagaggggaagagtgagacaggtagtgagagagataatagagaggaatagtggaagacgatatgataggtgggtcctacatttttttataaatagaatactaactagagtgccacgcgtacgccacatagaccaaaactaccgcggattgggtcgaggggggtaattcgtccggtttgcatagttagggttgaagaatatccggttttgtggtttagggggtaattcagacgaccgtgatatttcagtggtggtaccttctatctagacattgacaaaaaattgtgttcacgcacaacatgaagaatattctcttaaagcgcttggatgatgaaagtatcataattttagttttccgtagctacgcacgggtattttttctagtatatatctttacctattataaaagtttaagatatttttgccaagaatttttcgtacgttgtccgattccctccccgtgatcttttttttgcgatttttccgtgttattttccagtccgactccctccccgttcccactcgtgtcgcaccacagcgccagtaccacataaggcggatgttgcacaaattcaaatatcgatacaaaatccaatcggacatagaatatagagaaaaagaaaatgaaacaagaagaataaaaaaactgcacaaataaaaaaatcgcacaaaaaaaaagcccacgaccggctcaaatcgatccaattttcttcattgagtacttcaatgcccatccccaaattgaagatgaatatacgaacaacaaacaataatccccatatccttatttcaacatatgaacaacacatacaaatcctcaagataaaaaaaagcatgaataaacatgaacaaatcacacgagtaattcattatcatcgccttcgtcactgcttctgcttctggtgtgggaggaagaacaggagggggtggcgtcaccatcgcacctcctagatcagcccatctctgacctccaacaccaatggatcggccaagccaccagaggaaagtagaagagaaagagaggagaagaagggcatttgtcgcacctgcagcccgctgtcaccgtcagctcgttaccatggaggtcgtcgccggttgatgccgtagccggcggcgggaggagtccggaagaccgagtcgccgtcgccgccgcctcgagtcgtcgtgcccttgccgggaagggtgagtgcaggaagaggaggagatggagcagaagaggacggatctgggacgccggaccaccgccgcctcccctcccgccagaagggagggcgccaccgcctgccaccacccatcagcatcgagccctcccgcggccccatggcgagggagaggaggcgagggacggagaggcgtcgctgcgcggaaggagagccgcggacgccgaggagtagcttgccggtgctgctccccagctcgttgcgcaccgctgctcctgctctctactctctaggcatcattgccgcgggacggcgggtcgtgggtagagggagagaggaggcgtggagaactagagaggagaggagaggatgtgtggctggtgacaggagagagatggggaaagagagagagagtaaacgagagagggtggatagagataaggttctttgattagaaacattcacgatattttctcagtaaagtactgtaccagcttctgttttcttatactaaaatgaaatctacgacctagatatgctattcattgaattgaattccgctgaaaaattacagtgggttgagatacacatatatacttagtgttgttttctttaattattattttttactagtgaaaatactcgtgcgttataacgggtgaaaaaaatatttaatcataacatacgtttttcacgaataaccatgtcaataacaatatttgtatggatcgtttgtagctaagacaataagaaaattggaacatcttcaatgtaatctcgcatgtttttatttaatttttttacggacgatggaaatacattttttctcacgcattttttattttttacaaaagacagaaaacattattttaacgctttttctgacttttttctcacgcatttttaatcgtttttattttctcatgtttttttagttgtagaatgaaaacttctctttttaagtagttatattagattagaattagagaagagatatatactgtctactaaaacgaacagaaatcggacttcttttccatgctttttttccgctctttttattttttttcatgcgtgtttttttatttatacgagccattttttcaccactttcttaggaaatcggatgaacttttttttacatgttttttagattttttttatttttcgtcttttataggaatcagacatttttctatttttatgggaatcggatctagctttttttcactttttttcacctttataggaatcggattttttcacgttcggacctatggtttttttgccactttgtggaaccggatttttttagttgtttttcgctattttttccttttttagggggaatcggatctacggttttttttccactttttagggtagtcggactttttttttttgctttttcactatttttttattttgacggacgaaggaaacgttttgaaaattttgaagtagtagagattgctgacaccaaaatcaccaaaacttttctactattataaaaattgaagataattttaccggtactctggtacgtcatccgtgtatgtgttggtttttaaccgtattgaaaaatacagttcgttcgcttttagaaatccagatctatatttgagctaggttttaatttcgttcgcttttgaaaatacataaggagtcgtataaaaaatctcttgaaaaaaactcgcatgctaacttaacatgatttaatctcttgaaaagaaaaacttgcatactaacctgacatgattttctagaaaaatatatatccaagcgaattctcacagttaatgtataataagattaaaatagcattcaccagttgcaacgcacgggcatttatatatatatatatatatatatatatatatatatatatatatatatatatatatgatgtgcgccgcgttgtgtttcgctttttggcagttcgatcgatcttatctcgtttttcttctccgaatcatcttccacaatgcatgttggaccagacgcgccaagtcgatgaacgaacaactagcctgctagatcggtatatacacgtacatatatcactgtaggtgttggaatttgaatcatcatggcggcggccgacctcctaccggacgacgtgctggaggagatcctccgccgcctcgccccgtcgccgcgcagcctcgccgcgtgccgcgtcgtctgcaaggcctggcgcgccgccgtcgacacccggtgcccgcccccgcgcccggacctcctcccgctctccctcgccggcatcttcttctccggcttctacttcgcacatgagtacctaccggggttcttcgcacggcgggggcaccatcactgcgaccggatcttccccaagctcgactacctcgacgacgcacccatctccaagctggaggccatcgaccactgcaacggcctcctcctaatgcaagagtacatcgtcaacccggccacgcggcggtgggcacggctgcccccgacgccggagtggagccccgcgggatcggacttggaggcggtggtcaccgactcatgtcgcgaggagtacctcgtgtttgacccaaccgtctcgccgcactacgaggtgttctccatccccgagcttgtcttctgcagaggtgatgacaaagacaatgccgaatcggtggtaagacagcatgagtggccgccatcgccatttgtcgtgcaagtctattcgtcggcgacggggaggtgggagaaaaggtcgctcgtccggcgaggggaggccgccgggaccattgctgatgtgcactactcatcttggatggcaagtcaccacctctacggcgtttattggcggggtgcacttcacgttcagatgaaaaataacgatgttataaggtattagcttcctccgttttatattatagatcatcgctttgacttttcttttcaagttaaacttattcaggtttgatcgaatttcttaacaagagagcaagcactcactcaagctcattaattatttgctcatcgtttttaaactcaaggaataaaaataaattaaataaaaacatacaatcagtttgagaaaacaaagagcaaattgatttatcttttgctttaagtaattattaattcttttcctatcatttgatttattgttaaatatattttatgtaggcatataattttacatatttcacaaaagtttttgaataagatgaacggtcaaacatgtactaaaaagtcaacggtgtcaaacatttcgaaacgggggaagtatttgctaatttgttggttttgcagaataaccttgttagatgacaagtatcaagtgatcaagtcaccaagcgatatcaatctaaacaatcatccttatatttaccttggaagatcaaagaagggggtatgctgtgcatcaattgatgacaaacaacatcagcgtcttcaggtttggctgctgcacgaagtactgcttggtggtggtcagatggagtggatgctgatacacgacgtcagtctcgagcagatcatggcagatttccgctggaatcctgaagctgttaagccatggatcaaacataatacgtaccgtggcgagaacaagaataatgaagaaatatcagaagatgaatctcctggttgggactctgaggatgatagcatcgttgtttatacggaagatatggtacgatgggacatgaatggatacacttatatccttggactccatccttttaaagagattatctttttatttaactcacatcaggatagagtatgggcttaccacttacacagctcaaaggttgaattcttgggtatgttatgggtaggcttttcagaggagatagggcgacgccttgttggattggagatttatcttaaaacattttgttactaatttataataatccattattagtatactcaagacggatcttcgtggtcatatggccatcttgtctccgtagtttctttcatccacaggtgtatgactggctatgggcttcgtgtacatggcgtcgttacatgggtagagacgatgatggtgttctttagaaaattggtccttaggatttttctttgcttcactggtgggccatctgataaatggtgaatggcttataaagattgtggttgcgttgacagatggtggcgtaggaacaaatctagttcgggattggagcacagcctctctaatgtttacttaggggttctatggatctattatttcggatgtacgaatattatgatcttcaaaagccactatacaattgtggtttgtctgaatttttcttggttctttgtttgtcctctcttccactcgtgacaggattggtgagaatctggaacaacatagggtggctacggttgtgatggattgttatgacctgagattggttgagatgaacagagagaaacagaggagaatagcgaaaacatagtaaatgagttgtttgatggtattttgtagaataaaactttatcagtggcaatattttagaacccacgctttgtcgatagcatggaatggattatctttaaactaaatgctttgttctaacctacgtataatgatttgcacatatacataaatctctaaaacatgaattcaagggtcaagcgatattttttcggtcagcaattggcctcgcgcatatattttgaatctccagcaacaatcaaatggccaacagtacaccatatcactaacatccaaattttcaaacacacgttactgaaattgatccaaacagttttggctatagacatcggctgtattcagccttgaaacctattccactacgacatatcactgcattgcagctcattccgcatcagattctaccatgtcgtcgttgctgtcctgttcagtaatgccctccctctccaattcatccataaggctcctacctacacaggccatgccgcgaccgccaccccttccacttccacgtggtctccctctcctccctctacccctgctcattgccttccttaccttttcgaagtttgcgggattttttgggcaggtagttgtgtaatggccatccctcagtccacaccagctgcacaccctagtacagagcttcttcccccttgcaccaagtgatacattctcttctggacctactgtccgctctttagtctttggtttgggtggtggttcttggcttatgacttcagctgatgtgcccgcaccattgttgcgtgcaacgatatcatccctacatgccacgctgtctggaagcatctcttttcctttcgcagcactttaagggcggccatggctatttcaaatgcaacccttgacttactacctaaccgtacaatagccattgcctcagctagcagtgtcttttgtcggtaactttcttccacactgtcaggtccagctgtaacacggtcacgcctgtcaaatgacatgtcacttctggctttcatcgtgtagcgtcagagcacatactgaggtggtatcttctcgacctgagcatggatgaatgtccgaagaaggtgcgtgcataataaacctaacacaaataagcaatttaccagcagaaacaaacaattcagcaagctaaatttgttattatgtatctcggactggaatcagaagagttttgttcttaccagtatgttcccactgcttgcactcacattcataacgacctttctgaacgtccgctaacactttaaattgtagttggcaccaatcatgcttctcagaatgctccatgtccaacacaatccacctgtttgtgttgccaatgtccatgtcgatcctgaaagctgtgcaatcatccaatgcctcctcgaacaacttgaacacagctcttgtgtacacccttgacatctgcaccacgaatgaccaccttgtctttgttatcggcatgccctgcatatgcgatggtattaaaaacaaagtggcccactagtcagcagggaatgcaaaaataggcaacgatatacataccaaacaagccctggtctcagcagcctccttcgcttcccgtgaaattatgatatcaagcatcctacgcgcaaaactgtgcagattggtttggtgatcgacgaaatttctcttagctagtttgttcacactctcactctgctgagtagatgtcatcctgccacagtagtccttcttgaagagcgctgggatccatctgtgccttatttcgtacaagttttgcagggtcacactatcctgcaaatcaaactcatcaatgaaccacgaccacgcattttcaaactcctgtggggtgtatgtctggttcacgcacaacaacaattccgattcaatgcgatcgtcccttgcatatagaatgttgagtgcctcagagtgattcttcagtatgagccacctgcacagcctatgtattgtcttcggaaagacatttgttatggccaccgcgatcacattgtcctggtctgcagatacacaagattagtgaatacttatcttatcagttcacaatgtgtttactgctgaaccatgagctattgttgacataaacattgaaggaattacttgcctgttagcacgcatctaggcgaggggcaatcctccatacagtttttgaacgttttgaatagccattcgaatgattctatcttcttgtctcgcagtagtgcacaaccaaacagagtgtcttgtatatggtggcttgctccaacgaacatcgccaaggacatcccatatatgttcgtcttgtatgtcgtgtccagagtgactgcatcaccaaagtccgcatactcggcctgactgctagcatggctccaaaaaatgttcttcaccacaccatcctcatcgagctgcatgtcccagtaaaatttagagttctgcatcttgcattcactgaagaaagcgaacagtttgttgatatcatccgccatctccgcgcgtttgttagcagccctcctgtgtaaataaatatcacagattcaatatgaaactgtagggggttactgatgcaccaacacaacatgcgaagtgacaaaaaaaaatattcagcacttcaacagcaccatataatacctgatttccacgtccggtgatgtgaatgggacattttcctgaccttcatgcatgttttgggtaacacgacactcttgcaccgtgtcagctctgttcctatgcacttcaacagcaccatataatacctgatttccacgtccggtgatgtgaatgggacattttcctgaccttcatgcatgttttgggtaacacgacactcttgcaccgtgtcagctctgttcctatgcgacctcatttgtttgacagctgatggcgatggcgatggcgtcaacgggtggttgtgccctataacgacgacgtcaaaaactacagatgacaatttgccgtcagttgtgacattcttgattttaacatatgctttgcagccagtcctcttcgatgtccgtttcctctccctgttcgcctcatcgcccctgtatttgtgcctcccctcccttgcgcagcatatctcccgtatcgtccgcttcaatctgcttttcctgacatcaaaacctgcatggcatgcgtatttctcatagaaatcgtacgcgtgatcaaacgattcgaacaccatcccctccttcggcaccaagtcagaactaaccccaggtccctgccagtagtcaaatttttacaatcatgcatacggtgaaacttcacgctaacagactaaacaaaacaatgcttaattgctttcagtaaggccttgttcatttaatccctcacccaaggggattgaaaaggattcgaaggggattaatttcctaactaatcccctccaatcccttcctcatggggatggataactaggcctaaaatggatccgactgtgcaaaatagattggaatgactccgatgcacaactgctatcaataaaatggatctgaaatgggggtttgtggggggggggggggggggctcacatgggtgtaaaccatcgatcgactcggggtcgccagattcgccggctgcggagcacgaaaccgtgccgcctccacgctcctcagtgggatcgactcctcctcgcaggtgcggcggccatggcacgccgacgacgtcgtcggcacatcaccatcgccgccgcggccgccgccgccgctacgcaagcgcgaagcgacgggcaaggcggcggaagcagatgatggagagggtggcgccagggtcggggccgagcacggcgactccggcgatcgcataccggcggcgaagtaggatcgccgcggacggaggagcctttggtggttgtcttcctggagcgacacgagacgacgctcacatcggtttttacttttttaccccacggtcaattgttttgcggggaagttactgctccttccgtttttcctgtggaagcgagcgtattatacgggatgttttcttcattttttgcgaaatatgcggatctatcaaacgaggagtcgaggagcagttacgcaaatagtttttcttcacgataattttttaattcatgtatttagagatataataaattatgtgttcagtaattttatgaccggtatctaagtaaacaatacatgcagcagtactcttagcgaacaatagcctctaagccattttgtagaacatgatactcgctccgtcccgaaatatttgacgccgttgactttttagcatatgtttgaccgttcgtccttcgtcacgttgctgaccgcaaggacggtggtggcgggacgctctccccacgagtaatcccagtagcggcaggtcgcgggaggcagtggtcaggtggtaagcgcggcggatccagccacgtcggaggtagatccgcctcgcccgatggcggatctggtcccccctggccagatcgagttggagaggtggcggtagcgggagtggtcggcggtggcaatggctagatccgacgggaggcaatggctggagtagtcaacggggtggatccccccttccctgaggcagacctatggcgcaacccagtgaggcgcggggtggcacggtggttgtgaccagtggagtaggaggccgacgtcgcggcgaagggtggttccgatagcggcggagctcacggcgacggcggcgacagatgccaatacagcatgcacgaggaggcgcgacaggtggcggtgaaggctgacgcggtgtgaggaggtgcgccggcgatggcggaggtcaatgcgacaagggtgacaccacgaggagactggcaaagcggtgggctctggtgcagcggtgcccatgcgccggtggaagttagatggcattggagcaatggtacgtcaactatggataggctgtcggctagcggcaggggaaacctagcccggctttgggcgggtcaacaatggtggcattttcgagcatcactccccctcttgagggtgttggtgtgccgtctcatcccctgtagtgggactgccgggtgaaatcccagtttgcattctttttgagacctcgacggcagtggtggcggctctttcgtcgcttctctccttggagacgtcgtctaggtaacctcttgccgaaacctcccaaacatctagtgcaagctcgctttaaattcatgtctttttgggttgtcgccctagcttatgcaagttgaccacgtcgaagggtctaggggagagcagttctcttcttccctgtcaccccctctccctcaatcccaaaaataaatatggatagagtggggtttgtgttggttgtaagggttgggttttgggcgatctcggttgtagttcttttgttggcctagcgacagctggtctaatgctagcattctattcggtctttctgttggtgatgacggggcgtagatagtggtatatttttttcattttcctagtcacgaccacggatcagatccgtaatcttagtaattttttttcatactctatcctttaaaaaaaatcaaggttcacgaagaaaaggtcgatgtgtagcaccaatgtcagatccaaattatcaaagcagccatactatgttactccagaatgaaaatttctcgtcttctgaatgtagtaggagtacttcaattttgttgcataacgccacatttcggacaattaagaggatcgcctcaagtgatcatatcgaaaacatcgatggtcacatcaagaactatctgaaaagttttattcaaacttgttgtgtcgagcacaaaagtctgca

SEQ ID NO: 66969 - DNA, 23182 bp, Oryza sativa
aaaaagcgctttttcagtcgtactcaactctgtagtctctgcttgttttggactttgcttctggatccaaattcacttattgctttacgtagtaatgcatcgcgattatttaatccaagaataatttatgggtttctggtatgtaaaagaaaatagattaagactcggtcagattaatccagctcaaggacgaggttccagaagaacatacagcctatgcaactttccaggtaaaactaagatatattcagacttcaagtggcacatttgtgcatggcatatcttggagtttatacttgttgtctgatcgtacaagtagatgacgcattgacctatgaggctgttatcaattagtctgtacaattaactctggctaacaacctgacgacggggctaagtgtcgttatctttgaagctatacagtggcttctgaccgatggaacctcacgggacacacttgaaacttgatcagcagctagctactccctccatcgtatcctcgtaatataagagattttgaatgattttgaagggatctagattatttatagttgtggatattatgggtaccccatatccatacggcatggttatccgactagtcataggggataacttatatttatgtaatgtgtaacagatcatgacttgggtgttacgtttccttgtatattacggaacggcctaaagtcctggtttgataatattgtgaagtagatttaggaaaccgataccgtattggttaaggtttctatcttgtaatcctgccccccatcctatataaggtgggcaggaggccctctagggggcagatgatacaactagatcgtcagatctataatacacccggcggattcaaatccccaaacaggagtagggtattacctctcattgagagggcctgaacctgtctaaatcctttgtctccgcctccatccacttttaggtctcgtgcgctacccccttttattattgccgaaatcatgtttcgacagttggcgcgccaggtaggggtgcgtcgagtttcttattgacgagtgcgatggaatcaattcaagcgttgagattaatctcaacaagttcgacgacttcaaacgataatcggtttgtcgtttcaatatattattatcagattgatctataatcacatttgatgctctggtattttttttcctcggttacatgtactgccggttggggtgttcgctggttctctgcgggaccaccggtcgagccatcgtcgtcctcacgttgttcgtcgcccattggcagcacgacaccgacaccaggcgtacacgacgacggtgcatgctatgaccatacactggctagagcaagcgtatagattggttctgatcaatctagtgcatgcactgccaagtgccaacgatcattgcatgactggattataggagcaagcaaacaaacctcgcatcactaatatatgcatgcctatagcaagtatatatgtatataggcatctgttttctatggtgctaataaatttttgttgtttgtttcgcatgtaccgccgggagcaacgtgctcaccggccgcctccacgcatgccgccaggcggcaacctcatccccgcgtcggccgcgtttgttgctatcgtcaaccgcgtttcggtcgtcgtgcacatggtcgccgagttttgcggagtttctggttgcttgcaggcctggcctattatgccgccgctgttgggcgtctacgacttcaccgccggcctgcctccgtcgccgccgattggtgcctccgcctacacggctggcctattatgccgccgctgttgggcatctacgacttcaccgccggcctgccttcgccgccgccgactggtgtttccgtctgcacggctggcctattatgccgccgctgttgggcgtctacgacttcaccgccggcctgccttcgccgccgccgactggtgtttccgtctgcacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacgtcctcaccgttggctcaccttcgttgccgtcgactggtgtttccgcttacacggctgacctattatgccgccattagtgggcatcttcgctttcaccgtcgaccgccttcgtcgccgccgactggtgtcttcattgttattgatggacgactttgttcccacattggccacttctgccatcaccaaggggaatattacaaagctaagtcatcatttattttttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggtttcctttgggccgattcctagcacccgggggctcgttggatggaccgagtaacgcaaggtgctaagtattattcggaataaatcaaaagcatagagatgagataaatttattttctgctcttaataattgcaaaagtacctaagtagtaaattctgatccgtgaaactttgttccattaatgacgaactcatgtcactcatatgcatgtttgggaaatgcctaggccgactcccgatgcttggtggttatgactagtcgggcagagtgtttaaacgtacagagtcatctgctcggggaaatcaaaattgacaagaggagaaatacatatttataaatattttaaaatacttgattttttctcgagtattatatttatatcagatactactcatcctatatgtttgttctgcaggatccagatccagatatgcataaaagggattcatggctttaagcttatctcttacgctccaggaatggatcagtcagaacatcaccaccggctcgcctcgaccgccgccgactggtgtttccgcctgcacggctggcctattatgccgccgttgttgggcgtctacatcttcaccgaccggcttgccttcgccgccgccgactggtgtttccgcctgcacggctggcctttatgccgccgttgttgggcgtctacgtcttcaccgaccggccgcctcgaccgccgccgactggtgtttccgcctgcacgtctggcctattatgccgccgttgttgggcgtctacatcttcaccgaccggcttgccttcgccgccgccgactggtgtttccgcctgcacggctggcctttatgccgccgttgttgggcgtctacgtcttcaccgaccggccgcctcgaccgccgccgactggtgtttccgcctgcacggctggcctattatgtcgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcactgaccggctgccttgtccgccgccgactggtgcttccgcctgcacggctgacttattatgccgccgttgttgggcgtctacgtcttcaccgaccggccgcctcgaccgccgccgactggtgtttccgcctgcacggctggcctattatgccgctgttgttgggcgtctacgtcttcaccgaccggctgcctcgaccgccgccgactggtgtttccgcctgcacggctggcctattatgctgccgttgttgggcgtctacgtcttcaccgaccggccgcctcgtccgccgccgactggtgtcaccgcctgcacggctggcctgttatgacgccaactgatgctatcttcttcacggctggctacatcgctgtcactactaataggcatcagtatcttcaacacaagctgcctacgtttgccatggctgccgactggtttcttcacttccatggctgcatgattctgccagtgttgattggccttaccatcttcatcgccggtcgtctcgtctgctgctgactagtgccctcgcctctacatttggtttatacagctaccactactgatggacatcatcgtcttccgccgccgactagtgcttttatcttcacaactgcgcgtcttcactaccggtttgcttctgttgccgccgactcgtgttcacttcatcacggcaacacaactttgtcatcatggtggagcgacttcatctttattatcttcggtaccagcaaactctattgctgctacttcacaagttttgctacatcaccaaccatgacgttgttgtgaatctcgacatctcggcatgcgatgccgtgttattttactacaacaagtggctctccaacattcatgatttctacttggacatcttcaacacatatcttcaatcaagcaatgactattcgacgacaagaggctacagttctcgactctatgttcagttgtttcccaactaatcaaagagtcgggggctacacaaatacaaggctcaaaattttgacaaattttatgtcaagctgaagaaatcaattcatcaacccacgagtcaactccaggagtcattatcttcatctttgcttcggagcagacattctacttcaacaacttcaaatatttcggtttagacgagttgggcaacaacatcaactcttcacggttgacctactatgcaaatgctgatgagcgtctttgtcattatcattggttgctacactgctattggctggatcaccgacatcgtcatcttcatcatgtcggttgcgtttgtcgtcgtcaactacacaactttatcgctgagcgccttcatattcattgctggctgacctgactgccgccaactggtttcttcgcctccatggctatgcgacttcagtacttttgattggtatcactatcttcactaccaccaatatttttgccacctctggtgggcaatattctctctatattggttgtcttgtctctatgccaactgcgtcagctaccatcaatgaacaattgtgactacgtgctcaggggcttactagctcaaatacaagtattatatcttcaatttggacttgctccggatacatgcaacatgaattcatgatcatgggtctattttatatgctcaaagactggactatttattattccccgtaagggttatcaactgaatacttgcgccagtcgggattcaattgttacatctattttggagtatcccataagggataaccactcggatcagaagctattcatatgagctacgcttggtctatattacccggaagatttattactcgggagcatgttatatgcgtcatcctttaaagggtgtcgaaggcatatgttttggcctaggcctaatatgtctgcagcccatattttcaggtgtggcctgtcacgttcttttagggacttaggcactttttgcttaggccaaagtgcgcgtgatcaagtgcccaataccttaaaattcttttataccgcagttacttaactttttaggagttggtacaatgcatcttaaaaggtgtcaaacagtaaagctttatatagctgtcccgctgacttttttatatataagtcaaggtgttgtttgggtttttaagcaattgattggatacaatatcattgcttttcgccacgtaagtgtgcatttttattgaccaatattatggcttaggctgattatatattgtggtcattttctaggcggttggtaaatcctttataagtttatttacttggattttataccacatatgccatatatttccaggtgtggtggaaccatgtgtcttctagggacttaagcacatctgttaaagcagtgtgcgcatggcgtatgcccaatactttggaaatttctttattcacaacatacaagcttttttatagctgttttgctatgtgaattttcaataatgtagccaactttaggttacactcatcatattttgcaaagcagtcggtatatcactcggatcatgttattcagggatttacaccgcatatgctacatattaatatcaagttgcttggttaattacgattatcaaaaccacttggttggttggattatttattccttgactatatgcttggtttgttcaattaaccacattgtcaggggctacacctattaggtgcatctagtcgatgcacctgactatatttttcagccctccacagtcttcagatttggtaaaagtactcgggagaccatggcgaagatgattgaagcactcggctttggagtaatctagttcgagagaaggttatcttttcgactgcgaaggtctcaggagctactgtggatattatgggtaccccatacccatacggcatggttatccgactagtcataggggataacttatatttatgtaatatgtaacagatcatgacttgggtgttacgtttccttgtatattacggaacggcctaaactcctggtttgataatattgtaaagtagatttaggaaaccgataccgtattggttaaggtttctatcttgtaatcctgcccctcatcctatataaggtgggcaggaggccctctagggggcagatgagacaactagatcgtcagatctataatacacccggcggattcaaatccccaaacaggagtagggtattacctctcattgagagggcctgaacctgtctaaatcctttgtctccgcatccatccacttttaggtctcgtgcgctacccccttttattattgccgaaatcatgtttcgacaatagtactattacatccctccaaaatctcttatattttaaaacggagggagtactacaatagtagctgaattttgtacttgcaagattatccggcacaagatagaatatattcttgcgagctgaatggatatatatatacgtgatcgactatggagtacacagcataaatacttatattcacttattccgaaaaaaatacttatattcacaattatattcgcgaaagtggtatggtatggtagtatattatgacatggatgcatgatcgatccagccttatagcatatgctacatatgtacgcgcattactacgtggtgggctagatgacctgggtttaaagcctcattctttctaattatttgatattatgtcattccctaatattcgcgttactacgttgcaaatgggtgggcggcatctatattatgaaaattatgctagcttatagataacttcataacacataaaactggttagaagtgaagtgagcgtaactcaacagggttcaagttccagacttgacacggccgttcgtatttatgtctaattattttttcagtggtatgcgacgtacctgttgacataaaggtaaggtgtacgtgtgttttttataaggatcagtgtacgcatgttgtgaacgcttatatttgtgctgtgtttctcgaagaaaaaaatatatcacctgataaaaaataacgcatcatggccattgctacagatattgtaaattgtcgtcattggcactgtaatatagccaactagcatacttatcaaaccagtttggatttaataacctattcttgctcttcagacatcaaatcagagatattacaatattagtacttagtaccagtatttagacttggaggaccagtgaagtacagagtgccaactaaaaatttgaatataaggtaaagagtaaattgcattgccggtacatgaacttgtcagatgggtgtaatttagtgcacgaatttgtaaaatgtttgttttggtgcatgaacttgtctagtacatacggaggaaggcgaaaaagacactacatagctaatcttattgatttagaagtttattaggacactatgtaaacatagttctaagaaggttgttattggacatacacattttcaataaaaaatagaatatgatacagtaatagtagaaaaagattaaaaatccgagcaatgatacaagggttagaaatatatgaaattcatcatttccacgatgaagggtaaagtagagaccaaatttataaataatgcatttcttatgcatactcactacacgtatgtacgtcacattctaatcaacatctcaacttcgtaaaattaacattgacaagttattttggtcctcattcacacgaactagacaagttcgtgtactgaaacaagaattttacaaatttatgtattaaattgcatccacctaataacaagtttgtgtactgccaatgcaatttactctaaagtaaaatttgattgggaaccaaggccccgcttgtcatacattgaatccacccacgtgttttctcccaattgaattgcatagactcgagtatatgtagacattgcaaaagtttctttagacatgctctgataaactggtcaatgtatgcagctagctgcatggaggaatcggaccaacccatgagctaatctgatctgagcgacccttcagaattcagtacagcatcaacctctcgttgtcacttcggactaccggagacaaattccctatagagattacttcggacattctttgaacaatggcatataaaatcgtttttgcaaattgcatggtacactgggatggatgaatcatgaatggatatatgctttggcaaacggcctaaaaattctcttatataaatgtgggatcactctctttctacaagcaattctacctgctacaatggcttagatctacatgcaaaggtccaaagtatcattattaatactcttcatttttaacagaaaggcccagcaacataaaaaaagagtagattttacatacacgttttgtgacacttaacgcttaagtattaaagtttcaaaaaatcgcaatatcaacaaatgggttcacccgcgagatgacatagttctttccttgcatatatttaggatgtaggcatggcgaacttaaattttcgcaaaacatagttctatctaggatgaagctcccaaatctatattctaggtggaacaaccacgtcattttgtaggtggatctgtccgttgataatatagttttgcgaaaatttaatccaaaataaatatagttaagtgccaagtgtaaaaacatgtgtagttttttacaacttggaccataaaatatgtaattctattaaatttactcaaaaagagaaggactagcactcgagtgggcttaatttttttatctgtgagatttatgggctgacacaagtaagcctgtgcagcccaggtagagttcgttttgtgcccagcccaagaaattaacacgaagaattcggactatccaaataagtccgaataagacacggcccgcagattatttacggctcaaatgagtcagaatggattgccccaaatgcaaaattctgtgcatatgcactgccaattaattcacagcaactgtactcctgttcatatcaatcaaaacacaattatttggataaaaaattccgacactatctatctaacctactacttgcactgtccatggttgaattcctgtcttgttttaccggccttcagtggtgaaggagatcgagatggagttcctggagtcgtcctcggcaatgccgcccagcgccgccgcagacgccgacgccctcgtcgtcatcgtgtcggtgccgagcgtggtggccgtgttggcggtggaggcggcggagaacaccgtggtggtggtgctcatccaccggccgacccggccgtggatcgccggcttgccgggcttgggcagcgtgaaggagtcgctggacagcatgaggtggacggtgtacatgtccggccggtccgacaccacggcctggcagcacagcagcccgagctgcacgcacagccgcgcctggtcggcgtcccactccgccatcgccgggtccacgatctccatctgcctcccttcctctgacagcttccatgtctgaataatttccagaaaaaaaaaagattcagtcacaactcacaatgctgctcctggaagataaattttcagaatccagtgttgttatttcagagtacttacgtaattcaggaggtcggttttttcggcgtcgagatgtttatcgatgtttttcctcccgctgacgatctccagcaccagcatcccgaagctgaaaacgtcggttttcgtagacaggtagccgttcatcgcgtactctggagccatgtaaccactgcgacgtatcacttactgtactcacacgcaaccacagagattttgtggacggatcaagtgaataacaacgatgggttctggtgtaattactcactatgtgccggaaatccggaaggtgttgacgtgcgtggcgtcctcgaggaagagccttgccatgccgaaatctgaaatctttgggttcagctgttcgtcgaggagcacgttgcttgccttgatgtctcggtggatgatcttgacgggggattcctcgtggaggtagaggaggcctctcgctaggccgacgattatttggtagcgtttgggccaatccagctgcacgctcttctttctgtctagaggtacataaacaggtatcatacatacagcaggttgcagagcattttctgttttttttttttatgttgtactacctctgtcctaaaatatagtaacttttagtcatatatctggactagtgctaaaagtcattatattaattttggaatggatgtagtactgaatactgatctggttttgtatggattatatatgcagatggaattaagtataggtacatgcgtatctttatgtttaaactggaaattgtaaagaacataattagttatgctttatgtttttttttaacaaaatcatggagcatttcaaactatggtacggagtagctaattgaactttctgtcttttgtttgtccacacagaagtttgtgtgtgtgtgtgtgtggggggggggggggcggtgttcagattactccaaatgacaagaaatcctattcgagaaatggtcaatccaaagacattgggcggcataatggcatacagccatacccgatttgatgtgatatgttgagcctttgagattaagcaaatcgaagtattgcttttgacacagtaaaggtcaatgagaacgtcaaggcagatttttccttacattgactgacaaaaagacttcttgcagattctgtgttctgcttaattgactgaacaactctgtgtgactgtgtctgtgcgaatatatgctttgccacggctaactcatcgttttggtctccttgaaagttgaaaccactaggccacaaacaatggaactccagtagggacttgtttttctaccagaaatgactgtttctacaagcactttccctgaattttgttcagaactaccatagagttttggctattatgatttgtgcaccacaaactctccaacagagtgcctagcttccgaggttagaacctttgtgttttgattaatgataaacagataacagtgattcgttatactactaaaaaaaatgaccaaactgtcagatttagctcacaaattctacccgtaattcagaagcaatctgatggcaattaataattaggacattttgcaacataatacagtagtatgcagatgagagagaggtgtcaccgaagaggaagtggtcgaggctgccatttgggaagtaagggtagacaagcatcttgtgaccggaggaagcgcagcatccgagcagggagaccaggttcctgtgctgcaccttgagcagcagcctcacctcgttcaagaactctctcacaccttgccgtgactccagcgacagcttcttgacggcgatctcctgcccattctcgagcaccccctgaagagagatggtaacaagatcaaccgattttttgtcagttagtagttcattcttcccaagatgtaaaattcctgacaagtaatggtacgtttattatttactactactgctttgctttgcaggagtaaaaatgatgctttggttcgtgcaatgttgagattagaatctcaaaagagaggaaaaaaactaatatcgcatattaatttgacgaaatgatgtctgaaagtagcagagcaggtataatcagttattagtggtgaaaaaaaaaagagagagagccagcaaacagtagaaaagatatttgtccatggaaaagatagtacacccattacccatacatagacagggttagatcaatcatttgtgtcgttttggtaggtgaaaaggacaaaatcagaatggaaagcaaggaatggctttgttgaccaaccaataaaaaaccagtctttgttaatgttaggtgaattccacaagcaaaacagggcaacagcctagcagcaaagcaaagccatggcgaaaggggacgatgagatggcagtaagaaacaagccttgtagacggggccgaatccgccgcggccgaggaggttgtcgtcggagaagccacgggtggcggcctccagcacgggcagctcgatgaagaggctccactgctcctcctccctccccgacgccgccccgccgccgccgccgccgccaccgccgttggcctcacgatcagcgcctcctcctcttccgccgctgctcctcctccacctcccgcaccagccgcacgaccacggcatggcagcagcagagcaaaatagagagaaattaaaacaccaaagcacacgagtacacgacgcagacacgcagaagtgcagtgcagttagctaggtgtgacgtttcaacgacgcgcgcgacccggtggcggggtgcagagctagtttagtgcaggtagtctggtgatttatggaggagacacgtacgtacgtcgtccatgaccgtggggtgtgtttgtatcgcagtgttgcaggcggcaaagccggcaaccgcgtttgcttgcttggtcagtgtccaaatgggacgagagacgactcgtgccttgactttctagtagtactagctagctcccatcgtatcatacgtggccggcggcttttcattccagccagccattaatagaagacgcgcaattgattgacctatcatcgatcagtcgtgctcctcactttactccctccgaaaaaaatactacatctccgtcccatgttacctgtaattttgactttttatatgtaacatttaatcattcgttttatttaaaaaaattggtccaaatataaaaaatgatagtcatacttaaagtacttttatgataaaacaagtaacaaacaaaataaataataattctaaatttttttttgaataggacaaatgattaaatattaaaataaaactcaaagcgacaagtaatatgggatggagatagtactacaaactatactactagtatttcgacagaaagttatctagatttgtcaaccttttatcaatgctctgaacctatgggatataccgcagttgaacatatgcatgaagtattaaatataggctaaaaaaattaattgcatagattgcgacaaatttgcgagaggaatcttttgctaattgctacacgatttgataatgtggtgctacagtaaatatttgttaatgacatattaattaggcttaataaattcgtctcgcagtttatagacgaatcttgtaatttattttattattaaactacgtttaataatttaaatatgtgtccgtataaccacgtgacatggcaacatgatctaaggtcagcggtaattacctaccgccggccgtcgtgatgcctgtgggccctacagcccgtcagcacggcctgtctcggacgatttgcattctatccagcccaacactatttgggccaccgagaattgggcctattttatgggccgtgatgggcgaataggcgggaaggagcccaactctatgggcttcttcgggctccttctacccgagctaatgttattaggccgaaacggcggctctggcttacgttgttgggccgaaactagcgatgaacggaccaagcttgcttagttgttgccggtaacatgttactgctacaagcgatcaatgggacaattatcgcccgtgaattctacctgatgatttatccacgtgctcatcacagccagcagggaaggccagaggcgggatgattaatttgcatggccgacacgtgattgccatataggattaacggggtgaaattaaacgacaaaaatcatccctgatctgttcttccctgttgacaccaaattaatcgatcctttttattacggttaaacaaccaattctgggaggtgatgcgatgatgttctagctagtaagaagagaccaaacaaacagactattgagagttgagactgctaccaaattcatcttatttattggacagcaaccacaacatactagtactacgtactctggtcaccgaaacattccctcacgatccagataaaacaaacacaataaagaaaaaaaacacaataaaggaaaaaaaacatacgtgaccacacgaatgttacacatatgtcactgctactcggcagcaagcaaggcgttaacgctgatcgagcggtcagcgcgtgcgcccctgctcgacgcgtcgctcttattcaccgttggatcgtatgatctgaggctaattaacatgagtagctaattaagctggctggttgtgacacttgggccccgggaagccgtggtagcgatcgaggcagcggaagcgcggcggctgcgactccacctgcacgcacttgccgcagccgccggagcacgacttcaccttgtcctggcagctgcacgtcggcggcatcgaccttgtgcacacggcgtcgtcgcagcatttccacggcctcgacctcaccgcctcctcgccgccgccgccggtgcacttgggcccggggttgacgccccagtaccagtcccggcagacgtagccgccgccgtcggcacgcttgcagtcctcgcaggcggcggcgcagtggtcgacctcgtccaggcacttgtacttgggcggccagatcctgagcggcgactgcttcagcttgtcgcagcagtcccacggcggtgacggccattcgtcgccgccgtcggtggggaggcggatgttgctgttgggggtgacagcggcggaggagatggggatgccggcgaggaggagggctcccagggtgagcgtcagcaggctgccgctcttcatggctgatcgttttttgttctttaagaagttgggtttgagatgcagagtgtgatagtagtgtgtgtatttatagaccaggaaggcagcaacggggcccacgaacgagtccacgagatgtggagaagagcgagcgcgcacgtggcgctgtccccacttgtcagaacacgggaaacacgactgaactagggaaactattctaatcccttaataatgttcctttaaggatgttccctcgtttgctcaaaaaccatataaacggttatgaaaaattctggaaaaaattgacaatattcagacaacacatatatacaactccataaaatcttaagtccaaactcaactcacacatcgagatataaaaaagacaaattcagcgtataaatagtagcgtactgtttatatgtaaatttatctttttttttctcgatgtgtagatcgaatttgatcatgaattttggtgaactagtaggtattattatactctacactgtcaatttttttcagaatttttcataattatttgtatcaaatttaaaagaaaaaggtatacaaggaatatcttctcgagggattagaatccactcccactaaaatatggaattgtggtcgggtctggacttctcggtggatggaaagggcggatggtaacagtaactgcacatgagcttcacgaggatcttggcatcgtgcaacgcatgtgacggtacacgcatgcagttgcctccacgtgcgaaaaagggcactagcctgacgcatctcgctaatcgatgcctagtttattgatgccctctgcagccctggtccctggacggagtaattggtcatgtcatgtcaatgatgtcaagtctgctggctgctgcaccctgcacgctgcggaactcctcagcctcaagccctcaacacgttgctcatctcgatctttcgtccgtcggcctcccgtgtcgtctacgtgggctggacgggcctgagcgctttgggattttgggcttttaagaaaaacaacgagcttgggctcctaatctgattcttggggccttgccgtcagtgggctgcaaagaccggcatttactccatcagttttaaaatataaggatttttgaataatactaactcaaacatttttaattttaactatttatagaaaaaaaaattaaaacatcaatcatataacattgatgttagtataattatcattaaacttttttttatttaaaacatcttacttttataaatattattagttaaaatagtatatcgaagactatgctgaagtttaaaagtgtttatattttgaaacggaggaaatagatcgtacgtaattggtggcatcagctgaactggtgcgtgccagcatcgcacccactgtcgtagtgtagatcatggatatatatacgagatcatagaagtagataattaataactcaccaggcgactgatcagtatatattagcactgtattagtgtattctcgatctcacacttgcagttaatttcgagatgaacatatatatgatcggtactacgtgattccgatccttaataatattagattaattagttaattaatcaagcagcttaattgtgtggatcatatgaatcaagcgtgaggaggaaggaggcccttgtcctggaagctcttgatgcagtcgtcgaacatctgctgcacggagaggaatggcgggaagccgagagccctgatcttggcggtgtccatcttgtgggccctgtcgtctcccttgtggctgccgcactccgcggggatcgggtaccccgggtacctctccctcagcgaccccacgatctccgaccagtgcgccacgtggcacgagcagatgagccgccccgacgccctggcgtcctccatggccaccacgtgggccagcaccgcgtcgtccacgtggacgaaccccaccgtcgtgttcgggtacctggggagctcgccgcggaggagggcgagcacgatcagcgccgtgctcgtcggcgcttgcaacaggatggggcccacgacgaaggacgggttcacggcgaccatgtcgaggccgcgctccttggccagccgccacgcctccctctccgccagcgtcttggcgtaggcgtaccagaggccgtgcgccgcgcagtaggcggcgtcgctccagtgcgactcgttcagcgccgccgccgcgccggcgcggtagcgtacgcaggagcaggaggaggtgacaccacgcggcgcgggcgcggcgacgccctggcgcaggagcgaagctcgttcgacgcgccgcgcacgatcggctccactagccgctgctggacctcctcctcgtcgtcgtcgtcgttcggcttgccgttgttgctgctgctgttgccgaccaccacgacgggggacgccgcgtggaacacgccgtcgacgccgcggacggcgtcgtcgaagctaccctccaccatcaggtcggccttcaccagctgcagccgctcgctcgcgccatcaagctcccataggaaccccaccttggcttcatcctctgcatgcacacatgctcagatctcagacgtgcatacgtcgtgttcgatcatttgcctcaacggcgcaagtgtgcgtgcgtgttacctgggtctctgacggtggcgcggacggtgtggctggcggcgagcagcgcgcggatgaggtgcgacgcgatgaaccccgtcccgccggtgacgcagtactccggcatctctctctctctctctctctatctctagcttactaccgagagcgatctctttatgtcgaaatgacgttaatttattctgaacttggggagctcagcaatcgaaatgttaattatttcttcctttgattatcattttagaagaaagaaactccgttggccggtttgaattaggttggtcatgggaagatcgaggtatagtattactcttttctagagaaggttagtgtgcatgatgagcttgaatttgtaactgcaacttactaaattccaaccttctcttgtagctattccacctgtttcaaaatatatcaaccttataccagaatgtgatacaatgtgcagatttttattgtagtacaatgtactcaagattggtttattatgggacagtgggattagtaacttccaacttgctcatcgtcagtcgatctcgctggattcattaattagcaaatgacacattggctccatcgtttcatttatgcttatgcaagatgtactaattaatgtgttgttagtatactttaggatcgatcaaattaaaccctggttgctcttcgatccatcctcacgatcctgtccaagtaacaagtagatgcaaggcgtagagagggtaagctctaggttcaattctgcaacagcccggttatcatcttggtggttacagctacttgcgtcgtcggcgactgtacattcatcgccattgacgtccttggaggaagaagatgaattgtggcccggatgctttgcaccacgttcgtcgtgagcttcgcttcgcagacggcgacgccgtcgacggtgttcatcatcatgtagcgagggtggatgctctatagtactatccatcagcttggagttccagtggttcatgacctctttgtctgtcctccccggtagcctcccagcgatgagggaccaacttgatatatatgcatcaatattaatttgatcattgcttaattataacaaacggtgaattaatagcggaatattgttgatattgggggaattaattaattacgtacgtaccggttgccgagcaaagcgtgcagcttgaggaggagctcgtcctcttcctcggagaagctcctcctctttctgctccggctaagcggcgacggcggatcaccggccggcaagtgctcggagatgagccgtggtggaggctgcgatgacacctgcagacttgcagagctgcgccgtcgtggacacctcattacacatgtgttagcacaaattacagctagagatcgtcttagctagatcgatcgatcagtagcagtagaagagacaatataattctgcatgcatatgatcagatgtatatatagaaacggggctagttgctgggagatagagaggctttgacttgactggaatggaagtcgatcaggttggtcgagctgaggcgaccggcagctggttggttcagccgggtacgtgttggaacgaacgataatgcggcttgctgcaaggggctcgtgcgcgggcagcagcgagcaagaattcataaaccggccatgaacgcttgctggtagctacaaaccatccattcccggccctgttgctactcccctgcttcgtattgtaaggtgttttagtatttttctaaattaaggtgactttgactaacttttttagttttttgaaaaacacaccaacatttataacgtcaaattattcgttaaaatctaccataaaatatgttgtatttatttgttattgttgtagatattagttatttttcctacgaatgtagttaaagttaaaaaatttcgacttacaaaaccaaaatacgaatactgcatagagcgatacggtgaggattccatatgccagcttcaaatttctgaaatttcaggtacccaaaaactattttgcccgaatttttcacccaaaccagctggtaagtaagcatgcgagaaatgctaatctcaagaggcgcacccgacaggaaactacagtaaattaacagcaagtcaggtgctaactgaactagctacacacgtaaaataaaagggtagttccactttgatcggtagctgtaatagggaagcagtatacctaccaaatcactccacaactgaatgagacttatgctaccaagcggtgcatgtccgcaggtcacacgtggccggccggccattctaatcgaccaaacgtaccacagtagatgcatatgcccgagcatttgctaaaattcagcataaacttctacattcattgctgtaaactgaaatgaaattgtacttccaatggaagggcaaaaagccaggacactgtgcttctgtcttagcaaactcaaactactgatgtgggttacatgttacctctaaatcgtgatgccataagaaatttggcttgtatatgtacatcagctataactaggattccactgcagtgttgttcttgtggaatatgtacaaatgacttcaaaatttggggctcccatcttgccagaactgaattctataaacttttagttgcacaactaaatttgttaaactagttcatgtgtatatagtttctcctgcggtggtgaacaggccgatttcttagaaccacgattttgtgcagggtatagtctaagagagcttttaagatgatcaattccttgtcttctaagagcatttgggttgatacctgccttgtgagctgcgattactccaatggcttcccaatagttctggacatttagctggggagcaaaagggtcaacactgtaagattgctatgatttcttgcataagtatcagaatgagagctttgtaaaattgtcaagacatgtggtacataccgcctctatattgaacttgtcaggggtatcatcaagaactgtttcattttcttgaaccgtaatgattaagggctgcaaaaaaacaattattcatgaggataataaaatccaaatggaaagataaaacatcacttatcactgatatctaccttgttctttgtagcagttctagcaaaggcaatagtaccatctcctccgcaagcatcttttggaagaatcacactatcaacatcactagccactatgcaaccattatccatgtttccattcctcctcatcacatattgaggggcattgcttaacccggcaagcacacaaggtagaaaggtatgtccaatctgttacaaaaaaagatcaatgagaactggtacaaaaagatgatataaaattaacgagcactgcttaatttgacataggacagcactgatctatatgctaggaatggatgtgaacaagtggactaactttaagaaaacatgtaactaccagatagtgaacatttgaaattagcctgatatacaacatttcattgtagggtcattactaagcatatccctgatatttagttaacttagttatgcaccagcatagttcagcagaaagagtagaaacctcttcagcagcagatcttggggacactgacagactgagaactgggggtaaaactgcaggagcatgggcagctgggattttgaatttcttcacaattagatgactgataatcgcttcaactcctgccaacagatcaactccctgcattgatatggcattgaagaaaatacaagattagaaatgatagatgcttggaaatgctgaacaccacccacaaatgataacctcagcatgtctaccgtgatcagtatcaaccattgaattgcatcaatataaaaattcagcgagcaaaatgacaccataaggccaacagctttcaaactacttgaaaagagagtgttgttgcaacttgcaagggacatttcagatggtccaaacagtaaatttgaaaaatcgaagagcatcccataacaaactaaatcaagacaacatggtgtttcaagaattctaagtggcacaactatcagtaacctgttaggaaaaataataaaccagctacttgagcaggcaagtattacctttccttcccgataacaatctgaatcttctggatcatcatctggaaagcgcgcaacaaccgccacagcattcacatcagagcggttcaccagggcctcaactgccctcaggagagaatcagagttcccaacactccctgtagacttcccacattttggatcaaaccatgtcttgatctagaccacaaatgagcaggtcataagtaagcatgaatattacatcaggcactaaattatctttctaactagaggtatcactagatcttaaacgtattctcactcacaggacaaaaaaagaagggatcagaacagaatgagcacctccaaaggagtatcagtcacaatgtactcgactacagggagcccaagagaagccctcgcggcatccgcaacctgcaagtgacggagtcgaagctcctcctcgattccagaatccaacaccaaacctacctaggttgaagcagccacaatgtgtcaatgtatcaacaaaaccgtagctaactagctacctacagttacattatccatggttgtgtctgagcaatctctagaaccactaaattggtagtagtaccttgttctggtgaactggttggagagcccaggatccttcagcgaacctgtcaagggcgtatccctcaacgtagagcgtgttgggcatcggccagtagagcatcgcagcgttcagcacctgtgattatgtgaagacgaaatcttcaaccatggagaagccaaaactaaccctaacagctactggaagttaatacttacattggggtgggagatgacgcagtcggcgacggcaccgagcgcgcgcgccacgggaagcgcatcgccggcgaaacccccgacggcggcgccgactccggtggggaccaccaggacggacgtgtagggcctcctgaagctcgggccccgcgcgctggcagaaggggcgaggcaatgagcccgggagctccgacgagtcggccgcggcggcggcggcgacggccggaggaagggacgggtgaggtggagcgccattgccgcggcgaagcgagggcggggacgcgaacggataaggctgtgactcactgggccgccaaattgggcccaccactcggcccaattatgcactgaatcaagggggcccacctgtcattctcacgtagaaaccaccaaacccttcttcttcccccatctctccgcagccaccggtggagaagattcgcgcggccgctcgcatgtcgtcgccgtcgccggcgttgtgcgccgccgcctcctgctccaccccgcttcgcgttgcgtcgcctgtcgttcgg

SEQ ID NO: 66970 - DNA, 4439 bp, Oryza sativa
  unsure (1)..(4439): unsure at all n locations
tgatcagcaaatccaaaccagtcatgcactaccctgttttcacataaaagagaaaacaaatatgggttgcctacaaaggacaatgatcatacagaggtaatatataaaattattagcatgtagtaaactcttaaatcatttatccttgttagcgaccaaatttggtaattcaagtatcgaaggtgaagataaaatcaaagcggaatctaagagatagatcgttccggaaacagagcaagaatcggccgaagtccgaatcggctacgaccagaatcgacagagttcgagtcggacaaggtagccgattgagccgattccgacaatgtgactcggtacacgttgtcgggttgagttaatgtgcttcatatggattgccatgcacggattgagtcctgaaaaggcaattgtatctattaattagaatattttatgtaacttccttagagataagtttgggcaaaagtctgccgtaaagacttatggtgtcttagagtttgttaaagataagagtcgtgtccgacaaggacatgttttgtatctcgggtataaatatgactcgaacctatgtaatcaaacaacacacattcaatacaatctcgacgcatcgccaccctttttactttcgtttcatctcgacgaattcttgctttcgggttgagttgcatcgtttcgatcttcaactagaggtaaacttgtcatgacggcttgcgttctcgggattagtgcttccatctttatgacactctaatcctatttatgtaaatcgtcgagttatcatatatcctatataatctctggcaatattgttatttaatccttaattagctaacatatattactggaaggcagccgattaggttaaatattaacgttgacctagattatatagggtatccaccaccctatgaaacgtccaacggcttgattgtctagatattgtccttcttttctgtcacgcccggaatttctatccaaaattccaaacgcttacatgtgtgtaaaccctcgtccatgaatcagccgaggcacacaataacaaattgataataaagtacaattattactctaattaataagcgaataaaatatcattacagaggtagatagttcctctcaatcaataaagttctaagcagcggaaaataaaagaaacagcgcaggcgactcctctccacaggtagcttgaccaggactaggcctaatcctcaacaccatcagcatcactatagaactcctcctctgatgaatgattgcaaggtaagtatatgacatacttagcaagccacgcagcaaatatacaagtgcacaggataacaaaggatggcatagtatagtctcatttgcataaatagcatttaacaaatatttcagaatttaataaaacagttaaataataattaaacaatattaatccaatgctatacaacataccctgttgcataggcccaaccattctgaacaaccaatcccggctacacagttctatctccaaaccaggaattaaccattccaaaccaggagctaaacaagttattaacatcataaattaatatggtgagaaatgtaagactaatcacgaaagacattgttagacccgcccataaccacgggcacggctattcgaatagtttaaactctggccagaggtgtaccactgtacccacaagacacaaccttaacatcatgtcaaccatgcgtcacgatacttgacaagtacccgaatagagattgtaacaataccctctatataatacaattcaaagcagtgtaccgttcctagatcataatcacccccttataaacaaggtatggactccccagcgacccccgtgggcttatctccgccacttcacagtctggtgctctactatgaaccatactatacataaagtaaagccgttgcccacgctggcttgtggttggcacggtaaatgtttcacaatcaaaaatcgtgaaccggtccttaattgtcatgagcacaaccatcaaaaccatatgctcacaacccaccattatcaggttttagttggcaaattaattaattaaccaatcatgattaaccataatgagctaccattaagccatcattaaataatagtgaagcataagttatcccagtagtgtgccaatgtttctaagcatggctaagcaattatatctaatatccagctgaatccatatatataaagctcaactagtcaagttataataacccaaggtatcaaagaatagggtaatcaagaacaaaagggctataacaaagcaataggttatttccacccaatgacattcaaaaataaatgcaatagttgaatagaaacaatagctttaaacgggatcaacatgctcaaaggattgtttgggatctgtgtgacttgccttgctggccttggaactcttcaaagtcttctcctgcaaattcggactctcccggaacgtcggaatctaaagagaaaagaacaaaatcaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacatttatatagattttaattgaattatgacacaataatgaattatttttgaaaaggaaaaaggggattattgcgtcagcgggtcggctcacggtggaccgggtgcatggcggcggatcacggaaacgaacggccgtgatcaatctatccaaaacgggcggccaagatctaacggtctacgaccggtctacgacggacggcgtcgatgacgtcagcgatgacgtcatcaccaacggcggctcggcctcgcgtgctcgccggtgaacgacggcgtggcgacgcaaatgaaggacacctacgggttgctggcgacgcggcgaactcaccggtgaccaaaacaacggcagaaggtcatcggatggcgacgacgatgaggaagaagcggcggcgaccttcggcttgacgacgacggcggggcttcggcgatctacagcgacgacgaaggggcggacgaggtcggcgacgacttgatgatcacgacggcggctttcccgagcgatgacgacgaccggagcgacggcggcgcacggctggacgaacggcggcgacggcggcgctaggctacacggcgctagagctctaccggcggcgagagacgaaagcgagggtggcggcgggtagaggagacaccggggtccttttatagcggctaggggtggcggcggaggcccacgacgaccggcggtgtgaaggaaagtctagggttcggggagagagacgaatccgattcgagatcgaatccacagatttccaaacgattttagccgacgatttcaaaagagaaaaggtagagtggatctcggggatcattttccctctatcaatttcaccggatcgagaaaggggatgaacgaatttggaagggcggcggcggcgcggctcggctagggttcagccgggcgacggctggaggttgacgacggccctctcagcgggaggacgcgcgagcacgcgcgagcggcgctcgactgcgggccggcttgggccggggagagagagagagaggtttgggccgactttcggcccaaagccaaaagagaactttttaaaacctttttcaatttaaattattcatgaaatgcaattccatttattaaaaatacttccttggctcaaataaatctcagaaaaatctaggaactatagaatcaagcaaagtatttaataaaattttatctagcccacttttatattggaatttattatttaaaattagatcttctcttctaggcttttaaaatcaattctaataattctaattaaacaacaatttatatatttgggatttttagggtgtgacaaacctatccccctaaaacggaatctcgtcctcgagattcggaagaactggcgaacaaatgcggatagctgactttaattcatcttctcgttcccaagtagattcttcctctaagtgattactccattgaaccttgcaaaaacggataactctattcctggttcttctctcatctgtttccaagatacggattggtttctcaacatatgtcagatcctcttggactcctatctgttcaagattagcttcttcggtaggtacccttaaacactttttcaactgcgacacatggaacacattatggactcctgccaaagattgaggtaactccaactgataagcgacctctcctcttctactgacaatcttataaggtcccacaaaacgcggtgccaatttttctttggtgtgaaaacgatgaaccccccggagaggcgtgacacgaaggtacacatgatctccttcttcaaaacttaattctgtgcggcgattgtncgcataactcttatgacgagactgagc

SEQ ID NO: 66971 - DNA, 872 bp, Oryza sativa
aaatttcaatcacttttgagggtcaccaagtgaacttattcctagcaatatatatgtcacagcccaataggagggaggaaaattagtcttattctgaggaaaagcacgatgggccatctctacctttgggccggcccggcacggcccgagtcgtgttgggccatgcctgggccgtgagtgcggcacgtgggttggcacggcacagcccggtgcgtcggtcggaccgtgccggcccgacaagctgcccacatggccatctatactgacaggtgggcccctacacagtaacttttcgtattttccttatttaattcaaatcctattctttagaagcccatatctcctaaagtgtagatccgattatagtgaaacttatacctaaattcatataaattcaaactctacattttgataccaaatttagtattttaatattttatttgaattttcttaatttatttaaataccatttgagtttatatttgatttactcctatatttgaatttccaatttaaacttatattttattttcaaatattttattttatcccaaaatacctattagccactaaaaagccgccggttggaactttacgccttccatggggatgttcgtgcggtctacgggccccacgtcggaccgttggttgtaaaatccagcagaaccaaacccaaggtcgaagtgctgctcctggcaccccacgccttgatgtgtacagtggtcggagcttcactattcccttgacctccacaacacgccacacagttaactctcgggctctgtgcgatcctagtcgctccgtcgccacccacgattgtgaagtaatactttcgcctcgctaaacttgcaccaacctcctattcctctagc

SEQ ID NO: 66972 - DNA, 8389 bp, Oryza sativa
tctggcgccccaaaaaggaccatttctgggataagttttttcaggggtctatttgcgaaataagtttttcaaaaggaccaaaatgtgaaaaatccagcctagctacctgctgcgagattgttgtcaaggctcaccaagtgacatgttgttgcaccattctctcttgacgaagtctaaaataaaattgtagaaaatcatttttttttctagtgacaacaatcgctcatcataggtctcacaaggcatgaatgaatttaatagggcgtaaatgagaagtttggagtccaatgacttgagtaaccaaatttcataagtaatcatgagtgtggaatgttgttacttgaatgatcactggatctaaccaagcctaccttcagcttaaaacaaagctatgcatatcagaaattaaaccaccttttacacatatatctagtaccgtgatatatatttctcataccccatatatatatatatatatatatatatatatatatatatatatatatatatatatatatatatagacacacactatatatatatacacacacaccgctcgttgtcttacttatcttacatcctgtaagtaacgctgtgtttgtctgtgcgattggaaagagttattctctcgtttatcgtcaggggcggtaccacccattaggcggggttaggcggccggcccagctacggcccgtgccgccccgaccctccatatccttcttggaccgtctaccaccacatccaattcacaattggcccataaataagcagcccaagtgtccaattttaatcctgcgtatgtgatggtttcctcggtcaattcctcaacatcgttcacccccgtcccttactatagtaagtgcctactgtttttctttctctcccttctaagcaaaataataatcattttattctggtatgcgatatcttcttatatatttattttttaaaagatatctatcaaccatgctttatgaatggactcatatttgtaaattgatatgtttactggtatctttttatgtatgacgaattatgtacggcgcaaaaattattactttattttaatatcatttttgttttttgtttgccttaatttattgattatactatatgttaatatgattacaacataaatatggtattttttgcgtttagttgttcttattgagacgagcatcttcgcctcatctttattttaatcctgcgtccgccactgtttatcgtgatcatgcttttcaagctactaaacgattttttttcaaaaaactgttttgcaaaaataaaaatatatatatttcaagtttataatagttaatacttaattaaccatgtgctaatcagccaatcaacagcatcgaatttagcctatgttacagtctattaaaccatggtgttctccaaaactttgaatcatatactaatatattttttaagcaatcctgttacctgggccggtattttacattcgagaaattgatcagctgagcagattaagagaaacaaagatcaagaacaagagaataaacatttggcacacgcgtgcgccacacaagaacaaaaggccggcaatcgttttgccgttggagaggcagccaagtgcacggtttcatgacaaaccaacgcagacgcagcacaaaaggcatagaatgggatcggaaggaacaaacagcaacaacgaaaaggaggagaaaaaagaagaagaaacgggagggggtgacatcagtgacgccgacgcgtgctgaaactgcgttgcagcaacccacagagaagagaagaggagaagagcagagaaaataaaattttgcaggagcagaatctaatctcacatcacacgcaccacctgcagcaacctcccctctctctttcttttcttttcttttcttttgttttcctttttgttcttttctctcctctcaacctttctcttttctttccttgtagttgtcaaccttattctatatgtgaattgcgtaatgtttttcagttgaggaaagaacggtagaggagtctttgcgcggagtcatgggtgccaacaaaaaaaaacattgaaatatctcgtcggcgcactagcgagttaggctgaattgttttgttagctttcccaacttatctccctcaatttttgcacgcacacttcttaaactactagattgtgtgttttttcacataaaattctatatgaaagttgatttaaaaaaaatcatatcgatctatttttcaaaaaaaaatgctaatacttaattaatcataccctaatggatcgttctgttttgcatgtttggcggagagttcctaactcccactaatgtgtggttcgagctgcatgattgaaacaagagagcctgcgaagcttgtaccatggattattaatgttacatcatttttttctttttttacttttatttgggaacacgcaggagatccgtgcatcattttattaagcaatttctctttttatttgttgtcatttagtatgaataagatgtgcaacatatatagttatgtttatttttgttcatctgttactcagcttacaccaatgccttttatgacaaatccacaaatgctatttctccgcaacgaagtattatgttgcaaagcgtaattaaaggagtgcacttagaacatcagttttgaaaagatgtggctatacattaagctccaacatcatacatgaatatgtgtacatgaagatcataggaccagacactttctctagaagaattgaatctatatctcacatcacacaacctgtacgcaacctgcacagctagctagcccccatctcgctctcttcccttctttttgttcttttctcatttatctcattctattatctttagttttcttttaccagttgtcgaccttgttttttaaactgcatagcatttccagatgaggaaagaacggtacagaagtttttgggcattttaggcccaaactaatgagaaacattgaggtatatctaagctttgtttgggggctcgagattccgaaaaatagagaaactggaaaagctggtcttcatgaactatatctgacctatatcttctaattaattttttattctataactacacgaattcttatattttagttttttatttaaattctcataatttagttgagaatctgaattgtttatgaaagttagagcattcgacaaaaacttagctgatagaaactccaccaaacaaagatgctactggtaacaatataacagtaccacaatgctatttttagaatctgattggctgacatttttttttctgcggtttataagtgtttgaagtaacagaaaataattttaggacaatactttactcatctacaatttaacggtttaaaatccaaagttatgttggaaaaaaaacaattacaaacatatagattaattttcaaattaagattttgttagtgatataccctagaggcaatcatagagatgattgtatcacatactatgtttacatatttatccgactttgttccttgaaatagataattaatgaatatgtgattctttcatgagactctttatgttgtgtgttgctatttctaaaggatccctgatcaaatatcatatgtagaacaaatatatttagatgatcagcacatgtattaattgatgatcatgtctcatggatcatggtatagagataccaaattaataatgtggacacatgttagtgaacatgttattggatagacccaacataatgagacactgcaagagccatatgtgttgtgtcatcagtgatctcatttagtattggtgttgaatccttagacctgagattatcatggttcctaacatgtgtagtagcttacttagggactgctaaacgctactccgtagttgagtagttataaaagtagttttcgggtatgctatgaaacatgtagtgggatatgaataatcaagatgggatttgcccctcctatggagatatatctctgggcccctcgatgttgtagattatggaagtgcatagccatgccaaaggtgattgaggagtcaatcacaagttatataatctattaacaggttcgagtgaacggttgagctgttagaggatggcacatatctagccttgagcttaatcgatatcgtgaggcaaaggggttcatacaagtatacactaaaggttcagccgatatgatctttatgtatgccccgtgggtcaatacactctgctaggggccgctgttgacgcgtgaaccgaaaaggagtttttgggttacagccgagtgtacatgaacctacagagtcgcacgcttaatgggctagaataaggggattggatggagatccaatatgagcttgattcggataaggatccgaataggagtcctacgggccttggaggcccaagtgatggatcctatatattcgtgagaggtgtgaccggcggaggtattgcatcatgtgagaaaccctagccgtcactatcctccctaagcaaaaccctagccgcgcgcgagtgctagcacatttacgcgtggcgttccgtccctatacgtgtggataccggtagaggcgccgctggtttgcggtactgatcagcatgtgaatacggcgaggagaacgcacgaggagaagaagatcgagctggtgcgatcgactacttcctctacatcgacccgctacttcgcgagaattccttcgacttcttagcgccttctttcgctgcgcagcgcgtcgagtggtaacgatctatgatctaatacttgtatggttcctggtttacgcgatagaaaattttaatttatactatcgtagcctacgtgtatcctaacagatttagcctattactgagaaggtcatcaccgatggttcctatatagtaatgccttaacggggtttacctagatggttttgaattatctgataaaatatatgctacttatggttgaaacaagactcatttgtttacatcacgctactattagaaggtcaccaattagagaagtttcgtgaaccgtctatggaaaaagaataaactataatataggattttcttaaatggtatttgaatgattgggaatcagaaagcttttgtgattaagagggattcagatgtgggtagttttgtgaaaccttaccaccaaaattccaattatatatgatatgtcatatatatatagaagtgttcttctaaaacaacgggcaaattttataaacacttttcattggcaaattttactacataacactttaagtaatttgatgttggacaataaaagtgtacgatgaagaaaggacacattcaaatatgtaatttattggatagtacaggcaccgtagctattattttatttaggttcaattggagagagagtttttttttcaaaaatacaagaatgacttttgagccacaagtttctaacctgatgcaaagaagaaatttgatatatggcagcaatatacttggggcgatagtagattgcaaattgcataatgtgtagtttgaaaatttggaaaaataagaaaagaataaacaattgattttttctaaacatttgaaaaagtaaacaaattggaaagttgtaaaatgtactcgtggagtcgtggtcgccattctagatttttgaagggggtcgggcggaaaagatggcattgttcggttcgatcaaaccaaagccgagtaacatacatgtgctagctcgagggacaaattcatcatttcattacggtttctctctcgaattagataaaaataataaagcaatagttttggtgtcccctcaaatatttttatgatgtttgtaatgtttattgtttttcatttcccatccatctagagtaagcttgtataccttgtaaaggacacgtgtgtcatgcaatactaacgagtttttaataccggcagaaaactaaaaagagctgaaaaaaattcatgtcatgtccctacacaaaaggtggtcccacatgattaaccgctttgtcagagacgcttaataataatgtgttggcatcaagtggtgctggcccacccacgcacacagagaatcaggggagggagagcagtgagcgcgagggtttctgggctcaggaatctaaataaaaaaaccaataataaatatactagtggagtagtagtacaataataaatacatgtaaatttatatttacagctaattgtatttaaatttacagttaaactttttagcaggtgatatactcatcgataaggaatggtccgttaatcttaagatatatcagtatattctagaggtgattatagaaatagggtacgtgcgtatacgtttatatgggtgagtgaaacgtacattacgagctcttagtttctcaaaataaataaatgaataatataaataacttttcttttgatttggctgtagcaattgcttagtaatttgcaacctgcagatccgtggtgcagaccaaaagctggaattctctgtggcgcccgtgtgctgctgccccccatctcctgcctgcattctccttctctctctgtggtcccttgtgtggcccaacttgctgcatatattatacaaaattatttatgtacaagagaaaatattagtacaatagtaagttgttgtgtataatggaaaatggcatgtgtaaattgttaatatggtagtaacatttcatgggttcctatgtctacccattactgaaggctaaacacaaggtgactaatattatcttccgtcataaaaatgtttcattttttctgaaaaaatctatacatattaatgttagtaccgtcttctagacgcaacttcgattactaatttgtattgtaggtactataatattatgaaccattttttttggactagcctgcagatatggtttttatgcatccgatctaaatattcaaaagatattgatatcgatgcacaaaggttttaaagttagacttagaacatgactagagtaacatgcttccatgacttgggggagtgtaacaagtacatgcacagtgtatacctgtgttgttttgtacatgaggagacgtatatgtattctctccccaacatattagcaaacatccaacgtgtcactcaccagactgtataattattgttgttgtacatgtcggaaggtctaacccaattattgctttcagggtattttgtgagacaagtttctaaataacattatttagaattagatcttgtgtaaacataatgcaaattatttgcacggaacgatgcatgagaccacaattataaaaaggatcaatgagaccttgacaaattgtatttataactcatgtgcatgaatttcacattaaattatttactcatggattattttccagttacaatttcatcactataaatcacaatgcatactatggcgcccttatttcaaaactcgggactctaagaagcatctattgaataaaaaggaagtcatctgataataattaaaaaaactaggttatttctagttcatttttctgaattgcatgggtctgtttggctgctatatgcagctgctgggctatcacagctacaaatacaaaacaatgttcctattggctgcagtacagtaataaaaattgcagccgaacagagcccatagctatagattcttatacataatttgaataaaaatctatagattggaaactggagatgctgaaagaaactactgagtgctagtaatatttttccttaaagccacatgagatgccaccctatgcttgagcacagaagatgagagctgtgaagggcattgtaattattggggtgggcccgcagggaacctaaataaaggagggccccacatgggagagggacgtgtgtttggtggtggcctgtgatgggaggcgactctcactttcatgagctgacgagagtgaaataaagcatgaaaacgccatctttatttatttacttatttatttttgcaccgtatttatttatttgccacctccaaagtccttccattgcacacttaattgccaaagaaaaccaaacacaaattgatgggaacatcagatcacatgatcaccacaacattttatgccatacgatggattggtcgatgatactttatgagattcgtatatttaaccacaatatcaaagtagtgcacaatagatttgttgatttgatgtccctactttccagagaaaatgttgtgtgctgctgtgattttgagcaagcttgaagtaaaataactataatttttaatgttaatggttcatggcaaccaaaatatctttattttacatttttggcatacaaaatatgatgtttttttatttatgaaacacatataatcataattccttttgaaattagttacagtatagttgaagcttgagcattatatcaccaagcttaagaatcaattgacatagtttaaaattttaaatacctttttttttgcatgctt

SEQ ID NO: 66973 - DNA, 7212 bp, Oryza sativa
ggtctccacatgttatcctctttcaacaagaagctgggaacgaaccccacgacggcaacgagggatgtggcggtggcgggagcagcggcggagtcagtggtggtagcgttggagaaagaagagagaggaaaggggatagagatgaagagaaggagatggggagagaggaggaagaaaggaggggtgagaatgacatgtgggtcctaccattttttattattttatgtgtgaaactgacatgtaggtcccatgagtttttattatttttctggatcaaattgccatgtaagcggcacgtgaatgccatgtcagatgaagaccgagtcaaattagccacgtaggcgccacgccagccaaaaccgccatctaaaccgctgagggacctcatctgcaccggttttgattgttgagggaacccgtggtatctggatttccgattgaaggatgaaaatcggattcgttgacaagttaagggaccttagatgaacttattccgtagggaaaagaggtggggaagggagaagggagaggacttcggcccaaataaatgttttctgaattttagaagggctttagaaaatttggtttggatagaatttgaatttggaggaaattcacaaaagaaagattttccaaaagacatattatctagtttatttgagtgcaatattttgagagaaagaatacattggactaaatattaaagcactcaaataggaggggaaataaataatatgattactcacaaaatatatttttgggaataaggaaggaaaatacttagaggcaaaaaaaaaaggatttgaatccttaaattggtagtatgaatatttggggaattatttgtggctaatagggaatttagattttggatgagaacgatgaattaaaatctattttcttagcacaagagcaatcattccaaaatttgtaataatactattcttgtgccggggaggttgaagccatagggattaaattggaggctcgatcgaaaaaggaatttgactattggaatatctacagaaggattggtaacatgtcaggatagagaagaattagagataagactagatcaaaggtttggtcaaggattaattccaatgaaattagaatcatggttgttggtatttcttaatgatattactagaaatataattcccagcaatagcgtagaaacactcttcgtatattatggttacagactttatctgcaagcgcacggatataacattgtagcatttcacccgagagtatttgtaacgccccgattttcgttcgggaataaaaatcaattaataatacattttctagaaattaaataaaagttaaatcaacttaatcaagtgaattattgagggaattaaaaatttcctttaaaaattattggccgggaatattttgtaatattctttgtgccctaatgtactctccggaattttccatgaattttcggagctcgagaaatagttttaatagcacaaagatcattgcatcaattaaaataaaaagaaaacaattaaaatcccccttcctctctttgggccattttcggcccaagtcttccttcctctcccgcggcccgcgcgccttctccctctctcgggccggctcccctctcacttggcccgctcgcaaaagtctgttttgcgtccctccttctctcccttcgccgacaggtgggaccgacggtcccacccgtcagctcgtcctcctacctctcaccggccgaccccaaccgccattgccgtccacgtcgccgcaaaatccggcgccctcccgcacccgagctcgcatccaacgacgtgggcacgatcccctccacgtcctccaccatttcccccactctccccgcgaaaatcggcgccagttaacccctccaccaccccacgtcggcgccccacttcgccggccgattccgccacgtccggcctcgatcccgccttcccgagcccataaaaagcatccccgtgctcccctcgtccgtttccccatttttcccgagcccggcatactctccctcgctctccccacgccgcacccacgcgctgccacactccggcgaactccggtcgccgtttcccgccgccacagccgtcaccgcgccgagccgccgccaccgccagcttcgccaccgcaaggggaagtccggccgcctcttatttccccctctccacccctcgagcaccactcccaccgcacacccgaggccgccgcccctttcaccgcctccagccgcgcgccaccgccgccctagccgtcgccccaatgcgccaccactgccagtaccttcgccgcctcaaagtcaagctcggccgccgctcggttgtcgcctctcgccgcccgagcaccaacttcaccaccaacccgagatcgccgccgtgtttgtcgtctccatctgtgtcgccccgcctccccggtcgacgccggactgcgccgtttcctccctcggatcggcaactccgagccgcaccccggccaccgcttcctcgcctccgggaaccactgaaatcgccctctccgcgccccggtcgtcccggtcaccgtccgccgcctcgcgcccgtggtacgccaccggaccaccgttgcctccccgaggagcccgccgccggcttcctcgttgtagtctcgccgtcgccgcccttggtgagcatccctcctctcctccccgcgctgtcgccggccgtcgccgcgggtggccgcgccgccgcgcgccgtcgtttggccagccggctttgtgccgtgctgtgccccagccgcgccgcccctggccgcccgatcggtttgggccgatccgggccgtcggttcccgtggaccggcggtggaccgcctcggtggtcccggtccacggtggaccggcgcccttgtgccgctgaccggtggggcccgcttgccggcgccgcccctcccctttgatgacgtcagcaaccgtcttttcctttggaaaaataaataataattgcgtcataattcgttaataattatagaaattcatttaaatggctcaaaacttctaaaattcatatctaattcattcgaactccgaattgggccattcaaattgcaaaattcatctaaaattgagctctacatgtttgtttactttttatgtactgttttcttggtttttattagagtttttcctcgttttgcgtgtcagcgtgtagaatccgtcgtttcggaagtccgcggtcgcgaggaaaagagttcggaagatcaaagtgaagcagcaaggcaagtcacacattccccttgagcatgttgatcccaatttataaatgttttaccgtttacaaataaatatgcatgttttactaattacatgggatccgggtattacctatctgctcgcttgtgccatgtttacttgatatctgttctttgtcaaccttgggtaatgaatccactagctcatgttacttatgtgacctagctagaactatatgcttagccatgcttaattaccactagctcagttgatgggataattgcagtattagaccctttagtatcagagtgagctgcgtgctcgagacacccgtccatgcttcatggtcgtaattatccaactaaaatgcaactgaatggtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagctgacacatccaggcaagggtgggcgtgatggagcggggcgggccctgcgacggcctctgtcgcttccggattcacctaggcacgagaggggactgcccgttgcccgctggggacgggggtgaaatctgaggtgtggtgtgcttggttagagggggttatgcgaagggtcctgtcacggcctctttccgatatgtcgtggtggcatgtcggcgcacggaaacgtgttgtggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagtccaggtgggttggttgggcctgttcaacgtggtgtagcgttgatcagtggagatttaatgttactttaattactcaacagttttactgttttgctcaataaaatgttttacaaccgcctttatgcaaatagccacaaacccctccttgtatccccttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgcctgtggagtggagctgaagccccgctaggatcgcccttttccgctgctgctgctttcgtttcggtgcgaggactaagtgcctcttttgtaagtattttacgctttatttacgtttggaactgtatattacttgtcgttttgtgtaccctggctggtcctggacagggatttaatacacaaaatagtctagaaatttggactaaatttctgggcgtgacaaagtggtatcagaggcaacttgactgtaggttgagccaaatggtcaaaccctaaggacaagttttctgaaaaccctattcgcaaattgtctcctctcgcccttcggcatttctttgcgaaacagtttattaaaatttttcctccctgtccctccaactcttttagttgtcaaacatgtaggagaaaccgccagcttcatgcccgtccagaagtcaagtcgagtctcaagcttcgtgcaaggagcgggaagattagttcagagtcatcgttccgcgaagatcaagaagagttttcccgaagttcacctaaacctaatccttcccggaagagtagttcgttagattctagatcgtgtgttgtttgcttgtgtgtaggggtatggtttgcatcattggtggggatgcgactatactaggttgtttgcttaagcaacttgaacaataaaaatctattaacaacatatcagtaggcaagtggtttagtaccttatctttagcgacccctctcttccacctctcttccgtcctggcagcagatggtcagtgttagagataagatcaattaaagccacagatcaatggtttagttgaaagctgcaaggtgccccaatgccagatgaaacctgctcatgatcaacttttggtgtccaagatcagaagatgggtgtatcgatgtgggagatgcaggttcgacacctagtcaaatgtagcggaaataactccagcagtagtgtgttgcagtcagagtcagtggatcagttcaagacaacaagctaccagctaagtcagagcacctcgctctggttagccaagattggaagatggatgtgccagatattgatgtagcaaccgcagagtccaaagcagcagatgcaacgacaatgtctccaacaacaagtacaagctcagatgcaagccggaatcaggatcagagcgaaagtcagtttgttttccaagagcaagcacctgcaacctcagacagtacgccaccaagtctttagcagaccagcacagctaagtcacccccaatcccagaggcaacaagtgctacctatagtggttatggtttacaaggtcagttcttgcaaggttgttcaacggcaaggcgttagcgtcatcaagacaacagctctattcgcagcaccccagttcctcaagttgtgtcaattccaatgcgagtcggtcagtttagttttgagatatcaactacacaacccatttaggtggatgacaccgaagtcaggtcagaagaaggacagtcatgccagcagttattactgatgggatagtcagttaagagttagtaagatcaggagctaaatgagaatttctttatgtggaatttcctatcagcaactgagggttaagttccaaatcttaatgggatgaaagtgcatcgttgttactctattttgatcgatcggcgaagtttttagttttcaaagtcagggctcttcgcaaaacagagaagtgttggttatattcgaaggacaacagttcaaccgatctcagccacgcgaaagtaagactactccttgtaaggggggtaggtctcggagaagagttttgcctcacttcgtcgctgttttagttgaaggttcaaccagtgccgcaatcagggtagcacttgaagaagcatgttgcaaggtatcagaagaactaagccgatcccagggcatccgatgagcccagttcaacagcttagcttagaggagcaacagtgaggacagttgcagttcagacgaaagacaggtcaagcaggtttcctggaattacgtgtcactcgagtcagaacccgttcaagcggatgtaggatcaatgagttacaaatgccagatgcaagattcaggaacaactccatccttctctagccaacttggtgaactgtcaggttatcaaattgctagcatcaacggttcagtccaagataagtaagttccaggagcatccgcagttctggcctgggtcagttcaagcagaaccaatcagtccagttttggcaaagcaaaggaacagaaaggtcgaatccagccagttcaatcatgcaggtttgatcaaccagtcaatcaatcagttcgaagcagaatgtggcagttcaatgtgcagatcagtcagatcgcccaccagcactggctttctttctagccatcccagaatctcgggacgagattcctgcaagggggggagatttgtaacgccccgattttcgttcggcaataaaaatcaattaataatacattttctagaaattaaataaaagttaaatcaacttaatcaagtgaattattgagggaattaaaaatttcctttaaaaattattggccgggaatattttgtaatattctttgtgccctaatgtactctccggaattttccgtgaattttcggagctcgagaaatagttttaatagcacaaagatcattgcatcaattaaaataaaaagaaaacaattaaaatcccccttcctctctttgggccattttcggcccaagtcttccttcctctcccgcggcccgcgcgccttctccctctctcgggccggctcccctctcacttggcccgctcgcaaaagtctgttttgcgtccctccttctct

SEQ ID NO: 66974 - DNA, 10755 bp, Oryza sativa
tcaattgggcattagtatggagcccgtcaccgatgagtcatctgtgacgagccctacggcaaagcccgattgagatagattaatctctatcggccgtaaacgttggcccgtcaacgatgactcattttccatctttcatttgttgtgagtgcaaaatatatagctgctgtgtaataattcattttattagtcataatacattttcggatagtaaatgatttcaaatggaaatatggtcaacaacaaagttgtagagcctttcaagatctactggttttattttggtcatttttctatataatttttttcccaacagcttgaaattgattttgacaatatgacaaatctaaacagcatttgtaaatactaaatgatttcaaatggaaatatggtcaacaacagagttgatcctctcatcaggatctacaacttttattttggtcatttgtaataaaacaaaattagccatattaatgactacacatatcaagtctttgcaataaaacaaaatacttcattcattacaatagataagtacaaatgcatcagtcacaaggttatgccttccgtatcatctgaacgagcatatgccacaggctcttggggatcatcgtcaaggtcaatgtgaggtcttacatgaagattatggttgtattcttcttcatcaacgacgttgtcaactcctacaattcggcgctttccatccctcactatgtgcatcttcttgtttgaagggtcttttatgtagaatatctgctcgacctgtttcgcaagtacaaatggttcatcggcgtatcccaccttagatagatctactaaagtgaaacctttcttgtcggctttgacaccagtgcgtagattaacccaacggcagcggaacaaaggaaccttgaacttgacgtagtttagctcccatatctcctcaatgcggccgtagtatgtgtttgacccaacttgatcctggaatgcatctatacggacactcctgttttgcactgtgcttttgtcatcttgtttgacggtctaaaatgtgtatccatttatattgtatccttgccatgtgtctacggtccaagacggtcccatccccaacaactgtactgtctcatttgggacatccgtggacattgtcacacgattcttgaaccattcgttgaaccgagaattatgttctctgttaatccatgcatcagatcgccccaagttctcatctcggattttcgctaagtgctcctcaaagtatgggccaacttctgccatatgttggagcacagcgtaataagcatacgtgtacgacgcttgatcgggcctaattcttttccttccgattgtgccaacacctgacaaccttccctcgtgacgagacgcgggaactccgataggatcggcatcggacatgtaattgacacagaactcaatagcctcctcggtcgtgtaaccttcaatgatgctcccctcaggtttagctctgttacgaacgtacgacttcagaactcccatgtacctttcaaacggccacatttcccttagaaaagccgggccacatagttttgtttgcttcaccagatgaacagggagatgaaccattatatcaaagaaagacagtggaaaaaacatctccagatgacagagggtattcacaatattggtctgcagcccaactagatcttatggatctataaccttctgtccaattgcattgaagaaggcacacagacgttggatcgtgtgacgcactttcggtggtagaatgcctctgatagcaactggcaagatttgtgtgattagcacgtggcagtcgtgagacttcattccaacaagttttagatcgtccaatttaacatacttacttatcctcgctgaatagcccgatggaactttaatatccttcaagcatgataacattgcgatcttctcatccttcgacagtgtgtggcaggctggagggatgtacactttacctgtctctgcatcttgtatgggctggagttcactgcgaatattcatgtcctgtagatcatggctcgcgttcaaacccgtcctttgtcttcccgggaatattcaacatcaggccaaccaaactctcacacacattcttttctacatgcatgagatcaatgcaatgacggacatcaagatctttccagtaaggtagccgccaaaatatggattttttcttccacatacccttctcctttgtcttgctacgttttcttttcttcccaaactcattgcttatgtccttgaccatattgtggacctcatctctggacaaatctttggtagcaggctgaagttctctcttaccgttaaaaattttcttctttcttctaaatgcgtaacgtagcgggagccacctctggtgacccatgtataccatcttttgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcccgaccatatgcatcccatgtttccacactttctttccaacgaatctccagatcgtcaataacaggctctagaaatacatcgatatcattgccgggttgccttggaccttggattaacaagcacaacaaaatatatttccgtttaaagcataaccatagtgggaggttatagttcgcaataagaactggccaagtgctgtgagtactactcatgtcatcgaaaggattcatgccatccgtacacagacatatcctcatgtttctagggtcggcagcaaagtctttgtgttttcgatcgatattcctccattcaatcgaatccgctgggtgtctaagcataccgtcattccttctctccgtggcgtgccaacgtactaactttgcttcgttcgggttggcaaagattctcttgaaacgatcaatgataggtagataccacacaacatttgccggaccacccctctttgacttatttccttcgtcagcacttttctttcgcttgtatcgagaagccttgcagacaggacaagcatccaagtccgcatattgcttgtggtacaatatgcagtcgttgggacaagcgtgaattctacggacctctaaccccagtggacacagaacctgctttgcttcgtatgtcgtctcgggcaatgtgttctcaacaggaagcatagccttcaaaattcctaaaagatctgtgaaactcttgtctgtccatccactacttgccttcagcttcattaggtccaaggtaactgacaacttagtgtgttttgctttgcatccagcgtacaaaggcgtcttgtaatcacttaccaacctgctgaacttcattccatctctctcattctaggctaggtcctgaatgtcacgtaacatgtcttgcagcagatcgtgatccacatcaaccatttcaccgcccaatggagaatgtataaacatgtcatgctcatcttcatcttcctaattatgcgcaccacttctgtctgctgctgctccacttcctgattcttgctctccatgcttcacccaacatgtaaagccctccatgaatcctcgttatatcagatgactgtgtacgtcctctccgctatcaaacatattcccattcttgcaatctgcacatggacaacacatgtaatcactgtttcttcttatccgatcctcctccgcagcgttcataaaatttattacgccctttctgtactccgtagaacggcgtttcaaatttttcgcatacatccaacttcgatcaattgctacaaaataaaaaaacaaattagaggcacatattataagatcattattgcaaaagtaagacgtgatgaaattgctcaattaatgattaatattactcacttgattgatccattttgatcacctacaggaatttaatttctgttttccttgaaaaaaggacaaaaaatcgccccctacagccttccaccaaaatagtgaacaatgggatacagttacactaggtggtggggggtatttatactgtgcaacaaatatctgtaacggccctaaaacaatcaaccgtgacgggcatacaagtaatctctatcgggccttaataaaaggccgtcaaaaaagagtgtcatctgtgacgggcactaaacttatctcaatcgggcctctagttggagcccgtcacagatgaccctcatctgtgacgggcttcttttagggcccgattgagatatggaacccttatctcaatcaggcctcaactatagcccgtcacagataagtggcatccgtgacgggcttttagttttatgccgatataccatggctgtgtgaccatatctcaattgggccgaagttcgcccgattgagattacttccttgtgacggccggcaaattccaattttgttatgggccgtcacagatggaaagatctataccagtgaaacgtatagacgtactatagattcaattataaagaagagatgcaatttatctttatctcacaaactagggagcatattgatttacatggtgcatgaagttatcagtggtgatctaaatcattgaggtacccttctttggcactacaacaaggaggtgactgcccacaagttacaaatcatatacttcctctgtcccaaattataaggcctatatttttttacacggttttcaataacatactttgatcagtattttatttcattctatgatcccaataaatatgaaattagcatcagatgaatgtattttaaaatataaatctagtgatataacatgcataatacttagtataaatataggtagtatgattattagtcaaaagctaccgagtttgattttccttaaaaagtgacgccctataatttgaaatggagggagtatattaaataaataaaaagacgtgaagtactccagttgtgctctcactagcaaatgacaacttatattagaattgtagggcttgtttggatcaatgccctaccaattctttggtagtgccaaaacataggcaagttttggcactgccaattatttggtagaataaatttgtattcatcttatttggtttgctaccaaaatatagctaaattgtgataccataataaaaaaaagttctagattgctaccaaatttgggatgggtattaaaaaatgttggcatcaatccaaacaaatggtggatattatttaggctaccaaaatattggtagggcaaattttggtagcaatccaaaactgcccgtaatgtacttagctgacattctcataagtaacatggataaaaaaaaaatctgttgcctgaagacgtactgtttcaaattatactatgactactcactaagggcagacaaccacctaagcacctcctttgcacagaacaaccaagggaatttacgtaaataattatactaagatggcatattctacgagtaaaaactaagtccatatacagtgtacatgcatgtttctaacaaagggattgatataagcagaaaatgagttcactagtatgtagtggaacttgacttgggtagtttttttttttatttgaacttgacttgggtagttgatgtaatatatatacaatgcatgtaaagttatcaagtagcctttcaaatatataggcagaagctcaaatgtagctcataagcaaaagtagaaccaaagaatagagtaaagcttaactagaaacaacactacagccatgaaagaagttctcatattccccaaagactgaataacagatacaagatatataggggtatgtctcaataatttataagaaaaagaaaggagtcccccaagaataaacaaaatacaatttctgatacccaatattttgctcaaactatgacagcgtgctgacttacatggcatatgagccttcatatcatcggtttcgtcagtggtgactcgaaccttctaagaggccttctctgacatttagcaaggttctgactgccatcaaattttcacttctattagaagagggaatatataatggtatgtacaagtagctaaatggatcgagactaagaaggttcttatctttcctactggttaagtaactattggtctgttcactttgataaaaaaaaaaaaactgaccaaattttggcattgccaaaattttagtaaagttgtcaaaattttggtaacttgccaaaattttggcaggatttcttatatggttaccaaaatttggtaacaaactaaatgtaaccactttttttttgataactttaccaaaatttgataaggttaaaaatagcatcaaagtgaacaagccctataacaggagtaccaacttacatgttattagccttgaggtcttcagtggctagccaaaaaaacccagcattgtaggatattgaggtaaaatcataagcaaataagaaaggctggatccaacaagtctacatttgtatgtttgtaacacaggatatgcattcctctactgatcaatgatccaacaaaccatccgtcggctctggtacatgctcctctactgctccagtaccaaggcctgcatgtgcagcaagcaatgtcaatataatctttcactatatctttgccacagctaattaagatgtatataattattcaaactaacatgctaagagaaaagtctatgtatgacttgtataaaaattacaaaatgaaacaaaacaaacatatagaatgagatcgagcattgcaggcatataattttatcttttgctcaggtttgatcgaatttcttaacaagagagcaagcactcactcaagctcattaattatttgctcatcgtttttaaactcaaggaataaaaataaattaaataaaaacatacaatcagtttgagacatgcatagaattatatgcatagcgacgccaaaaaactcggatcgccacccatgccgtcggcacacgacctcttcatcaagaatctcatgcggcggggcgccggccacgacgacgccgtgccgtggttgcattaccctgccgtggacgacgccaacgctgacacggcgccgctgcctcccgagtactgcgccgctgcctcccaacaactgcgccgccttgctcagctccggcttctccgaccacctcccgccgcccgccgcggagaccagagacccctgctccttctcccacggcactgtcgtcccgtccgcgtccgccgcctagcaggctcgcacaagcgccgacgccggcgtcacgaacttcacctttttctcgaggcctctgcagcggccctccgggcggcgagagcacgtcggcgaccatgtcggcggcgggcacctcgaccgtccccgtcgagtcgacggtggtgcagccggcgacgaaccggctaatggcgaggaggagtgagagagatgacgaagggagagaagaggggaaagagaggagagaaggctaacgtggataaccctgacatgtgggcccacgttggtcccatgctgacttagccgttacatagattaaaaccagggttaaaactaccaaaggatctcgggtgaccggttttgtatagttaagggaccccgtatatttggttttgtggtttgatgatgtttttttatcccgatgacaagttgagggaccctcggtgtactttttcccgacacaaacagcccacaggcccaatagtacctatatacctagcccatcgtccggtagcttcgtatagttccaggccaagcccaacgagttcacgcgctgcttttagaaggagaaagtacattccgcacccctctgaggatgactgggtgaggcggccagaggagatcgatgcgcgcgcggggatccgatcgaacactagatccagtccgtttcatttgtggagtgatgagatatatatatatatatatatatatatatataacgtgacaacacagctagtggtagctggtttatataccactctatctataagagaaactatccacctatactttaacggaattgctaatggtctgttgacagaaaatagggtgctaaatctgtcacttttttaccattcatctttgtttaaaattcgtgctgcatttggattcaatggattgagcaaagtcaggcacggttgtggactttgagatggattgggcttttgctagactttgttgttgtgttctgtgggtctcacatatttacggttcaatttcgaaacacacgcctgttttttttcctcgcatttgagcagtgttttttattgctactttgtttatgatcccacacttactaattacatcgtaattacactaaaattacatatgtaattttgtgacttacatcgtaaatatactaaaattacatatgtaattttattacttacatcataaatacactaaaattacatatgtaatttttggaacttacaatgtaaatacatgctgacttttttttttgttaaatattatgacatcatatcataggtactccctaaatttaaatagatgagattaaatttagctgttagatgtttattctatggcttcaaaaatctgtatgataggaggctagaaaatctgttatatgatgtataggcagtcccatactttaaatgcaattttctcttaaactattcatccaatctacgatccgattacaccgttatgttcataacaattaaatctttacaacaagatctcacataattatattttgatgaaaaatcacaaattacttttagatttcactaagttacttcttagacatacaaaagtctaaattacttttgtatgtctaaggagtaacttagtaaaatctaaaagtaatttagacatatcataaaagtaatttgtgatttttcatcaaaatataatcatgtgagattttattgtaaatatttaattgtaacgaacacaacgatgtaatcggattatagattggataagtaatttaagagaaaatttcataagaagaaaaaaaaatatgcacaacctaatagcaaaaactacttgcatgcatgtctgtaacgctaccagtacttctcacgtaattgcccgcgttgctcgttaagtctaaatcgagatgcctcccgaaaatatatatatatatatatatatatatatatatatatatatatatatatatatatatatatatatatatatatatatatatatatacacacatgtatatacacgtatacacatatatatatatatatatatatatacatatacatgtatatatatatatatatacatatatatatatacatatatatatatatacctattataaaagtttaagatgttttttccaagcaattttgtacgtcgtcgcttgtccgattccctccccttagtgtgcccgattcctcccagatcaccgtatcaaaaaattcataagggttccgtttctgtcgtttgagtccgagtccgtctagaaaaattcccgtgctagatacccaaatcaatcaaccaaccaaaaacagcacgaaataccaaatttaatctagaatttgatccaaagaaacctaatcacccaatccgatccatctgagccaacataatacattaaacaatagaaaatgaatcataaatatacttaatcacgaaatcacaaatccaaaatcatcaaaaaaaaattaaataaaagaaactaaatcatcgacgccactgctcatgggagccaaggacgccgctgccttgaggccgtggtagcttggcggccgcgccaccgtgcatcgcgaggagggtgctatcaccggccgaggagaagacgccgtccgcagggaaaaggacaccacaggccgggagggggggcagtgtgagggcaccacagctgagatgccggctgccaagagaagcggcgtcgccggtggggggaggaggggaagcggcgccgccagttgggggagagggagtggcatcggcggagagggagggcgagctggctgaggggttggggaagcggtatcgctgccggggaggagggggagcggcgccgcgccgctggttcggagtgagggaggggcagcggcaatgagggactgagggcgccgctggctggaggagaaggaagcgcagcggaggagaaaaggagataaggtgggcaggcggaggaaagaagtccgagagggaaaaaaaagaaggaaagagataaggtcaggcgaagaatcgagacgcgcgtgaccgcgtcttctctcggctccgcgtcaggaagaaaaatgtatacgtataactgtagtcttttactctcatccgaaagacttgattcatctaagcgacacatgtcccgcacgaatctcagagccaagcttctctatgccgagcttgggccggactgcccacgcggcatcaagctagctcgtgctgccgttctacggctagaaagatactctgtatctcatgatttggaagaagccgcgtgtgcctgcgttatcaattcgaatcgcttctagacctgcaatgcaaagagttgcctcgatggtgaagttattcaatggttagattttgtttgccgttgagtttagtttgtagagtgaatttcattgataatctttgctgggccggacttgtacattgaagttgtaactttttctctatatccgatcgagattacgttcgtgtagtgtgacacgaagtccgtgtgtttggttaatgtgaaataggctgttttgaaaaaaaaaggaaaaagtacgaattactcccgaattattgcggtcgtccgaattacccccatgaaccacaaaaccagacattatttaaccccaactatgtaaaccggacgaattaccttccttgacctaatccgc

SEQ ID NO: 66975 - DNA, 4104 bp, Oryza sativa
ttcttcagccttaaccttatcaatacgctctgtgtgcagcttttctttctctttatcttgatccctgtctctttcagctctgtctttctccttctctaactctttttcttggtcatggcgctccctctcccgttcacccccagggcgtcgttcatgctcctccatacgttccttttcttttcccttgtccttgtcacggtcactttgagtcttctcccttttccttttcttaacaatctgttgcaactcttcaacattttttgtgattatttcaagaggttcaagaagggcaaaatccttcgcaagatcttcatcattctgcaacaagataaagagcatgatgtagcatgcatcagaaaaggtaatgaacactagaagacaaacaaacttacttcatccgtatttgcttctagttctatgtattggaggcctttctgcacgatagtgataagagcaccaggtggaactagatttccatcaatcccacccttatggatccctgcttcataccctaatgtgaatgcggcatgaatgaaacctggaaaggttgagaaaccatcagcaataactgtcatagtcatatataaccaaatatatatataagtcgggtgcagcataaagtagttgcagctacatcattggacactgacacagatcacatgtcagttatgtatcaggaaaaagtcagctaaaatagatgatgttttttttttccgatacagctttggaacttcattgacaagcatgcaaaaatttatcgcacatgcaacacaaccctgccacttcaacaaaaagtgaaaagcctatcactagaaacagacaactaaagtaaatgatattattctttgatacagctttggaacttcattggacgcatgcaaaaatttatcacatccacaacacaaccctgccacgtcaacaaaagaatgatataagcttatcgctagagtgctagaccagcctccctccataggttttctcctcgtcatccagaccatgcacctctctggacatgcccccatgtcaagctcagttaagccatgtcaagctcactggtgggttcttattagttcctttcatcagttccttctgaattattaagttcttctctaagttaggttacatggagcaaaactggatgagttttggatttgttcttcttacttccactttcatattttagaaaatagaaacgaataatacaagtattccaagaaggagcacatactatcatcaaggcttcctatgttgaattgttgaaaaagacaaatactgaaatgggaaataatgtgcatagagagacatatcgtcatgttgtcttgtttgcaaaaatggcaatccctctcttggagtctatgtatcgtattcatgcccgtggaaccatatatatcaactgtgggtaacagataaatgagagaatatggcataatattcttcttgactcgttaggcacttctagaacaaaaaggcaccatagtagcacgaactccctatagcttggttctgaactctgagttctgagccatattttactctctgcaattgaggacagttagaaatatggaagccagcagtgctacagtgatcagtgaacaggcaccaaacgcaattctctcccgcaaattaccagttaccactacaatttcaaccccaaaaccaacaaaaacaacaacttcccatgcaccaacggttattaaaatcctcgggtccaactaaaaggaatgaaacggaagttagtaaaagaaacagacaacatcgaaccctattatatatatgggcatgtttggattgctaccctaccagtggtagtgccaaatcttgggcaagttttattactatcaacattttgttagagatttctagggagagatttctattgatttggcaagttatggaatcaatccaaacatcacacaagtactatttagactacctgttggtagtgcaagatttggcactaaaaccaaaacagccctatgtttccctggacacatcagatcccaagattgtgccctagcagaccctattttccccagggccgcacatctccaccacaatagcaccgaaccacactagagctactaaacatccagcagcggtaaatctccaacccacacgaaaatcctctcaacgtaaataaacacaaacaaaagaacctaatatccccaacgccccacatctccaccacaatagaaccgaaccacactagagctactaaacatacagcagcagtaaatctccaatccacacgaaaatcctctcaatctaaacacaaacaaaagaacctagtttccccagcgccgcacatcaccacaacagaaccgaaccactagagcagcagaggtaaatctccaatccacacgaaaatcctcgcaacgtaaccacaaacaaaagaactagggagaagaattcgagagtggacgaaccggactcctggagataccggaagatgaggaagttgagctcggccgaggtgattgcccccataggcgccggtcgacgaacgcgtggccgccgccgagacgggaaggctccggaggagaggggagaggggagaggggagaggggagagtggccaaggggacgaaaccggcgaagggatggatggtgtgggtataggaaaaattgatggattgagaattttaggtcatctcctgaagtcagtctggacacggtcaggatcgcgtgcagaaaaatcggacggggcatgagccccgtaggcatggacgggcctagaccgttcgtttgctttaagatccgtgcacaactggaatactaaatgctacaatgtaattctattgtatttaataacttttaagatcttgatttttctgttcgtcacacaaggcacacgtcgaccgttgccctttgagcacatagcatgagagcatgaatataaacccaaataatagttcgatatgaagtagatgtcaaattaatagtttcaccatgtataaccagattaacaattttgttggtcatctcgttatcgtcttcttttaagatctatatggcacgactattaaaatttgtcgatggcaaaagtaaatatttagagaggcatacttgttaacatagtcatggtattattccggtgcaaatgggcgcatgtagcacgagatggtatggagaagataatcacacaatattctacatgaatggtgatggcgtgctgtacagaacaagaggacattggtgagtaacataaagatcagcaatttactatcctctagattatgttttcgaattaattttgatcatgcgaacctatatttgctcactagtcaagaacgtctttatatacgatattcctagtgctcttccctgtggggtctacttctttctttggcttggctaaaatccttgttgtttgtcttgacacaccccttaacaatgcgacatacaactgaccatgtgaaaaaataggctatggatgatagatcccaacatttggggctgtgtcttgtgggtacagttgtacacctctgatcagattaaaattattcgaatagcagcgcccgtggttatgggcaatcaaccggattcaccgtgattagtctcacccctagtttagcttaatggaactggttagttcaggtggtggattggccctgtctcaacgtggtgtagtgttgagcagtgattggttaatattgattaattactattacagttttactgctttcaactactgcttttaaatgcctgctttatgcaaataaacctttagcctcctttggatatatcttgcatcataccttctcttctggtatgacttgctgagtgcagtggatagtactcaatcttgctctctcttccccacaccagagctgaagttcttctcagttgggctgtctcagagaagttggtttcgttgccgccgtcaagaatgcctgtggaatggagtcgcctcgctgcaggagtcaagtcttcaagcttagctcgtttttatctttctgttgcatttgtaaatcttttatatgtttgtaagacgtggatctgtatgtcaaaaattgtcgcttgtgtaccctagctggtcctggataggggttttaatgtacattcagcttagaaattctggttcgtgaatttatgggcgtgaca

SEQ ID NO: 66976 - DNA, 21590 bp, Oryza sativa
tagggtcgtgctccaccagcttggggcgcaccccacatgggccccacatgggccggggtcccaaatgaagttacaagcccataggcccattacaggtgtcgcagcaccttgtttcttcagttgctgccgactgagatggaatttggcaacgaggcttgatgcattggaaagaggactccgagagctttccatcaagtactcacgggccaaaaacggaggtcgtatggagcttcggcggccgtttgaagtcagcagtgtagcaggtggccgaattggattttggcacttggaggactcgaacttgatatcttgttgtttatccatgatgtgagcaacggatgtatccgtagtagccatggtcatatcaccctagtagttgagcgtgaggaaggcaaacaggaggcccctccggcttgcgatggcccctcgtcccccgaaggcctagcgcccaaagcttccagcccccgggaggaccccgaggcccccaagggaggaggggaggctttggcaggtggccctgaaccttatgatcccgaggcagtccgggatccccccgggacctccgaacaggcgtgccccggatcatctgcccctgacaacacgaacctgccccgccgaaaggtgcagcggcccgtctactttgtcagcgaggcacttcgagatgcgaaaacccggtatccgcaggccaagaaaatgctttatgccgttttgatggcctcaaggaagttgtgttactacttccaagcgcatcgggtttccatggtgacgtaataccctcttggccaaattttgcacaaccgagagggtactggacgggtggtaaaatgggccatcgagctggctgagttcgatctgcacttcgaaccgcggcacgcgatcaaaagtcaagaagtcctggctgatttcatcgcagaatggaccccggtggatgaacctattccgtccaacaatcgtacctgcggggagggcggttgaaggtccacttcgggggctcgatgaagctcccctggcatggctccgtttgccctatcttccggagccgcttctttttccgtccagcctcgggcccggcaggtcgcttgtggcccgctggcgaacgatccgtcgcgcgctcggcacctcctccacgtgggggagagggcgaccgggaataggccaccttccgcttcccctttgggtcaccggcggaatcgtctccgggtccgcggctcggtccgggcgcccttgaaccaccgccgcatggaccgccggcccggctcccacccgcggtcgcaccaccaccacccgcgccgacggcgctaccgctggcgccgcctcggctggaccggctcctgccggcgccgacggctgacatcacggccaggatgctctcccggtcacggtcgcagcagaagggaagaatcccatctgggattagtgttggctcggcggagtctaggcccagcacctgccgagtcaccctcttcgcgtcctcctcaccccagtcccagcgctcgcccacatgcgtccgcatggggtcgttgggaccagtgtattcccacgctccacgggatcgttcctggagaggtgcgatgcggcggcggaagtaatcgccaaagaccatcgcccccgtgaggcccaggctccgcaggcccttgaggcagtcccacaccgcgtcgtattcctcgcccagctccgaagccgccagccatgcagcagacctttcaggagggccagtaggaactcgaagtcgtggatggtccggtaacgcggtgtagaaccagtccttcttccagtcctcccatttcttgcggagatggctctcgatgtactgacccgctgtgcctggccggggctggaagtagcatccccccaccaccgcgccttgcagcagctgcgggatgaagaaggcctggaacaaccgcatcgtcggtcgtaccccaatgaacatctcgcacaaatgcgcgaagatggccagcatcatcacggcattgggtgcgagatgcaaggcatgaatttcgtagaaatccagaacctcatggaagaatctggagaacggcagaatcaagcccgccatggcgaaggacaagaggtgcacggatcgctccggatatcgcggccgtggccgcgactctcccgcccgcacgatggcaccgtccggcatgatcttgcggggaaggctaaggtgcttgtctgctgtgatgcgggaggaaaggagcactgcatcgccggtgtcttgagccatggcgaccggcggagaagtggcggagagcgtggcgcgcgagacagtgtgaagtggcgagaatgttagggttcgagaagcgaaaggacgagtgggcagttggcgaaaggaaggaggcagagtctccgcctccgcccccttttatcctcgcctcatccgtgctcacctcctcgtgtcacgcccccataattgcccccatgatcctcgcgcccgcatatgtctcttcgttttccgcgcccactcatcacgtcgcccgttgtatctgcttcccgcctttagtgcgcctgtcagtggcacactcgaggtggagtgcgcaacggccatgagcgcaagttgagaaaaccgtcgccactaccgccgcaggagactgaccccccccccccccccggttatcgcgcctcaagcatcttcttcatgatcgcggtcagtgctggtcaaaccgctgttatggttggcacgccaacctggccacgcggcgatatccctttgatttccctgccgggcccacaaccccagctcgagaagtcatgaggcaccatgtcagaccgatctcaggaaatcgatatctgatatagcgccgggggctactgtcggagatatgggcccgggggtatgtgaagtagaggggagttactttccctccggccacgtgactctgcaagttggccccactcacgcgtcacgcgagtcgtgaaaacggcgggggggggggggggggggctcggggcatggcgtcaccccctcgggctctcccgcagcttcgccccgaggccctcccccggctgccacgcggcggagggagagagagagagggtagctcaggctaaacatccataaatgtgcgacgccccaactgtccctcaccgcattaaatgtggtaagggcagacgtgcggcgcgcctagctgactcctgtccatcggatgtgaccggtctgtgaccggcctgttaccgtcacatccaatggatagggcaatcatgtcctcacgtcgcctctgtacccggcggagtgggggtgggtatgacccgtcacatccgagcgtcacacgaggaagggctgtcgcaagtcatcgctcatttatgaggaaatgacagggctgtcccccgtgtcaggcggggggcggcgctgggttccactcgagaaccggttgttgcttagcttccgggagaaggcacgggttgaagcccagtaaaagtggagtgggatccccctcctatggagggtaggtagaggcggcgcatgtggtatccccttgagctataaaaggaggacccggcccactgaaacggggggacgacgcccagaaaacctgaactccagaagaaagaaagcgagtgcgctctctggagtgaagaaaacctttgtaaaactcatccataatcccaaacacaggagtagggtgttacgctccatagcggcccgaacctgtataatccgactatgtgcaagcttgtcggtagtcttagggacgagcgagtgatttccaagagacgagcctctgcccccggccgaactcacgagaaggggggtctcacgactcctcgctattgaggatctttcctcgatagtatcgatggtgttgatgtcctcatcactttaaattcgatgcatcgagtttggatggcttggataacgtatcaattatcccacattctctcttttttttttctcatagtacaatctatttgtatttgtaactcataggtactaaatctaggaagacaactagagtgttagaaaagatatatcaagccaaataaactgtaatattacttgtgagctgataaaatagtgattaaccaatttttcattatatttgtaggtagatttaaaatagatttcatatatctctactatataaaaattgaaaatgtttttgccggtattttgatacgtcatccgtatttgagtcggtttttaagttcattcccttttggaaatacagatccgtgtatgagccggattttaagtacgtttgcttttaaaaatacaaaagaagtcgtatgagaaatttctttaaaaaaacttacatgctaaacttgagataaaagtcgaactccttattgcatctcatgatttttttaaaaaaatattcaagcgaattctcacagtgaatttcatcttagctaaaccatataacaataataagattaaaaaaatagcattcacccattgcaacgcatatgcatttttttctagtgtttgataatatagaatatacacgagtatataactcttcgtatatcctaatattttttttgggggatttggattcaaactcaactcttctcatattctaatctatattttttggagttatgattcaaactcgaatattaccgtgtatctctttttactctccaatatgctttgcggattcagattcaaactctgatactaccaggtatcccatttttctctcccatatcctttccatgagtctcgggttgagcgagcgtaaaaatactcttctcgttttcacttctaaaatcacccattttttccacattagtcgccacatcaccattgcagacttattacaagaagcaacacatcacattgaagcatatgacgtgatcatgtgaataagctcttactcatacttccctctccttgaaaatacgatggaacagaaattcgtataaaatcgagaacagttcttttcatacgaccctaaccatgatgaatacttacacatttattttactgggaatgcttaaacatctttgtctcaagaccagaaatgcttagtcggggagaaaaggctagaaatatattctaggcacacattttagccggaccttgggattcaatagcatcaatcccgtattgcatgcaggaaatttagcatgtggatctttggattgagatcaaccgcagatctgcatgcaatctcatagctctatgtttccaattaaaaaagctgcaccttacatcggagaacactaatacgacagctagttggaaggactgcacagtaactggattcccctatcttctgttcaaacgcctgagcggcctgttgttatcatcaaatccaccacttttaacccaatttcttcttgcgttactctgtagatctcttgagccatcatgtagttcagtagtacctcttgtacgagtcctatcaaagggcgggtgaccatcacgcatatcagaactcttgaatcgttcattcattttcttcctatttgagttggaggccctggcatggaattcatcactgaactttgttgagaacctgttcctcctatctgactgaacacagccacctatgtcacaatccatatctgaaaatggtacatcatcaagttcattatgcctaacaacaactcttctaggataatgcttgttatggcctcctttacatttcaatccttcattaatatccccatccaaatcagaaataatcccatcatcactctccgagccaaaagattcccttctgtggttgttggaaccattgcagcttacaggtttcctccaagaagcagcaagatgactagatctcagggaagggtgatcaaattcctcatcctcaggagaccctattatatcctcctcttcaccgtgcttagagttcctaattttagcacgcccatttaggtctgccgagtcacaagcatcttcaaagtccaaataactcatccttgacattccatctgtctgaccaccctttgataaatcaagctcgtaactatcaatatcatcctcttcgtcatcaaagtcatcaaaaccaactctttctctttctgaaaaccttctctctgttccctctctccatgtttcattaattccaaattcgttgtcctcagagaacttagaaccacctctagaagacgtgttgtccacagacaagctattcctggcctttgatgaatcagcaaactcaaatgctgcaacatcagcaccatctgattcattgtcatcaaaatcaaagttccatgcattacaaacttcagatttgtgagcaggtctttccaatcgctttcgtggaacagattgattagcttccatttggctgttggtgtattcatctggtggacggttgtgttcacaatggaagcacgacatattccgcctgtagttcaaaaagttgcacctgaaatttgaaggacacattagcttatgtggataataccatgcacatctaccgttgaaacatataaattccatcatttttccttccatgattaccagaatgtttcttcagaataatgacaatacagaaatattttaaccacggttatgtaatgaaaaagatggtcacgatatcacctttaccagaaacaacacaatggcaaaaactctttctactgactgggtttattttaaattcagaacaactttgttagggtaccggttgatagcttcataagataaataatgaatgccagtcaattcttctaacagtgagaaagaaaaataagatgaaaggatggcaatttcactgtcagatccttctacagaggtctgaaaaatagcttttcccttcaagaaaacgtggaaatataaaatgctgttgaaagttaaaaaaataactctgttctgcctcacaagcagtattctgaccaaggataacttatacaaaagaggctggaggaaagcggacaataaatgtcagtttttgtagcaaattaacacaattgatcacttgtttatacactattctctagcctgacttaatatgcctttgatattggtcccatagataatatgaataatctttttggcccttggcttaagaagtttgatgcagaaacacagaacatggtggtggtaggatagctacagttatttgggccacctggaaaactaggaatagaacttgtttcaggaatacactacccaaagaccatgtgggtgtatcttctatgtttgtcattggatttctacttggcccattttgcaagggttggagggaaaggaaggaaaactgcaggagggagtaactctactcaagcaggtggcaaaggaggtatatgatgctcagcatggttggcagctttaggactggaagacttgaaggatgaagattgaggacggtgaaacaaccaggatggaggatgagatagtgtggtagtatatctttggcttctggttgccttttgcagaagatttgttttgttggcaaccatgagcagtaaaacctagcttagacctgcaaatgagatggatggcatctcagtttgcaaatgccatggaagatgatcgtctctaggaagttactgtttgaacaccggttttgttgccatttctgataatagaaatgggggttctcaaaaagaaaaagacgatggtcaaacaagtaaagacttgtttcaattcacaggtaataaaacaagggtgtggaaaaatatatgttaaaatgtattaggggtcactagtgtgtcttgcatgatgtagtagataataatttgacaaagttgtggttgatcaaactaaccgaggacactcccattctccagggagaagttgccttttgggacgtttagcatcgcattgcaagcaaatagtgttttttgcaaagttcatgaagtcacacctgcagccaaattccagaaaatgagaacacaattctgagctcaataagattctacagatcacaggaggaagttgctataagtactttgggcagagccaatctcctttcttcatctctacatcatcacgtcccactcgtttctttggtggtggaggtggttgtttcaccttaggtggtggctttctgattatagggggcggaagattgggatcaatggggacagcgctcagcttggcaatgtcatgtatcaatttacgaacaactgtcttcacagatttcagtttgaggagtggcttgttctccacagtttcctttacatgatcaaaaccatagaacaacaaaatacgcataacatcaagagttcgagcttcatcttctttgcgtgtaagaatatagccccttgagcatagatttcgtaaattacaagaactgcatacctgcaaagtaggaggaaaacaagaaattcagaatgtcacatgttcctagtgttaccatcttcactaatatttaaagattttaggttagcattggattatttaactaaacaaattgtctagcttagcttttacaagctacttggaacctgagaagataaggctgcaagaatttgtatcagtaaaactgaggcgtgtgtttcaaccctaacatcagcaagcccctctactccataacttgtacttcctccgtccctagaagagtgcctttttagctatgtacctggacattggtaatgtacaagttcatagctaaaaacacacttttttatggacggaggtagtatgtcttaatgcatattttgtaatatcatggaaaacgccatcataaattcatggctagttaaagatggctaatcatgaaatcagtcactgagaactgaataatccaacaaggagtatgaaaaacagttctacatctagaaacattggctcactataaatttcaagtcattatctaaaagataaatttcaagtataaatgaaatccgcaagggaatacaccatagcatagaaagacacctgacatttagtattggcaacagttttacatggcagaatcttagttatctataatataaatgtatatggctatgcctcagaaaaatttgaaattggcccaagctacttccacagcaagcagggtggtgtcaactatacctgcctttcatttccatgtgttttatagaaccaagtggggtgttcctaccaacagtaactcaatcaattcaggtaaaaacaatttggtctggaatccattgataagcagcacagaaaggtagcaccagtttactgtactggagcaagttaggtctagatgaatatttattttgttaagaagtctagtttgttttaggtaatggtttattagtaagtcaatatatgttgcacaattatttgttgctggtgtcatctctgcagcagtgaacgcacacagcttgtacagcccatacaaggatgcagacgttattggacaggtcatatcccagactgcatttatatggtgaggccgacctctccttcagtgctacatggtttttctgttgcccttcctgcacagttcattcatgcacatttgaatagggagatagagaatagggtcgggggagtgggggatgaggttcaggtacactaacaaaacatcatagcagctcatgcctcctaaatgctagcagctgacttcaagatgtgttctccaacgttccagaccaaagactaatgttgtttccaaagcagccaaataagatttgtgtattcatggacttccaaccgataggcagcaggcatactgggcatagttatctatcgattagttgtaacgcctatttcattaatttctatattatttagtatccttatctgttagggagtttatttaacaaactgggaaactatgcatggataagaatctgagagcctcaacataatcacataacatgaaaggatgagtctccactaccatgtaggttctcatctggaatcagaccacctggccatcccttacttcacattcaactgagcatagaaaagagagaatggataattgatgctaatggaaaagaaggccaagaaaaatggagatcaagtgggacttaatgtgattatgctacccatgatcattaccacagcccactacaaacatgcagtaaagatacttttactgttccagaaaaacaacaaaaaacaagcagttttgtttccttatgaacttcagttgaattgctacctaaagtcagatatgcatgtctttatatgtttagatgttatatagatgtgcatggtgtcgtacatggagtgtgaacatgtcacacgtggtcctagtggagctagagataatctgtgttctggaatctaatttggactttggagaccagtcatactttggtcagtggtaccaacgaggcaacaaggcagagatagtaaaggccttcgtggcaggcaagcatgtccaaactgtcctcatcgatgtgggctcatgctaaccatgtttagctccacatctcaactttcaagctggcagatctgccatcactgcctatgggtatgtttcacctcctggtactgagtacacctcagacatacaaacttgcgcccaatgaacaccattaattttgcatgaacaccactggttccataactgtacttcacagacaccaaactccagctctattgcatccatacaccagcctccagatattcccttccctgccttcctgcatgtgcccattccctgattgccagcatgcaaatcggtcaactaggtggaactcttcttggcgcctagctacctagtgtctttactttaggaaaaattaccaggtagcaaaggtgatgatagtgaggctagcaacattatcatcttcttacaacctcttcaaatcttgtcctgggtgaatcattaaattatattggacacaaacatggccaagaagaggcaaaaaactacaggacggcttgagaaaacatttcaggtagctatgcaagggagaaattacacttgtccctaaaaactcaacagtgactctatttatattgataaattgagaaaatcgatcctccccagtttgtttttcctatttctgttactttccatgccatatcgactggccaaaacattttttttctcaaccagcaataaaaaaagcagcaatatggtaatttttgaacgataggaaatgaaattttggtttaggagcaacttacatccccctcatcaagatggacaagttttcttatcagctttgcagaaaacacaactttcggatccatgctagggcacccatggccaaccaatacctgaagatccttcctaggcaatgacctggattgataagattaaggaaccattaataatggtgttaatacaatattatttgattatttgttattacatctattggctgccattccagtaccatttttccatgtttaaggaaattaattgccttttttccagaaaatggaatggaacttctcttagattttcaaaacaaaattccaaattctgttcaagtggtctttactaattctcaagtaggaaagatttgtatgtctgtttgcctgtgctttaggcaagaatatacacaacaaaatttatataatttgcatgcgtttccagcagtctttggagtctgtttatcacaagtacttcacacaaccacatagaaatttatacagcggaaagtataataatggttatagagggttgtgaactcgtgatcaagtgcagtccttgcttttactgcgatttaagcagtaggagcccatctatgtcatccaaaaatcatctaggattcactgtccacaccttttcccccctttgttcaccaccctcaaagttccacgaagcaccaaactcagccgtgattttgacgctcaagccgagccctgcaaggtgcaagcatcttgaagccagtggccgtgaagtcgtcatcaacatacagttcagagtcgtatccttgaggggctcgtcgatgccacgttcaacacactgttaccagaactcagactcgagagtcggaatcttactcggactcgggtgtccaactcggcaaactctagaaaataggatccgggaactcgtctaacatatataatttttttattaaaaatattacatagtaataccaaataccaacaccatagttggtcaaacacttaaaactttaatatcagtagtcttgtgcacaaaggatccaattgctttgtatcttgtgccgctgaacagtgacgtattgcaaaaaaggagaaaagatggtgcatatgctacagcctacagatactctcttctctctagcctgcggctatccctcttccagagcctgaaaaagctacaacttgactctctttcccagcccttctcttactttacctcctacaccaagtcatcttccctactagaacaactagagttttctctaccatacagcggctgcagagcccctgcaactcctctctcccaccttgggactcgccaacccacgtcagatgcgtgtcgtcccgagtcggacgcgagtcgacacgcagatacacgtcgacgcggcaaatttttttcctgacacgtgtgtcccggtaacactggttcaacactaaggccagacaagcacttgccagtggcagcaaggtgctcattgatatgaagctcattgacctgcgcttgaaactgtctctgcatcgcagcagccattgtgagctccttcaagagatcagataatgctggttaaggctgcgtggcattgggtttgctgcctgacagagctctctggagtggaccaggtgggattgacatgttgtccctaaggaaggacttgccgtttgatctcttttggaaggggctacttctaaagttgactgcacctgatgtcctgatccccatccgtgtagggacatggagaactcaattagtgtttaatatttgttctgtgttttgagaataggacgctgtccagaattttaagcaaactataagaaaaatcaaggagataatttcaaagggaatgaattgctagtaccgagcatggtaggaggggttatccacacgtaaaaaaagggacgactcagtgaagacgttcaagaattatgctttcgtggaagtatcttgttagtttcaacagattgcaatgtacagattttcttatgcctacgatctagaggtaagcagagggcgttgagggttcgccggcttacgttggcgccgcggccagcggcagcgaaggcgtcgacggcctgagacagcgtcgtcttcgtgacaggaacaggaagatcgcgatgctcggactcggcaaaaactttcacggttcgtcgagatggccggctacaccaaccaaaccaaagactacttacatggatcccctttttcaccactgtgggcagacagcgataaagaatccgtctggtcctcgtcttcgtactcgacggcggtgttcataagggaggctaacgagactggcttcatggtggaaaagctcctacaggcagaataagatatttctcttttagggcacaagatgggtttgacggcaaggcgagtgaacgaattgatggtcagtcatcgcttggcttgtcttccttggcgtggtcggctgccagtgcccagggtttcatcgtcgctaaccattggggacgtcattgcttcggccaagcaaccaaaggtacgtcaactcttagtttcgatgcagcataattctccggtgatgtattccgcatcggcgagacttcagtctttgccggcggtgaggtatgctcgatccgatgatgtcagtgagtatccgagtcttctgggggatatgcaaatttcaaaatttggtttgttttcacgtgcaaaccaggcccattctcctccaaagcccaacataccctttaggcccatgctcgcattagtttccctactcgctagaacggggacttctcaacttgtggctcctagggttatcgccacacaatcgccatacacggacgttgtgcgcgagaaacaacatcaataatggagagaattgatgaagagacctatcgaggtggtgcaagaggtggaggtcaaggttcgtttgcggcaggcggaaggggtggtttccagggctttaatcacggctatgcaaccggtggtggctggtcatatggagtcggcgatcgtggtagatcgatggtggcagaggcaacaaagatcgtggcttctacgacggtcgccatggaggtgggagatacggtggcaacttccaggggaattggcaaggcggtagaacggtcagcgctttccgatgttcacaggcaacatgccgccggtgtcgccaacgattggagtcgctggggcagcaagtgcaactggagtggctaggactggtgccgtagcttcgaagggtttggctacaacagctagtggcgtcgtcccaccgatggctacagcatcaggtggtcttcgtccactggctggagtgaccggcaaatggagcagtgtttggagtggccagagggcctaccttggccaacaatatggcaggaataggcagcatggctggcaacattgccggcggcatggcaagcatgggtggaggcatggtcagtggcgtggcgggcatggctggcggcaatgtggatggagggatgggatcgcaaggtgcagcaggtggggcacctagctctttgcctgcagctatcttgttcgcttagccaggtatgggcataataggtaatggggcagctgctgtcgtggcccaactgaggtctttgacagtggtggcgcatggaggttcaacacctatggttctaactgggattgagacaggaaagaagacaggtttgatagaggtccatgcaggaggtgtgacgagttcaggacagccgggagtgatgccagaagcgattgtgtcgcatggtggatcaatggctcaggtacatatgacaagtatggcaggggagaacattaatggtgatgtggacgttaaggctaaaatcccatattggtaccgttgctacacaaagggtcatacccttaaggagtgtgtaactcagcttttctgtaacatatgtgaaagtgctgaccatgtaacatctagtgtcctgtttttaaatcagcaaacaagcacatggcgtctttgtgtggttatgcggtggatggcttgggattctattatatccctcttcctgcaggtcagaaggtgaagcatgagtctaatgtagctttgatacatattacaaaaggggttctaacagtgatgaatgtgacatcggagttagataggttgattccaagtaaatggaaatgggaggtttatgataatggtaacaatacttttagaactatctttccttctaaggtggaattgcagagaatggtagaatgggggcaagtgaatactaagtttgtgaaagctaagatggaaatgaaggagagagatgttgggaatgagataaaatatgctattccaaaggtgtggatacagtggattaactaaaggagctaagggaatactagatcatatgggctgttgggttcattcttggtgtcaccgagatagtggatatgaagttgaccaagagatatgatgcagcccatttgcaagttctggttctagatcattctttaattcctgaatctgttgatgtgataattggagatttcttatacgaacttcaatttaaagttgggcctaagaatgatgatgaaccggtgcctatggagatggataattttgatggtcctaatgatgacacaaagaaagagggggatgatttggatggaaagaatggtaagaaatcattatggtaagggaaaggagttatctaagtccaatgatggaaaatcttctggagttaaaattggggcacctacacagatatgggactgacggtttctgatgagtatgatggacttagaaaacacaatgatggtggagactggccagcaaccttcggcacttgtgctagcgacggttccgtaggtagtgggcaaatgattcggagcaggattctcttgagatggcagataagcttaaggtgatgtgcaacctagagattctatcttcaaaaggtaatagcttagttcataattcttttttgcaattttctgatgagcaattaactagtaaggtcactaaattgggaattatgttgggggtgatgatacttgtgttaggactatactacatgatagtaaatcttcagaacttttacggttacaaaatgttaacatgcaagaaaattgacatgttaatgttgaagtggaagaggatgaaatgctagttgaacaggaatgtcatgatattatggaggaggtaatggatgtgggtggtgatcacttgtgtgattttaaagccataccatcttcagaactttcttgcctttttgtttaatgtcattatagatggtttaagtctaagagagttatatatgtctggaacgatatatacttgtgctaataatttgaatgtgcctacttatgaaaaacttgatagaattcttatgtctaccgaatgggagcataagtttcctctttctactgtcaatgttcttactagagacatttcagcaagcaaactcacatctgtctctaaagaaagatccattttgttcgtgctgaaggtttctccgtggaacaatccacgacttaatccatatatatctgatactatgtggtttccaactaacaaacaaacaatgcatgcaagctccacgagatgcggctaaggaagagcaaacttacttgacgatgtcgaaacggtcacggccgaagttcatacaggcattcttgacagtggtccagtccctagagaagtcaaaaccagtctcttgagtgacttccgctaggtccattggcacggcggcggcgacgcagccctcgtcagcgccgccggtgcccccaaggtcgaagtatttctgctgcgccagccgatccatcagctcgatccactccggccagggatgcacgagctccacttccctccttagcacctccgccacgctcatcctctccagctcctcctttccggcaacgtccaccgcctcaggttccttcttcaccggctcgccaggttcgggtgccggtcgcggctccgcctccgccggcagcacgtccggaagcgcggcggggcggcgccaggactggatgcggcggagggccgcgtcgcgggcggagtggtcggagaagcgggagcggtcgagggcatcgagttggtcgaacacgaacgagaggcgggcggagagggaagggggcttcgccggtgagagggacgaagggcaatgggaaaaggaggaggaaaggaggcgggggaggagcggggggagggtggggatggtgcagcggcggcggcggcggcggagaagcgatagaacgtaggaagaagccatgatgtgatttcgtggtctccgtggtccgtggtataggtggccaaacaggctgcgcacggcccgccccactcaccactaaaccccgtgaggtggtggaataagtccacttaacctcccttaaccagtggccaaatctaattcttatccctgaactacaaaatattagatatctctaatcctagctattaaaactagtgcaatttgactttctctctctctcaactgttttgaagggtaatttctttaacatggcactttaactaggtccaacctgttgagtcaccctgtgagacccacccgtcagtgttagaataggtgtcgaatatactagtcctaattggttacagttggacttggagttataataggtggtgggggtgaagttagagtcggactctataacccggcaactctcttaaatagagaggaggcaccacaatataaccatggtgactacaatatagcgtaggcacgcagggagatgatggtgcgcggctatagactcgtagcagctatgagctatattgattggggaggcgcgcccataaccagagccccgaggatgtaagcttcggctgaacctcgttaacaaatatcgtgggttcctgtgttgccatctggcatgtcttagctgatcaatgactgaagcgatcgagaaagttagtcgtcgttccgctatattgactaacttttataacaagtggtatcatagcagaagttttcaacattggaccaagaagacatgtggaggaggaaacacaaggtgaggatcgcacatcgacagaagatcgtcagccatggcgatgagatcgatgacgacaacgaggacgtcgcggagacgatgacctcactcacgattagacaggtccaggtgtggctgaaggcgaccagagagattggaggggtagcgctatggacgacgcgcccaacgcacgcggcgatcgcggatccgcgactgatgtgaccatggctactacggatacatccgttgctcacatcatagatgaacaacaagatatcaagttcgagtcctccaagtgctagaatccaattcggccaccgctacactgctgacttcaaacggccgtcgaatctgcatacgacctccgtttttggcccatgagtacttgatggaaagctctcggagtcctctttgatctagcctcattgccaaattccatctcagtcggcagaaactgaagaaacaaggtgctgcgacacctgtaatggccctatgggcttgtaacttcgtctgggactccgcccaagtggggcccatgtggggtgcgcaccaacccagtggaggatgacctagaggacctcccacctacttaaataggtaggtagccctttagagttttttgggttttgatagattaaagtttagctattgctacttggttgcagggcacgtgtcggctagaccgtccgtttggttgtttttcggaaccccaacttatcatttgtattaaattcctatttgcaatatcagattgcttttatcttgttcttgcttgtttcttcgatttgcttgcaggaaaagggttgatctgcaccggcaagatcaacaacccacggagaggtgtatcgatcgctaaggcgcaacacaacgtctcgtacggttgtagtcgggtcgtcaacgtgtctcccaaatcgtagttatctcaactcaccgaaagatcgggccaacaacagccttgagtgtcgagtggaactcagggttcatcagcgacggcagggaggccagtgatggaagggtgaagtcagcgagcgcggcatggcgcggcggacatgcagggccgggacgatggggtcgtggacggtgaccacgagggctgcggactgcgatgcgtaagagaggcacggacggcgtacacaaagtgcacgtcatatgcacacaagctacaccaatgagcaatgcaacggatagagaacagaggagttgctggcacattgtattggaagcacggcaaggatacatgcatgcacttgccatgcatattccgaggtggcaatctgatgcatgtacagggagacatcaatagctctgctctagcgccgtgtagcctagtgccgccgtcaccgccgttcgtccagccgtgtgccaccgtcgctctggtcgtcgtcgtcgctcgggaaagccgccgtcgtgatcgtcaagtcgtcgccgacctcgtccacccctccgtcgtcgctgtagatcgccggagccccgccgtcgtcgtcaagctgaaggtcgccgccgcttcttcctcgtcgccgtcgccgtccgttgaccttccgccgctgttttggtcaccggtgagttttccacgtcgcccgcaacccgtaggtgtccttcgttcgcgccgccgcgccgtcgttcgccggcgagcatgcgaggccgagccgccgtcggtgatgacgtcatcgctgacgtcatcgacgccgtccgtcgtagatcggtcgtagaccgttagatcttggccatccgttttggatagatcgatcacggccgtttgtttccgtgaaccgccgccatgcacccggtccaccgtgagccgacccgctgacgcaataatcccctttttccttttcaaaaataattcattattgcgtcataattcaattaaaatctatataaatgttttaatccgattaaatctttgaaaattcataactaattcatcttagctcggatttagttggttcaagtctctaatttttctaaaattgagatctacatgttaaaaatatccacatatactgttcatgcttgtttatgtgctgttttggtgattttgttcttttctctttagattccgacgttcccgagagtctgaatttgcaagagaagactttgaagagttccaaggccagcaaggcaagtcacacagatcccaaacaatcctttgagcatgttgatcccgtttaaagctattgtttctattcaactattgcatttatttttgaatgtcattgggtggaaataacctattgctttgttatagcccttttgttcttgattaccctattctttgataccttgggttattataacttgactagttgagctttatatatatggattcagctggatattagatataattgcttagccatgcttagaaacattggcacactactgggataacttatgcttcactattatttaatgatggcttaatggtagctcattatggttaatcatgattggttaattaattaatttgccaactaaaacctgataatggtgggttgtgagcatatggttttgatggttgtgctcatgacaattaaggaccggttcacgatttttgattgtgaaacatttaccgtgccaaccacaagccagcgtgggcaacggctttactttatgtatagtatggttcatagtagagcaccagactgtgaagtggcggagataagcccacgggggtcgctggggagtccataccttgtttataagggggtgattatgatctaggaacggtacactgctttgaattgtattatatagagggtattgttacaatctctattcgggtacttgtcaagtatcgtgacgcatggttgacatgatgttaaggttgtgtcttgtgggtacagtggtacacctctggccagagtttaaactattcgaatagccgtgcccgtggttatgggcgggtctaacaatgtctttcgtgattagtcttacatttctcaccatattaatttatgatgttaataacttgtttagctcctggtttggaatggttaattcctggtttggagatagaactgtgtagccgggattggttgttcagaatggttgggcctatgcaacagggtatgttgtatagcattggattaatattgtttaattattatttaactgttttattaaattctgaaatatttgttaaatgctatttatgcaaatgagactatactatgccatcctttgttatcctgtgcacttgcatatttgctgcgtggcttgctgagtatgtcatatactcaccttgcaatcattcatcagaggaggagttctacagtgatactgatggtgtggaggattaggcctagtcctggtcaagctgcctgtggagaggagtcgcttgcgctgtttcttttattttccgctgcttagaactttattgattgagaggaactatctacctctgtaatgacattttattcgcttattaattagagtaataattgtactctattatcaatttgttattgtgtgcctcggctgattcctggacgagggtttacacacatgtaagcgtttggaattttggatagaaattctgggcgtgacaagttggtatcagagcctccttgaccctaggttatgccaaatggttacctatagaagccctctaaaaatgttgaaaagtagaattgttctcctctctttctcttttatttaaaccaaactaatggcacatgcagtttataattcctttaattgttctcattcaaaatttatttattattccggtgttgttagtactgtaca

SEQ ID NO: 66977 - DNA, 29046 bp, Oryza sativa
ttttcaactgttggcaggtaaagatttatctaggtcaatgtaatatgctcctcttcctttcgatcataaaataattgatctatatatttctatttagattgatgttttgttatgttccagtgtcaagacaattcgaacatgctatcctcaaaccccaaatggcactggtccagttactaatagatctgccaagctagatatgctttttgctaacaaggtaattacttttaatatttccattactcaaacaccactttgttactgatcactgagttctagtaattcctgtagtaatcttccctgaacaatgtattcttgcacagtagcaataattattgagcataatacaactaccaaaagatttatggaaattaagagtctaatgaggatttagaaaaaaacctagtgggttaactccattacaacacactggtccttacatgtgagacatctcagttccttgattgggggttcagagtctgattatatggtgcaggaaattctggaaacccaattgccatcttgacctatggttattctgtttgcactagattgcatgaataaaatcatgacacggtcgatattttgctttatctgatgtgttttgaggaaaaaaaaaactttatattctatatatatgtgcatgcatattcattatttcatttcagtatttttaggggggaaatatttcattattttttcgatgtaggtccagatgaaatgatggataaacataggaagtaataataagatattaattaacttggctcaaatgaataatattccttgttaacaaggttatttctttgttccatttttgttgtggccgacatatgtgctacactttttgtcattgatttcttgttggattaatatattttccccttgttggcagctgcatgcttttgttgagtacgatactgtagaggatgctgagaaagcggtatggaccattacatgatgcattgtaatattttcatgaacatggtaatcactgttgcacatgcatcatctctgatattttcttcatcctatgcagatcgtggaacttaatgatgagaggaactggagaaatgggctgagagttcgattattgaatacttgcatggtaaccattggattagtcaattgcacatgagagttcagtactttggtgcttaagtgcatatgcaaatgtcatgttaatgcgcacttgttatgtatgtgttgctttacctgtctgagagaactttagttggttttgccgtgtatgaatctgctttaatggcaagagaccatgattttaaatctaatccttattagaatggatcaaaccatgtggacggattcaatcgtatggcacttaacatccattggaacatctaataagagtatgaggtccattaatctatccagctttaaatacgcaagatttaggggattgcactagtgcactcataatagcgttacatttcagatttgctctcaagtatggcacaagtaaccttgaaaagaaatacacttcagttgttatgcccccaatttgcaggtgaccccactttgatcccaactctccacgaatattaataacagatcaaatatggggagttggtgaccctgtacctcatatattgtccaatatattatagacaggtctagagaatgcatttgcaagaatatagggaaagtttggtaccgtggtatataggttgacgtgtttcaactttcaacgtcataatcttaacttgttgctaatatgtgtgaacataaccagttactcaagaaattataaacatggcagcagatcaacagagaagtcatatttatctaaatagccatttgactaaaagatcacaagcagttcagtgccaaaataagcatgtttttatgttctcagcgtggacaattcatgttaattttctgtgagcgcaatttatgccatgttcagacttaattcgaacttcaagtaacaagtatcccccttctatttgggttattttctatcagtaatatgtatacaacaattggcataatcatcatcatcagtttagtgtatgccatcaatccttcctttcttttgtttgtgttcactgcaacaattatatagtgtaatcaatttgcgcagtgctatcttaatttatttgcgcagtgctatccttaaattggttgcatagctcaaaatgattatgtagtttaatgcatgccataaatgcttctttaatttgtttgcacaatgcaaaagaaaggaattctctttacctttatataatgttccttttttgtggtatagacaaagggaggcaaagggaaaaagggtggccatgatatcaatgatggacatggtgtagaggatgatgtctccacttctaaccaatcaaatgagaaacatggagaagaagcactgcaaacaccagatgcacagggagagcaattggtaagctctccattttactttgtataatcccttatttggaaacacaaaaaagaaacaaaacagtgctttactgctgtagagtttccaagtgtgcgtaaacttatttccaaatatgagcacaatttgtggcactggtgttaataagggtttcttagggcatgtaccatggtctttattagcggtctctctttattgttatgcaagcatatttggtgacgtggaagagagaggaagaaggaaagagaaagatggttgctacgcatgacaacggcatagagtcgactcttagcatttattaggaaatttttcgttgtattgagtctaataaaggaaagatgactagtaagaaagtattttggtacattaatggttaaagaccgtattgtcttaactattgtaacgtgatagcctctaattaacgtagagaccatactgttctctactagttaggaatgttcgctgacatggaagagagaagcgaggagaggcaaacatcgttgctactgttaacaactgcttagcaacgactcttaacctatataaaatggaaactttgttgtatgagggtgtgaagaaggaaagaatagtaatatattttttttctggatcaatatggtttagagcatttgttgtctcacaccattgtaaaggtatagtctctaaataagcatgcgttatctaagtgtctatatgggctctacctttgaacatatagtgttttctttaagcagctcatgccaaaaacataactagttacatcacaatgaatggttctctctctctcatttgaaggttcatgattggttgtaaaaattttacctaatagttgggttgtgcatctaagcttgttaaagaaactatactcccaaagatctgaaaccaatttgtttctgtacagcctgatgagagcgctggggatatgggacgagggcgtggcaaaggccgtggccgtggaggtaaaggccgagggcgtggctaccactaccacaacaacaatcaacagagctaccacaaccatcagcagcataatcatcagaatagcaacaaccggaacgccgcccatccagttggaacgccgccatccaaccatcctgccaagaacgagcagcaacagcaggcacagccacagccacagccacagcacagccacagccaccagcaggagcaaacaagcagcctccagggccacgcatgcctgacggaacacgcgggttcgccatgggcagagggaagccgcaaacatctacgacgacacccagcgcatcatccggtagcgaaccttgaaactcgaaacacgcaatgttgctgttggtcatgttgatagaaagagatgcggttgagagacttgtcttttttacaagtctgtccttggaagcgtgcctccttttgttgtttgttctatatatacacgtttttctgccgtgtgctgttgttgtgtagtactacttctgaaacaggtagagcacacaccgtttgtgtgactcggtgtgagtgagtgacctgagtgtgctccctgtcactttgcagctctgtttttttttttttaccatttttgccgccctgactgtaagattgtagtagtaaaagttgattccagaaagataggggaggagaacatagtaaaatgtgatgatgtttcttgtactgtgttgtgttgtcctctgtttttgttgctcaactggatgttttggtgtatcatgcttgtaccttactttgaaagcgatataattgaagttcccgtaaataacgacgtagtatcaccttaatatggtttgattaaattgtgaaatagaatgtgcaagaacaaattataggaatgttgagaagcaaatgctagaaattttggaagtatgttattcagagcatgtttggttggttactgaacaggcatatgatcatgacctggcaatataacaatttagtattgaattagatagtacaacatttctccaaattcatattactaggctgtgtctataatcttgtacagggttactatattttgggacggtggtacatgatatgtaggaaagactaccaatgaagcaaagcatccttgtaacaaattgtgtcacgcctaaagccttgtggtgtgtccttagaattacgtagacaaccaaacaaaacacacccccttaagatcgccctttctagattccatgatcagaaaaacaaaattaattattgatgttactatatcacactagaaatttcaatgcacgaagaattttacatataccagaacacacaagatcaatcatgtgaaattacaaagccaagagtacgtgcacaaagtgcacacgttacaaagactaaaaaactacggcttcgccgccgccgccgccgccgcggcgagcgggtggaccttgacgacgccgccgctcttgccggcgtccggcgccgccgccgcgtcgtcctcgtcgaccaaggtgagcaggcgcgtcatctcggcgaaccaccacctccgctcgaactcgtagcccagcgccgcctccaggccgatgtcgccgtagcggctcacgtcgacggcgccgcccttgccgtagccggcgccgtagctgtagccgtcccaaaccctcgccgccaggtgaagccccacctgctcgtccacccaccgcctcttctccgccttgtctgggcggcggcgagccgccgccggcgccggcgccgacgacgacgacggtggccggaagcagcaggccagcttggacaagatcgccatgcgatcgaggcgaggcgcaagagcgagctagactgatcgatcgattggcaatggcgccgtgtcgatccctctatatgtagcgcgcgcgcgcgggctcgcaatccgagtcggagaggtagtacgtgacgatttgaaatcggagtcggagattttctttcccgcgtcgtcgactccgaattgagcaacgaaggctaagtacaagttgaatccacaatataagtgaatgtcatacagaaatacacaactttgcttttttttttctcgattttcccattgttcgctttgatcaacactaagaagtactcggatttggtttgatatcttctttgagagccacagggagtaacctaggctgagttcgtttcaacggttatgctcaaatgttcagcgctgccggtgcgtgaaactgagataatccacgattaattgagtattaattattataaaatttgaaaatggacttatttgattttcttctaaaagaactattgtatagaaaaattttacacgaaacacatcgttttgtaatttgagatgggtgatcacggagaatgaaatagtagtagctgtataatccttcatgttcatttagtcatgtcagctgtataattcacgcaacctgaacttgtataatcctgcaaaacgtaagcaagcaatgaacacgaaggattatatagatttggaccgcatgtgtgcgtaatatcctactcctgtatatggaatatggatgatcgaaataagctacaatgcatggggtcctaacgaggaatgctagtttctctgttcataatatcatactcctgtatgtgtcctgtatgtggaatgtttagattgtggatcattaacctcatcttgatgagtatgcaaccaacgcatgtaagttgatttatttcacctctgttcgtatggatcagtttcttttatccaacataatttagttgtcattgcattctttggcacaagcattgaaacatcatgacttggtttgcctgatttttacgatttgcaacactgcaaccatggaaaacaattcaatataaaccagctttcatgctggtaactattaatacctctgttagtttgttctacaatttggtcttggattctaaattctgagacttactaaaaaatactcagttatctctttagaatagacatattatctctttagggcactactgtgttctgccttttcaaattgagcgtctaaatagaagaaattgtgcctatgtaccttttctatatattcgatgaaataagttttgatagcaaaaaaaaaaatatgcttgcggttctacataaatagcgatatggctgaaatgagacatttctaattccagattatgcaccattttgatagtgctttcagtttatctatttgaaaagctcttagatatgtgatttagtcacccgataagcttgcgactttgcagtcactgctgattggttcttttcatgtgtgctttctctcatcagtcattgttcttgccgtagtttccagataattagaacttttcagaaaaagaaagcagtgatatccaacgtgttttataacacactacgatgtacttcctccgtttcacaatgtaagtcattctagcatttcccacattcatattaatgttaatatgtatagattcattaacatcaatatgaatgtgggaaatgctagaatgacttatattgtgaaacggagggagtacatgcatctttcattttgtgttttgtgattcttacgacgagtgtccagaggtagatcattcaatcgacttgaaatgcacttacctggcaaaatatgttcactgctgggtatttttactctcattctctttcatcatttcgtatggggaggtatggtgaaggcgagaagcctataatgaagtatgcctgcttcaccttgtctttgctggtatataatggcccatttttctgattcctggttaatatcaaagttcttctcatcaagcaaaatgattccctaacctccacaagcaaaattgtttgtaatgcctttaagaagagaagaaactaccaaaatgattccctaaccttttccagtgtctataagcaaaattgtttgcagtgcctttaagacgcgcgcgaagaaactgttttgagcatgttgctacatcaatagtacaatcgtcacctatagatgcctcacataaagtcattgtggctcacaaatttgcatccaaaacatgaattgagattcttttaaattggaagctcgtcactgagggttaggatcaggattgtctactactccaagtgatctgtacaatagatgatcagctcttttttttttttaacttcgcaacaggtgatagattcgataaccattggaaatatttagaaacgtgtagttgaactggaagaatatttgtggcattatagccacctaacctttttcttaatgaattattccaataattttttattgagtaatctgcccttataggaagaaatttgtactctggccatttaagctcctataaagcatgaacattattgcataagcagggagacattcttccagagtataagcttctatccttatttgtggatccaaataattatgctacctagttgaaattgtatgttcatcgagtgaaaactttcaagctgaaattgtttcgttcgtttttctcctttaagatgtgtattacatgtgcaatttttattaaggtgttacagtacttgtgcttaactgttctgtttattcaacagcagcgttacaacatactccatacaaatgtaataactcgcagcattttttatatcaataatggaaaattttagtattgatgtaaccacactcatgaggcacgccaatgccgcgccccgtaatctagtgcctgtttaccagccaccacaagtagtgatgatacaatgttgaaaaaagaagtctgcaagtattataagttcaatacacatggtacgtagcacatataattgagttgtaaagtcatcaacaacaagccccttattacaaatattaagtcttcggaccattggaccttatgtccacagcacaatcacaaaaataacaggatacatgccacacgtactagtagtatggtctgacaatcagaccatattgaggagatcagagttaaaagttttacccaaccaaaatctgagctccaagactggccattcaccaagcaacttagttattgccggcaataaaactgatagcaaacaaattccaatagctagccatagtaatcgtggggctaatacggtgtataaaccagttgcaaatgccacattagttgccatgtatgcaaaccacatgagcttcttagtgaaggacctataatgaagcaagaaatgaagatcctcccaccttgctatgatgcaaatgaaggcgatagcaagtgaggaaaacattgccaatgtgtttgcgatcaagaatgacaaatgcaaattttcttgccaatgggaaatcccaagtttccagcatcgctgctataccctccaggtaaggtgaaagcagcaacaaatgtaattgtagcaatgattattgcaactaaagaagtgttgctcgtatatgtctgagtcagtgacttagcatctttcattgataatttatttaatttgtccttggccatcttatgaagaatataaacggacattgcactttggggatcaactttgaataaaagcatcaacacttcattctgcatatattaaaagagaggaacaaatgactaaatgtgattggtgtaacataataggaaagccttgatatctgtgcctttcgagtataagtatcagcaaaacatgaaacacctttgtaatttttctatgggaaaagtgggcttgtaaagtcatttagaactcaacacgtggtgcaaagaaaaacctatttgtatgcacctacaaatagagtgccatgcatagctaatttgtgaccataggtattatgggacacccttggctctcagtgaagcctcgagagcaggaaatcatggatctttgggtgatgggattgggcttattgagatgctgataattgcatggcttggcaaatgcccatccaatggcttggttcgaggacttttcaggtgtcatgggtaaccctgtattggctttggaagaccttgtcacgaacatctctttattgtcatatatcttgcaaacacaggctagatgattgaaataagtttgtgtcatgggctcatggggtaaatcccacatcttctataggggttatctaatttgtccaaaaaaaaaagcattgtccatggtcatgcatcaaagtaaggtggttcctccggtgacgcatagtcttgtttgcaaaggtttcgaaaagttatgtgttaggtattaggtaatatctatctatctattatatactaaaagtccattaagcatcctataaacgttccgaagccgccacgtggcgcttctacaagcgttcctagaccgccatgtggcattctacaatcccaccatctattttcatttaaattggtggacccattattttacaccgtcggattagatctatttaaaaagtttatgctttctatatccgagcaatttaccggaaatactatatacatcaaaataattacgtactatggaaatacttacatatgtgtacgtatgaaagtacttacatacgtatatgaatatttaggtactgtaaattaaaaaaacaaacaaagaacgtacgtgtgtacgataaaaaaaaacctaaaaaaactgcaattttgtcatgatgtaattaggacccaaaaacttatattttcttcgtatcatgcatgagatgaatatgtttaaaatgcctcttgcgtctctatatgcgactgtgatcctatattttaattaaattataatgctgaattttagttattggtactaattggctataccttaaagttaatttctaccacaagtccctaggtggtctgattttaaaacacttttttttgttccaaaattcctgttagaaatacaagatacatctttatttggttcgaaaattcatatgcatgaagtttatattactaaactttgatttcagaaaaaaagaaagtgagttcaaatagatcatcttgttttatgtgtttctgtttgtgatgtgtagataataacactcctattattgagttgttagtggcactatagttacattcggtggttactgaaaatctgttctaaatatcattgtccagcatctctattatgttttctcgatgattctgacattttgagctaataaaataagaaatatcgctaagtacagttctttgaatagttcagattaaactggttcttttgtttaggaacttttgagatcaatccaaatatcagactgggagcacttgctaattctaatcacattgtctgttcagttctcacctgacactacgcttttcttcttggttaaactaatctgtcctctacttttgttcccttattagttattacacatgcaagcaactgcagcagcaagagtaagagccgattatccgggcaaaagctatagaagacaagggagcttgcaggaagacaagaaaaaatgctacatgagaggacaaggtttgagagagcaacattattggtcccatcgtttcgattatttgtggaataagccaaatggtatatttgcaaacgaaaaataatttgcgaataaaatttttatatatgtgttactagcgatctaaaaataaaggataaaaactaaacttcgataataaaaccctaaaatcagctccaactttaaggttgaaaatttaaattttggttgataagctaagtataagtgaaaattcaattttttttccagaattctcatagcttgaagaattgcaatgagggaatgaatgagcaagtggaaaatgaggtctgttgttttatgatgttgttagccttttcaaaatgtgatcaaacgtatcacttagttacaatatctgtcacatgtgattcagttcctttggcttaatttcagctgttgtatatatgttcattttctccaacaatctcccaaatattatctttgcagtgaattgatgtataaaagtgatcgctgaactgctggtgtatacataaatcttgatggaggaaacaagtcaacaaccatgaatctaggttcttgtcattaactacacatctatctatctatctatctatctattaattaattttaattatatactaaaagtctattaaacttcctacaaacgctctcaaaccgccacgtggaatttctataattgctcctaagctgccacgtggcgcaacaaaagaaggcgaggacccacatctgcagcgcatgtatctgtggataaaacagatcgatctctaccattagatctaaacaaattcccaaaacaaaagaaattctgaaatcccctccgagaccccacacatacacatgcgacattgcgacatacggacgccgcttttattctccagcttttttttcctacggtaattaaaagatacccctatttggtaacaaagttttgatctaacaaaaaaaaaaccgaaatcctttccatgggctcccgcatgcatgtacgcatgcatgccttttcttccctgcttttttttttctattgcagttaaaaaatatttactgcacttttatttatggtaaaagaatttctgcatgttccatattgatgtctcacacacaaattgttcttcgtgggttttataaacaaataagcaaagtttaaatgattataaattatatacccaatatatgatcggtttaaaccattgtatattttaagcaaattaataatttatgattcattcatattgactattttcaatgctaaaaatttattacatgttggaaccacctatcatcttgaggcctcaaccgagttaaaggaaatcttaaaaatctcattgaaatcaaatgccaaaccttaattatttttgtcacttacggttagacatctaataggttttttacgaacataattattttatctctaaatgtgtgggggaaactataacctatacgcatggatcatcatgcttttataaataagcaatcataaaatgatcatagcatctaatacaatacgtgaagtctctaataattagaggggaaaaatcttagaatgatctcattttttttacatcataacgtgttccttatcaggagcctatttttcatagacaacaaatttaaaatacaattatggacatttggcatcatgatgggtcgtaggaagcacgtgtgtttcaagaagggattatggtagtgaaacagctatgtggtgccattagtgatcacttaaatttttgtatataccatacgatacttcagaatatgaatatgtgataggagattccggtttggttttaatttattactacctcagttctcaaacagatgcagctaaacctcggaatattaaatcattagcaaataaaaaatagggtttgatatggaaaaaatgatattaacagaatgttactacctccgttctcatatatgtgttatcctagaaagcgtgcagtaaaatatcaaaatcttcattaataaaaatatattatgcttatatggaaaaataatattgataatttttttatgaaaaatgcttttatacagttatatttttattgtttttgaaatatatagctaaaaaataaatgatgtaattaataatggaacatgtatattggagactattgttgtccaaaacagagaacagagaaagtaaaagacagttcatataatatttttggctcaattttggtggtagggttaggacgtctttagcctctactgagttgtacactcaacacaattttgttttcttcccaaattttagagatcaaaagcatttcaaggatgattgatataacataaatctccaatattccatacgagatggaaaggaaaactggaatttcaataaaaattgggctaaacttaaacaaattttgttgaatccaaaggccgatataaattgcagaaatagaaaaaaacacttctgcaggaacaatgtaattggaatatgtgatttttgtaaagaaaatcttacaaaatattgtatttcaaatatttttggttaaatttcaacaactcttctaaaagaactatgtggatttcttaaagtatagatgtccaaaacgaagatttgctaagtattccaataaaaacacatattgtaaaaatattagttcataggagttaactctattgttgtggcacaatattttcctataattcaagatttcacggttttaagtaattttagtttagaatttatatgttgcgagggtaattagaagaaaatcataaccaacattcaaaatagtcacaaatgatttattgggaaaaaggttgataacggaatacaaatgttttagaaaaaatgactcatatttttcaagcaacattaaataaaatgctcgcgcatatgcgcgggcttgcttcctagttacctttaaagaaaaatcttcggtgtgggttccaaactgacagtagtttcaacaaatatatataaagagtgaatttcagaaaaccccatgttttgaggccaatgtaacacataactacatgttctatttattttctcatataacccagtgcattcaatccaattaacacagtaccataggtttaagtgtgggaaagtgttacaatggcaagtgacatggcagacctactccacatcagctggccccacctgccagatcaatgcgtgggctatttagggcgggatcatgcggaagaacagaactgcacgttccctgttgccacgcacacacggccggcgacggcattccccaaccatctctcgcatgatggcctccggtgatgatcgtgctattgacctagctggaggaagagtagaggaagagaactcgttggctaccaagattagggagatggatagaatcaacaatattcctagcagttaacatccatccattttcttaagatgatcatctgaatcgactccaaagtatgctggttggtgattcgcaaggacacactgcttcatagttgatgaggaattaaatctagctttttgatcatgtttgtcttgtcaagaaattagggctaataaaatgtgaagaacatgtgaagaactcaggttttatataccattctctggcatacaggtgcattctcacaaagcgaccatcctatttttcccaagcagtcacttaagcaagaacgatcaacagtacaagtatcataacattggacaccaacaaaatttgttgttttatctgtagtgatagcgccatcctttcaaattgatcgctccttttcgtctccactctccagagcctgcaacatggtgatgtccttgttcctctctccgtcagctatcatcctctccttgtgcagttcataccattgattcacttaagcttcatttcgatttcttgcacagtcaacagcgtgtcgttcaatctcaattgtgttgagatctcttgcagccactgcccacaaaatcacattcatcgtcatcctgcaacaagaaaaaaaatgccaactgaaacataaataagaaaaactagtgagaaagaaattgagtcagcaatccaactcatatggggcacccaatggattgtctcccagcatctgaaccttcccaggccatccttctcactggctcaacataattgaaatatcatgcaattttattttgcattgacaaaaatcgcaaattcccaagttactgaaaccctacaaacataaattgattaaaattgcagaaaagcagagttggagatgcttgcctttgcctgtgcacgacgacctgcccctctgaacttgtaagaggacgatttggtggaacactgccgcagtgagcatgaggaagacgaggggtgcatcgtcgcgtgcgtgggaacagaggatgggtgcttccgttctcccgcgtgatcccgccctaaatagcccacgcattgatctggcgggtggggctagctgatatggagcaggtctgccatgtcacttgccattgttgcactttcccacacttaaacctgtggtattgtgttaattggattgattgcactgggttatgtgagaaaataaatagaacctgtggttatgtgttacattggcctcaaaacatgggtttttttgaaatttactcatatataaatgatgtgggaagttataaatcctactccaaattgctattatttaaccatgacaacttgattttaagcaaatttaagaacagagaatactgcaaaacaatctactcaaatttgtgatgtacgaccattttaaaattttatttgcaggttgaaatgacctattgctactgtaacgccccaggtagccacgtacctagagtgccacactaaaaaaacattcaaaaccactaactcccgaaattattagaaatttcggcagagtctctcctaaaaatacggacatccacgacacgtagttataagatagatcaataaagaattaaccaaccattgctaaccatcctagctccataaattccacgtgaaaataaagactagaactttaaatgaccgttacaagttctacgcaaaacttatgctaaacagaaacatagtctaaaactaaatttcaatagtgtgcaataataatgtgtagttcaagagtgctactcctgtcccatgccgatcaatatcattaggtacctaaaaaccaaattaaacacaagagtgagtaaagaatactcagcgagtacaatattgaactagtaaaacatacacaggtttaatgcaataagaaaaccaatatgaaacatttgacttcctttaatttaaaacgaaagaggcaaaaagtagtagttctctccgggcaggtgtgaatatcctcttagcattaccggtaagccgagcaagcgtgatcatcgcttctcaaggatcatgaataaagatccaaattgcactcccatgactacgcatggtacttgaataatgtaaacaaaaatttccggaagaatgaaacatgaataacgtcgtgaacttgaacatgaagtgaaatatgaatatgtagcataataccaaaaccacataattgataatacgaagcttcgaataataattgggtaaatgaaaccaacaaagcaacacggtttatccatcacacaagtccatcttgtacttgccttaacttcttcgataatccaactcaactcctccaacgttggaaccctccacacctgtggagaaaaactacgcataaaccactatatctaatgatagttacaagggacatttactaaaatcgaaacctagaatatataaaaaattttaccgatttatattaaataacctatagctgttcccttactgttttatgcgtaactcacaaaccgtctaacgaaatctatcaaataatataacttcggacatctatacaaaattgtctacaactttcatgttgggcgaaaattccgattatgcctctgcaaatcccagattaaggaaaacgaattgctgtcctgatttccggatccggtcagcagtactgtttctgttgtttctcctaaaccatttatcggaatcaagggaaaccagcggcgttagaaagatatcgacaatggctacaaactttatttagaacaactaacctgaatcccgacggtttaatatcagatttgaaaatacggtttcagcctataatcaataacctcgaaaattgcacaaacgactatcgaataaatttctatttgaatcaaatacttctagagagtagccaaaagtaccgctgcagtgtggatactagaatctgagaacaaacctgctagttgcaaaatcaccgaaatccccaaattccttcttcctcctgctctcctgcgcccttctcctccctaacagcagcagtcagcagcagtcgtcatcagcagaagcagtcagcaccagcagcgatatgaagagaccagatcgcagcacatcaaggcatcaagccatgcattagcagcagcggcaattaaaagatcggatcggcagcagcaacaacaggaatttggcagcagtagctcagcaagaggcagccgagcagggaatcgattggcggcggcggacgacgacggctgtggcgacgccgtcaccagcagcggcggtgcagaggcagggttggggaggacgacgggctagggctagctgctggtgtccttttcttcttgttttttttttcgttggttaaatagagagccgagagcctaatcaatatcgaacgacccatattaatttgatcacctggatttcgttcggactccgattacaataaatttatagtctattttgcactactcggcgagctctacgcattcacggttcctgattgcctattcgaataacagtttaaaagttaaaattttgcgcgtttgttctaatattctccgaaatatactaattcgaaattcggggtattacagctaccccatgaagtcacgagcctccataatttattagcttgaatatcagatactggaattgaaaaattaccagaaaatttcgtttaatggtcaatatagggagttcttaaatgggtatcatagtagtgcaaagcacgactacatggctagtatttctcgaatgggtctaacgaattaactgacgaaatagggtggtatctaagccttggtggttccaaaaggttgattaatgataatttaactaatgactaggaaattttaacgaaacagattttcttctaaaatttccttttgaaactttgctaaaactcttacgaggcttgctatagctgaagtaattgcattttccatcatgtctttcactaaacctcctttcaactatataaaaccaaatatatgttcctatcagccaaacacgttaacaataacaagaagagaaaattccatgtgtacccctgaaagttcgctcaatcccttctatacccctgagattttctcattcccttccatacccctaaatttcagtttggatcttttctataccccttccatcagttgaccgttaaattcatatcataaagtccattttaacatttggtataaaaaaatataaatttatgaattatattgatggagtttataaatttattgtataagtttattttgtgagatattacttaacaaaaataatttttatctcgcataacaagatttatcttataaaaaattttgtactactataacaaaatatgctatatatacagtttttaatggtaattttttttgttttatctaaaataaattttgtcatagataaaaattatttttgttttcccttcacgaggtaaaactaaaatattacttttgttaaaaatatctcacaaaataaactcataaatgtaatagtcgcatacaataaatttacacaccccatcaatatacttcataaatttatattttttttataccaaagggttgtcatagataaaaattatttttgttttctcttcgcgaggcaaaactaaaatattacatttgttagataatatctcacaaaataaactcatacatataatagtcgcatacaataaatttatacacttcatcaatatacttcataaatttatattttcttgatagtaaagggcaaaatggactttatgatagaaatttaacggtcaactaatgaaggggtatagaagggatccaatttgaaatttagaggtatgaaagggaataagcaaatctcaggggcatagaagggattgggtgaagtttcaagagtacacaggaaattttctctaacaggaaggtaaacaatagttcattaaaatggacttgatgtacgtacaagcaaggtttagtttggatgaacgcagtttatgtttcactcataatcccaaaattaggaacataatatcaacatctaagcatcacaacacgttacatgtgcatattgctttgagaactaaagagaacagaaaatatccagcaccaaacatgtcaaactagctaggaatgccaatatctacccatgcctacctccctcggtgtgcccacgggcatgcctgtttaccagccaccacaagtagtgagacaatgttgaaaaaagaagtctgcaagcattataagttcaatacacatgtacgtagcatatataattgagttgtaaagtcatcaacaacaagcccctaattacaaatattaagtcttcggaccattggaccttacatccacaacacatcacaaatataacaggatgccacactagtggtatggtctgacaatcagaccatatcaaggagatcagagttataagttttacccaaccgaaatctgagcttcaagactggccattcaccaataaccttagttattgccggcaataaaactgatagcaaacaaattccaatagccagccatagcaatcgtggggctaatacggtgtataaaccagttgcaaatgccacagtagttgccatgtatgcaaaccacatgagcttcttagtgaaggacctataatgaagcaagaactgaagatcctcccaccttgctatgatgcaaatgaaggcgacaacaagtgaggaacacattgccaatgtgtctgcaatcaagaatgactgaaatacgaattttcttgccatgatgggaaatcccaagtttccagcatcgctgctataccctccaggtaaggtgaatgcagcagcaaatgtaattgtagcaatcagtattgcaactaaagaagtgttgcttgtatatgtctgagttagtgacttagcatctttcattgatgatttatttaatttgtccttggcatccttatgaagattataaatggatgttgcgttttggggatcagcttccaacataagcattgacacttcattctgcattgattaaaagagaggtacaaatgactaaatgtgattggtataacataataaaaagccttgatatcctacctttcgggtataagtattagcaaaacatgaaacacctttgtaatttttctttgggaaaagtgagcttgtaaagtcgtttagaactcaacacgtggtgcaaagaaaaacctatttatatgcacctacaaatagcgcactatgcatagctaatttgcgaccataggtattatgggacacctttgcgaccataggtattatgggacacctttggctcttagtaaagcctcgagagccgaaaatcatgaatctttgggtgatgggattgggcttattgggatgctgttagcatggcttggccaatgcccgtccaatggcttggtcggaggacttttcaggtgtcatgggtaacccctgtattggctttagaagaccttgtcacgaacgtctctttattgtcgtatatcttgcaaacacgggttacatgattgaaataagttagtgtcatggggtacatcccatatcctctataggggttatctaatttaaccaaacaaccatcgcccatggtcatgcatgaaagtaaggtggttcctcctgtgatgcatagtcttgtttgcaaaggttttgaaaagttatgtgttaggtaatatttatagaaatagcttatggcttagatcgataacttgatagtcaaatacatgtacgtgcaacttgacatatctgtgggcaccatagatgggcttcctgatggaaatgttgtgttgccatgcctgacggtggtggacttttggagcatgttaaactgatgcagctctgggagactgggagccagtaattctagtaggatctttttttttttttgcggggaattctagtaggatctagaagcgtaacaacgaacaaatgactctaaatacgacttaggttaatacgtgagttgttgcaatacaacttagaatatgtcgatatgaaaagttgacagagcacgtacacatatagcagtttcaaaatcatttcaaataatagatttgcagaacaatataatctctcttaaaattaagcttgtataatatgcactgttccatagcttgtttagtacaaaagtagtcaatctacatctcatcaaaatccaggatggtcaacagaatccaggaacgtgaaaaaagaacaaaggaaaactagagttttatcttagccccgtgctgttggatgtggttttgggtgtgagatgtgcagattctattagccaatgttcggtagaggttatgagctgagctaatcagctagtgaaacaaggcaggttattaatgcatgattaattaattaagtattacaaatctgaaaaaaagatttagtgttttttgaaaaaaaaaacttctataaagaaagccttttaaaaatcagtagcagttcagcaaaatgtgtttattgaaaatggtaaagtagttcagcttacaagccaaaacaaatagtgacttgtatgcatacatacacgcacatgtacaaatggtgacttatatgcatacatacacgcacatgtgcagttatgcttactgagaattccttgtatacgccaagtcgaccattagatctttttacttgtacataagtgccagctaaaaagaataattgataacaaatttagaaacagaaaattgaattttgattatattcggaacaaatttaaagggtaatttctttttttttcctctccgatggatatctctttaaatttgcttcaagttgataaaaaatatattttggtttataagggaggaaaatagaaaaaaatggtgatttgtataatctctctctatgaaacttgagcaaatttggttgcaattatttgaaaattttatattttggtcttcaaaattagtcaaacaattttgtcccttaaaattttttataagtgaaaatttcaatttcatatataattaggagtttgtaggaagctagcacttgcggcgataaaaacatgatggtctaagttataggttatatatggtaaattaatggaataggtgtagaagagataaaaattcggtggtacatacagtggatatggcaaactcgagggcataaaacgaattttatgtaagaactcgacaggagaagagaagcatacgaaaatgtctctactaactatgcactcatcaacaaggaaaaacaaaatttagtacgcaaaaaggggtggtggattatattaactaggaagaaagcccgcgcagatgcgcgggaatcttgttaattgtttttgtaaaaagaatatgaaaaaagtcaccgttaccatttctacttaaatgattggaacatttctcaaatttaaataaaaacactttcaccaagtaacatatagatcactactactaattatgttttaaaagctaatatagatgaaactgcatatgcaccaataaaataagcataatacatcattaatacactataatatctactacctgggtttcatgtctcacttatttctaaattcacatataaatatggtaaaaataccgttacttctatccattaatgggatagcgcaattaaaattaaacataaatgctactctaatggataaaaccaatcgtagctgctaagactttctttctccgttgccttgaaatatgggtcatgcattgatatagccgtgttcctcaagatcagcttggagcacaattttaatctctaattcatgatcgcatgctcatgaagtattgcatggaaaagtacgaagttgagtacaattagtcagtggcggacccaggattttgctaagcccggggccaaatcttattgccaccgcacacaatgatacaataatagatgctacattgctagtttgctactaatactaatgcacgatcaaaatgtatggtacaaatttagttgcggtgcgaaaaagaagtacaaatacattttcaaataccttgctacgtgttatcttcctcggagtctatatcatcctcattgaattcttcaattgtagctccagatcttgatcctattggaaaaagaatcacatattacatccatggattgagaaaatgagaatcaaagttaacagtacacaaatttcagaacaagaataagacataccactagggagaggtagcttcatctttctggttctcaattcttgaaaatgagttaatatcttatcattatcaatgcttgcaaatatgtctctctcaatatagcagaccacgcgatgattgagccattcatcagccattttattccgcaactcagttttgatgatattcatagctgaaaaagccctttcaactgttgctgttgccaccggcaaaatcaaagccaattcaatgagccgataaaccaaaggaaaaactgtatgtctatcactctgaaccatcttcattgcaagattaccaaggtcactgcaacttaggaaatgtgggtctgctctcacatcagctataaatgtctcaagttggtcctttaggactatgcaatcatatggagagaagtcggcagcatacattctagcaagctcaattaacttatcttcatcaaaattggcaaaagaattcctaggatcaagacaagcaatgcatctcaataactgggtagatctctcagcaaaccgattgtttaactccacaataagctggtcatgtaccacattaaagatttcattattgaaatgatgttggtaagttatcaattgacctccacgaccccttgaacgacccctagtagtagttgtatctgacatatctggcacaatgatgttatacttgagacaaaatgtctttgtctcttcaaagagttcttgccaaccatgctgccttatgtggttaattttttgcaatgtggtcccaatcaatcctatagcacgaataatattttggtctttcttttgcaagcattgtgacagatcattagttttacccaatagtctaatcattaggtgcatgataagcacaaattcaaagctctccatctgttttagcaaacctgtagcagttatttttgtagtggggttatcctcacatatattttctaatacctctaggactgctttccacatgtgctgcaaacgacacaaggttttgtgatgtgaaccccaccgagtatccccaggtcttgcaaggttagttgcttggtttttccctcttcctgaaaatatctccccagtctctaaactactcacaagattatcatggtgttcttgggccagctgatcatgtctcttacaagaaccattgacagtgttaacaatcatgggggtatagttaaagaaatctgagacaggagaacaacattttgcaacagacacaaccactagctgcaactgatgggcaaaacaatgaatataaaaggcataggggttttcatccaatacccgtctttgcagcccatgaaattcacctctcatgtttgatgcgccatcatatccttgccctctcactttatgcatagataaaccatgactaacaatcatggcatccaaagctattttcagtgcaactgatgttgtatcaggaacatgttcaaccccaagaaatctctcaatcacctgccctttgctgttgatgtacctatgtgacataacatagaataataccattgttaatatggtcagtttcaaaatataagaacaaggaaaatgcaaaagacagcaactaacctcaaaataacagccatttgctctttaatagatgcatctcgagactcatcaacaagaatggcgaaatttctctcaccaatatcctttagaatggctttagttgtcttatttgcacaagccttgcacaaatgcttttgtatttttggtgaagtcaatagatgattcccaggagaatttccaagtaatttttgggcatctttatccttctccttgtaccattctatcatctctagaaagttccccttattgctagatccatgagattcatcatgaccacgaaaagcaagtgcttgcaataaaagaaatctcacaacacccaatatcatagttatacgaccataatattgttgctctaacttcttagatccactatccatcttatatgatacactttgcctttgatttttgaaatcctcacaatgttttctagctctattatgaaaactatctactttaccaacatgttcattaaaagatccagttgcatgtttccaattagtaaagcccttacttgtgaaagcatcaacaccaaaattatcaggtcttggttgcttgaaaagataacaataaaaacagaatgctgcatctttggcaatactatactccaaccaattatgcattttgaaccacgagtcatgaaagcttctttgtcgatttcccattaacttctgtggatatttatgaccaattggttggcatggacctcttgacaagtattcccttctaacagcatctctaatgtctatatgaaattgctcaattggttttctaagcccaggatcagcaactatgtcagccggattaagctcaactgtctctgaattgtgaggttcttgttctggttgtggaatattactccccactgtctcaacaatactaggggctgcctcacaagtactaggggcatgttgaacttgaatgttactagctctagctccagtttctcctatggctgcctcaacaacagctgctgcttgctgagtattactacctccggttcccgctgtttgtggaggatttgggtctaaattggattggggtgttgctggggcataaaaagatttcaatgtagtcctaggcctcttcatcttctgatctctattgcaagttaaataaattgattggaatcaatagatctatagacactgcagtattttaggcacttagccacttaggcatttgagaaaagaagtaaagaacaaattgacagaagaaaatagagatggaaaacttacccccgtacttgctgctccgctcatgagcacaaagccgcgccttggcccttggcccttgggggttgtcggctcgttgccgaccgccggtcccagtgatggcgcactggtgctgtccgcctgtccgccagggagccggatgaggagaggagttgaggctgaggagtgaggaggcagcaaggcagaggcaggtagggagcgaccgagcgagccgaggagacggcgtgccaggcgggcggcggcgccggcgtgctgtcgtgctgggtaggaccgtaggagcgagcctcgagcaagaaggcgtcgcgccacgccgccgctctcccatctctgtctctcgcttctaaggaactgaggaggggagttagggttaggttgatttagtgggccttgggccaaaatttcagaggtatatctaggtggggggtccattactacacggcccacgacctggtccgcggcccaggttgccccaggcctgggtccacccctgagagacgctaaaactttactgatctgaattcagaacgtgacacacctaaaggagcaggactctcacatatcagttggattttatgtagcagacgatagcctagaaaactttgagctgaaatgagcatttcaggtagtgaattgcaacctgcactattgaagtattgagactaaggaatgttgacctgtttcacatggttagttagcaaacttacagcagcaagtttaaaatgtgacaaactaaaggaaaatggtataagatggaaatgtcagataagatatgaacaaataatatttcaatggaaggtagcgtctagtgagacacatacttatgtgaacctaattaatggtccgtaaacatatgatgtataaaatgagcattataaaagcaaacagagtctgcattagttaaacagatcgagattatggttggaacaacagatacctattagtgttatcttacatttgaacccaatatcttggaagcaaggcagtaacatgagctatatatgcacagcagagagacaattaagaaggatttgagcaaatttccatagagcagaaaatgattcactcgttgcaacaatttgtctcaaggacatgaatataagaatgttagatctctatcataccttgggtacaatctggtcagaaatctgcatactataaagacatttgcccacttaaattaaataaataccttcagatattaggagaaaaacaattgtgtatgcagaagtataaaattgtgctaaaagcagcaaataccacccataagaacgtaccagcaaatcgcatcatatcatcaaccaaaaaatattgttcttcttaccactttcttaccggataactgaaacatttggtccacatctaagatcagatatgccataggccaggcctggtgactacatggtgcagtactttacaaaataatatcattgatcttgcattggccaccgatgagcaagaagaaaaaggcaagattgggatccatggtgcatggtgatgccgcagacgaacattggagagagagaggtaaggactcaaggtccttgaagtactccattatcatgtcttggcaataaatctgatgatagaggtcagagaagagtggcatcgagtgaggggggttaaaagaagataaagtgcaggagcgtcgagttgaatgctccttccatttgtagaagtggaggaggcagggcatgcgccatcagtttcacgcgagggagatggaatggggaaggtgaaacgaattagcgaaagattgggtggaagcgaggaagggaaacagccctgacggtcagggggagggtgggtgggtggggagggggggtgggtcatggggagggatgggggaagcgctacgcggcgacgatgctgggcccgcggctggctcgcgctaggaatgagaggagacgcgatcgtggccggctagcgggcccacgctggcgcgcgtgatgggggagaccaggagaggaagcgagggtgtcggcggagggccgcgtctggcacacgcgcgatggggagaggaagcagcgcgcgatggaggaggcgaagcgggacgcggcgtgaatgcggtggaggggcggcggcgcgagatgcgggagaggagcgatgcgcgcgtggggccggcgaagccgagatgcgggagaggagaggaggggagcgatgcggggaggggaggggagcgatgcgggatgcgcgtggggccggcgccgcagcgagatgcgggaggggagaggagaggagcgatgcggaggaagggctcgatgcgaatctaacggtggggacaaaaaggggtgacgtggaagcaccaggaagcagagaattgtagtagtggggatgatttgtataggtatataggatttgtttgagattaagattctcaaagcattttttggatattttcagaactatttgattggtatttaagaagtaggcagcatacatgatacatagatatgaaaaaaaatatcaacaatatttccagccaatgattttgctacaatccatcaatagatttatggtcacatatttttgtctttgccatgattttgaacaatgaagtaacatgctaataaactactcatgtcatattttcttatacttaaggaatttcactatgtcaggcataattgatagatatatgccataaacttgattgacgtgactataagtgtactccaatggattagttagtatatataaatttgggaaaaataaatgcattcttcaaattagtaaaattgcctcatgtcactatgaacaataggagtggaaaacaaactaaacgctaaattatatatatttgtcaaaatataaacaataatatggtgttctcgatattatcaaggtgctatgtatctttagctataatttttttaagtatcatgaaatgattaacctcactcattttcaaaagagagtattttatctaaatgataaaatttgagtagtaatgatgaacaccaaaaacaaactgtgtgtacactgtaccacaaatgtacttaaaaacataaaaaaaaactatcttgatatactccatcttctcttgtcctattctaaagggcatcaagggaacatatgactaagttaaggtggccacggtatatgccaccatcactaattgcaggggcggacccaggcctggggcaacctgggccgcgaaccaggtcgtgggccgtgtagtaatggaccccccacctagatatacctctgaaattttggcccaaggcccactaaatcaacctaacccta

SEQ ID NO: 66978 - DNA, 8587 bp, Oryza sativa
aaatgcctgctttatgcaaataaacctttagcctcctttggatatatcttgcatcataccttctcttctggtatgacttgctgagtgcagtggatagtactcaatcttgctctctcttccccacaccagagctgaagttcttctcagttgggctgtctcagagaagttggtttcgttgccgccgtcaagaatgcctgtggaatggagtcgcctcgctgcaggagtcaagtcttcaagcttagctcgtttttatctttctgttgcatttgtaaatcttttatatgtttgtaagacgtggatctgtatgtcaaaaattgtcgcttgtgtaccctagctggtcctggataggggttttaatgtacattcagcttagaaattctggttcgtgaatttatgggcgtgacagtagcgaagtatctgctaaggtttagttgtttgctagtcattgctagagttgggtagcatgatgactgagtttggtatcttctctagccggtgtccacgaatagcatatcggctagaggaataggaggttggtgcaagtttagcgaggcgaaagtattacttcacaatcgtgggtggcgacggagcgactaggatcgcacagagcccgagagttaactgtgtggcgtgttgtggaggtcaagggaatagtgaagctccgaccactgtacacatcaaggcgtggggtgccaggagcagcacttcgaccttgggtttggttctgctggattttacaaccaacggtccgacgtggggcccgtagaccgcacgaacatccccatggaaggcgtaaagttccaaccggcggctttttagtggctaataggtattttgggataaaataaaatatttgaaaataaaatataagtttaaattggaaattcaaatataggagtaaatcaaatataaactcaaatggtatttaaataaattaagaaaattcaaataaaatattaaaatactaaatttggtatcaaaatgtagagtttgaatttatatgaatttaggtataagtttcactataatcggatctacactttaggagatatgggcttctaaagaataggatttgaattaaataaggaaaatacgaaaagttactgtgtaggggcccacctgtcagtatagatggccatgtgggcagcttgtcgggccggcacggtccgaccgacgcaccgggctgtgccgtgccaacccacgtgccgcactcacggcccaggcatggcccaacacgactcgggccgtgccgggccggcccaaaggtagagatggcccatcgtgcttttcctcagaataagtctattttatgtctctcttctttgggctgtgatatataaatagctaaataagtctatttaaggtccctattctttggacatcgacatctctaatactaccaattgcagggttcaggatcaagtttttcattgggccacatgccaacttataaatttcgttagggcccatctgaaaatctgccacgtgtccccttctctgattctaggatttgctccgacgcatcaaagccttcaaaggtagagatggtgcaaaggacctaactgtaaattttgctattcaaagggagttgaatgcaaaaggtacgatccctatcttccacatgattcgttccccctcctgaaacatcaagagcctcatgctaagatcatcagatcgatataaatcaggtcatgtgtgaaaaaaaaatagcatatctaccctaaatccacattgagaaaactaaaaaaaaatctaagaagattaaaaagcacggcagaagtaattggtgaaaaaaattgaacacaatctccttgcatattgcttgacttcttcagttctttgatatcagctttctataacgccgatcagaattgggaaaaaaaacaaggaaagcaaaaaaccaggaaaaacaatttaagcaatacatctccaaggagtacttcccaactatctgctcccttaggcaaggaaaaaaaatctgttgctccgtcctattcgattgaatatacatccaggattgtgaaggagaaaaaaagaaagaaaaaatatcagatgcccaaaaaagaaaaatcagtaccggtggttagctagacggatgaactagagcttgaccggctgccaacaacgagctatagctcagctcactttctctgtttcctctcagatgcggccagccacctaccgtcggccgtcacctccctaatccctatccacgccggattaggcccgctatggctagcggttgcacagcaccgaatctagcggacgaacatgtcgtggcccatgtgagcaacaggaataggggatcatggaggattggtggcgacggaatccgcagtgcgccaacgacggggaatgagcgagaataagactagttttattcttttctcctttttttcgactttcatctcggtgatttctctatgagctttatcagcatgggcaaaacgatatgggccaagagcccaaagagaggtaggttggatatggcagtagtactatgtgtgatttatttctaactcgatttgttcgccaagattttcaacatattgcaaaccccaacgctaggggggcttgggggaaaaaagattgtctaaaatacaatttcatttagaagaatctagaatacaatgggtctccttaacaattagaccaagtgaccagtccgactaggtagattagtcgtgctgtcctaaaacagcgtcaatataacttaatgctatttttctagattacacgacagagccacacatgtacacatcactatatacgcaaatacgcaataccacactgacaaattttgctataacttacaatcgtctaaattacatctaaaacaaaaatttagataaagaatcaattatccaaaatattaagttaattataactatcactgatcgattagtttgatgtatttgtgacatccgcatgcatagtgttactacatacccaccttgatcactacatatatgcatgtactgattaaccggccagcatgccatttggcctaattagaatactcaggagcatttgatatatttcccgtgttctctctttccgtccaacaccaaaactaatactccctccgtttctaaatatttggcaccgttaactttttaagaacatgtttgacctttcgtattattcaaaaacttttgtaaaatatgtaaaactatatgtctacataaaaatatatttaacaatgaatcaaatgaaatgaaaaaaattaataattacttaaattgtttgaataagacaaatggtcaaacatatttaaaaaagtcaacggcgtcaaatatttagaaatggagggagtaaaatagtgggatgatgtccagtagcaaggagccacattataacagtgtgtttctctaaataaatatttacttttacgctacaactaaaccacgaagtcgcaaaatccaataacagattttaccatatttggtgtttcagaaaagattaagtacacaaggataaaagataaatgtggcataaacaatatacataggaaatagaaaattgttagcatttcatgttcacattgtaaactatttaaatttatctcaagttaaacttctatagctttggctgacttcataaaaagaataataaaactacaacaccaaactaattgagttagatttatcatgaaatatgtctccatagtgcatttatttattattatagatattgctatacttttctataacttataagattaacttagaaaaaggattaatgaaaaggagcaatattgaacctatgctattataaatgttcggataaacactacacctactatttggtaacaccaaaaattagaaattaaaaatattattaattacatatatttttgtttatagacgtatatgggcgaaaaaatcaggggcgccaacaggcgcaccgattttctagtttatatgtctatttttagtctctatactttgtgtgccgggcctggccttccggcccgaccgtgccgggccagcccagcatgccggtggggaggcccaggcacggcccggcggtcaggccgggccggcatggacccgacccaagtcgagccatgccgtgcttgggccgagccaaaatgccgtgccgtgggccggtccttcgggcctcgggtcttatgtccatctatacttgtcagggaatattctattctttttatttttatttttcatccttcctctcgtcttctttcttctctgtttcgttcttcacaggtagagcagagggaggagaggagcggggcgccggtgctccggtggctgggtggttgcgacgccggcggccaaacgtgttcctgagggtggcgcacccaggaagggtggtggccggcagagagagtgtgggatgtggccggaacagtcggtagaggagctcagctctggcgacaaaaagaggtggtggtggtggcttgtttcggaggggggaaaggaggggaaaatggtgaaatgggctctcctcggcgaggcgaggctggtggtgagagggaattggaagagttgctatggaggaggagatcggccggtgactttgtggtagccggccatggtggagagagaagagagagctcgaggagcttagttgtggagagggatggcgagcttgctggccatttataggcggagagaggcggtggagtaagtcggctgcggaggagaacggcgaggagtacacggcgacggctgcgtggaggagaaggggacggcgcggcctcggcttccaattggtcggccatggcggcgcgtgtacgtggagactgccctagggttgggcggcggaggaagaggagcacaacacggtgatgccggaggtgcaactcagtgggcggcagtggatgtcacaccccgaagttctcctcccaagccaaatttaatttgtaaacaaccccaagaaaatgcaggtgcaaatcaagagaaaaccctaagaaagtaatgcaaataataatcggatttggcatgtggaatttttcttgagttctacatgtcgaaattcattaacaggatttttagtggaattttcagagctctagaaataattttaaccaattaaaattgagcaagcaatattttaattccagggaaaatcctttttcctttttctttttctttttcctctctttttcctcttttttccgaatgggccgccggcccattctctcctttcttccccctcctccttgttgggccagccgcaggccgaggcccatccaggccgtcccgcctccctcctctctcggggtcgccgacaggtggggcccacctgtcgggcccgtctccctcctccagccgacgccgcgcccgcaaccgccgcgcccgcaaccgccgccgcgtcgcctccgcctcctccgggccacgtcgaccacgcccgcgcgtgcgccgcgttccccgcgcccactcccctctctctcccgctcgcgcccgcgcccgagatggccgggattcgattttcgaatcccgcctctctctcctcccccacttctcccacgttggccggcgaaatcccgcctctcccggccacgtccggccctcccctcccctatttaagcttccccgtcactccctctcgctttttccttttctcgccgaactccctcgtgctctccatcgctcccgcgccgtgcaaccacccgccgccgccgtctccgctactccggccgccgctagccgccgctaggctcaccgccgcaccgcgccgtcgccgccgtcgggttcgcgtggccgagatccaccccgtccacccctcctccgtagagattcgccgccggagccccatccccgtcgtgcgctggtgagtgacgccatggccgccgccttcggccggcgccctcgctctctcgcactctcctctctccctctaacccctctccttttgttcgttaggaggttccgaagctcgtcccgccgtcgccatcgtcctccgtcgcccgccgtcgtcgaccgttgtcggtgaggcctctcctcctctttctctctctcccgcactgtttagccgtcgcgccgccgcttagccgcgtagctgccgcttcacctctagccgccgctctccgccgccggtcggtcgccgtcggccgccgtcttgcgccgctgccgcatgtgcgccgcgccgtcgcgcgccatggtcgccgggccggtttgcgccgtgcccgcgcgcaccggccgcgagctcccgccgccgtccgatctacccttgggtagatcggggccatcggttcggccgccgcgtggcgcgccgctcctccccggtccgtggacccgatccgccgtggaccgccctccccgagccgctgaccggtggggcccgcttgtcggcgcccttcctccctccccgagccgctgaccggtggggcccgcatgtcggcgccgcgccccgccttgatgacgtcagccctggaatatattgcgcaataaatgatttaaggtttttcttgtatagtaataaacacagtgaatcttctaaaattcataactaattcatccgagctccgtttaaacccattcaagtctcagtaaatcaagaaaaatgtgtagaatccattaaaaatggttttgttccctgtttcagtagtcttatagcctgtttgcaatgtttgctttgtatgtcactagattccgattcctccgacgctccggtgtacttcgaaatagtcgccgaggttcctccagcaacagagcaaggcaagtcatgcttgtcacttgaacatgttgatcctatattgcaaatgctctattgttttcgttcaaatactgcatcgttttataatgttactatgggttgtttacctattgtcatagccatgctattgttgtaccttgtttctttgtcaacttggggttataacatgattagagttaggactagggaatgcttagccatgcttagttcaactagtgcacaatggggaaaatcctattaatgtttagactgttggttctaatggtgttgttggattagtgacaccgctttggtgttggttaattaaaataaaccacatggtgggctgtgggtgcatggttttgctggtcgcacccatggcagttaaggaccggttcgcgggatgccctggaagaacttatcgtacttaccacaagccagcgtgggcaacggctgggcttgtagcgtagctttcctctagccgacgcatccaggcaagggtgagcgtgatggagtttggatgggccctgcgacggcctatgcggcttccggattcacctaggcacgtgaggggactgcccgctgccttgcgaggagtgggggtgaaacctgaggtgtggtgtgcttggttagagggggttatgcgaagggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccatgatttgtctcaccctagtgtaatcttttaaaattggatagtttaggtggatggttgggcctgtcgcaacgtgggttagcgttggacagtggatagctgatattgtttaattattacaactgtttaaatctttcaacttctgtttataaatgctcgctttatgcaaatgaaccactttagctcttctttgatgattccgtgcatcatacccctattccggtatgacttgctgagtacagtgggtagtactcagtcttgctctacttttcccaaccccagagttcgagtatgtgtcagatgaaggtttctccgaggagtaggcttcgtccgtgccgtcgaggatgcctgtggagtggtgttcccgctgcagttttagtcaaggcttagctcctgtgtctttcttttcttccgctgcatttgtgtaagacttttatgatgtttgtaagacgtggatctgaatgtcaacattgtcgtttgtgtaccccggctggtcctggacggggattttaatgcacattccgcttgaaattctattcgggaatttctgggcgtgacagtggagaacggcgggcggcggcgcaggccgtaggcaatagcagcggctgcgccatgcgcgtgcgccacgcgcgcccatggcgcacccccagagaggagagaaggcggcggctgctgctcagcttggctagctgggccggcttgggccgtgcgctaggtttgggccggggtagggaaaggaataagtttatctgaggtcccttaacttgtcatcgaatctgattttcatctttcaatcggaaaaccagatatcacgggtccctcaactattaaaaccggtgcagatgacgtacctcggcggtttagatggcgattttggctgacatggcgcttacgtggctaatttgactcggtcttcatttgtcgtggcattgacgtgacgcttacgtggcaatttgatccggaaaaataataaaacccttgggacccacatgtcagtttcacacacaaaataataaaaaggtgggacccacgtggtctccacatgttatcctctttcaacaagaagctgggaacgaaccccacgactgcaactatggatgtggcggtggcgggagca

SEQ ID NO: 66979 - DNA, 30977 bp, Oryza sativa
gtgtagctttcctctagccgacgtacccagacgagggtgggcgtgatggagttgggtcggccggggtgtccgattgatcggcttccggattcaccgcggcacgagataggggctgcccgttgcctgctagggacgggggcgaaccctgaggtgtggtgcgatcggttagagggtgttatgcgaagggtcctgtcacgacctctttccggtatgtcgtggtgtcatgtcggcgcacggaaacgtgtggtggggctgtgtcttgttggtacagttgtacacctctgatcagagtaaaactattcgaatagtcgtgcccgcggttatgggcggtcgaccagattcaccgtgattagtcccaccttaataaatcgactcaatgcactgtagttcaggtgggttggttgggcctgttcaacgtggtgtagcgttgatcagtggagatttaatgttactttaattactcaacagttttattattttgctcaataaaatgttttacaaccgcctttatgcaaatagccacaagccgtccttgtatccccttgcacgtctgcatcgttggtgtggcttgctgagtacggtggttgtactcagtcttgctattatttcccccttttcagaagtgtagtgcttctgagctgaagacgaagttagaagaccaaggctcagaccccagttgagttttgcctgtggagtggagctgaagccccgctaggatcgcccttttccgctgctgctgcttttgtttcggtgtgaggactaagtgcctcttctataagtattttatgctttatttacgtttggagctgtatattacttgtcgttttgtgtaccctggctggtcctggacaaggatttaatacacaaaatagtctggaaatttggactaaatttctgggcgtgacaaagtggtatcagaggcaacttgactgtaggttgagccaaatggtcaaaccctaaggacaagttttctgaaaaccctattcgcaaattgtctcctctcgcccttcggcatttctttgcgaaacagtttattaaaatttttcctccctgtccctccaactcttttagttgtcaaacatgtaggagaaaccgccagcttcatgcccgtccagaagtcaagtcgagtctcaagcttcgtgcaaggagcgggaagattagttcagagtcatcgttccgcgaagatcaagaagagttttcccgaagttcacctaaacctaatccttcccggaagagtagttcgttagattctagatcgtgtgttgtttgcttgtgtgtaggggtatggtttgcatcattggtggggatgcgactatactaggttgtttgcttaagcaacttgaacaataaaaatctattaacaacatatcagtaggcaagtggtttagtaccttatctttagcgacccctctcttccacctctcttccgtcctggcagcagatggtcagtgttagagataagatcaattaaagccacagatcaatggtttagttgaaagctgcaaggtgccccaatgccagatgaaacctgctcatgatcaacttttggtgtccaagatcagaagatgggtgtatcgatgtgggagatgcaggttcgacacctagtcaaatgtagcggaaataactccagcagtagtgtgttgcagtcagagtcagtggatcagttcaagacaacaagctaccagctaagtcagagcacctcgctctggttagccaagattggaagatggatgtgccagatattgatgtagcaaccgcagagtccaaagcagcagatgcaacgacaatgtctccaacaacaagtacaagctcagatgcaagccggaatcaggatcagagcgaaagtcagtttgttttccaagagcaagcacctgcaacctcagacagtacgccaccaagtctttagcagaccagcacagctaagtcacccccaatcccagaggcaacaagtgctacctatagtggttatggtttacaaggtcagttcttgcaaggttgttcaacggcaaggcgttagcgtcatcaagacaacagctctattcgcagcaccccagttcctcaagttgtgtcaattccaatgcgagtcggtcagtttagttttgagatatcaactacacaacccatttaggtggatgacaccgaagtcaggtcagaagaaggacagtcatgccagcagttattactgatgggatagtcagttaagagttagtaagatcaggagctaaatgagaatttctttatgtggaatttcctatcagcaactgagggttaagttccaaatcttaatgggatgaaagtgcatcgttgttactctattttgatcgatcggcgaagtttttagttttcaaagtcagggctcttcgcaaaacagagaagtgttggttatattcgaaggacaacagttcaaccgatctcagccacgcgaaagtaagactactccttgtaaggggggtaggtctcggagaagagttttgcctcacttcgtcgctgttttagttgaaggttcaaccagtgccgcaatcagggtagcacttgaagaagcatgttgcaaggtatcagaagaactaagccgatcccagggcatccgatgagcccagttcaacagcttagcttagaggagcaacagtgaggacagttgcagttcagacgaaagacaggtcaagcaggtttcctggaattacgtgtcactcgagtcagaacccgttcaagcggatgtaggatcaatgagttacaaatgccagatgcaagattcaggaacaactccatccttctctagccaacttggtgaactgtcaggttatcaaattgctagcatcaacggttcagtccaagataagtaagttccaggagcatccgcagttctggcctgggtcagttcaagcagaaccaatcagtccagttttggcaaagcaaaggaacagaaaggtcgaatccagccagttcaatcatgcaggtttgatcaaccagtcaatcaatcagttcgaagcagaatgtggcagttcaatgtgcagatcagtcagatcgcccaccagcactggctttctttctagccatcccagaatctcgggacgagattcctgcaagggggggagatttgtaacgccccgattttcgttcggcaataaaaatcaattaataatacattttctagaaattaaataaaagttaaatcaacttaatcaagtgaattattgagggaattaaaaatttcctttaaaaattattggccgggaatattttgtaatattctttgtgccctaatgtactctccggaattttccgtgaattttcggagctcgagaaatagttttaatagcacaaagatcattgcatcaattaaaataaaaagaaaacaattaaaatcccccttcctctctttgggccattttcggcccaagtcttccttcctctcccgcggcccgcgcgccttctccctctctcgggccggctcccctctcacttggcccgctcgcaaaagtctgttttgcgtccctccttctctcccttcgccgacaggtgggaccgacggtcccacccgtcagctcgtcctcctacctctcaccggccgaccccaaccgccattgccgtccacgtcgccgcaaaatccggcgccctcccgcacccgagctcgcatccaacgacgtgggcacgatcccctccacgtcctccaccatttcccccactctccccgcgaaaatcggcgccagttaacccctccaccaccccacgtcggcgccccacttcgccggccgattccgccacgtccggcctcgatcccgccttcccgagcccataaaaagcatccccgtgctcccctcgtccgtttccccatttttcccgagcccggcatactctccctcgctctccccacgccgcacccacgcgctgccacactccggcgaactccggtcgccgtttcccgccgccacagccgtcaccgcgccgagccgccgccaccgccagcttcgccaccgcaaggggaagtccggccgcctcttatttccccctctccacccctcgagcaccactcccaccgcacacccgaggccgccgcccctttcaccgcctccagccgcgcgccaccgccgccctagccgtcgccccaatgcgccaccactgccagtaccttcgccgcctcaaagtcaagctcggccgccgctcggttgtcgcctctcgccgcccgagcaccaacttcaccaccaacccgagatcgccgccgtgtttgtcgtctccatctgtgtcgccccgcctccccggtcgacgccggactgcgccgtttcctccctcggatcggcaactccgagccgcaccccggccaccgcttcctcgcctccgggaaccactgaaatcgccctctccgcgccccggtcgtcccggtcaccgtccgccgcctcgcgcccgtggtacgccaccggaccaccgttgcctccccgaggagcccgccgccggcttcctcgttgtagtctcgccgtcgccgcccttggtgagcatccctcctctcctccccgcgctgtcgccggccgtcgccgcgggtggccgcgccgccgcgcgccgtcgtttggccagccggctttgtgccgtgctgtgccccagccgcgccgcccctggccgcccgatcggtttgggccgatccgggccgtcggttcccgtggaccggcggtggaccgcctcggtggtcccggtccacggtggaccggcgcccttgtgccgctgaccggtggggcccgcttgccggcgccgcccctcccctttgatgacgtcagcaaccgtcttttcctttggaaaaataaataataattgcgtcataattcgttaataattatagaaattcatttaaatggctcaaaacttctaaaattcatatctaattcattcgaactccgaattgggccattcaaattgcaaaattcatctaaaattgagctctacatgtttgtttactttttatgtactgttttcttggtttttattagagtttttcctcgttttgcgtgtcagcgtgtagaatccgtcgtttcggaagtccgcggtcgcgaggaaaagagttcggaagatcaaagtgaagcagcaaggcaagtcacacattccccttgagcatgttgatcccaatttataaatgttttaccgtttacaaataaatatgcatgttttactaattacatgggatccgggtattacctatctgctcgcttgtgccatgtttacttgatatctgttctttgtcaaccttgggtaatgaatccactagctcatgttacttatgtgacctagctagaactatatgcttagccatgcttaattaccactagctcagttgatgggataattgcagtattagaccctttagtatcagagtgagctgcgtgctcgagacacccgtccatgcttcatggtcgtaattatccaactaaaatgcaactgaatagtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagctgacgcatccaggcaagggtgggcgtgatggagcggggtgggccctgcgacggcctctgtcgcttccggattcacctaggcacgagaggggactgcccgttgcccgctggggacgggggtgaaacctgaggtgtggtgtgcttggttagagggggttatgcgaagggtcctgtcacggcctctttccgatatgtcgtggtggcatgtcggcgcacggaaacgtgttgtggggctgtgtcttgtgggtacagttgtacacctctgatcagagtaaaactattcgaatagccgtgcccgcggttatgggcggtcgaccagattcaccgtgattagtcccatcttaataaatcgacccaatacactgtagtccaggtgggttggttgggcctgttcaacgtggtgtagcgttgatcagtggagatttaatgttactttaattactcaacagttttactgttttgctcaataaaatgttttacaaccgcctttatgcaaatagccacaaacccctccttgtatccccttgcacgtctgcatcgttggtgtggcttgctgagtacggtggttgtactcagtcttgctattattccccctttttcagaagtgtagtgcttctgagctgaagatggagttagaggaccaaggctcagaccccagttgagttttgcctgtggagtggagatgaagccccgctaggatcgcccttttccgctgctgctgctttcgtttcggtgcgaggactaagtgcctcttttgtaagtattttacgctttatttacgtttggaactgtatattacttgtcgttttgtgtaccctggctggtcctggacagtgatttaatacacaaaatagtctagaaatttggactaaatttctgggcgtgacagtattccaagggtatcgtatttatttaatcctgcgggaagattataacagagagaactatactaataatttatatattacttgtaataatcaaagtataagcaggggttaagattataaatagggtagaatgacacacagcaagagaattatatactctcataataaattatctaagctaagtgggaagagaatagaaagaatctattcttatacttctaatatagatacatattatacatatacatccaagttatatgattacttagctaataccctctttccaataccgtcctggtgcttcgagaagccacccctgattgccgagtttcttacaacaatccgtcatgaccatctaacctgggctaaatacggaggagtagcctccccaggaaagtaacttaggagtatatacacaagcggaggaatacccgtactgagctgtcaccatcagcggcccaccttgatgtattcgtagcatttaaccccaaataacgatatctagtaatctaaacaccacgcttaaattaccaaatactactctaatatcattgtcatgacacagagcaatcgtatgcacgatcattatacccacaccattgcatttcccagataagctagcatcataatcaatatagtttgaatgtatgatacaattggtactcatatattcggaaagtagtacaataccagagtagtataaagaagaatattttaataaaagtataagtcttacaaaagaaagtaaagctaccggatccatacccgattcctatgaagacttctcggactaagactcctattctattcctactccactagcttgagaagactactaaactagagagacagcttgattcttcttgcttgaggtgtgtgaagaaatggagggagtgaggggtttatataggctggtaatgacggttggaaaggtcggtaatgccctccaaccatcattggggatcaatcccagccgtccagccaaaccctacatccatcggtgctacggctggttcggccgaaccctgggctggctcagttcttggcaggtggcctccccgtttgctcctctccgcagacttgtgaattttgggcttgttggatcttgtgaatttggtgttctcagcccatttatccataagtttgtttcttgacagcgtctgaatgattgatcgtatgttttgctgtcacttctccttcatttatgatcattctctgcaaaaagttagaaacctagtgctagtggaatatattttagtttgacatgaaatatgcattgcaagcataactagttctcctttattttaataatattgacgggcgaaattgatcgctaacgaccgtcaacaaaaccccccaagcttgaacctttgctcgtcccgagtaaaggactcacaaaaaaaaacttggtagctgatcaggagttgctactatgctgtatatctcaaaagtataggtgcaagaagatatgtgtactctctctcaaatcaaataaatttggcacggtggcttacccttacccctgattcccacgagacactgtccttccttgtcttgagcggttgagagacagaacacaaacaacaacttgaatatcttgtggtacctcctcaacctgcctacgcaactctttcaaaataaccatagctctttcatatgcgaccttcgacttgcatgctgccctcatcactccaaatgcttcaatcatcatcatgtttgttatgtaattttcatgcaccccatccggtcctgcagtctcacgatcacacttgtcactgtttgctttcatggtatacctctttaggaatagacaacagggatcttctccagttggatgtgtacgaacgccctaatcaggtgtgtgcaaaacattcctacaacacaataagaaaaaaacaaaaacaatttttgttttgcaatcaacatgtgtgagctactccctctattccaaaatataatgcacaaccacgcttaacccaaagaccaagaaataattattatcatctcgtagtttggatcatcctaataaatataatacatgcatccaataggattagataacatgagagtggagaattttaaaaagcaataatttaatacgtatatcaatgaataaagggaaaagaagttccggtcggtcattttttcatgttaacaagtctagattaaaagagtgagaaataggcctaaaatcattaacacattctagattaaccttgggctataattggccaacaattttttaataaaacaaccattaaagccatctgggcctggagctttgtcaatcggaagtcttttaacaaggtcatccatttcaagagtgaaaaaatgatctaccatgctatcggtcactcttatatgttgtcacgcccagaaattcacgaaccagaatttctaagcttaatgtgtaataaacccctatccaggactagccagggtatacaaatgacaattgttgacatacagatccacgtcttacaaaaatataaaagattacaaatgcagcggaaaagataaaagcgagctaagcctgaagacttgactgctgcagcgggcgactccgttccacaggcatccttgacggcagcgacgaaaccaacttcttcgagacatctccaactgagaagaacttcaactctgggggtagggaaaagagagcaggactgagtactacccactgtactcagcaagtcataccggaagaggaggtatgatgcaggatatatccaagggaggctaaaggttctttcgcataaagctagcatttaaaagcaggagttgaaagcaataaaacagttgtagtaattaatcagtattaaccagtcactgtccaacactacaccatgttgcaacaggcccaaccaaccacctgaactacaccagttcattagctaactaggggtgagactaatcacggtgaatctggtcgaccgcccataaccgcgtgcacggctattcgaatagttttactctgatcagaggtgtacaactgtacccacaagacacagtcccacgacacgtttccgtgcgccgacatgccaccacgacataccggaaagaggccatgacaggatccttcgcataaccccctctaaccgatcgcatcacaccttagggttcgcccccgtccccagcaggcaacgggcagcccccctttcgtgccgcggtgaatccggaagccgatcaaccggacaccccgaccgacccaactccatcacgcccaccctcgcctgggtacgtcggctaaaggaaagcaacactacaagcctagccgttgcccatgctggcttgtggtaagcacgataagttcttccagggcatcccgcgaaccggtccttaatcgctatgggcacgactagcaaaaccatgcatccacagcccaccatgtagtgtattttaattaactaacaccattgcggtggctctattccaaagctataccaataatcagagtctatgcattactgtaattcccccctctatgtactagttgaactaagcatggctaagcgttccctaaaccaacatctaatcattttaatactgttaacaaccaaatttggtaacatctgtgtcaggaaagaagattggatcaaagcgaaatcggatgcggagatcgagttcggaaacagagcaggaatcggctggagtccagatcggctacgattaggattggctaggtctgagtcaggctaagtaagccgataacgccgattccgacaatacgatttgtacgcgacatcgggttcaagttaatgtacttcaagatgattgccacgcacggatagagtcctaggaaggcaattgtatctattaattaggatattttatgtagattccttatagataaatgtgggcaaaagtctgccgcaaagacttatggtatcttagagtttgttagagataatggtcgtgtccggtatgggcaatcttgtaattctcgggtataaatagaccctgagccctatgtaaatgataacacacacgttcaatacaattttggcgcatcgccaccctttttactttagttttgtttcgacgagttcttgctttcaggttgagctgcatagatttcgatcttcaacaagaggtaaaattcgttatgacggcttgtattcataggattagtgcttccatctttatgatactctaatcttgtttatgtaattcgtcgagttatcacatatcttatataatctctagcaataccgccatctaacctactatcggctaacatctgttagcagagggcagccgattaggttagattttgacgtcgatctagattatataagatatataccactctatgagacttctagcggcttgattgtctagatattgttcttcttttcatacttaatgctgcatcagctgagtttgatctattaagtcgtgcttagaatatcaatctctagcctgccttctagttatcgattagaatagcatcggagtttcagccgatcgtatctggtttaactatattttttctatatgcttcattgacatgttaaatctgccctttatatcaagatgttgctgtatctaagtatattaggcctttgtttgatatattatatttgctttaatatcctgatatagagtagtatcggagtattagtcgatacatgctacatctatctgatcggctatgctataaatatatatagtcctgttattgatatatatttcgatctaagtgatttatactgtctcggcatgatgaccgatctatcccaatcacttgatttaagtatacatcgatataaggagtatatatcgttaatatctatagccgatcgagtagatttagtgtttatttacttattcatgactgccgatcgaaacacagatgacatcggctcaaagataaatgatatgtcatcggcatctagccgatcggctatcatttatagatttaaccgcggtttctttgcttctatttcttgttgattacaggatcaaatcaactggcacgctaacacatccgaaggcgagctttggacctgcactggagttaagcagatctcccaggccacgtgttttctatcaacaaatacccaagttatcatcaatggcataaggtaaacaagatatggctgagtggtaggacccatcccacatgatattgtaaaacaatgcaacatttaatagaaatgcgggacacttgtaaattgggtacaatatgatcaatctaatgcatgacttgccttgctctcgcactgatgagaccacagcaacgtcttcgagaaaccgcggatcgacggaacgaccgaaatctacgcaacaaacaaagcacacaagcaaaacatgctataagtctactgaaacaggaaacaaaaccatttttaatggattctatgcatttttatgaatttactaagacttgaatggatttaaacggagctcggatgaattagatatgatttttagaagattatttgtgtttttactattaaagaaaagccttattgatttattgtgcaataaagcatcctagggctgacatcatccaaggggtggggcggcgccgacaggcgggacccaagggtcggaggcacaagggagagggagggggtactagcaggcgggccccaccggccgcggctccaaaaagggggaggggcgacgtctgccgggctcggctcggctccaagccggccggccggctacagcgagcggcggcggtgcacggtcgccggcgatggcaaccggcggcggcgaacggcgcggaaggcgtcggcgtcggccgaaggcaatggcgcgcacgcggtggatggcagtggacacgggagggagagaaagagggaggacagggagttctcaccatggggttggccggcgcgggaagaagggacgacgaacggcgatggcgaacgaccgggagatggcggcaagtgccgaacgaggtccggaaccacctagttgtcaaaataagagagattagagggagaagggaggtccgcggcgagcgaaaactagggccgaaggcggcggcaatggtggaagctcgccggagtgcgaggagatgcgggctccggtgacggaattggacgggggagcggcggacgaggtggacctcagccgtgcgaacccgacggcggtgctagcagtggcgagcggtggccggaggagtggaaaaggcggcggcggctggtgtagcggtgcgggagcgatggagagctcgggagcggctgatggaaaaaggaaaaaggaggaggagaatgcggggatggtttatatgggctcgggagggacggacgaggccgggaggaggccggatttctcgccgacgtgggggagtggggagagagagtttgggggggggggattgaaaccgaatcccgcccttgcggggctcgcgcgtgcgggagaggagggggaagcgggcggcgagccggcgacgtgggtgtggggtggggcgcagatgcggagtggaggaggtggggcgccggcggttggagctacggctccaacggctagaggaggaagacgaccgacaggtgggccccacctgtcggcgcccgaaggagagagggagggagggaggacttcggggaggggagaagcgggccggcgcgggaaggaatgggccgacggcccaagaaaaggaaaaaggaggaaaaagaaaagagaaaagggaaaaaggattttcccagggatttaatattgcactttgcttattttaattggttaaaattatttccaaggctctgaaaattccactaaaaatcctgttaatgtagtagagcatgtagaatctaagaaaaatttcacatgccgattccgattattaaatgcatttattaatttagggtttctctcttgcctttaaacaaataatttcttgcaacaatttattaattgaatttttgctaaggagaagaacttctgggcgtgacatacgtatacaatgaataaagggaaaattaacatttcttatacgtatatcaataataaataatgtagttgtactagactaagagaattaacatgaatgcggagattatacaccaaagtgaatgagaaatgaagctggcatgcaaagaaacacaccaccagcgaatcacgtgtgagcacacggattgatgggaccacaaattaggccaaatgttgatggtctttaaatcataatatttgaccgtcaatacctgcatataatgaaataaaataatgaaataaaatatggtattcaacttagtggtagggattattactacccaattccactagtgttggtgaaatatgtgtatgcgggtattttaatgagaaaacacaccagtcatgcaaggaaacacacctctggccaattagacgcaagtacacggattgaagggcccataagtcaggtgaaaccgccatggaatgcgtcataactgtcataaccgccatcagggcccaccagtcagtctcctggccaaagggaaggccaggaggtggggcccaaggtttggccgaaccaccaccggcgcctttgatcctggccttccacgtgtgcgttcctgttaacaaccgaatttggtaacatcagcgtcgggagagaagagtagattgaagcaaagtcggaagaggaaatcgggtttgaaagcagagcaggaatcggctgaaatccagatcggctacgataagatcggctgggtctgagtcgtgttgggtaagtcgatgtagccgattccgacaatacgacttgtacgcgacatcgggttcaagttaatgtacttcaagatgattgccacgcatggatagagtcctgggaaggcaattgtatctattaattaggatattttatgtaaattccttatagacaaaagtctgccgtaaagacttatggtatcttagagtttgttagagataatagtcgtgtccggtatgggcatatcttgtaatcctcgggtataaatagaccccgagccctatgtaatttttaatacacatgttcaatacaatctctgcacatcgccatccttttgctttagttttatttcgacgagttcttgctttcaggttgagctgcatcgatttcgatctacaacaagaggtaacattcgtcgtgatggattgcgttcttaggattagtgcttccatcctcatgacactctagtcctgtttatgtaattcatcaagttatcatataccttatataatctctaacgatatcgccatctaaactactatcggtcaatatctgtatgcagaaggcagccgattaggttagatcttgatgttgatctagattatataagatatctaccattctatgaaactgctagcggcttgattgtctagatatggttcttcttttcatacttaatgctgcatcagttgagtttgatctattaagtcgtgtttagaatatcgatctctggcctgccttctagttgccgataagaatagcatcggggtttcagccgatcgtatctgatttagccatatttattctacatgtctcatcgatatgctaaatctgcccttgctatcaagatattgctgcatctaaatatgttagggctttgtttgatatattatacctgctttaatatcctgatatgaggtagtatcggagtattagccgatacacgctagatctatctgatcggctacgctataaacatatataatcctgttattgatatatatttcgatctaagtgatttatactgtctcagcatggtgtccgatctatgccaatcactcgatttaagtatataccaatataaggagtatatatcgttaacatctacagccgatcgagtagatttagtgtttatttacttattcatgactgccgatcgatacacagatgacatcggcccaaagataaatgatatgtcatcggcatctagccgatcggctatcatttatagatttaaccacggtttcgttgcttttatttcttgttgattacagaatcaaatcaactggcacgctaatacatccgaaggcgagttttggacctgcactggagttaagcagatctcccaggccacgtgttttctgtcaacacgcttttggcacgcccagtgggacttgattagaagtcagacgtcagttcttcctcatggccgagaaacaagcaccaccaccatcaagcccaggttccattaaaggcaaggcattgaagccaggattgactgacatcattgatgacaatgtcatgccaatcaatccagagaaattcacgcctgagcagaagcaggagtttgaagcaatgatgcagcaagcacgggatcagtatctgagctcgttcatgcaaacccgcaagggaacgcttgttcagaagtataagataaatgtggttgctgatagtcctggaaccggttcttctaaagatggagaggtgaagcaagctccagaaggctcggctcagccgagcaacaaaggtgctactgatggttctctaggaaatcaaggcgacaaccctcaaggagtgcacggagctcaaggtgatgctgctcaagggtcgcaaggaggaaatcttaatcagaataatgagctagcacaagactttttcaacaactttcaagatcgggttgattacactgtgcatcatgctctgatcaatcagtccggggttttagtcaatacattgtcaaacatgatgaagacaatagccgatggttcgatagctaagcatcaggctacgggcccggtttacttgcaaggaggtgtcttcccgaattatcgatctctggtcatcgatgttcaaccagctgtgcaagcggttccctctattgcacccacaactcagccaacggcgccaacatcaactcccttgcccgctacatcagctatggcgctaggccagccgatgaaccctcggttgttaatgagggagcatccacagcctactgggcagatcgcgaatccgccgacccatgatcaggttgctgccatgtttttgccacctccacctattgttgatccagtgcagcagcagccgattcagcagacactaccaatccagccagttgtacagccgatccaacaataggtcgtacaaccagctcagcaaacaccatcaacacagcagcctatccaaccgattcagcaaacactgccaaggcagcggcttcagccgatccaacagactcaggtgcgacagcagatcgttcagctgattcagcacccggggtcggccaatgcatcagctgggttcgcagcacctggtgggcaacctgcgcagcaatttgtaaaccaagttgtctcagagcatttggttcaccatgcacagccggatggcactgtggtgcctcagatggtccctgagcacttggtacgcaacatccagccgaatcttcataattaccaagggggtaacttgagctatcagtatcagcctccttccccgcaagcccaatatcagccagggggattggctcagccccagttcgcacctcagtttggtcaattcgagcccatgcagcaacaaccgcaaggagcagctcagcaatgaccatgggccgatgtgattgccgatgtgatgagggagcagtttggacttaaaccaaaagaaactagaagtttgtatcggcagccttaccctgagtggtttgaaagagttcctcttcccaatcggtttaaagttccagatttctccaagtttttgggacaagagggcgtgtcaacttatgagcacatcagccgattccttgctcagtggggtgaagcatcggctgtagacgccttgagagtttggttgtttcggttatctctgtccggatcagcttttacttggttttcttctttgccgtatgggtcgatcaatagttgggccgatttggagaagcaattccacagctatttctacagcggggtccatgagatgaagttgtccgacttgacagcgatcaagcagcggcatgatgaacccatgcacgagtatattcaaaggttcagaaagatgaggaacaagtgctttagcttgagtttgaccgatgctcagttagccgatttggctttccagggtatgtccctccaatcagggagaaattctcatccgaagacttcgatagcttatcgcacctgatacagaaggtgaccttgcatgagcataggtcagcggaagtcaggaaaagctctaagaaagttaatcacgtttgtccatatatgtatgggtcggatgacgaagaagatgattctgagatagctgcagccgaatgggtgaggagcaaaaaggttataccatgccaatgggtaaaaagtcctgggaaagaggagaagtatgattttgatatcaccaaagctgacaagattttcgatttgctactccgagaaaagcagattcagcttcctgctggtcatacgatcccatcggctgaggaattaggcaagaagagatattgcaaatggcataattccaggtctcattctaccaatgattgtaaggtctttagacagcaaatccaggttgccattgaggggggaaagattaagtttgatgattccaagaagccgatgaaggtcgatgggaatccttttcccgttaatatggtgcatacagctggtcaagcaaccgatagggaccatgcaaagggttttcaagtaaattcggctaagattatcaacaagtatcagaggaagtatgataagcagcaggagaggcgttatgaggagtacgatgatggttttgatcctcattggggttgcgagttcttcagattctgctggaatgaagggatgaggttgccatctattgaaaactgtcctgggtgcagtgatatcatcgagagctcaagccgaccacgtaatagggatgatcggctgagacagacaagactccctgttcatcaaaggttgggtccgatgaatcaagatcgtggccaagaggatgaggtgatcaggaagaatcaatggtgtccttctggtattttcacgaagaatcagaaaaggagggtccagagattgaggagcagggaacgttttcaggaggttgaagaggaaatcaaccattggctgaggaaaccaaagccaagacaggagtggcgtgtcaagaatcaggttcccgtagccgatgatgctgcagccaatgaagtgaagaagttggcaaaaggaaagagtgttatagcggcaccgattaatatggtctttacattgccacctgaattctggatcgatcaggccgatgttgatgaggtggaagaggaatcggctaagttggtcttgtcaccagaacaggcagtattcgagaaacccgaggggacagagaatcggcatcttaaaccattgtatgtaaatggctacatcaacgggaagccgatgtctaagatgatggtcgatggtggggccgcggtgaatttgataccttatgctacgttcaggaagctgggtaggaacgccgaggatcttatgaagataaatatggtgctcaaagactttggtggtaatccatcagagaccaaaggtgttccaaatgtggaactaacagtcggcagcaagactattcctaccacgttttttgtcatcgatgggaagggttagtacaacttgttgctcgaaagggattggattcatgccaactgttgcatcccttcgactatgcatcaatgcttgattcaatggcaaggcaacaagatagagatcgtgccagccgacaggtcagttaatgttgccagtgccgatttagccctttgggagatggatggccttgattgtttatctggaaaattctgggatggagattttctaaaagtgtccgattctgatatacagccaatcgaagatggagaacccaagctattactttgagggcgttgtggagggttcgaatgtctacgctaaggatacagtagatgatctcaatgacaagcaaggtcaaggttttatgtcggccaatgatttggaagaaatagacataggtccaggcgatcggccaaggccgatatttattagcaaaaatttgtctccagagtttagaaccaagctgatagagttcctaaaagagtttagagattgctttgcttgggagtactatgagatgcccggacttagccgatcgatcgttgaacatcggccaggggttagaccacgtcagcaacctccgaggagatgtaaagccgatatgctcgaacctgttaaagctgagattaaacgattgtatgatgctggttttattcgtccctgccgatatgctgaatgggtttctagcatagttccagttattaaaaagaatggcaaggtcagggtgtgcattgattttcgagacttgaataaagctacaccaaaggacgaatatccaatgccggtagccgatcagctggttgatgccgcgtcagggaacaaatttttgagttttatggatgggaatgcaggatataatcagatctttatggccgagggagatatccataagacggcttttagatgtcctggtgcaatcggcttatttgaatgggttgtcatgactttcggcttaaagagtgctggagcaacttatcaaagggccatgaactatatatatcatgatttaatcggctggttggttgaagtctatattgacgatgtggttgttaagtctaaagaagtggaggaccacatagccgatttaaggaaagttttcgagagaaccaggaagtatggcttgaagatgaatccaacaaaatgtgcttttggtgtgtcggctggccagtttttgggatttcttgttcatgaaagggggattgaggtgaaccaaaggagcgttaatgcgatcaagaaaattaagcccccagaaaataagacggagctacaagagatgatcggcaagataaattttgttagaaggttcatttctaatttgtctggaaggttggaaccttttacacccttattgaggttaaaggccgatcaacaattcacttggggagcagagcagcaaaaagctttggataatatcaaggagtatctcagctctcctcctgttttgatccctccacagaaaggaatactgtttaggttatatttatcggctggcgagaggtcaatcggctcggttctgattcaagaattggaagggaaggagcgagttgtgttctatctcagtcgacggctcttggatgctgagactcggtattctcctgtggaaaagttgtgcttgtgcctgtatttttcgtgtacaaggttgaggcattatttattatctaacgagtgcactgttatatgcaaagccgatgtagtcagttacatgctgtcggctccaatattaaagggacgagttgggaaatggatattttctttgactgagtttgatcttcggtatgaatcaccgaaggcgattaagggacaagctatagctgattttattgtggaacatcatgacgattcaatcggctcggtggagatagtaccatggactttatattctttgatggatcggtgtgcactcatggttgtggcatcggcttagttataatttcccctaggggggcatctttcgagttcgcttatactatcaaaccgtatgcgactaataatcaagctgaatatgaagcagtgcttaaggggttgcaattactcaaggaggttgaagccgatatgatgaaccctgagttcctctcgacactcaaggctgttgttggcccgatctttcggtgagttgtgataactacgatttgggagaaacgttgacgatccgactacaaccgtacgagacgttgtgttgcaccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaaccccagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcaccttgtttcttcagttgctgccgactgagatggaatttggcaacgaggcttgatgcattggaaagaggactccgagagctttccatcaagtactcacgggccaaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcatatcatcctccccttcttcacggaaaaccgtcctcggtttttccatatggtgttctttatatagtccattcaaaataacctgtttcatccaatcaaaactagagaaactcgaagtagtgtgattagcaataacatgtttctctaaatccgaacaaatgaaaactctatgcaccaaatatattcctctatcattatatttgccaaagatatgaaaaatagcattagttggacttggcaaatcagacttagaaaataatttctccttcaaattatcgagctcacaaaaatcattaaactgaacatagcccaaagtatttaaagaagatagcaatttacgttcctcaacttcattagcaatgtgaacagcatgcttaaaatcagcacacaaagaaacactaggaatagcatgttcattcactagttgtggcatggatataagtgaagcattatcacacaactcttctttatcacaaggaacagcgagtaaatcaacttgtgacaaaggaattccagcatttggttccactaacggttgctctacttttgcatgaaaagtggacaaatttacttcgttaacaatgcactcaccttgattaatttcagtatcatttactttaccttggatgtcctctttagatgatggaggtgtctcgaacttgggtgtgaacaatggaattggtggctctttcatgtctctctcctccttttcgtgattacgcacttcctgcaaatagttagtaattggaggcaaagacatagcgtgtttctttttcatatcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatatctgaaatatagtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacggctgtaatcaaatatgtggagctctgggtaggcttaaatacgtagcaaaggaatagcaaatgctcaaatcagataatgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttctcttttctttctttcttctttcttcttttcttttttttttccttttcttttctgatttttttttggtgcggctttttttttcttttttttttgcacctttctgcccttttttttctcacttttttttttattttttttaacaaaaactgacttaaggaccttaatgtaagattacagggactcaaacataaatataaaatttatagggactcaaatgtaaaagtctaaacccaaaattaaaattatacaaaaaaatggaatgctgaatttatgccggttccgtttttccaaacagatctcgaaaccgacaccaaacaaaaattcgccaaggtgtttgacacaactcggaaccgtggaattgagggagggggtcagactcggccaaaggggcgagtgggactcggcaaggaggtggagtggatggcagccgaatttggtgtatgggataaaacggaaactgatttttaaccaatccaatctactatatctttccaaaacaaacttgactacttccaaaatcagatatggtaattcaccttcctcctcttgtgcacgacacaggcacggccaaaacaaacacacacaaggatcggcaaactctagatgcaactcaataactccaaaactaaccgacagaaacttctgaaaactacaaaaatagaaccgtggcagcgagccgattccgttttcgtaggtcccgacaacaacagagacacggtggcagcgacgactgtggtacaaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaaccccagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcaccttgtttcttcagttgctgccgactgagatggaatttggcaacgaggcttgatgcattggaaagaggactccgagagctttccatcaagtactcacgggccaaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcatatcacgatactattgaaatcatgggggattcttatctagtaatcagccaattggctggagaatatgaatgcaagaatgatacattgatggtttataatgagaagtgcctggaactaatgaaagagttttggctggttactttgaagcatgtatctcgagaacaaaatcttgaagctaatgatttggcccaaggggcatcggggtataagccgatgatcaaagatgttaaagttgagattgcagcaatgtcagccgatgattggaggtatgatgtgcatcagtatttgagtaatccatctcaatcggcttctaggaaattacgatataaggcattgaactatacactgttggatgatgagctttattatcggacgattgatggggtattacttaagtgcttgagtgccgatcaggccaaggttgcaatcggtgaagttcatgaagggatctgtggtactcatcaatcggctcacaagatgaagtggttgcttcggcgtgcagggtacttttggccgacaatgctggaagatttattcagatattataaggggtgtcaggattgtcagaagtttggagcaattcagcgagcaccggcgtcggctatgaatcctattattaaaccatggcaatttagaggttaggggattgacattatcggtatgataaacccaccatcgagtaaagggcataaatttatattggtggcaactgattatttcaccaagtgggtagaagcgattcctttgaagaaagttgattcgggggatgctattcaatttgttcaagagcatataatctatcgatttggtcttcctcaaactatcactatggatcaaggttcaatcttcgtgtccgatgagtttattcagtttgccgatagcgtgggtatcaagttgttgaattcttcaccttattatgcacaagctaatgggcaagccgaggcatctaataagagtttgattaagttgatcaagcggaagatttctgattatcctcggcaatggcatactcgattggccgaagcattatggtcttataggatggcttgtcatggatcgatccaagttcctccttacaaacctgtttatggacatgaggctgttttaccatgggaagttagaatcggctctcgacgaacggagttgcaaaacgatttcacagcagatgagtattacaatcttatggctgatgagagggaggatttggttcagtcacgattgcgagcccttgcgaaggttactaaggataaggaacgtgttgctcggcattataataagaaagttgtacctaaagatttttcggaaggtgaacttgtatggaagctgattttgccgattggtactcatgatagtaaatttagcaagtggttgccgaattgggagggaccgttccaaattcataagtttgtgtctaagggggcatatatgttgcaagggcttgatggtgaagtttacgggcgagcgctcaatggcaaatacttgaagaaatattacccaagtgtgtgggttaacgcatgatcggctactactgccgatgcgtgacagccgatgtgtttacatcgccttgagatggccgatattgttatatcgcccttagttgtttttataatgtaatcggttgtggtttgccgatgtacaatggccgatattgttatatcgcccttagttttttttataatgtaatcggttgtggtttgccgatgtaaaatggccgatattgttatatcgcccttagctgttttataattttatcaatgctcttgacattgtaaaactaggggggcatatatatatcaaaatgcagtatgcagtacaaaattttttgagcaaatttcaaagtcatattaatcggcgcaaagggttgttaagacaataaagtatcagaatgttttagccgattacaaaagtcttaagtattattacataaagactactgagataagtatcgctagatggccgaaatagccttctgcctaatctgctctacttcttctatggcttgggcatcttgagcatcggttcgagggataacttttagggacttggtcagttcagcaacatgcttgatagccgatttaagtcttgctttctgttcttcaatagacttggggagatcggctagcttcttgcgctccatatccagctcggcgttacattcttcaagttgtgctaagaggtcaatcttgtgagcctcaagccgatcaatgttagacttgattgggccttcagataattggtcaagcttggatttctcttcatgcacaagttgtcggctggcttggatagtggcttcaatgttcttacattctcgccgttcgactaatcttaacttggctttctccagcttgaattggtgttgctcaaggtaaacagctggagtaaggatgtcggctaactcatccgggattaaggcttgaatctcatgcagccgagcctgattgagccacagtcaactactaagctgtctagtgatgatgcctctagccgatccaaaatacttccttgagttttcttcacgtcatcagataaaggagccaatgctttgcttgtagtatcttcttctccttcatcaagatagtctctgatattgaaagagaaaagatcggccaatgcctgcaataacaatttagaagcagattagaggttaaacgattatagccgatttgaatgcctgttgtgataaaagaaacttactaagatagcaggagcagttggttgttcttcttcctcgacgtgatgactccctgcagctgaaggggtctgatcacttgatgattgttgaataaaaggagaaggaggaggtgaaggctgaaagggagacaagtgtcagatagaatcggctaaaaattaactaatgaaagttaaatctatcttactggtggagctggtttagatgttgttgcagccgatttcttcttcaccgcagtcttctttttctgcaattataagacttgggaatgatcggctataagacaaaataatcactaaaaggattaacgagaaacacttacccttgagaagtggactggggcagaaggagttggaagggtttgcttaggcgaagccgatggtgttctttcagtatcgcttacttcagctgcggcctgatcaacttcgtcttcaattatctcttcatctaaggcttgttcaatagatggatccaaggtgggcagatcatcggccggcttgtcagtcggtttggttttcttgaacttggcctttttctttggagccaagattgaagtgctcacagccgaggatctggttttcctttttgggcctgcatcggctggttctctagttaggccgtgaaggagagttgaggtcttgggggcatagtagccaataacaggggggagatagcccacctccatttggaattaagcccgaagcatactcaatgttcttgccactattgctttggtgaggaggggaggactctgttgtctgcaaagcaggagcaaaagattggttaagtaataaatcgattaattgactacgcaatttgatagtaacaatgtttacctagggtatgacgtcgggggacagatctgtcatatacatcgtggctgattgatgaaacagatgtagcttctattcaccccaccatctgtcgaagtttttgcttctgaatccagccaactcaatattttcaatgctgccaagaggaggtcccgatagattgagtagccgatccatcattagagcagacgtgatttgtcctcggcactgaatcttgtcggcaaaaaataagccgattgggagttggcctaatccaagttgcctagccgagctcattgggtgataaaactcgtaggagacttggatgtttctcccttggtgaatgccgacaggaaggatgcaagggctgattgcggctataagaacttctctggatttctggaatttctcatggttaatatcttcgaatctaaaatctgatggaagttcgaggtctgctgattcttcataagggaaccagatccgggtatctttcttaaagccctcatagaagctgcagaaccagtccttaagcagctcagccgataactttgctccagcatcggttggtgtggatgcatattccccatatcatgtgcacctgcgatgagtacattcttctccgtcgtcacccacaatcggctctggcagtgggaactcagcttctgttacagaaggccgattgacaaccttcataaccatcaggtttaaccaagtttgcagtagccaccagggtccacctgctccaactgccgagccgacggctattctagccgatgtgttgttcaacatctggtacagatagccgagaaggattttgcccaaagggaattctttctttgactccagggcttcggctacgaactgccagttggttgtagggccacaactggatccacagaaaaggaacttttccagccacatgagcaaaaaggctacgtgctctcgaggggtaacggatccttgacccatatatgctgccacatagccggaccaacaacctatgctcttggttttgaaatcgaattggttcttggtattcatgctcatggggttggccgatgaagttacatctagtccggtgatcatagtgatgtcaattaaggttggagtcatcggcccttggttgaacaggaaagcgttgatggtgtttgaccagaagtaggtggcggcagccatcagaggttcgtctttggcagaattggctatggtgagggctagtgcttggccgattccaatctcatcccagtgaactttcttactagccgatacacgttgataccaagtggaccaactcctgtcgggtgtgggtttttcgagagatggccaggatttaaaggtgttcttccaatgacctaggttagggttggatagcctaaagggaatccggttggtctcaccagtgatgaaatcggtggggtcgagattgccgattgggccaaggaagtagtggttctggtgtgaaaggcttggaattgcgacttggtgggaaagatgttacgaatccaaagcaatcgaaaagagaggggaggtatgagatgagagaaaatcaatctattgctaaggaaaggggatttagccgatgagaacttacctcggcgtactcggctattggcgcaccagacgggctggcggaggatgacatggccgcgggcggagatctcgtcgaaggagaggttgcctgggaatcgcctttgcgtcggaagagtcgccggagaaggaaggggaataagttctgcttgagcggtgaaaacgggtgtcacggtgtgaggtttctcgggggtgacggttagtatttaaagcacggcagtaacggtcggaaaacggtaaagtgcgaaacttgctcggagtcgatttacagcaaatccgaaacattaccaaatattccggacttggggggcatgtgttaacaaccgaatttggtaacatcagcgtcgggagagaagagtagatcgaagcaaagtcggaagcggaaatcgggtttgaaagcagagcaggaatcggctaaaatccagatcggctacgataagatcggctgggtatgagtcgtgttgggtaagtcgatgtagccgattccgacaatacgacttgtacgcgacatcgggttcaatttaatgtacttcaagatgattgccacgcatggatag

SEQ ID NO: 66980 - DNA, 37565 bp, Oryza sativa
ccctccttcccggcacgcaaaaagaaacacctattattgtataattaattaagtatttgctatttttttaaaaaaaatgtattaatatgattttttaaagcaactttcgtatagaaatttttgcaaaaaaacataccgtttagcagtttgaaaagcgtgcgtgcaaaaaaacgagggagaggggttgggaaaaggggcatccgaacacagtctataatgttgattatagaccgtacgatttatttgaagaaaagttgtacttaaaactcctaagcgatttaagaaaatgtaatattaaaaaaaataagttacgatgaattttttaaaatcaactaaatattaagttttaaattttttttaactctggctggtgcttataacctgagccttgcatttagggctttagaaccattttggtttgaagttaaaatattccctaccaaattgtttggcatcttgaatagtattttgttactgtttggtttgttaccaaaatataccaatagcacacaaaaagttaccaaaattttggtattaccaaaacttgcctaggttttagtagtaccaatattttagcatggtaccaaaccaaacacacccttgttctaaacaacccgctccaactcaccaataaataaataaataaataacctacataaacgagtgatccagattgctccaacgatgcctaagcaccgcattctagaagcttaattagacaatggtggtccatatatgtcaacaccattgccataggtcttgaaaacatgcatgcttgttcgttgattgcacattggaaagctagcagacaaccaaaagttaattacaattagttggtctctgatttcatggcaattacacatggctacagtttagcgattttcgtatgtatgcaaaacacacattttcagtaaagtgattgatcacaagtgcactgaatgttttctctccctttaaattctcctggtccctagtaaagccacactctatgcatgaacccaattcaaagaatcttcagcgtcagcacagagaaaacatagtacaattagtgtatcacaggtgcactcttgcttgtttatcgtcgacagtttttaggacaaggaagcaagcgagttagttaagcagttagtttgcaaaatatcgacatcagattttttcatgatatatctctactattatatgaaagcagagtcatcctcctattcgatgatagttccccatgtaaaataaccaccctgcctagaaatccatcccacacacaaatatgtgcttatttccacacaaaaatcatcaaaaaaaaaccaccccagcccatgcataaaccagtgtttccacgcgtaaatcaacaaaaacaaatagacaaaaccgaaacctataaaaccatccgtacatattccttataatcctgttgcaacacacagacatgacacaatatctatgaaaatatgggctgctgtgaattacaaagcagaaaatttaattctgcaataagaaatgtgaacatttggtctatggggagtcaatcaagttttggatgtgcacatcttagatgcagagagtggatatacatatgtagtaattttctttctaaaaaaagaagaaaaaaatcatgtttgtactgtgttctgaaaaaagagagaagaaaagcagcaccagcaaagtaagcaagcaaatattacttccaatttgatcgtttttccgccacttttcattggatggatgattcttattttagcctttgacttgaccatggagaaaaatcgtgatatcaaacttatcttgattttaattttttcaaagtcctgtttgttcgatttaattatattcgcttgtcaatgccaatgaaactgctgcagtgctactaatttaatggaagtcaattagcatggccatatgacttgcagcctttcagctcttttttttttgaaacgctttatagtatcgtaaactactaactccaataccccgaaaaagaaaccctactaactccaaaataaattacagagtcattatgctattggtatcataatcctagtccaacatattcttaattctcatttcaagaacagatagttaggcaatgtctgcagaagtagggatttatcaaagaaagagaaaaaaaagattagttaacaacttagctatatctgaaaaaaaatatgttaaacctgatcgatatgatgttgtgtatgcaaattacaaccacgaagatgccactaggttcataacttcagctaggatctaattaaagtgcacatctggctgcttatcaacttgtaagcatgccaaggaagcttctgagagctagatttccagggttgatcatgtggatttgtcggcggaaaactctttgagttttgtatgcaccgacgggccatcagattcttgttctggaagaatggagtattttcttgcaatttgtgtccactttggtccttaatcgcaatctactgccagtaaagtacagcaggtgttgagcttatattaatccattcattttgatggtcattccagcaatgaccttacttgatacactctgtcagcacgtacaccaagaacaaaaataacctcaggttgtatgagcatgcagttgtagctttgcaataacctcatgttggacaggttgctgttttctgaagtgactggtggtagactggtagcatgcatccgcccaaaaaaaaaagttcattaaccgtctgtttatttgaaatatttgtgggtttatgttttaatatttgatcatccatctcatttaaaaatctattatctattatctatctatctatctatctatcttctatctatctatctatctatcttctattatatacttaaaagtccattaaactttctacaaacgctctcaagccgacacgtggactcctaaaatcactcttagattgccacgtggcactttaatagtaaaaaaatctctaactaccaatttttctttaaataagtggacccaccaaatctatcctaaaaacaagtacgtaagtactatccgcctcacgttagctgaacgatgaccaccccccaaattctttccctctcctattttcaagttatatattagatagaaattagaaacatatacaatcgacctccactccaactaaaagatctaaatcatatagcttatttgttatccatgtaaattattagattatttacaacaaattcattttttttgcccagaacaaatttaaaatttaagacccaaattatttaacaagtaaaagaaatgcattattttggaccgtcactcacgacacatttttaggggaaaatcatatgactaacaaaatgtagcatacattgaaacaatatgacgcccataaaattaattaataacattagcataataagtagtttaattagaaaatacatatttagcaagtaaaaaaatgccctattttggatctctaatattggataaaaatacgaataactcaaaccagtaaacacatttgttaaaagaaaatctcctcccctcaccaccaccggtggtaagaacatgcgcacgtctcatgtcaacgaccaacgaaaatagaggggtaaggattgatagttgtcttttccaattgtagatactacaaacaaacttatttttttccctgtgaatagtctatggatattatgtatgttttttttaatcgattttgctatatctcactcgaaagattttttcttatctctcactcgattttctcactcaaatttacagttcattttcttgtaagttacagtgtaatttatgaaacttacactgtaacttttgtaagttacactgtaatttttgaatcttcgcatgtaaattttaaattttgtattggatttggtctttttcttgaggatatggtaatttattgtctattatggtgtttcttaattgctttttgccttttattatatatatcggattttaatccaaagattaaaaatctgtgtgatacaattataaaaatctttcgaaagatgtataggtactcccttttttaatactgcatagctatttttcattaagtgcgtatgtacgtgcatgggcttggcccagtgaggaagaggatagggaggtggaaaaagtgcattaaatttcctaagaagcgcttctaggccaccgcactctaataggccaccgcactcgtataaattctaaaaaaaaatatctagccgttgatttgcacttaaattagtaaaccccgttattttggtcattggattagttctatcaagaacccctccctccctcctaatatctccctctcaagtacataataagagacaaaaacgaagcacagctaaacaatgcgtaggagataaaatacgtcatactgtttaccagaaaaaaaacaacaccaaagaaaaataaaagtacataataggatccgaataaaataaactgtctttaaattatgaatttttataatataaaaatatatattacctcaagcatacgcacacgtaaagcagattgtaaagttcgtaaattttaaatttatatatactatttatccaaatatatttcttaaattaaatataccattaataacatatgatggatatattgcagtgctaagtacatcgtgatacatgatgccaacatgtaataaataattttataataatttataataatttcatatcttaaatagtatctaattttactaatttcatatcttaaatagtatcaaattttactaatttcatatcttaaatagtagtaccaaattttacttgacaaatatactacacaatttaattgcgtttttacaactagattcaaagtttttggaatattttaatattttttagtgttatttgaggagtaataagcatacattataatagacgcgaaaacaaattaaattaaatttctgcagccagtgaccatgttataagacaaccccttaatctaccataacaattatggtcatgcgtgtaggttttttctctatcaaatagttttggcagcaaatggataattcacttagataaacattaaattgctcatgttataattttttataatcgatagaaattctaatatactcataattgacagacgtatgacacatacaccccactgaaccaactttaagtgtaccacaacaaattagatattgtaaatatgtctgtgaaaataaatacattcttattgtttagtaaatgtatctcatgtgattataaacacaacagatgttggaaacaaatcaaacgctgtactatatatatttgtcaaaatataaacaatgatatgatgctttggagattgtcaagatggtaactctcttcagctatagttttaatgctaataatcaacccctcttatatttaaaagagaatattgtatctatatcattaaaattgagtagtatttattaacactacaaataaattatgtgtactctataccacaattggactcaaaactttaaaaataactattttcaaccatatatcctccttctcaacaagatgtctaccatgtacaatagagcttgctatgatatcgtaagtattggacaacatacatatgactgagttgaggtggtgtaccattatttgaattatagctcatctggtctacccaccaatacaatcatatatgagtgtgctaaatcttatataagtgtgttgatggtgatgtaggcgttaaaattgtgctcaagatggtcgatgaaagacccatgctttaaggcattagagaagaaaggcttggtggctacggtcggctttacccattagaagggtattcatgtataattttaacggtgttatcttattacctgagggtagaagcaatattctcagacataaatagatttacaaataagtgagacatgaacacttaaatctgtagcgaggatgatttggaaataagtaagacacggacacttagatacgtagtgatggtgacttggaaacgctcttaagccgccacgtggcaatcctacaaacgctcctgaatcgccacatggcactatctaatctcaccgttgattttcacttaaattggtggtcccgatattttagactattagattgcatctgttattaaaaaataataccttccttccacaggagaaatatataactgttgcctaaaagataaataccttccccacgtatgtacgactaaaagaaaaaaaaagttgaaacatttgccgccgtacgtacgactaaaagaaaaaaaaaaagctaaaccattaattgtttgccgtgagaaaaagaagaccatgtgcatatacttataagatagagaaaaataaagaaaaaaagaacgtagtaccgttcctaagaaaaatcgatgttatttaatacaatttacaaattcacgcaaatatgcgtagttaaattacacctataatatataaatataaaatatccaatcaacgctctttaaacattccatcttttaaattgttttaaatttatatccaatttgtgatactattctattcctttacttaaagatgtctatgatccaaaatacatcacaacacatgggaccgacatgcatataattgatgttatgttatctatctattatctatttattatataataaaattctattaaacttactacaaatactcctaagccgccacatagcaaccctgcaaatgctcctaagcctccacgtggcgctataattatttctaaaaaaatcaaaagaaggcaaaacatctaaccatcgattttttttttaatttattcccggacccattgttgccaaccattagatctatttttaaaaacgatcaattaaatttatctccatcaatcccacgtacacgtgcatatatacaagcaaagcacatacgtatgtacggaaccagctggcctcatgtccctctttttcttttctttttctttctaaaataaaaaaaataaatacaccgttaaaaaccattagatctatcatgaaaacctaacagttaattttatcgctaaaaatcactaaatacacgtgcacataagcaccgtatataagtacgtaagcacgttggcctcacaaccctctgtctgttttttttttgtcattctgaaatccaaaaaaaataaatcaaagctacatttagggtttaaaattaaaaatcaagctataagcttccgattataggatagaaaaaacagtatgcaatttgaattccttattgataaatcattgtattatccttaggtttccacaaatatgtcatagcaattcggaaggaaaaaaaatcattttctacctataccatgcaagaaacacacacaaaaaatttaagtccattaaacatcatgcagaatgctcctaaaccactacatggaactttaataatttagaaaaatcatataaaaattataagaaaaaagaaaaatacttagttatccgttctaacttaaatgtgtttgtgtttctttcgtactccccccgtcccattttaagtgcaaccataaaatttcatgcccaattttgatcgttcatattatttggattttttataattagtatttttattattatgggataataagacatgaatagttactttatatgtaacttatgtttttaatttttttttaagttttttaaaagacggacagtcagagttgatcacggaaaatcatggctgcacttaaaaatgggacatagggagtagtaagtagatttttaaggaataagtttacattaatcactgcctttcttataaataatggaagtacagtttcaaccttttaatataaataaatggttatgttgctcaaatgtgctttattgcgcactcatatcaaaatatacaaattatcagtttgaagtatatattttttatatctttataaataaaaaaatacttagaacatgtgacgagttataatgcacgcataatgttatgatgccggactcagtcatcataagaatataattatgattttaatcttttactgcctaattaaatatgtcaatgattgttaggataactaacgctcaacatttaattttgaaaatatcaaacactcatattcaaaagaaaaagatatagttgtataattttgaacgatattaacaaagtgcccatagagtgagctataaatattaatcttggtggtttataaatctatacaatctagaaagtatcataactacttaaaaacatttttaggacaaatatcatgtatttaaactattatgaaataacatcttaagtaaaagtcgtcgtatatccctatggcaataaaataaaaacaaaatgtccgtgcatgttttattccttcacgtagcatctaggcaatcaagctgctaatggaaagtttgtttggttatgatttacgcattgatagatgatattttgatctaggtgggttaataaattttcaattccgtgattttctacactccattaaaacatccgttcttttcaatactctattttacacatgcattcctatcatatttttttaccttttctattctttttttttcaatcatgtgttacgaaggaacctttaatttttttttcaccgagaggcaaagtcataacatttcacaatcttaataacacaaattatgatggtttaaataacatgcccgcgcagacgcgcgggctaccttcctagtttataaaaaaaatataagttatgcatattcatattttatcatctaataacaataaaatattaatcacaaaaaaaatcacatgataaatctacatctcacatgaaatttattactcctattttatacatccaatccagtacctaaacatgaaccaattcctgagtgcttgcctaagttggcaacttgtgactagagaggctgatgatacctgcatgcatcctagtagtatcttgcaagttacaaccaagcatgcaaacatagtaggatttgaagactgcaaatcaagtatgtttaccattttgttagggcatggcttcttttggtaggtttgtttggttttggtcgattctataagtttaacggtttcacttttcacaacagtatctttttttttacctatagaagtttacttagagcatctcccaacatgctgaaatctaactctccaaatttctatttggctagcttgtcaaaaaaaaaaaatcagagagtcaaatttatctttcacttctataacttttcaattaccctcttcaatatgacaatggattcacttgtcaatctctgcgattcttcttcttctctccctcaacatctttccttaccccacccatagtgccccagacgatggcattgggtggacgcagtgcaaagggcccagtggggtccggcagcagcggagatgcaaaggagataatggatgaggaagttggtgtggcgaaggctgaggtcgatcagtggtgggaatgctacctccagtaatggcttatagcacatgttgatttgaatgtctacgacagggtacgacaaggtagcctcgagacaacaacatgcttctcatcaacatggagggaagagggagggagaaagtgtcgcctggtcacctccattgtcacactagccactggccagctctcccacaccaccaatgccaggggcgagctttagcacagccaccgcttcacctccaccaccgcactaccctagcttcgcccaacagccaccgtcaacgcctcctctccgtcaacataagagagagagagaagaggagagtagccatgtggggaggaggaatagtacatggggcctaccgtttggcaagttattttgggttgccaagttaggccaataaggggagggatttggccatccggttggaaaggttattggggtagtatctttttactagaattgtcaaaaaaaaatagtttgagagccatttggagaggatgttgcctgttagagatgctcttaggacatcaaattccataaaaacatcagaaaaattctctcgatgaagatttataaccactaaaactgccctcaattcgaagggagttcaaaacaattaaaatcatgttcgaattgagtttcaatttcactttaacccctttgaaatctcaatggtaaaacatcaacccgtcaggtagcatggttctttttattcctttcaaaaagagttaattacaaacagaatcaaaactaacagttaggcccaaggcccatccgagcaaacaatagatcatgggccaggcctgccaccaccctccccctcctggctcccgctcttgaatttcaaaatccaaaaatatcggcacgactggccgccgacggagcgggcggaaaatgacggaacaacccctcgaattctaccccaactacgcccaccaacccacacgccactgacaatccggtcccacccttgtgggcccacctacaagcgagacgtcagtcgctcgcagcaaccagtgggcccacctcccagtgagcggcgggtagatctggactcttacccacccacactaaacaaaacggcatgaatattttgcactaaaaccctcagaaaaattccgatattccaaaccagtacagttcctgaccgttggaggagccaaagtggagcggagtgtaaaattgggaaacttaatcgagggggttaaacgcaaaaacgccgaggcgcctcccgctctatagaaaggggaggagtgggaggtggaaaccctaccacaccgcagagaaaggcgtcttcgtactcgcctctctccgcgccctcctccgccgccgctcgccgccgttcgtctccgccgccaccgccgccgccatgagggagtgcatctcgatccacatcgggcaggccggtatccaggtcgggaacgcgtgctgggagctctattgcctcgagcatggcatccaggtaaaacaaacaaaaacggatctgatgcttccattcctccgtttctcgtagtagcgcgcttcgatctgtgggtggatctgggtgatcctggggtgtggttcgttctgtttgatagatctgtcggtggatctggccttctgtggttgtcgatgtccggatctgcgttttgatcagtggtagttcgtggatctggcgaaatgttttggatctggcagtgagacgctaagaatcgggaaatgatgcaatattaggggggtttcggatggggatccactgaattagtctgtctccctgctgataatctgttcctttttggtagatctggttagtgtatgtttgtttcggatagatctgatcaatgcttgtttgttttttcaaattttctacctaggttgtataggaatggcatgcggatctggttggattgccatgatccgtgctgaaatgcccctttggttgatggatcttgatattttactgctgttcacctagatttgtactcccgtttatacttaatttgttgcttattatgaatagatctgtaacttaggcacatgtatggacggagtatgtggatctgtagtatgtacattgctgcgagctaagaactatttcagagcaagcacagaaaaaaatatttagacagattgggcaactatttgatggtctttggtatcatgctttgtagtgctcgtttctgcgtagtaatcttttgatctgatctgaagataggtgctattatattcttaaaggtcattagaacgctatctgaaaggctgtattatgtggattggttcacctgtgactccctgttcgtcttgtcttgataaatcctgtgataaaaaaaattcttaaggcgtaatttgttgaaatcttgttttgtcctatgcagcctgatggacagatgcccggtgacaagaccgttgggggaggtgatgatgcttttaacaccttcttcagtgagactggtgctgggaagcatgtcccccgtgctgtcttcgtcgatcttgagcctaccgtgattgatgaggtgaggactggtgactaccgccagctcttccaccctgagcagctcatcagtggcaaggaggatgcagccaacaactttgcccgtggtcactacaccagtaagttccatctttactactatctgttcacaatttctggaaatgtgattgtttggatgtctaacatgtggtgccgttcgtttcagttggcaaggagattgttgatctgtgccttgaccgcatcaggaagcttgccgacaactgcactggtctccagggcttccttgtgttcaacgctgttggaggaggaacgggctccggtctcggttcccttctccttgagcgtctctctgtggactatggcaagaagtccaagctcgggttcaccgtgtacccgtcccctcaggtctccacctctgtggttgagccatacaacagtgtcctctccacccactccctccttgagcacaccgatgtcgctgtcctgctcgacaatgaggccatctatgacatctgccgccgctccctcgacattgagcgcccaacctacaccaacctcaacaggcttgtgtcccaggtactgccctgcatctttccttgcagcgctatgtactccagttatttgctgtaagatcaatgtaatgtgcaatttgtcttgacatcatgtggctaatgctaatgtgctgcaggtcatctcctcactgactgcctccctgaggttcgatggtgctctgaatgtggatgtcaacgagttccaaaccaacctggtgccctacccgaggatccacttcatgctttcctcctacgccccggtgatctcggccgagaaggcctaccacgagcagctctccgtggcggagatcaccaacagcgccttcgagccgtcctccatgatggccaagtgcgacccgcgccacggcaagtacatggcgtgctgcctgatgtaccgcggcgacgtggtccccaaggacgtgaacgccgcggtggccaccatcaagacgaagcgcaccatccagttcgtggactggtgccccacggggttcaagtgcggcatcaactaccagccgcccagcgtcgtcccggggggagacctggccaaggtgcagagggccgtgtgcatgatctccaactccaccagcgtcgtcgaggtgttctcccgcatcgacatcaagttcgacctcatgtactccaagcgcgccttcgtccactggtacgtcggcgagggcatggaggagggggagttctccgaggcccgcgaggacctcgccgcgctggagaaggactacgaggaggtcggctccgagttcgacgatggtgacgagggtgatgagggtgacgagtactagagaggttcagggttcttgcctggtgccttggcaatgcttgattactgctgctatcctatgatctgtccgtgtgggcttctatctatcagtttgtgtgtctggttttgaaaaacatttgcttttcgattatgcagggtttgcttgtagctttcgctgctgtgacctgtgttgtttatgtgaaccttctttgtggcatctttaatatccaagttcgtggtttgtcgtaaaacgaagcctctacttcgtaaagttgtgtctatagcattgaaatcgtttttttgctcgagaataattgtgacctttagttggcgtgaaactagttttggatatctgattctctggttcgcaatcttgagatcgtcgctgcttaggtgagctaagtgatgttcctaagtaaatgctcctcaccagaatacgtagctgtgtgaaaagagaacgcgtgaatacgtagctgtgtaaagattgtgtcccaagtaaacctcagtgatttttgtttggatttttaatttagaaacattcgactgggagcggctagagccacacccaagttcctaactatgataaagttgctctgtaacagaaaacaccatggcaaagtgcacataaactttcccgtattaacaccaactagtaaatttcaacaaaaattctagaaaaattactaattatgttatcttcaaattcattatatttagggagcaacaaaaaaaaagacaaaatgttcccgtgagagtaaggctatgtttagttctaagggtgaaaatttttgccatgtcatatcgtatatacggacatacatttaaagtattaaatgttgtctaataataaaacaaattacaacattcgactgtaaactgcaagacgaatttattaagactaattaatccatcgttagaaaatgtttaatgtaataccacattatcaaatcatggagcaattaggcttaaaagattcgtcgcaaattagtcgcaatctgtgcaattagttattttttagctaatatttaatacttcatatagatgttcaaacgttcgatgtgacgggatgaaaaaacttgccagaggatctaatcaggccctaaaattactactatatattggaggccaagtttaattccaaactttttcttcaaacttcaaacttttccatcacatcaaaactttcctacacacataaacttccaacttttcacatcacatccttccaatttcaaccaaattttcaattttgacgttaactaaggctgtgtttagttggatccaaagtttggattttggtttaaattagagatgatgtgactgaaaagttgtgtctatatgacaggttgatgtgatagaaaatgactgaagtttggatctagacacagcttaaacatatgttgaatttaccactgagaatctcactgtcatgtccagacaaaattttcagtctcgccaaacaattaaacaaaaatacctgtagtgtactcctacgtaaataaatatccgagttagttggaagtgcacaaaaagcttggtttttctgtttctgttacagatataggaattaggaaagcattgcaaaagggattctcacatcacattatgccaatttgaagtaacatccttggtaaaaagatcagaaagtattctccagctattctatgtgaactagatatggcattaggtacaaataatcatgttgactttgcttcctccggctgcaattcttgcactgggatcctatggaagcaagcaagaaactctttgttcccttccgcgccctttatcggagattcaatccagcccttgttgcagaatccaaactgctctacgcctgaaattatcctatctagcacctgtgaccaatcaatggaatatgttggtactccgatcagaactcaagggaagaatcgtgaagtaaaatgaggcaacaatcagacactgctgaaatgggatcttttcaggatataatcaaaggatttgtttggggggtcttttcttgcttacaagtgaaactatttgtctggtggaatttcaggaataaacagcaaccttattttaaggaagtagctcattcctatattcaatgtgaagctttatgatggggacgcacaaaaaaggcagcaaatcatattacctctttatgaaccagagggtcccgaacaatcccaccacctcctacctgaacaggataaaaaggatttgctgttagtggcttgcttatttctatcactgtgcatgtatgaagagatctgaaggctatgaaagtgattatacattcttttccaattgatattcaatcaaaacgttcgaaaagaaaaactaagaccatttgtttgatacctgagatcgacgagcttcaaattgaggtttgataagtgtaatcaatgtcgagtctgtcttcattactttgactacagcaggcataaccttgatttcacaggtaacgtcagtgaacaatggatagcatgtgctttaataatttatcgaagctgctgatcttatcatcttatatttggaaaagattgcagaacatcaaaaacatcatgaacttgaactacataggtcagtaggagcatcggcagccatggacgccaaaagcacactattttttcccaatgcactattacttcagcaagatgagctaattgactatacaagaactctattgcaatgatactttttttttgctgggtcggccaaagattggccggccaatttcattaagattgagggaaaaaaagttttaaatacaacgatatgaaggatgtcgcgccggtctcaagcaatgatacttagatcattatgcgctaaatactaaacattgctgggaggacaatcaagcagcgtcggttttctaaggagaccttggaagagaaactacaaactagactaaatcatcttcattgcttaatgagaaaacaatgccatcgttatacaggctagacgtcacaaattaatctaaaccttcaactgctgcaaataacattctaaaccagataagacaatatctataagattactagatagaaactgtaactacatataagataacagccatctagtcaagcaaccatagttaagataacagggcacatgaatatacattcctgcatatgatatatgcagcatacaatatatagatgcatttaagtactggaagtctatgtagttgattgggtcaattttactgtatataccagacaactttacaagaacacacagatcatgatcctaagtatatcatactaaccatacaaatgaatagtacaaggaatgttttgtgcagaaacaccaactaaagaacagaacgatgtaaaataacccagtgtatttttcaataacatagggaaatggtattctcagttaagaaacagtgacatattataagagctctgctaaaaggacttgtgcaagtggacaatcatgcagacattaaaaaggcagcaccaaatcataccaagagaattgagatgaatgacagatccagggtcaccaagtcaaccagctgtggcagttcagtaagatatcttaaatttgtacgttcaattactgaaacacgttcatgcactcgaattttttcagccacctgaaatgaagtggagcatattatagttctgctgctgtaatcttgtaacaactacctgcagcttacaaataatgtgatagcggttagattaaaaataaacttttaagggagtagcgcaacctgtccatagccaacatcaacaccatatacatgtgatgccccatgttggagtaaacagtcagtaaaaccgccagtggataaccctgaatcaagggctaccttttcatcacagtcaataccaaattctttgatagccgcctcaagcttatgaccagctctgaatttgatcaggacagatgacacaattataaactggacaaactggagttacttttgtttgatagcaaagtaagccaatcagttcgagcatcacctacatacatattttggaatttcagccttgatttctatgatcgacttgtcagatacttgtgttccagctttattcacaacccttccatccacaaggaccttacctgaaatttgacataacagagaatgctttattaggtttgctttacatacaaaatatacttatgtacatggttaaaaagtcatagctgaaaggtgaagtgtgcaatttcctggtagatgtcatatgtggcaatagcatgagaaacacatttgagtacgcatatcatacaatctgttgcagtagggagaacttctataagcttttcactgatgaaattcaaaggggggaaggggcaaatttatggtgctaatattttctttgttccaaactcagttactttgatatatttgaatatgatgtaaagttatattgtaaaagtgccatgaaacatgagggcagataattgttgttaaataatgatacattaagcttaaggtggcataagtgtgcctctaatatagcttccccttagaagtgaacagttcatttcgatgtccactgatcttaggacaaaatatatatgatcaagtgtcacagaccattctcatatgtcaggaaagttgaataatcatgacatgattaaggcatgcattgagttttgcattatttggcatgacatgatagctgagattgccttttgaagcagtgttattaccatatgaagtataaagtgccaaaccaattcatagctgtaaagatctaaatgcataaaatcaatgaagtaaaggactaaccctgaagaatccatgattggatgtacgtcctgctatactgttgaaatctctcaaggcacacttcatccaatcgtcttttcctgagtaagaagaccaaaagtgacaacgttggttgaacaaactaattgcacgatacaaaataccatcacaataatgatattgagccattgccgctactttctttacggtaattgagtctctgatttaacaaaactaggatattgaccatttaactttaagaaacaaattgttagatttaaagagaatttcttacacttcacacttctaaataaaaacactggagtataacctctcaatgtggccacaccatgacagagcaggcaccgcacgactgttgtatgcacaatatcaacaactagtttgcgaatgaagaaacacacagaaaatagggaatctggaaccaaagcctacataagcagagccacataacattttgctatatgaaccaaagcttaagttactcggcactagatatgaactacccggcattacctaacacaagcacataaaagcagatttgaacaaagtaaaacaacagtgcagtgaaaaaataaataaattcagaggccttacttcttggcgagctgaagcttttgggttctcaccgccgcgaaatcccgggacggagagcagcaggtcggcctgaccccaatcagcctaactgagaaagcaaaagccacaccttaattaaccatttgaaagctctcttccagaaatcaagaaattggaggcagcacatgctacctagctcccctctcaacatcttcccaactacgcaaaacaaacacaccacaggttcagggatgaaaagggataaaccggttaactagtactcctattcaccacttgattccccaaccaatacaccctgcctgccctgttctttgtttccgatttctgtaagagccaggctatccacagataacaagaagaaagatttggtctcgcaactactagaacagaggaggctagcgagagaggaggaggaggagaagaaaagcaggagagagatgggaagagctcttacgctggtggaatcggagcctggaagccaccatcatcatcgcctcgcctcctcctcctcctcccgctccactccccctccgagccaaaaccctaatctcagttaccctatctcagttcgccgacgagatatatatatgctgtaggagaaggagaagcggcgcggatggcgggcggcggcggcggcggcggcgccccttctctcctctcgctcggtcctgagaagcgagagagagagagagagagttagaagatgtggtttggttcaaccacagccaggggcaaaaacgtccgaggaaaaaaatggatgaaaaatgttttgcaaacgtatggagaaaaatgatactaatatgttaacttcaaaagcaggtttcggtcaaatgctattatgagagtgagctttgttaaactgtcactctcaaccaagggctacatgccagaatgctactttggacaaattgcccctgtctcctccatccacctcctccaacgccgtggatgaagtgtacgacctccttccgctggccttcttcatctcaatggtttggaggacgatgacgacgaacacacggatccggttgaggatgtcgatgaggtcgcagatctggcgtcgccactgatgagcgcatggatctgtcgtcggcatagatgagcacataggtctactgtttgccgacaagagcgtagttctgtcggccgccaccgacgagcgtgtggatccatcgccacagttgatgagcgcgcggatgtaatggctgataacgataagcgggtaggtccaccggccaccgtcggtccgtcgccgatgagcgcacgagtttgctggtcgtcgctgccgagggcacggatcaaacgaccattgccaacgaccgcgtgggtcagcgcctcgccgtcgctgtgtcctcgtcacgatggaggtggagtatattcggacaatatagcgtgtagccttcggttgggagtggtattttaacgaagcccactcccaaaattgtatttgagtgaaactcatttttgaagatgacataatatcaattttcttaaatggaagaaacaatgaaaatgacaatgtagcgaatgccagcaggttgagagtggcattcaagcgaatctcaacgataacattctagcgaaaccggtttttaaggatgtcacatgtgaatttctcgctgtaggatggctgcatcccgataggtgggacccacatggcattggcgctgcgccattcgccaatcaagccaaacagcaagaagattcatcaactttagatagatgcactttacattcagacattcatagtcaaccatagaagattcatcaaatgtcagcagttgacagcatcacttaaccagcgctacatacactttacattctctgaattccaaattaatgcctttggagaaagaaattatttagacaatcaatggagacaaaatgattatattattattattatttctaatgttgctttgaattgccatcatgaacagaaattttaagcgaaggagctaaacagttgtttgttacagaatatcatcgactgagttcgccttgattgatagagtcagcatagcagattcatgtcttcagttgacaggatccttaaccatcatgacagatgacaaccacatactctgaattccaaatcgacgcctttcggcgaagaaaattgctcagacattaatcaaatgaaaggtagaaaaatatggtatattactcatgttgctctgaattgcaaccactggattaaaaatgaacaagaagttattcaaaaaacaaatctatctaccagcgtaatttacatgaacaggtgctcaaggtttaaaaacagaaaactccatatgttggtaaaagaaaattaaaagtacaaggccgggaggcaaacacaaactcctgtgttcgcagtggttcttctcatgctacaattagtacacaacatctctggacagggaaaccccactccaattcagacaaactcatgactcaaacaagccattcttgtagaagagagtccaatccgagtcgtcggacgacacgagctcgaatccttctgctctcattgactctgcaactgaaactgggtttgaagaaggcttactgtcattacacatttcaccaccaccaccactacaactgaactcaaccgatccaaagccacatgctgcagccgtttggtcgccacattcctgcaggcaagaagggatgactgactgaagctcggtatcgcgcaaagcctcttcattgccttgaaaaactggcccatcctcatcatcagaccaccacttgcagcagtccagatcacccatgtcaaacatcctgctaaccagcccttctcgccaagagatccgggggtccgcaaggaccggtttctgaaaacttgcactcttctcccccttcaattctatgccacaaggtgatctcttaaaagaggtcaagtctatggattccagagacattggagcacctgcaaactggaagctaaggtcaggcaatggtgcaggcaaggcaccatttccgcaataatcggcatccccgggccttggggacagagccatcatctcgagacattcgaccaccggatccattttcgtcaaagggcgactgcaagtcctcgtcagccctgagcacttgctgctccatgactcaccggagatcgctgtcggatcagctgccgagccatagctgcagctgcctggtccttgctgggaacacaaggacttcagtcctctagaggacagtgattgtgatgccctcttcacaatgagtgagaagggactaaggctgtcaccggtgcttggcgtcttctgcaggggaagaaatcctgatgacggtgtcgtctcggacaattccgatgccggcgtgccaaggtccaatagaccattgagcacaggtgagctcaacagccccgtggatttgggggagatttgccagaacgcatcctccaaagagcacctcgggacaaagatctcatcgccgagaagatccacgccgcgctcctcgcgcggcgacggtagccagttgacggatgcctcgttggtgcatttcgtcgagcacgttccgggcacctcccccgacggtgaggacagccagtggatcgacgccctggacgggtcggggtcgagctcctcgctcgccccttccccggcgatggccaggatgcccctgggccggcacttgcggcggtcggcgaccccaggcacgacgtggtgccccgccgcgaagcacgccggcgtggcggacccgcacgccagcacctcgggcgagatcgacgcgtggatcggcggcgtcgccccggacaccgccggcgtggcccccgcgtccgccttcctctgcggcgtcagggcctcgccaagaagcggcagccccctcggcggcggcgcatgcttcctcgccgtctccgtctccgccctccccctcgtcatcatcttctccaccacccgggtcctcgactcctgatccgcggccgccaccacccggcctcgccgcccgatctccgggcggggcttcttcaccttgggggacgccacgggggtcctcgacctggacccggacgacgcggacgacacgaggaacctgaagcacccgccccgcgcggcggaggcgtcaccggagttgagatcggtgagcgggctacggcgacgctggccgccaccaccagcaccagcgacagcattcttggcggtcttgggcgccgtcccgggggagggggacggggaaggggaggccctcctcctcggcttggacgcggaggaggcgggcgctggcttggacatcctcggcatcatggcggcggtgggtcagggggttggtggcggcggtggcggcggcggcggcgagggcattggggggatttggtttggtttggagaggagaggagagaatcgaggagatagccgttggaggaggagggttaagtgtcaaccgtcgtcagatggaggcattcaaagttggtgtaacggtaaaaggggagaggattcctcgccgaatttaactacgctagcacggtttactcgtgagtcgtgacacacaagatttacggcccaagcgaataaatcaaacagtatatttgtaaataaaaaatatttttttactaaaacttttatatatatttttagtaatataaaagtaaaggctgaaaaaataagcatcgatgaaaaaaaaaacctcaaaatcaacctcaaaaaatttaaattttagctaataagtataagtataagcgaaaagatgaaccctttaattattataaattacggagtagagtccggtttatttggttgataatgtaataatctttgatcgggatgaattactctgtgtctctgtgttaaacaggtctccacagtattttcggagtaaaatttattcgtgaaatctcaggtttttggagtacgataatacaaaagttgtaggctaaaatgtttcatgaaaccaagattaatgaatgtatcgtatacctcgtataatattttttaaaaaaaacaaattaccattataaaagtactccgtatttgttatttttctaaaatacatagcctgtgtttagttcacaccaaaattaaaagtttagttaaaattggaatgatgtgacgaaaaagttgaaagtttatatttataggaaagttttgatgtgggcgaactggccagctcaataagtacggtaattcgaaaatttttaagtgagcctattactcaatttagtgtttacgtgatatgtcacgtcaacgtcacgcattattcacatcaacaccatgtaggatttttcttgctaatttgaaaacagaattaaatgatattatttaataagttttgggacctatatctatattttattttagagtacaacgatataaatgacacggatgaataagtttaggaccgactgtataatttaccataacaaactcaggttatgcattaatcataactattattagaggatttgtgtaatttacttgatatttttttattgaatttcggttttctgaaagatcagcaagaattgttactgacaaccgacgcaccgtgctaaagaaagaggaaaaccattatcctcgagtgttgtgaacggatcgtgactttactcgtctatcaatgacaaggtcaaattgtacggtacgccattgttaaattgttttattccttaattatatgtctccattagattggtaaatgagtaatttgtctctactctctaggatctatgtgcactaacgtacgaagctaaggttgacatgatcccattatcacgtttataaagcatttttttaatgatattattgatctggaattcatgttatttcagaaagatgtggcggccgagatccaccaacttcactgaaaattatcgaaccacctacaatttcttttaccctaaaaaactttgatttttatattaattgaaaaaagtgccaaagaaataatgaacagaacttcaatttcagtcaaaattcccccccaaaagttctgaaccaaatttattttcttagtgttaaattatgtggccattttgacaacaaaagattatttttggtttaactatcttaattaacaaagtgtaattatccttaaaaaagacagcgtaattctacgaacattgaactccgtataattttttgcatcctttttcaccgggctcggcgaagcggcagccaattatttttaaggatcaatacattaacaagtaagactcttcacagtgctcctagctggagggttacctcgtttgtcagtgctcctagctagagggttacctcgtttgtcagctagttcaaaatctgatgtggatgaaaaaaaggtggcgggacccatatctttgctaaggaatgcatccctagctagggtacggtttcctcatgccaaaagggaaactgtgagtggtcccctcacatgcttgcgtgcatgggagggagagatggaagtgaaaagagagatgagtggggcctactaatatatataggtgggacccactaacatagatattgtctaagacacatgcattgtgaggtgtggttctctaaccggtttctagtctagctggaggccttgggctcctcaagtgcgctaccgcacttctactgccctaacaacaaacatggttgtgaagtagtatgaactactcccaagaaaaaaaggtaagtgtgtgctggtggaattatggcccaccagattttaaatttacatatacgggtactctttcaatatatattttgtaagatcagacacatgctacgaatctccaactttgtaagtgtgataagaggcggtcttcattaagtggtatatatactcctacattttgtgcaaccgaagaaaaaaaaactgggtcccctcgataaaaaaaggggaaaatatactgctccctccatcccaaaatataagaagttttagagttagacacggttattaagaaagtttgtagaagtgagtggtggagggttgtgattggatgagtagaggaggtatgtaggaaaaatgaatggtggagagctgtgattggttgggaatagaatgttggtggagaagttgttatattttaggacaaatcctgagggctaaaagttgttatattttaggacatgggagtactaagttgcagggctcgttgcagtctcaaattcaacaacaaaattttcaaaacagactaatttttaaaaattgaatcttcaggcagacccctccccacacactaccaacccctactatatgcggaattactattgggcgagtgatcgcccagggcgatcggatccggatccctctccctccacctggtttcctttttttggcaccgtattactttactattttagtaattttatgcacctaaagtttgtaaacctcaagtttacacatctaaagtttagaaacctaaagtttataagtcaaaagtttatatatccgattcaaatttgaatttgaattcaaatatttttatatatagtatttctatacatctaaagtttatatacccaaagtttataagtcaaaagtttacatacttgtttcaaatttgaatttgaattcaaatattagtttatagacccaaagtttataagtcaaaagtttacataatcatttcaaatttgaatttaaattcaatttttttaatatatagtagttgtatttctatacataaaatttttccaactttatttttttattttttaaatttgtatggtgtactgtattaggaagagaagaattgggggggggggggagagaaaaggggagagaaggtagcgtatagggagaggggtgggccggtgatcgctaggagcgatcacccccccattagccgtcccttactatatgtgctgagttcttttctttgggttcccattgcttaacggtgtgtttttttaaaaaggttttctatacggaagttgccttagaaaatcatattgatctatattttttaaaagctaatacttaattaatcacgtgctaatgaaccattccgttttccgtgcagagtaactccacctcccgaacacagcttaatcgggcttcttacaaaagtttactttttataaaacaattgcaagaaatgtgtttgcacaaatgaaatgatgaatgtaatttagcttcacaaatgaaattgcaagaagtgtgcctccgcatgtactgtgtttaaaagtaataatcaacgaagtgagcgtagcttaactggcaaggtttctcgtggtggaaccatttttctcgcgttcaagttctacatttgaaacatgggtactcgcatgtagatgagcgatatatgcccgtcgacatcgagacgcctatggtgatttcgtgaatctctacatatctcgtcccagtattttggagatgcttatagagataggatctgcatgtgtgcgtgcgtttataggggtgattatccaagaacgttcgtgtaattgtccgctcacgaacacgtaattatcatggtagttattgtgattaaatttttttatgcgaaggatagtgtgattatcattcccttttttgagcagattttattttgcatggatttttggaagtgattaatatttctttcatcgaaagtggattagcgtttctgtttcacatcttatgtttaacatttttagacatgattttcttaacatattagcagctctatattcacaaagccggaccaaatttaacgaaactttatgttaaaattattactatctacttaaattgccaaactttatactcaaaaactttcgacagcaacgaaaaagactttacgcacgtaaactttatgttaaaaagtcatattaaactttctactcatagactttacacatatataaactttgcacgtacgattaaacattcggtatgggtagtttatacatagaaatatgaattataggaactctatatataaatttttagtatagaaaatttaaacatagaaatcattcaaattggaaaaaacaaagtttttgtttggatatgatggacattattataatttagtatttcaaaattatggtttatttcttatagtgaatatggtgagataatgcttttttaggttttttaaataataaataatctgcccgcgcaactgcgcgggctttcttcctagttcatttaaaaaatattgtgtaatcagcatctttattatcggtaaatctaattggagaggcctctccaattatatgaagtataggaacgggaccacctatacatttgtcgacaaattttcttctaaaaatttgacagatgtaattatagtacaatcatagtgtaattacactgtaacttatatgtaattacaccgtaatttgcatgtaactacagtgtaacttatatgtaagtttcacataatcttgaatcgttagatctattacaagatttgttttggtgaggaagaaaacaaatcatagcacacacatatgtgaaaaaatttgttcccacgacctccattttaccgaaataacatgttacggagagatttttgaaagttacatacaagttacactatagttacaatgtaattacatgcaagttacagtgtaattacactacgattgtactgtaattatatctgtcaaatttttggggaaaaaattatcgacagatatatagctaaatcgtagatgaaagattagaagttgggcttagaaaattcaaaaggggagtacctatacatctttcgaaagatttttataatcgtatcacacagatttttaatctttgtattaaaatccgatagatataataaaaagcaaaaagcaattaagaaacaccataatgaacattaaattaccatatcctcaagaaaaagaccaaatccaatacaaaatttaaaatttacatgtgaagattcaaaaattacagtgtaacttacaaaagttacagtgtaagtttcataaattacactgtaacttacaagaaaatacactgtaaatttaagtgagaaaatcgagtgagagataagaaaaaatctttcgagtgagatatagcaaaatcgattcaaaagagaacgtcatccatctgacccatcaagcccatatgaatcagacccatgttttttacgcagtgcagggggcgccgtctctggctaatcctggccttccttgtccgattcggattttcggacgcgtaaacggcagcatctcggatccgattccatcccatcaaaattcccttgtccgatttctattccgcgcgacgctttcccgccatataagggtgccatccatcacgcctccagcaaattacagcagccagagttgagaagcgcaacctaattgcgagcagctagcgagcgagctcgatcgcctcgatctcctcgccttctcggcatggcgatcgagttcttgccgaagctggcgtcctgcttccggccgccgtcgtcgtcgtcgtcgtcgttgtcggcggcggcggcgaggcgaggacggcgccaggaggcggcggctcgccgtcgcccagacaaggcggagaagaggcggtgggtggacgagcaggtggggcttcacctggcggcgagggtttgggacggctacggctacggcgccggctacggcaagggcggcgccgtcgacgtgagccgctacggcgacatcggcctggaggcggcgctgggctacgagttcgagcggaggtggtggttcgccgagatggcgcgcctgctcgccttggtcgacgaggacgacgcggcggcggcggcggcaggcaacagcggcgacaacacgccggcggcgaagggtgtgtctggaagtagtagtaattaattagttggttcgtccagctattgggtgtctctctctggaggcctaatatgttgttgttaatagtgttcatcttttaggtttctgtcagtatatattttgcagtgttcaattgttcatagttctgtaaaaaaataaaagttgtacgagactacgagtacacttttccaaagcggaactgctatccgactgtcgacagtttttacgagcgaaaactgtcaaattttttagccattgattccgctctaagatttgtgctaagatattttgctatcggatctaaaccctcttttcacaagctagtcccatcatcacatgtttatggcagatttgttctagttatatctaagttacatgctagttcaattgtagttacattgtaactatagtgtaactacactctaactacattgttatctctatataaattagatataaagttgcatatattattttaatacatatatacaagttattattattatagtatagttctaggaaaattatatactatatagttagatttgaaggtttttttaaaaaaaaaacactcgacggtttttcagctaatccctttccaaagtacgtatactatgaacagtcccttgttaactataaaaactggaataacagaaaacgaatttaacaaccacacacacatatatatatcgatgactaatactcaattatagtggaaaaactaaacatacgagctagaacttacaaaaaactgaagatgcgatcgggtccgtgtcgctcggagcctcaggagtttaacttcataatgtaattggggtgatatggcttagtgagagaagtgaaaaataacattaaatgttttcactgaggttgagcttagcctagaaacaagtaataagttcactattcccagaaacaattttcacatagcccttagcccctattctaaactacacttgcatgaaaacaatttgatttagttcatcgggcgaggggggatcaagaaccacacgtgataatcatgtataggatagttgcccatgtaacacatgatttttatagctaggtgactttcttaagaggccgctcatgataatgcaactcttttcatggcccattgtttgctgggtggtggctcatagttcattgggccatggtccaccacacaatggtcgtggcctatagtctatttattgggccttagctcaccatatgctaggtcgtggcgcacagtcatcgagtaaggtatttgccataagctaggccatggcatacaattatgcttggcctcggcccactaaatgttaggtcatgttgttctgttcctcggaccataccctattatatgttgagcctccagttatttgtgacaaaataagtagttggtaatggtttaccaccttagtgtgtgagaaaccacaaattacttcacgtcgtacccacaccatcaggttgtccacatagcggcactgaagtagccgattcttgatggttttggtttgatgagtgatagtctagagcatcactaatttatggcaatggaaaaattgtctaccatttattatgatggaggcagccttttgtcagataaggtgatcctagatggagcttttgcactggaaatctttcatcacaagatagtcacataatacgatttgtgacggaatttcgctatttctagcttgatgcaagtaccttgttaaggaagactagaaccagtgtagtgttatatcaatcctctcttcatatacaatcccttttaagtgttttcttctccatgctttctccaaatcccttatgttcccatacggtactttcatgatttgtatcatttgtttgcaccttttttctcttatagcagagttcttcacacccattttatttttgttccttgtcttcatcctaacccttctttataactcctcttcttccacatctgatcccttttctactacctctacttattattttgcttttgcaagccactgcattattgttgctgtttcctctccttcccccttggcatgcttagttctcatctcagtctcaaaaagtgcagattgtgcatgttctcttgctacatcttcctcaccctctcccagagaaatattactcgctacatctgttgcagctaaatactattacctccatattttaatgtatgacgccgttgactttttatccaatgtttgaccattcgtcctattcaaaaaatttatgcaattgccatttattttattgtgactagattcatcatcaaatgttttttaaacatgatataaatattttcatatttgcacaaaaattttgaataaaacgaatggtcaaacgttaatcgaaaagtcaacggcgtcatatattaaaatacggagggagtacatgatttatctactgattgaaaaaaatgagggtacaatgacaatcagtcctctgcgtcctgttccctatcatccttgccattcacgaacatagctctacacaacgtggacgtgtttccttcatcgatgaatcccctccaatctgaaagcatctcgccaatgatttgcctcatggcgcgttaattagtttgcccgggatcatgtcggtaaaatagatgtttggtgtctgcaaaatcatgctggaattcagaccgacatagaaaagctttccattccctacttacgatggtctgctggcttatttgtgataaagaaacacaagaattaatgtaatttgtaattgatcactagtgcggaataggtcatctatgtcgaacgggaactctcatatgtgttggtgagcgacttattcacggattattagtcagtgatgcgaaaattcatctgtgtcgggccaacaggagttatcgatagctgtcatcttaatttgtcgaatctaaataaaagactgtcatcgactagatttgaccagtcaaacaagccatcctataaaccatcacggacatgatactttggcctttccataagattggttggactcatcataagatttagttgggcttcacagacatgatgcgcttcccataagatttggaccatttggttggcctcctcttcgatcaacccggctaaaataactggataaaaataaggaggagaagaagattctaggggctagctacagctgggctcagaagatactgttcttttctctctgagcatgcaatcccttttctcctttgaacatgatacgtttagttccatttaaggcttctcttcttgaactcccagcaaacggtgatgctgtttaaatttatatataaaggctgtgctagctgtttagtttgtttacaactaccaagttatagtctggtggtcatatttccttccatccatacaaaacggattcaactaccaggtaattaagcaggtagtagctagtcaatattgaatccctgtttcacattataacatattttaggttttgaatagattcatgtatataaatccatatatgtgctctttatatatatatatatatatatatatatatatatatatatatatatatatatatatatatatccaaattcatatggatactagtggatctagatgatggaaagaccaaaacatcaagggattagtatgtactagtcattaattaaaactcatacatcgttggcgtatattttatttcttcatacttaatgtaatctagtatacagtgacaaacgctcctaagctggtactctaataaattagagacatatctaagaaattctaagaaaaaacaaaacgtctagccctgattttcacttaatataataaacctattattttacaccattagatttattttaaatgaaaaaaatactatctccctaaaatcctctccggctcccctgcctcatgggcatgagggtatcctctcctcctcactacaagtacttacatatatgtacgtcccttcctctcacatcctctctcttactcgtcacttctatcatccaattttctagataacaaataataatgattagataactaaataattatattttttacaacatattctatatatctatattggccatgttttgatatataagaaatacatcatttgatacaaactcctataaatagcaaaaaattaataacatatactatcatgtcatccaaataatttcatgttccctctctccttgctcactttggcctccttattttctagctagcaaatactacatccgtcctaaaatatactccatctatcctataatataagtaattttggatggatatgacacgtcctagtataatgaatatgtccagattcattgtactaggatgtgtcacatccatctaaaatcccttatattatgggacggatggagtagcaactcagaactggatgagacgtatcttagtccaacgaatctagacagtcccttatctagattcattggactaggatatgtcccatccagtcccaaattgctatattttgggacggagggagtaataaatatccattaaatattgtgtatataataaaagtccattaaacattatcttccatgctcttaacccaccacatggtacatataataaattagaaaattgtattagaaattctgagaacaaaaacgaaaatcaacttagcatactctcacttaaatcggtgaactcattacttttaaccacccatgcccctcccactcgcatgcgcatgaggtgcacacggcccctgcttctccctctacctcatgctctctcctccttccttaattttatatactaaaacgatcacaattttcaagctataaaatctcattcctaatctagaaataaaatattgaaaaaaatgacatcatatattgagtcatcatatattattctacaaacatacatacccaaattaaatctacattatccaaataaaattacaaattcaaatattaaataatattttattgagggacaacatctcaaccctttcatatgtcatgcgatttaacataaaagtataaaacaatttaataacacaggttgccccatcatacatagttttcaaacatttattactaattagatatagaattaataagtatgaataatccaagtcccaatacaattattcctatatttttatctactcccagtatatttatcctctactttcacaaatcccgatgaaatgattactaaaaataaacttatttagaaacaaatggggatgtgccaaaataaagttattatacgatagagggagtaattgctctaaaatatattctatgttactatctaatcgactttagaattaagctatttagtgtagcttcagaataattatgtaaacaatgttgttgagcagtattttggaaaaatcctaccttttaatcattggataaataatttggttgattatctacccgtataaacgtagcgtaaaatacatgcccgtgtattcgcacgggctacctttctactccctccgggttaataatacttgttgttttggacaaggatatgttctctaaaaaataactttgaccattatttttcattataatatgtataaaaatattaacaaatatatgatcttattaaagtactttttaagactaatatatatatatatatatatatatatatatatatgtagtcaccatatttgatagacaaatattttaaaaataattcataattaaatattttaaagtttgacctcacctttttctaaaacgagtattatcagccctgaaggagtagttgtttgcttaaagtatggatagaaatgcgctcagacaattctctgcatatataaaatgttcagtgtaagtatatatatatatatatgtgtgtgtgtgtatccttctcccaatatttgctatcaagaacctacaaaaagatatatagtccaacgagctacatgatgacaaacagtacatatgtagtatatatcactagtaattccagtgcatctgtaccaacattaattaattcagcagaaggagcagtacataacagacacaagctgtaaaaatggacggacggctctttgaagccgcaaagtcaggcgattgcaggttgatgaaggagctggtggctgccatggatccaagcatattgctccgcacaactcctcaggggaacacctgcctccacatatccactatcaatggtcatgaggaattctgccaggaggtgttgatgttagacaattctcttctcaccgttgcaaactcacacggcgagacgccgctgctcaccgcggtaaccaacggccgcaccgccttggcctccgttttgctcagacggtgctgcgaagcggggctcagagaagctatcttgaaacaagatgagaatggatgtaatgccctgcaccatgccattcgcaacggccacagggaccttgcgttggaactgatagcagcagaagcaggcctgtcacaaggtgtaaacaagtacagggaatcacccatgtacatcgctgtgatgagagatttcactgatatcttccggaaactgttggggattcctggttctgctcacgtgggttgtcatggccgcaatgctctccatgccgccgtgagaaacgggaatccaggtaagaattgcatactaggctgtctgacgagtcattaataattactccattattcgttaaaatgaccacaggcaggtgattcttgcatatatcattaaatttgttttcagttattgctaaagagttagtggagaagcgtccagggctggctagagaattcgacgatgaaatggatactccaatgcatcatgccgcaatgtggggtaaaacccatgttctcggagcattgctgcagtatgattggtccttggggtatgtcctaagtaataataaggacagtgtcccgctccttaattccgccgcataccgtggctatgttagtgttgctagagagcttgtgcatcattgtccagatgctccgtattacgacgctaatggttgcacatgtctccatcaagccgcattcaaaggtcatctggagttcgtggaatttatcctagagtcgccgtatcttcggaaactcgtcaacatgcgagataacggcgggaacactgctctgcattacgcggtgcaggattgcaacccaagaattgttgccgctcttttgtcccatggagacacggacgtcacggtacttaactacacgggaaacgaagcagtttggcaattagggggagccgccgattatgccaagacattaaattgggtacgtccttaattactcataccgtgctcctctacttaatttacttgatgaagcatgaacatatataggccgtgtttagttcacccccaactatcctaaacttctaacttttttcaggaactaaacacagccatattgcgctcttacacaacttaccatgcattacatggactgttactattgttactataagtattaaaaaataatcacatgataaatttacatatcattcatatctatctattatctattatatactaaaagtctattaaacttcctacaaaggctcttaaaccaccacgtggcactcctaaaaatgctctcaagccgccacatggcacagtctaatcttaccgtcgaatttcaattaaattggtggaacccattattttacagactagattagatttatatcttaactaattaaaagattagtatttttccgttcgtcatcccctctattcgtccgaattttcgcccatccctcaaatcccaatccgatttcgattttgtttctgtcgtccatctgtgaaaaaagtgtgaaaaaaaaatcaagtctttccgattccacaaaagaaggaaacaaactcaagcgaagttttcgtccgcaacatctgagttgagagtccaacacaaagaaaaataaatcatccagagtgcgcatcaacaacctaatgcccgagcgatccaacgaaacttcattgcaaatgtagatacaaaatccaataggacaatctagtaaaagagaaaacaaaataaaaacttcaccgaaagccgatgacgccgacgttgccgccggattcgctgccgctgtcgtagccatcggatttccggcgcgggaagccgccatcgccgccggatcggcccgcgaaccggatctagacgcgggtagccgccggcgccgtcggtaccaccggatctgccgtgggaagcagccgccgccgtcgttgccatctgatctgccgcgggacgccgccgctgctagattgggctacgagaagctgccgccgtcgtcggcgctgtcgactccactgcggaaagccgccgccacagccggatcgggccgagggaagcagtcggttccgtcggtgccgccggatctagccggcggtacccgccgcactcgacccctctctctccttatccactcaaatggagttgtgccgtcattgtctttgcgtcatgccggcgagacaggagggagaggaggagacggactggcgacaccggtggggagggggagtggg

SEQ ID NO: 66981 - DNA, 20053 bp, Oryza sativa
  unsure (1)..(20053): unsure at all n locations
ataggaatatagcttagatgacattctcttatcatatagcatgcagcaacgaaaagcacgcatcaagaaatttaaaaaaaaactgatatgtgtatagcaaacttgatgaagcaagatgaaagtgcatataggacccctaattattttggtgttaatgacaataaaaaagagggttactaatgaagtttgttgagatgttgcaaggttcaaagtgatcagttgttgattcaaatgaaacatatagtctccatttagcatcggcattttattttaaattgccttttcaatcccctctagtctctgaagaccctttcacaataaaaggaaaaaaaaactatttcaaccctccctccaccccccccccccccccaaaaaaaaccattacatatgagttccaaagtaacaagtcaattttaaatggaaaaaaacaaattacctcttgaactattgccataaaagtgccacgtggcagcttaggagcgattttaggaggctcacgtggcggcttgagagtgtttatagggagtttaatggacttttaatatataatagatttcggagtctctgtatcatcggatactctgatcacatcggatagtctgatctgaaaatcactcaagagaaataaaaagcaattcaagacagagagtgaagttctgagaaagttcagacaatccgatgtatcggacaatccaaccttatatcggatagtccgatattttttagccaatactcagaccaaagacacagagcaaagttctgtgaaatatcggatagtctgatcaagatcggatagtccgacaggagaaaaaaggaacacttcaaatacaggattttgagcactagtgttctaccaattatatgcatgtggtatccctcttaatagtacggcatcctaatactcaagaacacaatatatacatggattagaagacaattaccacaaaagatgccgcaatgcttttaaactcaagttccactcctttttatccttgcatccatctcaacaaagagcattagtgaacctctaattgtgttgatattaacaccaaaataaatgaggggtcctagatgcactttcaggttttatgtttttaattggattcatttaattcttttttgattcattgtgtaattccccttagttgaatttgtttatgtgattggttttctcttaggttagatcgaaagaggctagagataagagggtgaatggaagaatttagaggtgagtactgatttagcctataaaaagtctaggctttttctcttttcttttcttaataaactctctcttcaccattaatttggctaaaatttacaccgttacaattacttcatcttaggtagatatttcactaaataaactactacaacaacgtgcaattctataaaaaaaactcaaatattatccgtctctcccgtcatatacttatattgatttagaatccacggatggaagcacgtatttcacaagctcagttaccgataaagttatagccaagagaatcatcatgtaatatattatataaatctttctaaaacatctacttcaatgctaaatcaaaaaccatagttttcaccaaaacatataaaacatcttcccaaaaatttacttacattttaattcgaaaaccaaaattttaaaaatgaagggaaaaaaatagaatagaaatgacttgaaattgctggcacatgtccccctcctccttccctccatccttctctctcctcctctccacctctcctctttttacctacacaccctcttctctccaccccctctctctctctcctctcctctcccctcccctctctctcctcgcgctgcgctccccggccgaggcgcggcgagccagcgagccagccagccacctcctccgcgcgcgcgcgcctcgccggcgtgcaaggcccgagctcgagcgccccctctcccgcggcctggccctcctcgtcgcgcgacacgcgcgcgcgcgctctctcacggccggcgagcagtgtcggagccagcgccatccagccagcgcgtgggtgggttgggggcgcgtcgcggtgtgctcgccggccggcctcgttcccgccgcccgtccatccgtctcggggtcgaatcgaatttgaaggtgactctcgcttctttcttccggttcttgatttctttctttcttggtttctttgatttcttgaattggagggagatccattgggggtctcgggttgattccttctcccgcaccgattaacggagattagcccatccgggtttgatttgatgcgtgtgggggtggtgctgttctaatcggagtttgttggcgaaccaaaaatgatttctcccttttttttttcttcttttaattttttttggggggttcaggatgccccacgttaggtccgccgccgtgaagctgatggaggagcagctggattcatcggagatggacatggacgagcccggcggcgccgcggcggcggcggcggatgccaataatggcgccgggtccaaggactgccccttgccgccgccgccgcccaagaccgccaaggcttgcgccgccgccaagaagccgagatcggtgagctccgacttcggcgaggagctggacctggagcagctcggtgccaagcagcagcagcagcagcaggagaggaagctgtcgaggcaggaccgcgtcgagctgagccgctcgttccagcacgcggtgagctcccacgactgggatggcgcggaggcgctggtgcggagggccgacgcgcaggggctcaacgacgtgctctgcgtcgccgtcgacgccatctggttcctcagcgacaaggaggagctcgccgccgtcgtggccctgatccggaggatcgtgtcggagggcgccaacgacttcacccgcgccgcgctccggacgtcgttcctcgcgtcgtgcgtgtcggcgtgcagggggagaacgaccagcctcgccgacgctgtgagcttcatggggcaaaagtaagcctgtccaaaacatgaattgcatgttttgcgaccgcgaaacttcgaatcgaattcgggaattcgattcgcctttatgctttgtatttgaaactagcctgatacaattgtggtgattgtaatgatttgtttatgtatttatcaggttgaacgagcgccttcaagaatcccatggcgacgaggtattgaaggcagaagcaagcgcaaaggtgcacaagttcacagagtgggctctaaagtgtatcgggctgcattcgcgtgtgcgggagaacaagggcagaggaaaccatggcacgatcattgaggtccaacttcagctgtctgctttcaagacatttctggatcttgccgataatgatcttactgggaaggatttcacggaggcctttgacgcggcatgttttcctcttacactcttctcaaacacctttgaccaaggttgggcatcaggtatctcggcagctgcaatacaaggactcttagagttgttagtagagggtggtgccgataatgtgaaccagtgctttcttgaggctgctcgctatggaagcactgaactcgtgcgcatcttacttcaggtaataataaaaacaataattcacatgtgaatcttatttcagttaataataaatattagttgtactatttaggttaatgactcctactgagcaaacaatataaatgcagcacaactaagtggttcttaatagcctgcaccacacattggtccccatgataaccaggtcatgaatatatgaatatggaaactatgtagagctaccacctttgctattaattcagaactttgttccttttgactggaaattgatcttttttttttctctatggagctttactgctcatgtttgaattatacttggtgtaaccgtcttcaaccttcatgccttcgaacctaccttaacctattactatactttccaaatttctggagatccatataatctgttacatagagtagctgggggactgttttctgctgacttgcttcatccagattcattacgacataactatagtatacatgaaaaatctggtgaattgtataattctccccttagagaagctcataaattttggggtggtcattaatctcactggagatacatagagaatccccaatcaaagggaaaaaatggtgtgatcaatctattcgtgatggaagactttcctgaactgcgctgattgatcaggtcctaaaataggttaatatattggagttgttttgactttagacagctggtgcacagatgggtttcctttgtaattcatctctactttgggcagcaattggaccaattccattgtaggtgcactatgcatgtatttagtcatgcaaaaaaaaaaagaacaatgttttgccatgcaccttttcatggttagaccatcactcaaatatggcagttctcgaatttaattgagttagataacaattgattatttgatatatttacaaatgttttcctgtctgaaaaatgtacaggcattataggtcttgtgaaatagaagctactcaggctgtttgaggaatttttttcctttttatttcatactttctgatattttgtctgttggtgcaaatatatcatgaaacattagcagcgttctaacatatctgttgtttgtatcttttttttagattgctcgaaggaatagcttggacatcgatgtggatctagcccttggctttgctgctcactatgggaaactggataccatggggtgcttagttgaggagggtaatgcggttgcctttcttggccctttaatgcgggcagctgaacggggatgccttcaagttgttgaatggttcgtcaaccttggttgtcgggatatggagctttgcttagcccttactgctgcaacctctagtagccaggttgcagttgcagcctatcttctccctctagtcccaaagcatgttcttgcacccctcagcgtcgaaattctcaaggctgctggtgagaggagcaccggttccctgcatggtgtggacttccttctccgctcaaacttcctcaatgacccagctgccacatatgctgtagcagacaacattgcaaaatctgccgatgaggcagtggatgcaaagcttagatctttcatgctcgagcattggtcagaggcagctttttctgagggattcgcgtctgcgcaagagcacttcgttaacttcatgaggataatggaaaagggtgagtcgccgatctgcctgagggacctcccacttgagctggtgattgccatggcctacctaccactgtacagggaatgcgtggagtcaggtgggcggctattgccgcagaagctgagagggcagcttgttgaggcggctggtagactcgagggccggcaactcgacagggctagccaaggcacagagctcctggccatcttggagcaccacctcccgtgtttcatgatccagacttgaaaggtcagcttccacatgatctgcattggtcgctgcaagaagcaaagtaacaagggcaatgcaccatcttcagtgttttccagtgctgtcatgttcctgcttggggacaatcatctgaaacgatggcaccttgaggtctctgagagcatagtgactgaagaactctcctgctggcgctgttcggagagtatataattttggggagaaaatggtgtgtaccttcttgtcgagccaagtgttgagtagatcttattgggatcataatcttgatgaaaatgatataagcattgagcaaagtgttctccagttttttctgagtgctagccatgggcgtcatgtttttgttttggactaatgagtttttgaacatggactagtctcatctttcttggcttcacaaacataaaaatgaatggacagtaagtatatgctttatatgcgttgatgatgccttgattgagacgcgagacaggaagtatagttttatactagtatattgatcttgctgctgtttcttgtcaattgatttttccttttgtttgaatgcttccaaacatcggattatcaagcatcatccatggctacgcggccataccatgagctgtgacatgccagctcaaaatgttcaatctgccaaatgtcacccctggtgatctctgattgaaaaaaaccctgaaaattgtttattttccaactagaaaattctctggtgattcctaaattgttctgcatgaacatgattgcagcctgtttgtgtctggtgatttaccacagggcaggcactgtgtcgttctgatggtttcagggcatcatcaatttggatgttgcaaccatgaaaaccagcaagttaatactcctatgtcaggcatcagacctggaccctagattggtcaggcataaatgttcttgtttagtactagtaactactcctatgtcaggtatcataattccaagggccaattgaacaaaaaataatagacttgatgaatttacatttgagtagcaaagtccaacttttgccataggggaaagcaagcagtgcatctcatcatttttttagtgtattgaatgaatatgaatggtgttctagaggaatatcccttaaaaatgagaaatgaagttaacaaatacttagaaaagcagggaagaaaatggtggttcttgtcaaacttcagagattttttttctttatattggttcaagccttttagttcacaaacaaaaggagaaaaaatatttttgaaggtgcatatgatgtgacatgatattcctttttcagtgcacaagggggtgcgcacaccactaatcatggtgttattctgtagttctactgctaacgaatcaagcatgtgccacatgtcccatgatctggcaattttttagtgtcaagggggataagaatatgttctctggttctatttcacagagagatattataatttaataagaataatgagtgtaaaggaaaacataaagttatataagttctcctaattgaccttaataatagtggattggcgaaagctcattttaggtctctgatctatggttaagtttaaatcgcttaccaggttttgcagttgagggacgtggtttaaactcgatccttggtgagggacccaaagtaaacttttttctatgggattgatgttatgatttcggcccatagggtattgaggcccaacaggtgatagtctgtaaccggaattttggcccattaggcacagcataaaattgtcagctgctctagacatgaccaacacacagtctgcccttactccctaattctctggttccctgatgattttcagaacactgaagccaattaggtgtggcttgactggagaaatattgctttgtcgatttgagatctgaagttcagtgtccagtctccatgtgaagacatgctgaaaatgagttattcgtccattcttcagttaaagtttataagttactccttccgtttcaaaatgtttgacaccgttgacttttaagcacatgtttgaccgttcgtcttattaaaataatttgtgaaatatgtaaaactatatgtgtacatgaaagtatatttaacaatgaatcaaatgatatgaaaaaaataaataattacttaaattttttgaataagacgaatggtcaaacacatactaaaaagtcaacggtgtgaaacattttgaaacggagggagtataagtattcttgtcaactgatattcagttattccaatgatagagggtagaacctcgaagtaaaaccgcattattgcaatgtattgggggtgaaagttatattcatgaactgtcagtatcagggcataattttgagtgttgatattggcacggtagaacgggatttgcaactgaaattatccaattctctttgtgattttatcggtgaaagtctaaactatcatggacttcactctgcataataccctacttaaaattgtcttatctcaaaaaagatacttcagttgcttagtagtgatcaattgcctctgatagcgttcatcgaccgaatctgcagctacatgtttttttaggacagaagtttcttctaaaatgtgtgctttcttaggcttcaattttcacatggattgtatttcagactacttatatgataatgacaggaaggaaatggaagacaaccatgcaagcttgggtaacaatgctcctacatgggcttatttgttattggaaaaaaatatttagtgatttacacttcaatatctgatcatctgaaagctaaattagtaatgaataaaaggtatttgactaggtaagcgaacctattctgttcaaacattagtaaaaacatggacacaaacattgttaactgatgacctatagactgccattctaatgcagcatgggcataaacattgtttactgatgacttagtctgccattctacttcacatataacttaggaaacttacatcgccgccctatccggattattttgtatgcatttctagggtcaaccgaagaataccgtcgcttgcgaagaactcaaaacaatgcccattctcaggtggagactttccagtacagctggagaatttgatcacttaaaagattgatcctttgacagaaaaaaaaaacctgcaaattttttttgtcaggtaaggtaatcacaccagaattcccaaattcagagtttcagaccagtaacatatgtaacctctaaacttcagcattcaaaatctgtctggaaagtgatgttttacagcttgcttcgtcgcgctcatcttatgtcgaatacaaaaccaaaaccaaaataacaaaaacaaaaataaattcccctaggagatgtatttacaagtaagaggaagccatgctccgcacatccgttggcatgaaggccagcacaaccagcaggatgagcaggcagactggcagcagcagcagcagcgatggcggcggaggcaatgggggaagcaccaatggaagtatgagcaatgacatggtgaggaagacgagcacgaggaacgcctcgatactgaagtaattcgatgtcgcggcggtcttcttctcggcagcatttggctgatgctgatgctgcagatgcctctttgaaccgtttggtctgggtatcagagggttcctcctctgcctagcacctacaccttccattgcaacaaaccccaaattcggctagatgttttgatctgtgattttgtctagatcagttggcaatccaagaactgagatgtgtatgagagttcttgtgatttctgatcagatctgaagtctctgttgcagacttgcccatcatctgaactgcaggcaaagtgacaacatctgaagaaaaaaagaaaagaaaaaccctttttagagttaacaatcatcatcctaataccaaatacacccatctgaaattatcaagaaaggcaagtaaaaagttcatgcctttccccccaacaattcaaagaaactgactaaccctaacaaagactaaattaggctgcaaaacaaaaaaaacatcaagaaaccgataccttcgatcctgaacttggcattgctcccatgtccggacttcgcgtctctcccaagaacgccctttctcgctccacccaacaagccaagaactcctctcctccctcaaaacccacaacacccccaaccaagaagcaaatcaagaactgcacagcccaagaactccaagcggcagggtcgcaaagatgtcgtcgcaggaggaggaagaagaagaagaagaggacgaagaggtggatcctcccctgatggcgaagcagaagatatcctcgaccctttcggtgatgttgcggtgatgaggaggaggaaagattagcatggtgacagggaaggtggagccgattttatgagtggggtggggtttggcttggcttcaaatcatgggaggtggaggaagaacacaagagaggggaaggggggctggatgcaatgcatcaaggaccaacttgtggggggcaaccccatgccatgcttacaagtggaggacgacgagtagggccccccaatagtccctactcctgcaattggaactaatagtactttatatgctatctgttttactccctccgtcccataatataagggcccctttgaatcaaagggtttatataggaatttcataggatttaaatcctataggatttttttatatttggtcctttgattcaaaggattgaagctttccaaatcctatgaaattcctatggaatggcacattgcatgtgaattttagaggaaatttagcaagagatccaacctcttggaaaatttcctttgagtctatctctctcatccgattcctgcgtttttcctacgctccaatcaaacgaccattcctgtgtttttcctgtgttttgcaattctctgttttacacttcaattcctgtcaaaatcctgtgtttttcctattcatctatttttttctaccctgcgattcaaaggggccctaaggtattttgagtttttgtttgcaacgtttgaccactcgtcttattcaaaaaattttgaaattattatttattttatttgtgacttactttattatctacagtactttaaacacaactttttgttttttatatttgcaaaaaaaaaataagacaantgnncnnnnntngcaatcaaaaactcaaaatcccttatattgtgggacggagggagtatatcataagtcgtttgattttttttcttagttaaatttgtttaattttgattaagtttgtagaaaaatatactaaaattttcaatacaaaataaatatattatcaaattatattcaatgttaaaattaatgaaactaaatgttataaatgccgctaattttttctatgaacttggtcgatcctaaagaacattaactaagaaaaatgtcaaatggctcataatatgaaatggatggagtaattgattatttagggttctttgttggggtttgatttaccctaattgccattatcatttgtctctccttgttttttttttggcctctttgctaatgtggatttctttttgaggttctgcgttgttcggctgaactccagatccccagatgcacattgatctagagtgtgtgttggttaaattataatagtataaaattttatattttctctatgaataaaataaattatccaaatgttatgaatataatcaaaattttggacctatagatttgtacagcttgaaatgcatatcttaaagaaaatactagattaaatagacgttagatgtgtagtaaagtgctgtggtgttcatttgaggtgtatggtaaaggttctttttactagttttttttaattcgtctttttactagcttctcgtttaaagtggtttatggggtcttgaatgcagaccttttactgttatctttttaaaaaagtgtgttactaaaagttattggaggtatcatgatgtgagctcttttcttttaccgagaaatctggtaatatcattttgaacatgacaaacccgaataattggatgggtatgtatggacggcacatattctaaaacgtcactagcaaaaaaataaaataaaataaaataaataaaaacttgtcgactgccttaagtcttgtttagaataattatgctctttccaaaggctagcctttggtggatatcgattagaaaaaaacagacggtttaggaatatctatacattttctgatatttggtatgttaggattgacctggtatttggttcatagttaaatacagtgacaatgtatgtaaactacttttagtatctcctcttctagaaagtattataatatgcttgttgtaatgatccattttggcagttgatgattaagaatcaaagctctctccaagagacaaactttgacaaagaggactggttggtaagattggctcgactgttcttcaactagatatacagaagtctgtatacattgtcactgtatttaactagtattaattatcctgacgaggatccgtcaggcaaattaaaatttcgctgacaagccagtcttgacgggatttccctgacggtacaaagtcaggacgtattttcctaacgtgataatggattttctcgacggtttttggctgtcagaagtaatctggtttttggtagtgactacataaatctacaaccattgtttattttctaaaactattttatgataatgctgcattttttcctggataatatttttgtgctaaaatagctagtcaatattagattttaaataacaaatagtctagtcctctgcacttgtatatgtacatgcagtaaagtaattcatatttcctaataaagtaaaatcaaattaatcaagccctttagtttgcattttggtcacaagtattgggtcccttattagagtgtggtggtgatattcttccaagcacttttgaaaagggagaggtgttgctgttcaagggttcttctcccctagccaccttttttgtgtccatatatgtgaaaatcaatcacccacttgctctgcaaagtccttatcaaactcctaacaacatagacattatgagcaaatcacaaattcacagtcaatattgctatcaaagaaattttgttctagaattgcaggtttgtactactttcatatacattttttccttcaggatgtttagtcaccattatcaagggaaaaatagcagaatttagcattgttatgtcaaagaatttcagattgaatcaggggaaagctgtcttggattagtgataaagacacactttcatctctgctcaaagggtcaccagtgttgcagccatttcagctcctgctttgtttcttttaattttgttgtagtggtctagtcagcatgcaaacgtggcaaaaccgtcgagtcagtatgccacataagcaaaatcattttgcgaaacaattaagggttatttggatcagacaaaagaattacagggactcagtatcttgcttaatattgatttgagatgctagaggaactctcggcctcagtttagggttgcatttggacttttcgctattgcatttaattgaaataatcttgcaaataaataggagcagatacgtcgtcagaggtacatatttattttgttcaccccatgcatgtttgagttcaacatgtgcctctatctattttctcatagatgcattcagcaaagccgactagtcattttcacaaagatcgactgcacttataatataggcagaaaattagagtttaatatattggaccaccaaaaatatattttttaaaaaatgtcagcttgcgttgtgcattggccaaaattaatgaacaattggccacatggagttgtgcaaattggaagggagcagaatacgacagggcaggcaaggctcaaagaccagggattccttactgtaggttgctgtgcggcttgtcgtcggggtgcagtaccgttaagggcccattaacctcacaaaattccaaagaaatttaaacaaaaaaataattttatagtaaattttgtctgattttccactaaccattgcggtaggcggtagctacgccattaccgtgccttttgagcttatcgtcggagagtgataagagcatctccaagggtgtgttcgctccctagtacgtaaaacgaaacaacatttagtacctaattaattaattattagctaaaataaattttaaaaagattaatatgattttttaaagtaactttcatatagaaagttttcgttaaaaaaaacactgtttagtagtttgaaatacatgtacacagaaaacgagggaggtgagttgggaaagtagagataaaaactcggtccaagagtcttttcaaatcttactctccatttgcttcctaaaaaaaatcctttttttttttactccaacaatcccttcatatcccactctccaaattatataggctctactccctccgtccaaaaataaaccaatcttgtacgggatatgacacattctagtacaacgactctagacataagggcatctaaatttatcgtactaggatgcaccatatctgaggttaatttattttaggatagaggagtacatgtcagtgtcttcctcctttttctctctctttaggcccatgtataatagttacaagcaagagagatgggagaaagatagacagaggatgcgggacccacgtttgacaagtggaggaggcgggctatattcggaaatatcggaaaaccagaaataggctatacagacataaacatattggtattgatcgaaagccgataataaatatcggaaacattggattgtaaaatcgcacaattaattttgcataactataatataacaaattcaaggttacactatgtataagttataagttgtcttcttttaaccttgaactatagttagggatttggttgagaagttgatgggctctaaactatgaatcaaataaagaaataggccataaatattagtgtatttagaaatacgataattatcataatataaaaaaggtaaaatcatttccatttccatgtgtttttttaccattttcatttctgttttcatcggtaatcatttccatgttgctcggctggtaaaaatcggaaatgaagcatcggtcgatcaagaattttcattaccatttttacccctaagcgtggctacgtggggattggtttggctagccgaatggcttggccatctggatagcaagtcctttagtggttttttttttggggtcaaattttaacatggagagctaaatagtcactcttttggagttgctctaacccctgaactccgttagtaaggtaaaatcctactcacaaccttaattcatgttggctcgtcatgcccttgcagtttgatcttcatcagatcatcgtgccacatgcatcacttgaggtctgtatcggacgtggaaattttcctgatttatgtaagaaattttcctgaaactcttacgcaaatttctgtaaaattcttgcatttaaaatgggatccaagtcctgttaacaaagcatcaatcatgtacaaagtaccaagtatttttacacaacaattggtccaattcaattaggaaattaccggcctcggagaaggcctattgctgtgtggtatactttacaagtcgtgttattcaatactactagttatctttcgtgctagctagctttatcgatgttgcccacgttttattcaggctgtctaattctgtagaaaggcatagttgaaatctcataaaaaagatctccgtttattaaaaacgaagaattcatattcctttttctgatgtaaagaaagaaccaggcaatcggaggatgaaccgttttcacgtctcccaaaagacatggatagtggatttggaacagacctattctgtattccctccatcttttgttacttccattatttatttcagaataagtttgtttatagagtaattattgcatcgaagtttataaaagtagagaatgattattttgggagcagataaagtgagaataattgtattggaatttaataaattagaggtattttaatcttttaagtttcgtattggtacgtgtgggatgggttaaagataaacttattttaggacagagccgtgttatcttgttggtcccttctagattctactaaccatcatatacaacctattattacaataaccttgtcagctagggttgagtttgaatcaacttttacgtttggttaccaccctacttttcgtaaatacacattttgaattgttgaaaggtgtgtttttttttaaaaaaagtttatacatatattttaaaaatcaaataaatcaaaatttgaaaattataatagttaactaataattcgataatacctcttctttcatgtgccgtggaaaaacccggtagttatgctgtatccaactcagccttaaactcgagtagagttagcagtagtaataatgaaaaagggaagcaactcatttcgattcagcaaagcgaggattctacgcaaactcattaaactcaacgagaaagcaagagggagaagaagaaaaaggaagaaggagcgaatcatccatgggccatggcgcatcgcacccaagcaagaaggcagcaggttcagtgcatgcacgcgcctgacctctggcggcagacagacaggtagaggcaggcggtttgggggcgtgtggtgtaggaaaatcgatggcgctgtaccccttgcacgccacacctttgccactcattcctttatcttttctcctttccaagtttagattcaaataagccaaaatgcaatactcttatatagtactccctccgtcccgtaatataaggaattttggataggaaaaagtacaaattaccccccgaattatcgtggttgaccgaattaccccctgaacatgaaactaggtattgctcacctaaacttttaataccagacgaattacccctggatccaatctagagcggttttgtcctacgtgacgtacgcgtggcaatccagtcagcattttccttttaaaaattgtgggacccacctgtcatacatcctcttcacctcttcctattctctctctgtgtggcaggtgcaggtccgcacagccggcaacggtgtgtgcgattgggtgggtgaggcgagcatggcgggcagccgggaggctgcggcggggaggaaggcggcagtcgcaggcgtcctgagctctgctgccccctccaccgcccaaagggttggcgaagcgtggcgctgcgccaagaggaaggcggcggttgcgggcatcccaagctccgccgctccctccaccgccccaagcgccggtgactgtgagtgcccccttcgccgtcctaagctctgccgcccctgcactgcctcaagcgccagcagagcgcggcgctgcaccgagagagaggcggcggccgcagcagccgttgcgggcgtcccgagctccgccgccccctccaccgccccaagcgccggcgactgtgagtggcccctttgccgtcccgagctctgctgccccctccaccaccttaagcgccggcggagcgcggcgttgcaccaagagagaggcggcggccgcagcagcggctgcgggcgtcccgagctccgccgctccatccaccgccccaagcgccagcgactgtgagtgcccccttcgccgccccgagattcgctcgccgccgtcttcagctcacctcgcagccccctccatccactcaagctccggcggctgcgggcatcccctctgttgcctcaacgagccgtgcgccagcaattacatgcgtcccgagcttcaccgccctgagcaccagtagctgcgggctcctgcttcgccgcccgagctctgcccatcgccgttctcggctccctctccgccgttgcctctcgatgacagagagagatggaggtccgccacccggcactcgtcattggcgaaaagagagagaagaggggacaagctaacatgtggggcccatggacttttttaataaaaattagttgaccgccacatgtacgccacgtaggataaaacgacttcgaattgagttaagggggtaatatgttcggtttacatagtttagggtgtaaaatatctggttttcgagtttagggggggtaaatcagactgacgcaatagttcaagggcggtaattcgtacgttttccttttggatgaatatgacacttcctagtacaatgaatttggacatacggtcacatccacccaaaatcccttatattataggacgaagggaatatcagacgttcgcttccactcctaaaaccctgcccgcacctcacaccatcttcatggtgtctgagttgcaccctgctcgccactctcccaaccgtagtatgtacgcattgcgttccaatctcttgagccacggcttccacatattaatgccacgatggtctcttccatctgttcaatatgtgatctgaattttagacttacaatatatttgaaatagttttttaatagaactctatatgtctttccatatcatgagtcttttcttatatctcctctgtatactcttgtaagatatacgagaagggggtgacgttcatattgttattaccctatgttcgtaatcaattcctaaattatgatcattgttgattggtgctcgtgatttttttcccgttacaggttttccacgtaaaaatccatatctcctttctgcatctactttcatagcaccatcaccgttgctactgcgtcttctgcatcgatgccgtgcacgatgcccttgctccgctatttgctcggctttcttctcatgatgccggcttcgtcttacgtaatcatcctttctagttaccccttcacaagaagtatatgttggtttctcccttcgtctgttttgtattgctatgttttaaacaataatagcacatagttcttaaacttggccaccacaagtccaaagaatgagttataaatcgctgcctcatccgtctcaaaataagtgcagccatataattcaaatttaaaatatacggttatattaattttgagacagatggagtactacagagtatgttcactactagagaaatgatcgaaactgggactaaaaatatctttagtcccggtttgaaaacccacgggtatttttttaatctttagtcctggttggtaacacaccaaccggggctaaatattatttttaatcccggttcaaaaacatgtcagacccctattatttttagtgccggttgtttataacaaccgagaccaaaattaaaaaaaattgctaaaatccctaccccgaaccgcgcgcactgcctcgtccttatcccctcctcttctcctcccccctttcattttctctcctctacctcctccccttcccctctcccctcctcctccgatagtgatagcgagcagcggcccggcggaagccgccgcggtggcgcacgaggcacaagcgggcggcggcctcccctccgccagatccaacgggaggggaggccgggcagcggaggcggcgcacagccgagcggttggcggcggcgtgttttgtgaattttttttgggaatgatttgtaaattttgttgtagattattttagatttgtggatgattttgtgaatgatttgtgtattgtgggcgattttatggatgggcttatgaatcgtggatgatttgttatgcatgatttgtggggattcgagggtggcaataaatgcaagcaaaaaaaaaagaaaaaaaaagcctaaccgatgatgttaccatcttttgttccggttagtgttatcaaccggaattaaagatccattttacttctggttattttaaccgagactaaagattgacatatttagtctcgaattggacgtcctggtttgcaaccagggaaggggttgcaaaccggattaaagagcccttcccagtagtggttacatgtaagagtagccgtagccatcacaatttggctataaatcgtgtcatcaaatcaatggaatattaatggcattgtcagtttgtcacttcaggtggcaggcattctgagtcattttcgcataaaggtgctttcttctaaaagaactccctgcttgtgtgtaagtaatttgggctcatttcttccgcacaaagatggaacaaaaaatttatttaacatgatgatttacttattaatcaggagagagtgagttttcggtccatccttcctctgcttatttgcaggcgagcgttctacaaaactcctggttggaataaaaattttgccccaaattaattccacatttgttctgaataccgaaggttgttcagtttagcttaatgattggaaaagccaaaccttaaccaaactggctggatcttacgtatctggagtacatttctttaaaaaaagaatcgcaaaatttcacatagattatatatatacttctgtgtgttcttaagccacttacttattttgtaaataaaatgaataaataattatttccgcattcgatcataacttaatttccctgtcgtgcccacgtcacctgaaaccatttagatctggtccaaagttaaaaataattaaacaattttaatagtttaagtttaagggtaaatactgttagttttaatgtttaaggtccgttctttgaactttcattagcaatttattgaggacaaacctgaaacaaaatgcagtcctgtataagccgtataatcaaacataatcatcagttagcttaggct

SEQ ID NO: 66982 - DNA, 68595 bp, Oryza sativa
tcagtagtcttagggacgagcgagtgatttccaagagacgagcctctgcccccggccgaactcatgagaaagggggtctcacgactccccgctattgaggatcttccctcgacagctggcgcgccaggtagggggcggttgcgcgtttcgagaggaaatcgctttcttccgtccctagtttctccaggccttagctgaccatggtcgaggtcctggaagtagaggaggaggcggtggcgtttacccccacccagtccgggagtggggattccggtgaaagccgtggtcctcgtctctgtcgccatggttctccaactcctctccgccgtgaaccttcgcggagggaggatcccactcgttcgggtggttcggctctctctccgccccctggcggagggaggctgcgacgcatcggggcacgccgctgtctcgactatggagacggcggttcgccccaaggcgcgctccaagcagcgggcgcccttctgcggcatcccccggtaaacccgcagccggagactcctgttcagcgctggctggacgacgtggccaacctggtcactgctgcccagcggcagttggccacgggtggtcgatccaccgccactggtacgtcgcgtacctcggtcaccctctcctcatcggcgaggagaagggcccgccgatcggccacgatcttgaggcgatccacggttccaacatcgtcgggggcctcgggaagccggaggcgtcatgacggcctctacgggacgcaggacgctcgaatcaacatcgagcgacgccgggacgagcgccgagctgcccgcatgggggaaggcgcctcctcatctggagcgccgcgctcctcttcacaaggcggccctcccccccacactcacccctggggggatgggttgtagggccttcgtggcgagtctccggaatgtccggtggcccccgaagtttcgccccaaccttacggagaagtatgatggtagcatcaatccctccgagttcctccaaatctacaccacgattatcgtggcggcaaggggtgacgaccgggtcatggcgaattactttcccatggccctcaagggtcaggcgcgcagctggttgatgacccaaccccccgactccattcactcctaggaggatctgtgccagcagttcattacgaacttccaaggcacatatccccgcccaggggaagaggcggacctacgtgctgtacagcggaaggatgacgagtccctctgttcgtacatacagcgcttctatcaggtccgcaacactattccgtgcattccagctcatgcggttgtatatgcattccggaacggcgtgcggcataatcacatgctggagaagatcgcctccaaggagcccaagaccaccgtcgagctcttcgagctggcggacaaggtggcccggaaggaggaggcgtgggcctggaactctcccggcaccggtgcggcggccgcggctacccccgagtttgccccccgctctaagcggcgagataggagaggcaaaaggaaaccagcccgctctgatgacgagggccatgtccttgcagcagatgggcccacacgggccccgcgcaaaggaaaggccaccggcgataagccgagccccaccgttccctccggcgagggccggtcagcggacaagtggtgctcggtacacaacacctaccgccacagtctcgccgactgccgctcggtcaagaatttggccgagcggttccgaaaggctgatgaggagaagcggcagggtcgacaggagagcaaagcccctgcgacctcaaccagtgaccggcgagaggaggccaagaacaagcccccccccccccgatgatggcggagacagtgaggatctggatttccaaatacctcaggggaccgtcgccacgctcgacggggagggggggttgcgctcacacctctcatcgaggcttcaagaccatgaggcgagagcttctggccgttgttcccacgcacgaggcggtccggaaggcgcgctggtcggaggtgaagctcacgttcgaccagagcgaaccattcgacggtgctcgctcggggtgggaagttggccctggtggtctccccgaccatccacaacgtcaagatgaagcgtgtgctggtggattggggggccagtctgagcatcatctccccggcagcctttgacgcactcaaggccccagggatgaagctccagtcgtcgctcccaattattggcgttactccggggcacacgtggccgcttggccacgtagagctcccggtagccttcggcgactccacaaacttccgcaccgagcggatcgacttcgatgtggcggatctcaatctgccctacaacacagttctgggcaggcctgcgttggtgaagttcatggccgccacccactacgcctacctccaaatgaagatgtcgggtcctgctggtcccatcaccgtctttggtgatgtcaaggtcgccatcgcctgcgcggagcagcgcgcagacaacctggcggtggccacagggccgcaggccgcagaggcctctgcgtcccacgcctccaagaagcgcctcacctcggctgacgaggtgcccgtcaaggaaatcccccttggcgacgatccgtccaagaccgccaagattggcagaaccttggacgccaaataggaaggcgcgctcgtctccttcctgcgggcgaattctgacgttttcgcatggaagccgtctgatatgcccggggtccccagggaggtgatcgagcaccgccttgccgtgcggccggatgcgcgacctgtccggcaaaaagtgcggcgtcaagcccaggagcggcaagccttcattagggaggaagtggcgcggctcctagaggctgatttcattcacgaggtgatctatccggagtggctggcaaacccggtggtcgtcccaaaggccaatggcaagctacggatgtgcatcgactacaccgacctcaacaaggcatgccctaaagatcccttccctctgccacgcatagatcaaatagtcgactccactgcgttgtgcgaccttttgtgttttctagatgcatactctgggtaccatcagattcgtatggctagggaagatgaggaaaaaactgcctttattactcctgtgggcactttttgttatacaactatgccttttggattgaagaatgcaggccctactttttagcgcatgactctattactttaagtaatcagatagggcgcaatgtagaggcgtatgtcgatgacccggtggtaaagacgcgccaccaggacatgttgctacaggacctggccgaaactttcgatagtcttatgtccacgcgcgtaaagctgaaccccgataaatgtgtgttcggcgtgccggcgggcaagcttctcggttttctagtctgttcccgaggcatagaagcaaatcctgagaaaatacgcgcgatagagaggatgccccccccccccagcaagcttaggaatgtgtaatgcgtcgctggatgcatggccgccctgagtcgatttatatcgaggctgggtgagagggcgctgcccctattcaagctcctcaagcactccgggccgtttgtatggacggaggaagctgagcaagctctcaatcagctgaaagcttacctcacttcccccccatcttggtagtcccgggaccggaggaaccattgctactctacttggccgcgaccccccatgtggtgagtgccgccctatgatggaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctaaccgacacgcgcgctgcaagcaagtagcaatggctaaactttaatctaacaaaaccccggaaaccctgaaggggtacctaactatttatagaggtgggaggacgaccaagagggtccaagggtcgtgctccaccagattggggcgcaccccacatgggccccacatgggccagggtcccaaacaaagttacaagcccattggcccaatacaggagacgcagcaccttgcttttgtgattgcggccaaacgagatagatttccgagatgaggctggatccgttggaaggaggacttcgagagctttccatcaagtactcacgggcccaaaacggagcacgtatgtagatttggcggccgtttgaagtcagcaatgtaacacgtggccgaatcagattgcagcacatggaggacttgatcttgatgtcttcttgttgattcatgatgtgagcaatggtcgtatccatagtagccatggtcacatcatcctccccttcttcacagaaaaccgtcctcggtttttccatatggtgctcttcgcgcagtccactgaacacaacctgtttcttgcaatcaaaacaagacaaactcgagacaatatgattagcagtaacatgtctctctagcttgcatattttatccagaactacaagatgttctaaatctgaacaaatgtaaactctatgcaccaaaaatattcctctatcattatattcgccaaagatatgaaaaatagcattagttggacatggcaaatcagatttagcaaataatttctccttcaaattatcgagctcacaaaaatcatcaaactgaacatagcccaaagtatttaaagaagatagcaattcgcgttcctctacttcattagcaatgtgaacaacatgcttagaatcagcacacaaagaaatagtagaactaacatgttcattcactagttgtggcatggatataagtgaaacattatcacacaactcttctttatcacaagaaacagcaagtaaatcaacttgtgacaaaggcaactcagtaattgattccactaatggttgctctactatagcatgaaaagtggacaagtgtagctcaccttgagaatactcaccttcatttctctcagcaccatttaatttaccttgcgaactttcttcagataatgtagctgcatcagccttctcctcattcgcgagtgatggaagtgacatctcaaacatatcgttcttctcattttggagacttttctgaacttcctgcaaaacatcagtgataggaggcacaagcatatcttgttgctccgttggattctccaaaattttgcgctcaacaatgcaagcaagcatgaacaattggcctatatgattatatgtcacattaacaagcccagcctgaatattgaaattaagccctctgaaaaatctagtcattgtgttctcattagattcttgtaaaccactataagtgatacaaattttaaaatcatgaaagtactccctaacagttttgtcaccttgttttagatgttcccatttctcaaggagagcacatctatagtatgaaaacacaaatctttttctcatcagtattttgcattcatcccaagtttcaagcttattccccacagtatgccaccaaaaagatgcagaaccggtacacttattactagcagccttaatcatttgagcattagaaaaatcatactcatcaaattgtttttctactgctagctcccaattaatgtatgcagcggaatcatactttccatcatagactggtaacttacatgcaacttgtgcaaaattatagtcatgtacctcatatgcatcacgtgaagaagtcgtcatatctcgtcgaaggtgtagatgttgacgttgagcatgaccatcttgtttccccttgcgcaatcctgccatggttagcagcaaacaagaaacatacacaagaatatacacgctcctatcaactactaggtactggcagctcaaatgtcacacacactcaagcttttaaccaagctcttacaagatcttaccaatgcaagtggaatggtgatgtacaccgactcaaccaagcaccccaatagaggttggatatatcgatgcctcggcaaacacttgctgtacggctgcaatcaaatctgtggagctctgggtaggcttaaatatgtagcaaaggaatagcaaatgctcaaatcagataatgcaaagttgaataattatagtcatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgttgatcttgccggtgcagatcaaccctattcctgtaagcaaatcgaagaaacaagcaagaacaagataaaagtaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcaccttgtttcttcagttgctgccgactgagatggaatttggcaacgaggcttgatgcattggaaagaggactccgagagctttccatcaagtactcacgggccaaaaacggaggtcgtatggagcttcggcggccgtttgaagtcagcagtgtagcaggtggccgaattggattttggcacttggaggactcgaacttgatatcttgttgttcatccatgatgtgagcaacggatgtatccgtagtagccatggtcatatcatcctccccttcttcacggaaaaccgtcctcggtttttccatatggtgttctttatatagtccattcaaaataacctgtttcatccaatcaaaactagagaaactcgaagtagtgtgattagcaataacatgtttctctaaatccgaacaaatgaaaactctatgcaccaaatatattcctctatcattatatttgccaaagatatgaaaaatagcattagttggacttggcaaatcagacttagaaaataatttctccttcaaattatcgagctcacaaaaatcattaaactgaacatagcccaaagtatttaaagaagatagcaatttacgttcctcaacttcattagcaatgtgaacagcatgcttaaaatcagcacacaaagaaacactaggaatagcatgttcattcactagttgtggcatggatataagtgaagcattatcacacaactcttctttatcacaaggaacagcgagtaaatcaacttgtgacaaaggaattccagcatttggttccactaacggttgctctacttttgcatgaaaagtggacaaatttacttcgttaacaatgcactcaccttgattaatttcagtatcatttactttaccttggatgtcctctttagatgatggaggtgtctcgaacttgggtgtgaacaatggaattggtggctctttcatgtctctctcctccttttcgtgattacgcacttcctgcaaatagttagtaattggaggcaaagacatagcgtgtttctttttcatatcctcctctattttactttcagcattgcaagcaagttgtaacaaatgagaaagagatgtatatctttgacaatcaagcatgtcctgaatttctttgttaagcccacataaaaacctcaattctttagcttcttcgcattcatctaaaccacaacgtaataaacaagcttgcatatcatgatagtatgaagtaacagttctggtatcttgttttaaacattgcagtttgttgaacaaaatgtcagcataatacatgggaacataaacatatctgaaatatagtttcaggtctttccaagattgtggtattttgttatgcctacaaagatgtttccaatcattagaagcatgtttaattaaaacactagaggcacacataaccttttgtttctccgacaagacatgcttttgaaattcactatcaaccgctagctcccaattaatgtaagcacgaggatcatagtttccctcgaaataaggcagtgcagatttgatcttacctagaacatcatcacttacctcataatggtcatgttgatccctcctcatgtctcgacgaagatgtcgatgttgagcacagctatccccaattatcttgcgtatccctgccattgttagtagaaaacaagaaacatacacaaaaatatgcgcgttcctattaactactaggtagtggcagctcaaaaatcgcacacactcaagcttttaaccaagctcttacaagatcttaccaatgcaagtggaatggtgacatacaccgactcaaccaagcaccccaatgaaggttggatgtatcgatgccttggcaaacacttgcggtacagctgtaatcaaatatgtggagctctgggtaggcttaaatatgtagcaaaggaatagcaaatgctcaaatcagataatgcaaagttgaataattgttcaaagtcaagtaccgtgctggtcctaggctagaacgtactagagacgcgagcctagacacaaacggtaccacaaaatagcaccagaaacaactcaagcacactctgatgtatgaagttcagctcaaacaaaacaatattttctcttttctttctttcttctttcttcttttcttttttttttccttttcttttctgatttttttttggtgcggcttttttttcttttttttttgcacctttctgcccttttttttctcacttttttttttattttttttaacaaaaactgacttaaggaccttaatgtaagattacagggactcaaacataaatataaaatttatagggactcaaatgtaaaagtctaaacccaaaattaaaattatacaaaaaaatggaatgctgaatttatgccggttccgtttttccaaacagatctcgaaaccgacaccaaacaaaaattcgccaaggtgtttgacacaactcggaaccgtggaattgagggagggggtcagactcggccaaaggggcgagtgggactcggcaaggaggtggagtggatggcagccgaatttggtgtatgggataaaacggaaactgatttttaaccaatccaatctactatatctttccaaaacaaacttgactacttccaaaatcagatatggtaattcaccttcctcctcttgtgcacgacacaggcacggccaaaacaaacacacacaaggatcggcaaactctagatgcaactcaataactccaaaactaaccgacagaaacttctgaaaactacaaaaatagaaccgtggcagcgagccgattccgttttcgtaggtcccgacaacaacagagacacggtggcagcgacgactgtggtacaaaaacgtgaccagaactcgaaactctaaacgaactagacgctaagaccagcaacacgacgtgacgatgcaacacaaaattcaacaaagcaaaaactgaaaagaacaatgcaatggcacaatatggctaggtaaatgatacgaatttttttgtatggctattttctggttataggaagataaaaactcaccgagcaacgaaagctctgataccacctgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgtgggttgctgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgcgcgctgcaagcaagtagcaatggctaaactttaatctaacaaaacccgagaaaccctgaaggggtaactagctatatataggggtgggaggacgacctaggggtgcctagggtcgtgctccaccagcttggggcgcaccccacatgggccccacctgggccggggtcccaaatgaagttacaagcccataggcccattacaggtgtcgcagcaccttgtttcttcagttgctgccgactgagatggaatttggcaacgaggcttgatgcattggaaagaggactccgagagctttccatcaagtactcacgggccaaaaacggaggtcgtatggagcttcggcggccgtttgaagtcagcagtgtagcaggtggccgaattggattttggcacttggaggactcgaacttgatatcttggtggtcatccatgatgtgagccacggatgtatccgtagtagccatggtcatatcacgatactattgaaatcatgggggattcttatctagtaatcagcccattggctggagaaatatgaatgcaagaatgatacattgatggtttataatgagaagtgcctggaactaatgaaagagttttggctggttactttgaagcatgtatctcgagaacaaaatcttgaagctaatgatttggccccaggggcatcggggtataagccgatgatcaaagatgttaaagttgagattgcagcaatgtcagccgatgattggaggtatgatgtgcatcagtatttgagtaatccatctcaatcggcttctaggaaattacgatataaggcattgaactatacactgttggatgatgagctttattatcggacgattgatggggtattacttaagtgcttgagtgccgatcaggccaaggttgcaatcggtgaagttcatgaagggatctgtggtactcatcaatcggctcacaagatgaagtggttgcttcggcgtgcagggtacttttggccgacaatgctggaagatttattcagatattataaggggtgtcaggattgtcagaagtttggagcaattcagcgagcaccggcgtcggctatgaatcctattattaaaccatggcaatttagaggttaggggattgacattatcggtatgataaacccaccatcgagtaaagggcataaatttatattggtggcaactgattatttcaccaagtgggtagaagcgattcctttgaagaaagttgattcgggggatgctattcaatttgttcaagagcatataatctatcgatttggtcttcctcaaactatcactatggatcaaggttcaatcttcgtgtccgatgagtttattcagtttgccgatagcgtgggtatcaagttgttgaattcttcaccttattatgcacaagctaatgggcaagccgaggcatctaataagagtttgattaagttgatcaagcggaagatttctgattatcctcggcaatggcatactcgattggccgaagcattatggtcttataggatggcttgtcatggatcgatccaagttcctccttacaaacctgtttatggacatgaggctgttttaccatgggaagttagaatcggctctcgacgaacggagttgcaaaacgatttcacagcagatgagtattacaatcttatggctgatgagagggaggatttggttcagtcacgattgcgagcccttgcgaaggttactaaggataaggaacgtgttgctcggcattataataagaaagttgtacctaaagatttttcggaaggtgaacttgtatggaagctgattttgccgattggtactcatgatagtaaatttagcaagtggttgccgaattgggagggaccgttccaaattcataagtttgtgtctaagggggcatatatgttgcaagggcttgatggtgaagtttacgggcgagcgctcaatggcaaatacttgaagaaatattacccaagtgtgtgggttaacgcatgatcggctactactgccgatgcgtgacagccgatgtgtttacatcgccttgagatggccgatattgttatatcgcccttagttgtttttataatgtaatcggttgtggtttgccgatgtacaatggccgatattgttatatcgcccttagttttttttataatgtaatcggttgtggtttgccgatgtaaaatggccgatattgttatatcgcccttagctgttttataattttatcaatgctcttgacattgtaaaactaggggggcatatatatatcaaaatgcagtatgcagtacaaaattttttgagcaaatttcaaagtcatattaatcggcgcaaagggttgttaagacaataaagtatcagaatgttttagccgattacaaaagtcttaagtattattacataaagactactgagataagtatcgctagatggccgaaatagccttctgcctaatctgctctacttcttctatggcttgggcatcttgagcatcggttcgagggataacttttagggacttggtcagttcagcaacatgcttgatagccgatttaagtcttgctttctgttcttcaatagacttggggagatcggctagcttcttgcgctccatatccagctcggcgttacattcttcaagttgtgctaagaggtcaatcttgtgagcctcaagccgatcaatgttagacttgattgggccttcagataattggtcaagcttggatttctcttcatgcacaagttgtcggctggcttggatagtggcttcaatgttcttacattctcgccgttcgactaatcttaacttggctttctccagcttgaattggtgttgctcaaggtaaacagctggagtaaggatgtcggctaactcatccgggattaaggcttgaatctcatgcagccgagcctgattgagccacagtcaactactaagctgtctagtgatgatgcctctagccgatccaaaatacttccttgagttttcttcacgtcatcagataaaggagccaatgctttgcttgtagtatcttcttctccttcatcaagatagtctctgatattgaaagagaaaagatcggccaatgcctgcaataacaatttagaagcagattagaggttaaacgattatagccgatttgaatgcctgttgtgataaaagaaacttactaagatagcaggagcagttggttgttcttcttcctcgacgtgatgactccctgcagctgaaggggtctgatcacttgatgattgttgaataaaaggagaaggaggaggtgaaggctgaaagggagacaagtgtcagatagaatcggctaaaaattaactaatgaaagttaaatctatcttactggtggagctggtttagatgttgttgcagccgatttcttcttcaccgcagtcttctttttctgcaattataagacttgggaatgatcggctataagacaaaataatcactaaaaggattaacgagaaacacttacccttgagaagtggactggggcagaaggagttggaagggtttgcttaggcgaagccgatggtgttctttcagtatcgcttacttcagctgcggcctgatcaacttcgtcttcaattatctcttcatctaaggcttgttcaatagatggatccaaggtgggcagatcatcggccggcttgtcagtcggtttggttttcttgaacttggcctttttctttggagccaagattgaagtgctcacagccgaggatctggttttcctttttgggcctgcatcggctggttctctagttaggccgtgaaggagagttgaggtcttgggggcatagtagccaataacagggggagatagcccacctccatttggaattaagcccgaagcatactcaatgttcttgccactattgctttggtgaggaggggaggactctgttgtctgcaaagcaggagcaaaagattggttaagtaataaatcgattaattgactacgcaatttgatagtaacaatgtttacctagggtatgacgtcgggggacagatctgtcatatacatcgtggctgattgatgaaacagatgtagcttctattcaccccaccatctgtcgaagtttttgcttctgaatccagccaactcaatattttcaatgctgccaagaggaggtcccgatagattgagtagccgatccatcattagagcagacgtgatttgtcctcggcactgaatcttgtcggcaaaaaataagccgattgggagttggcctaatccaagttgcctagccgagctcattgggtgataaaactcgtaggagacttggatgtttctcccttggtgaatgccgacaggaaggatgcaagggctgattgcggctataagaacttctctggatttctggaatttctcatggttaatatcttcgaatctaaaatctgatggaagttcgaggtctgctgattcttcataagggaaccagatccgggtatctttcttaaagccctcatagaagctgcagaaccagtccttaagcagctcagccgataactttgctccagcatcggttggtgtggatgcatattccccatatcatgtgcacctgcgatgagtacattcttctccgtcgtcacccacaatcggctctggcagtgggaactcagcttctgttacagaaggccgattgacaaccttcataaccatcaggtttaaccaagtttgcagtagccaccagggtccacctgctccaactgccgagccgacggctattctagccgatgtgttgttcaacatctggtacagatagccgagaaggattttgcccaaagggaattctttctttgactccagggcttcggctacgaactgccagttggttgtagggccacaactggatccacagaaaaggaacttttccagccacatgagcaaaaaggctacgtgctctcgaggggtaacggatccttgacccatatatgctgccacatagccggaccaacaacctatgctcttggttttgaaatcgaattggttcttggtattcatgctcatggggttggccgatgaagttacatctagtccggtgatcatagtgatgtcaattaaggttggagtcatcggcccttggttgaacaggaaagcgttgatggtgtttgaccagaagtaggtggcggcagccatcagaggttcgtctttggcagaattggctatggtgagggctagtgcttggccgattccaatctcatcccagtgaactttcttactagccgatacacgttgataccaagtggaccaactcctgtcgggtgtgggtttttcgagagatggccaggatttaaaggtgttcttccaatgacctaggttagggttggatagcctaaagggaatccggttggtctcaccagtgatgaaatcggtggggtcgagattgccgattgggccaaggaagtagtggttctggtgtgaaaggcttggaattgcgacttggtgggaaagatgttacgaatccaaagcaatcgaaaagagaggggaggtatgagatgagagaaaatcaatctattgctaaggaaaggggatttagccgatgagaacttacctcggcgtactcggctattggcgcaccagacgggctggcggaggatgacatggccgcgggcggagatctcgtcgaaggagaggttgcctgggaatcgcctttgcgtcggaagagtcgccggagaaggaaggggaataagttctgcttgagcggtgaaaacgggtgtcacggtgtgaggtttctcgggggtgacggttagtatttaaagcacggcagtaacggtcggaaaacggtaaagtgcgaaacttgctcggagtcgatttacagcaaatccgaaacattaccaaatattccggacttggggggcatgtgttaacaaccgaatttggtaacatcagcgtcgggagagaagagtagatcgaagcaaagtcggaagcggaaatcgggtttgaaagcagagcaggaatcggctaaaatccagatcggctacgataagatcggctgggtatgagtcgtgttgggtaagtcgatgtagccgattccgacaatacgacttgtacgcgacatcgggttcaatttaatgtacttcaagatgattgccacgcatggatagagtcctgggaaggcaattgtatctattaattaggatattttatgtaaattccttatagataagtgtggggcaaaagtctgccgtaatgacttatggtatcttagagtttgttagagataatggtcatgtccgctatgggcatatcttgtaatcctcgggtataaatagaccccgagccctatgtaatgtcacaccctaaaaatcctaaatatataaattgttgtttaattggaattattagaaataattttaaaagcctagaagagaagatctaattttaaataataaattccaatgtaaaagtggctagataaaattttattaaatactttacttgattttatagttcctggatttttctgggatttatttgagccaaggaagtatttttaataaatggaattgcatttcatgaataatttaaattgaaaatgttttaaaaatcctccttttggctttgggccgaaagtcggcccaaaaccctctctctctcctccccggcccaagttggcctgcagccgagacgccgctcgcgcgcgcgtcccactcgctgacaggtggggcccacctatcggactcgtcgtccacctccagccgtcgcccggccgaaccctagccaagccgcgccgccgccgcccttccaaattcgctcgtccctttctcgatccgatgaaattgtttgaggggaaatgatccccgagatctcctctactttttcccttttggaatcatcgcctaattcgcttttgaaatcgccggattcgagtttgattcggattcgttttcttcccctgaaccctaatgtttccatcgccgtcgccggccgccgtgggcctccaccgtcaccccctagcccctataaaggacccccgagctctcctctacccgccgccaccctcgcctcgccttccatggccggtagagctctagcaccgtgagctcttgcaccgctgtcgctgccgcaagtccagccgtgcgacgccgtcgctccggtcgtcatcgtcgcttgggaaggacaacgccgggttcaccaagccgtcgccgtcctcgtccacccctccgtcgtcgccgaggatcgccggaagaccgccgtcgtcgtcaagccgaccgtcgccgccgcttcttcctcgtcgccgtccgccgccgttcgtgcctcggtaaggatcgctgcatcgtccactacgcatagaggccctccgtttgcgccaccgcgccgttgttcgccggcgagcatgcgcgcccgagccgccgccggtggtgacgtcatcgccgacgtcatcgtcgtcgtttcccgtgagccgcggtagaccgattagatctcggccgtctgttttggatagggttgatcccggccgttcgtttccgtagaccgccgctgtgcacccggtccaccgtgaacccgagccactgacgcaataatccccttttccttttaaaaaattattcattattgcatcataattcaattaaaatctatataaatgatttaatccgatttaatctttaaaaattcataacttattcatcttagctcggatttagttggttcaagtctctaaatttttctaaaattgagatctacatgttaaaaatatccacatgtactttttatgcttgtttatgtgctgttttagtgtttttgctcttttctctttagattccgatgttcccggagagtccgattttgcaggagaagactttgaggaattccaaggcgagcaaggcaagtcacacagattccaaacaatcctttgagcatgttgatcccgtttaaagttattgtttctattcaactattgcatttatttttgaatgtcattgggtggaaataacctattgccttgttatagcccttttgttcttgattactctattccttaatactttgggttattataatttgactagttgagctttatatattggttcagctagatattagacataattgcttagccatgcttagaaacattagcacactattaggataacttatgattcactattatttaatgatggcttaatgatagctcacgatggttaatcgtgattggttaattaattaatttgccaactaaaacctgataatggtgggttgtgagcacatggttttgatggtcgtgctcatgaaaattaaggaccggttcacgattttcggttgtgaaacattaaccatgccaaccacaagccagcgtgagcaacggctttactttctgtatagtatggttcattgtagagcaccaggctgtgaagtggtggagataagcccacgggggtcgctggggagtccatgccttgtttataagggggtgattatgatccaggaacggtgcactgctttaaattgtattatatagagggtattgtcacaatctctattcgggtacttgttaagtatcgcgacgcttggttgacatgatgttgaggttgtgtcttgtgggtacagtggtacacctctggctagagttaaaactattcgaatagccgtgcccgcggttatgggcgggtctaacaatgtctttcgtgattagtctcacacttcttaccatattaaatgatgctgtttaataacttgtttaactcctggtttggaatggtatattcctggcttggagatagaactgtgcagccgaggttggttgttcagaatggttgggcctatgcaacagggtatgttgtatagcgttggattaatattgtttaatttaatactctactgttttattaaattctgaaatatttattaaatgctatttatgcaaatgagactatactatgccatcctttgttatcctatgcacttgcatatttgctgcgtggcttactgagtatgtcatatactcaccttgcaatcattcatcagaggaagagttctactgtgatgctgatggtgtggaggattaggcctagccctggtcaagctgcctgtggagtagagtcgtctgtgctgtttcttttattttccgctgcttagaactttattgtttgagaggaactatctacctctgtaatgacattatagtcgcttattaataattgtactctattatcaatttgttattgtgtgcctcggctgattcctagacgagggtttacacacatgtaagcgtttggaattttggatagaaatttcgggcgtgacatgtaatttttaatacacacgttcaatacaatctcggcgcatcgccatccttttgctttagttttattttgacgagttcttgctttcgggttgagctgcatggatttcgatcttcaacaagaggtaacattcgccgtgatggattgcgttcttaggattaatgcttccatcctcatgacactctagtcctgtttatgtaattcatcaagttatcatataccttatataatctctaacgatattgccatctaaactactatcggtcaatatctgtatgcagaaggcagccgattaggttagatctagatgttgatctagattatataagatatctaccattctatgaaacagctagcggcttgattgtctagatatggttcttcttttcatacttaatgctgcatcagttgagtttgatctattaagtcgtgtttagaatatcgatctctggcctgctttctagttgccgattagaatagcatcggggtttcagccaatcgtatctgatttagccatatttattctacatgtctcatcgatatgctaaatctgcccttaatatcaagatattgctgcatctaaatatgttagggctttgtttgatatattatacctgctttaatatcctgatatgagttagtatcggagtattagccgatacacgctagatctatctgatcggctacgctataaacatatataatcatgttattgatatatatttcgatctaagtgatttatactgtctcggcatggtgtccgatctatcccaatcactcgatttaagtatataccaatataaggagtatatatcgttaacatctacagccgatcgagtagatttagtgtttatttactttttcatgactgccgatcgatacacaaatgacatcggcccaaagataaatgatatgtcatcggcatctagccaatcggctatcatttatagatttaaccatggtttctttgcttttatttcttgttgattacaggatcaaatcaactggcatgctaatacatccgaaggcgagttttggacctgcactggagttaagcagatctcccaggccacgtgttttctgtcaacacacttttggcacgcccagtgggagttgattagaagtcagatgtcagttcttcctcatggccgagaaacaagcaccaccaccatcaagcccaggttccattaaaggcaaggcattgaagccaggattgactgacatcattgatgacaatgtcatgccaatcgatccagagaaattcacacttgagatgaagcaggagtttgaagcaatgatgcagcaagcacgggatcagtatctgagctcgtttggacatttcccaatgtcggttggagggcagtttggacatttcccatagccataactgtcatatggagcttataaaatgaggtctccatccacacttcaacacacacaactttgagctgaattacaagaggctctattgtatctcttgaacattagaaaataggtagagagtgaggggaagctttggaggactgcccgaaagtttggcgctccatccgacttctatctcaacgagtgtagctttctaggaggaattctggaggagtaccggagttgtcggcacatgtcacgcccagaaatttagcccaaatttccagactattttgtgtattaaatccttgtccaggaccagccagggtacacaaaatgacaagtaataaacagctccaaacgtaaataaagcataaaatacttatagaagaggcacttagtcctcacaccgaaacaaaagcagcagcagcggaaaaggcgatcctagcggggcttcagctccactccacaggcaaaactcaactggggtctgagccttggtcttctaacttcgtcttcagctcagaagcactacacttctgaaaagggggaataatagcaagactgagtacaaccaccgtactcagcaagccacaccaacgatgcagacgtgcaaggggatacaaggacggtttgtggctatttgcataaatgcggttgtaaatcattttattgagcaaaacagtaaaatagttgagtaattaaggtaatattaaatctccattgatcaacgctacaccacgttgaacaggcccaaacaacccacctgaactacagtgcattgggtcgatttattaggggtgagactaatcacggtgaatctggtcgatcgcccataaccgcgggcacggctattcgaatagttttactctggccagaggtgcacaactgtacccacaagacacaatccaccggcatgtcaccgtgccatcatgtgcccatgatgcacacgtcaccatgtcgagtgattgtgacaaaaccctccgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggcaagcgctgtaagtcttccagggtttcccgtgaaccggtccttaattgccatgggtgcgactcacaaaaccatgcacccacagcccaccattcagtcacattttagttggataattacgaccatgaaacatggccagatgtctcgagcacgcagctcaacaagataatagaatgtctaatactgcaattatcccttcgactgagctagtggtaattaagcatggctaagcatatagttctagctaggtcatcaaagtaacacaagctaggcgatctattacccatggttgacaaatgacagatatcaagtaaacatggcacaagcgagcagataggtaaaccctgatcccttgtaattagcaaaacatgcatatttatttacaaacggtaaaacatttataaattgggaacaacatgctcaaggggaatgtgtgacttgccttgcttcttcacttggattttttgaactcttttcctcgcgaccgcgatcttccgaaacgacggattctacacgctggctcgcaaaacgaggaaaaaaactctaataaaaaccaaggaaacagtacataaaaagtaaacaaacatgtagaactcaattttagatgaattttgcaatttgaatggcccaattcggagttcgaatgaattagatatgaattttagaagttttgagccatttaaatggatttctataattattaatgatttattgcgcaattatcaattattttctcaaaggaaaaggcattcgctgatgtcagcaaggggcgccggcgctgacacgcgggccccgcacgtcagcgacacaaaaggggcgggcgcacggtggactcggtccaccgcggcctggcggcaccgtggacccagaccacgggagtggtccatgggtggcgaacagagcggcaaggggcgggctcgccggccagcccgacaaggcggcggcacacgcgcggacggccgccggcgatggcagcacgacgcggcgccggacaagggaggcagaagggaaaagggaggaaggaggcctcaccgtgcgccgggcggcgaggggcgatgagcgcggcggcgagctcctcaggacgactgcgggatggtgctcccgcggcggctccacggggtggaaacggcggacggaggccgggatgacctgggagggcgatggaatgattaggggaaagggaggaggcgcgaggcggtggaaaaaaagcggccagaggccggcaacatgggaagtagctcacctcgacgggaaggagaggactccggcggtgaatggcgagggcgaaggggcggcaccagacggagaagccgatggaggcgacggcgcatattaaggtggtctgggacggcagcaggaggcggctggaggcggaaaatgcagcgtcggcctcaggttggcggtgggggtggttttcggtggtggaggggaaaaactgatcggtggccgggcttgcctgcgcggcagcgaagccggctgcggtggtggcaggacgcgggagcggctcaggcgacgacgacatgcgactggaggcggtttagggtggtggcgactcgggtgcatggtggaaggggagtttcggcggaggtttgtgcaaatggagcggtggccggtgtgcggcgaggcatggcgaagccggcggtgtaagcagcgcagcgtggcggtggctacggcgacggcggcgtgcagccggagctcgccggaaagcggcggagcacgggctcgcgcggggagcacgggagaggtaacgaggagctcggggaggggagggaaacggaagaggagagcacgagggtgcttttgataggcttggggaggagaaatcgtggccggacgtggcggatttgaagcggcaacggccggcgacgtgggcgacaccgtgggcgaagtggggctcgatttggcgccaaaaattggggaaaagtaggggatttggtggaggaggtggaggggtgacgtaagagtgcataaatgccacaaccacgctggcagaccaataaggagtgatctctcggtagtacctaggtgcttggaacaaagtcctatgttgtcaggatatatatgttaagtgatactaaatatgattactatagaagtacagttatatcatagtttcctaatgttattttccactagacattattataaaggtgaatctcctgtttgttcactacattatcaattataggttgattcatgagatataaaccatatatttataccgccgccttcccggtggaatataaatacgatacccttgggaatactcatgggagaaatgctacaacggtatccgtgcgcttgcagatttatctatgaacgtacgaaataccaacacatgacccacgtgccccaatcatgcccaggctggcatgcgacacctcaggaataagtccacattgactccctcaactatagctctaatctgattcatatccctgaagagcaataccatatatctttttttagtgtaaaatactaccagagctttgcctaataattatatattaaaataaaaagagttatttacagaggaaaaaacaaaaagcaaaaccaatacccctttgaaaattacaaactttgtagctagctaagaatggaggagctaagagaatccttcattctgcagaaatgtagaagaatttcatttgtaaaagcaacaaaccacctattaagataaggctgaacattataaaaaacatggccatttcgctgcttccaaatgtgccaacaagcaaatcaaataatatccagaaaaccttttcttctgaataaaattcgacatttgggaaatttccaagtttcgattccaactgaggcgctcccagcacaacttactaaaaggacaagtgaagaaaaggtgaatcaacgtctctctaggaccaccacaaattacacagtttaaaactgcatctttaggagcacaatgcctcctatccaacatgtcgttggtatttagcatgtcccacaaaagcaaccacataaaaaccttaattttcttcacacatttggtcttccaaatctagataaaaggccttggaacatagagtcccacaaaattagtcctgtaaaacttttggccagagtagatgtgtgaattccagaagaaagtccataaatctcccttatttggactgagagacagaatgactaaatcagattgcaactgaagaaactgtctataagcctgatcatctaggggaagattaaagtaatcttcaagttgtaaattcaaaaagtgattcacagattcccatcttaaagtagtttgggagaaaagatcacgatactttagtttcttaatctcaccattccagagatcatcccaaaacaagactgaagtgccagattgtattgtacattgggaaatagctctataaatatcggccaactgaattatgtacctccaccaaaaagaccctttattgaaaaccatatgaggtacttttgttctgtagcaagaagcccaaataagtctaacccaaggaaggtcttgttgtaacgtcccgcctttgcctctcccaggctaggcccacttacattcataccattttgtcacgtcccgcctctcccaggctgggcccacttacatctaatagcttttatagttcatagactaccctcacagaccaacacaagtcttttctgcacactttatcctcactcatgtgcacccggaagaattttccggtcggtcacccatcccaaattgctccaggccaagcacgcttaacctcagagttctttggatatcggcttgaagttgcaacttgttgatatgagtattctattaatcctattaagccctgggccagaatgtcacacttgtgctgtgtaaaatttatgcaaatgcttcaaaagcaaagccacattctaaatatacagatttaatacacctagaccacccttgtccttaggtctacagacttcatcctatgctgccaaagattttcttttaactaaaacattagaacctttccaaagatttcttcttgcagtgtcaatggcctctataatagtctttggcaatttaagggagcacatgcaataggttggaatggcagataaaacagagtttatcaaagtaacatgcctccataaggaagagaagaagcaatggcagtcaacctcctttccaccctatcaaccactgctgccatatcaaccactcttggccttgtggaaccctttggaaagccaagagaagtgaaaggcacagagccagattttccaatttctcgtcaaggacattcaaaggataaatattggacttatgatagttaattttcaaaccagtgtcttgattgaaagtgtgcaagagggccttaagacaaagcaattctctttgtgaagcctttaagaagatgagagtgtaatcggcatgctgaacaccaggaaaatcacctcctccttgaccatttataggcttagataacaaaccaagactcatggctctacttaaaacatcctgaagaagttcagcaccaatcacaaaaagcaagggagagagaggatcaccctgcctgacccctcttttgcacctaaggaatttcccaggaatcccatttagtaagatagaagaacttgctgattcaaaaaccatcttaacccaattcaaccattttgtagggaacccatatgtttcattattttcaaaatggtcgaatgttcgattgtatcgaaggccttttaaaagtccaatttaagaatcaggatttccctcttggattgctgacactgatgaatatactcaaaagacccggctaaatagtcttgtatagtcctctctttaataaaaccatattgattttcatgtacaatcttctttataactccttgaagcctatcagccattagcttagtcaaaaattttagagtgatactcatacgagaaataggcctaaaatcattaacacattctagattaaccttcttaggcacaagaataatataagaagaattaatgcattgcaggtcaaccaactcagcatgaaagtgagcatccagtctgtaataatcttgggctataattggccaacaatttttaataaaacaaccattaaagccatctgggcctggagctttgtcaatcggaagacttttaacaaggtcatccatttcaagagtgaaaaaatgatctaccatgctatcaaggttatcatttcttggaataagatcatattgatcaaaactcatagccgataagtagaaacacccattctagattgaaaagtgtcagaaaagagagaggctttatcatgatgtgctgagacaacggatccattatcattaatttgagctatcaagttatttttaaacctctctgtagccatggcatgaaaaaacttagtttctattcaccaagttggatccatctatttgtgcatcttttcttccaatactcttccaaactgaaaaaagtttcaaagctgttttttcacaatttctctaaaattccattccatcagagataaagctctaacttcttcaattagatcaagaaaatctaggactttattgcaagacttgattaattgcaataatttagaaaaaccattactccaaatcagcagaccctttgttaaccgtttaagcttaaaagtgatacgcttagccgaataaaaaaactagggtcaacactctatacttgtgccacatgatcaaagaaaccctctatctggacccaataattctcaaagcgaaaaacattcgattttggaatagaggattcaattttgatcacaaaaggaacatgatcagaaatagctctaggcatagtataaaccacaatgttagggtactttagggtccagtcattagaggtaaagacccaatcaagctgttctaagaggtgattactttgcatattactccaagtaaaacttctccctttaaaaggttctcaatcagccgtaaagaactgataatattgttgaaaatgaaaatgttattcatatcagcccctggtttatttctattctccacatatctgtaaaaattaaaatcactaagaaaaatccaggcttcatcatgctgaatttggaaggattttaaccaatcgacaaaataaactctttcatggcctctacaaggaccataaattgaagctaggaaccaagatttagagttatgcctagaagtaaattttaggcaaagtgcaaaattattagaggttatcaaagaacccctaaaaatggaaccacaccaacagaccaaaatgccccccctaagcaccatgagaaggcacaaagtgaaaactatcaaatcttttgggcacaacttttttaagagaagcacagtctacaatctctcttttagtttcctaaaagcaaaccctagctggtagctactatcatcaatatttataagagcagcccacttgtccactgaattcatcccccttattctaacataggatatttgagctacgctgctgattcataagtaaaaagatgaacaaagagagaaaacagaccaagcaaagcaagtctggcataagtggcatgatacagaaaaaactagtgaccggctgagtacaataactatcattacaaaataaccacataaaaacaccatatttaaaacaaattgttttttgaaacgaactgccattgataaacaatttaaactaatcatcttcttcagctggcctgggcaccaagtccaatttagctcctcccagcttgcttttagccaccttctcaagagatagactgcacgtttgaactcccatcttttgtaaaaagggaaacagacaatcagatggggaataatcagtttcaaaataaatatcagaatcaaagttagattccttaaggatactgccagaagataaaacattagaaatacatgccaattatttcaacttctttgcaaattttcccctaggtttaccaatgcccatcctgggatttaagtccgcaacatcaatcagcaaggccctcaacctcgagctttgcattctcacttgatcataaagaactgttttaccatctcttttcttagcaggagcctttggaagcactaaatgttagtgatatgccctagaggcaatcatagagatgattgtatcacatactatgtttacatatttatccaactttgttccttgaaatagataactcattattggttaatgaatatgtgattctttcatgaggctctttatgttgtgtgttgctatttctaaaggatccctgatcaaatatcatatgtggaacaaatatgtttagatgatcagcacatatattaattgatgatcatgtctcatggatcatggtatagagataccaaattaataatgtggacacatgttggtgaacatgttgttggatatacccaacatgagacactgcaagagccatatgtgttgtgtcatcattgatctcagttagtgttggtgttgaatccttagacctgagattatcatggttcccaacatgtgtagtagcttacttagggactgctaaacgctactccgtaattgggtagttataaaagtagttttcgggcatgctatgaaacatgtagtgggatatgaataatcaagatgggatttacccctcctatggagagatatctctatcgtgaggcaaagggattcatacaagtatacactagaggttcagccaatatggtttttatgtatgcccggtgggtcaatacgttctgctgggggccgctgttgacgcgtggaccgaaaaggagttttcgggttacagccgagtgtacatgaacctactgggtcgcacacttaatgggccggaataaggagattggatggagatccaatatgagcttaattcggatagggatccgaataggagtcctacgggccttggaggcctgagtgatggatcctatatattcgtgaggggtgtgaccggcggaggtattgcatcacgtgagaaatcctagccgtcactcccctccccgagcaaaaccctagccgcgcgcgggtgctagcacatctgcgcgtggcgttccgtccctgtacgtgtggataccggtagcggcgctgctggtttgcggtgctgatcagcgtaggaatacagcgaggagaacgcacgaggaggagaaggtcgagctggtgcgatcgactacttcttctacatcgacgcacgctacttcgtgagaattccttcgacttcttagcgccttcttccgctgcgcagcacgtcgagtggtaacgatctatgatctaatacttgcatggttcctggtttacgcgatagaaaattttgatttctgctattgtagcctacgcgtaacccaacactaaagtaacagagctagaggcaacaagtgaacttgggtgcacatccatctcctgagaggcagaaatatcaacagggggccacgcagtagagggacttcatcaggagcaaaaatatccagaggggtagggggtagaatagccaggggaactagagaaatcattagatcccctaaagcatgcatgacatcatcaaccactaatagactttttttccatggcccaacttgaggcctcacccacgttgtcccttttaataacaggtggagaacagtcagtgatagctttccttttagggaaaggagcggattgaaaagagcagctatttgaatgggcattgggatgggggctctattttgcaaagagctcaaaagtttcaccctcaaaaggaactcatcaatcttctcctgcatctcaggtgttatagaaaactgtggaaaatatttagtattgtcagccaacattatgatctgcatattttcacttcctccatgtgagcttataccagactgaccagtcccctgattcttagcctgttgatcctagttatcccatccccctacatcctcttgctgctcattaatatcatcccaagctggaccttgatgttgagtggggcctggtggcggtggcgggacaccaatagggggcaaatcttcatcttgcggttgtggattagcaaacttattatttaagttaagcactccaaaggtccacgattccccttgaccaccatgattaggaatctatttaagaacaattcttccttggaccaaatcaacaccatcaaaatatgcctgcaacagaacacgaccagggatagcatcaacctcctgcaagtagtctaactttccaaacaaacccatagctctagagatgtaacttgtagagcggaagtctagaggataccctagaaacataatccacactcctttgtcagcatgagcagctctccagttagtacctctatcatggttcacaaacctaaccacatgacccccattataataaaaaccaaaggctgcaactaatgtatctctaataagagttgatctgacagcaaaaaggccaacaccaaggggatgcggagcgtaatgagtgaccataatacccagttcattctagagatggttacaaatctgcaatctgtgaacatcccattcatcttttgcacttggggttcaatcttatcaagcacgtaggcttcatgctgcttttaacgagcaggaaccgtaatgtcagctttgtgcaaacgatttggactaccatcttgaacatgatgaccagctcccacgaatcaccccggattgaagacaatcttaggacctgtttagtacagctccaactcctaaatttagctccaggagttcgatccagagtagagttctggagctgcctaaacctagctccacaactctagttcattttgtgagagagctccacctagctccactcccagttttggtggagctgaaactgtttggttgagctccagatctaggagggatggagcaggagctggagctatgccaaacatgcccttagccatggcaagattttccgacagcatattggattgagaaggattggggttttctagagcaacagtaatctgtcgagaagaagtaggtgaagaagatggaaaaatagatttgttaacgcctttccactgtcaagtctctttaactatccacttggaagtagtcttactcttttgggccaaacactaatgggccttatgtccataactaaaacagaagttacaccggataggattagaacaatttgaaaccccatgatcctgcctaaggcatcgtgaacaaaactgattagaagatttagaggcctttggggaatcagaaggaaaaactagcctatcaaaaaccgaagaatgatttggcacattgaaatcaagctgatctttgacagatctagaattcttatccagtatactctttttcaaagaatcaaaaaccttttagacagggatcatagatgagggaactgaacgctcagattgaacaacatttgcaaaagaaatactaggctatactacgactgaagatctcagatccttagacttcggtttcacttaagtccactcacgatcttgcttaatgatccattgagaatattctttataccaatctggccccccatttctccacagatgaaaaaataatttgaagtggtgacgagagaaagatttaagagaatagatgtcggcgggtgaactcctccaccagggaaccatgaggccccccttttttggttcggccgggggtagtgattggtattcgaggattctgtggtggagtgtgaataagagggggtcgggcccccctagggagatgagacaatagcggtttatacaggttcgggccgttgagaagcgtaacaccctactcttatgctatgctgattgagagagtgagattacaagatctccttgttggagtggaaggtgttgatgatgaggggaggcgactgctctagtgaaaaagggctcatcccctccctaagtaggcctgcacctccttttatatctcaaggggttactacatgggcccactgagcctattcagggaggataatcacattaaatgcatgtctcgttccttgccttggaagtctcttgcatgccatgttgcggcgtggggcccgtcaaatccatctggctgacacaggggacacgtatgtcattcgatatttaataaatgaggacttttgggtcctcacttgtgctgggaaacggaaaccctaccataaccgggttaggcaagcctcacttgtgcgacaagaggctaagcggcctcccatcatcacgatgtgacagggggtctcaggcggcacgtgttggtatttcttagcgacactactgaaaatataattcccagcaatagcactagaaataatcctggtatattatggttacagatgtgatctgcaagcgcacggatataccattgtagcatttcacctgggagtattccaaggtatcgtatttattttatcccaagggaagatatgataagatagtactatgctaataattcaaatattacttatatacatcaaagtctatgcaggagttaatttagttcaaagggtagggtggcacacagaagaaagaactaagatattctcactaaaatatagtctaagctaagtggagaaagaataacaaaaagtatcattcctgtacttctagtatatatacatctttagtctatacttgttggtatacaatcatgcaaccaataccctctaacagtgtcctcctggtgttttgagagaccaccccttgttgctgagttccttacgacaatctgtcatggccatccaaccgaggctaaatacggaggagtaccctccccaggaaattgtacttaggataatatacacatgcagaggaacacccgtattgagctgtcaccatcagtggccagcctctgaaccattgcatattaccccaattaatggtatataataatctaagcatcgcacttacattactaaatactactctgtatccttgcaaccgacatagagcaaacgaatactcggacactaaacccacaccaatacacctctctggtaagctagtcacacaactatattcgtacaagtataaagtaaagtcggtactcaattatatgaatggaataagataacgaaagtgtataaagaagaatattgtattaattcaataagtcttacaaaagaaaagaggaaagctagtagagccatacccgaaatctcctgaagagtcgaggactatgaagactattctatttcctactccactagtactagaactactaaactaaacttgggagagctcttgatcttcttcttgaggtgtgtggagaatggaatgagataacctcccaatgacggttttggcggttggaatggtcgaaaatgccctccaaccatcattggggagtgatccacaccgtccatcgcaaaccctgcatcgaacggcttcaaggtgggttcggccgaaccatgggctgggctactctggcccatttttggcaggtagcccccataactcctctcttatccagaatagtgaattttggtcctattggatcgtgtcatatctgagttctcagcccatctatccataagtctgattctcgacagcgtctgattgatcgttcatctattttttgtcgattcttctctatttatatgtgcttcttctacatagatgttagtagcatagtacatagtggaagtagatattttattcgggaattatacatcgcaaacatagctagtatttactaattgggtaatattgacggtcgaaactggtcgataacgaccgtcaacaaaccccccaagcttgaacctttgctcgttccgagtaaagggctcacaaaaatttaaacttggttgtcgattaggagttgctactatgctgtatatctcaaagatacagatgcaaggtatgtgtactctctctcaaaccaaataagtttggcattatggcttacccttacacctaattcccgcgagacactgcctttccttgtcttgagcggttgagagacagaacaacaattagagcgctagtcacccaatctttatttaacttttatcttggaagttttcaaatgatttttcaaaagaaatctaagttcctcaaatgattctctcgatcactcagagtgtttgaatatgaattcctcaccaaatttgcctttttgaatcctactctaaggtttgatatatggagcttggtagggatcaaacatggcatacttgtattcacatttattactaagtcaaaaacttggactaaaatagatgactaatcatactcaagatcaagattgtgcaaagtgtgtgtgacatatggtggaaatggaatgtggaaaagaaagaaaattcttctcctttgtgcttactttcttctccaaatcctcctttcataaatatagagagggcatggctacattttttttaacatcttgctcaatattttgagagagcataagtttattatgattattattttcataaccatgcctttccctcctttttctcttttcttttttattcagaaaggattttctttttaggagaagaaagcacatataagcatgaagaatttattttgatgatggtataatggaaataaagatagaatggatgctagcttgcagtgtagaagtttagcatatgcatatatgtgggtgtatgatcttgatcatagagcatgaaaagtatctacagaagtcacaaagatttgacaaatttcaatggacttacaagtaaccaaaatgtatatggcttaatcaatatggatattttttggctctagtaggaactcatatcaaatgaggaactttgaaatttatcatttcggaaaataaaacattcggaattcaagtcaaacttagaacaggatcatagaaactcttatttactatctcatatctcgcaacaacctagactcagatcaacaaagtgcagctagactcagatcaacaaagtgcagctcacttacctcaggttcctgataattgttggttattcttactcaaattttgagagagcacttaaccatgacccatatatgagagatataaaacagaataactattcatcatttcaatatgaataactaagcatgtcttacctagcatattaccctatctttttggtatttttgattttgcaaaattttatgttgtttttaggtgtataaatgcaatgcaaaaatttaaacatgcaatgaaaggaaagatacaagtcaccttagtgagagggggaggggggacatctccccccaagcttgcttcttgctatggctcatggtagggattgaatccctggtagcggtagtacgcttgccaatcagcttactgttgttgcatcgtggtgttgagatttgcaagttgtgcatcaacagattgctgccactcccgtgtctgcaccacatgtccctccagcgtgtgctgcatgctccctgtctgcagttcaagtatgcccatcctttgggtaagttcacccaaatcccctcgagaggagactgagcgacgcatccgggaggcaggaggtagaccacttgaactagaggaacgcgagtacccccagtgctcctatgcataccaccggttgtcactggcactctgccaggtcgaaactccggcatcatactgcaggactttggtccaaccgggggcatccgcggttgggtcccaactgtctctatacatccgcactggtggtgaagaggaagacgcctcctggggtgcttctatcgccattcgtcgtgttaccctgcgtgggacatcacgatacaactcctcttggagagaaatggttagttcttggcagttatacaaataaaaccccgggttaggtagcgggatctcatttgtataaccgaggaagaaaaacacaagagtatcatttggaccatgcttgagtatgtggccttgaaccaaataggcctcatcaacataagagcggggagtagtaatataagatacttgcatattaatcaaagccccaactctacatgctagacgggtaaccaaagatgtacactcaacaggaccggtcaaccttatgttttctaaccactgactaatcatgcactgaacgggtgaaaccttaattctcttaaccatggcatacaagaggataagttcgtctttacgaactatctggacatcggctctagggaacaaagtaaaaccaagccacttatgcataagcctaagagtaggattatgggtgtcattagttctaggctttttacagaatgggagacccaaaatactttgccaaaacatacgtttgttaaaattaggaaatgcgttactgaaattaactttgcatgttttgtcaaagcctagatgcaagctaaggtctttccaagaaaggtgatattccttgcagaataaccggaaattaacaccatcgcctacctttagcaaggtacataaaaactgcatggtaagcaaacgggaaccggttcatctacacatgcaaatttatcccatcctaaagcacgccaaacagtatgaaactcagcatccatacctatccttttcagaaggtccaggtcgtatgcttgggtgtgagcaagcattcggtattttagcatgtaataggcttgcagttcccggtcgcccatgaggtcgagatcggagttgtcgtatagccttggtggaacgtccgcctcctccatcgatgtatcggcggaagagggtgtgctgggctcatcgtgtcgccttaactgtgtgcttgatcctctcttgaatatgcccgaaaattgtttcttcatggctacaaagagcaaggttacaagactactcgagcgggggttaagcaagtacccgccgattaaccttgcaccgaactaaagcaaacttgtatatgccaagtgtctaaactaaatgcagcaaatgaagattgagataggctaagttgaaatgaacttgagagcaaatgaatttgggggagagtattagaattgagttgaattggtatgaatgtctcccccctagccatgcggctgaaaattttattttatttttgctcataaatttattttaaatttgttgtctccaaattcatattaaaatgcaaaactttgaatggaaaaactaaaaaggtaaatatgcgctaatgcaatgcggaaaataaatatgggataactacaaatttacctgttggcaagggcgacatcgttttaggtccgacgagcatgatcgtacctccatcgttttagcttgatgaggtacccggttccagagatacagggacgggtgccttctccttaactcgccacaccttctttgtttttggtgcggtcggtgacctcttcgaaactgggaacgcaggttgaccggcctgtattcccggcttcttgaatgccaacttgaggtatcgacggatcctcgtttcttcccgctccaggaagttcaccatgaaatcgatgaggctatccgtcagggttttactttgaccttcctcatgttctgttggttttggttcgtacgtaatattccctatggagcaatgtaccatccttcatctctttgtggacgataccgttgttgttattcatgaacatgacatccttatgggtttccggacgatctgtcccagagtgaccgtcatttccacagaccttacatgtcatgtgagagcccagggccttaacagtaccctgcttggcgtatttctcactgttgtctagtctctttttaaggagatccaacttagcagcgagcatttccgtctccatgatggtgtgcatgccgcgttgatgggttaagagtcgttccttgctccaacctatgtttgagatcatcttctcaatcaggttagtggcacctctaaccatatttgagaagaatgtctttccagcagcagcgtccatgtgatcccaggactagaggattaatccattgaagaaattttgcaggatgagccactcgtccatccgatgaggacgagtggtgacgtactactgcagcctttcccaagcttcaggattggtttcatccctcatccgctgaaagctggatattcttccacgaagagcgttggtttttgcccattaggaagaattttgagaggaatgtcgttgagcacttatttctggtattcaccattgcacggttggcgtagaaccactatttcgctcctccaaggaaggagaacggaaacagtcggagcctgatagtatctggactgactccgtgctacagatatctaggaattactggagatgagcacttgcatccttattaggcttgccacataatgggctagcctacaccatcgtgattaggctggttttcaccatctcccatgctgacttcgggagtccaacgggcatgttgtcagcagagggagcagtgaacttgtgaagggtcttcttagccatatcgttaagtgttgatgacgctggtatgactgatctggttgctgataaagtcacttgaggagagatgactctgggtctggctcttctcaggagtgattccggattctctttgaaattgatcagcaaatccaaaccagtcatgcactaccctgttttcacataaaagagaaaacaaatatgggttgcctacaaaggacaatgatcatacagaggtaatatataaaattattagcatgtagtaaactcttaaatcatttatccttgttagcgaccaaatttggtaattcaagtatcgaaggtgaagataaaatcaaagcggaatctaagagatagatcgttccggaaacagagcaagaatcggccgaagtccgaatcggctacgaccagaatcgacagagttcgagtcggacaaggtagccgattgagccgattccgacaatgtgactcggtacacgttgtcgggttgagttaatgtgcttcatatggattgccatgcacggattgagtcctgaaaaggcaattgtatctattaattagaatattttatgtaacttccttagagataagtttgggcaaaagtctgccgtaaagacttatggtgtcttagagtttgttaaagataagagtcgtgtccgacaaggacatgttttgtatctcgggtataaatatgactcgaacctatgtaatcaaacaacacacattcaatacaatctcgacgcatcgccaccctttttactttcgtttcatctcgacgaattcttgctttcgggttgagttgcatcgtttcgatcttcaactagaggtaaacttgtcatgacggcttgcgttctcgggattagtgcttccatctttatgacactctaatcctatttatgtaaatcgtcgagttatcatatatcctatataatctctggcaatattgttatttaatccttaattagctaacatatattactggaaggcagccgattaggttaaatattaacgttgacctagattatatagggtatccaccaccctatgaaacgtccaacggcttgattgtctagatattgtccttcttttctgtcacgcccggaatttctatccaaaattccaaacgcttacatgtgtgtaaaccctcgtccatgaatcagccgaggcacacaataacaaattgataataaagtacaattattactctaattaataagcgaataaaatatcattacagaggtagatagttcctctcaatcaataaagttctaagcagcggaaaataaaagaaacagcgcaggcgactcctctccacaggtagcttgaccaggactaggcctaatcctcaacaccatcagcatcactatagaactcctcctctgatgaatgattgcaaggtaagtatatgacatacttagcaagccacgcagcaaatatacaagtgcacaggataacaaaggatggcatagtatagtctcatttgcataaatagcatttaacaaatatttcagaatttaataaaacagttaaataataattaaacaatattaatccaacgctatacaacataccctgttgcataggcccaaccattctgaacaaccaatcccggctgcacagttctatctccaaaccaggaattaaccattctaaaccaggagctaaacaagttattaacatcataaattaatatggtgagaaatgtgagactaattacgaaagacattgttagacacgcccataaccgcgggcacggctattcgaatagtttaaactccggccagaggtgtaccactgtacccacaagacacaacctcaacatcatgtcaaccatgtgtcgcgatacttgacaagtacccaaatagagattgtgacaataccctctatataatacaattcaaagcagtgcaccgttcccggatcataatcacccccttataaacaaggtatggactccccagcgacccccgtgggcttatctctgccacttcacagtctggtgctctactatgaaccatgctatacataaagtaaagccgttgcccacgccggcttgtggttggcacggtaaatgtttcacaaccgaaaatcgtgaaccggtccttaattgtcatgagcacaaccatcaaaatcatatgctcacaacccaccattatcaatttttagttggcaaattaattaattaaccaatcatgattaaccatcatgagctaccattaagccatcattaaataatagtgaagcataagttatcccagtagtgtgctaatgtttctaagcataagttatctaatatccagctgaacccatatatataaagctcaactagtcaagttataataacccaaggtatcaaagaatagggtaatcaagaaataacaaagcaataggttatttccacccaatgacattcaaaaataaatgcaattgttgaatagaaacaatagctttaaacgagatcaacatgctcaaaggattgtttgggatctgtgtgacttgccttgctggccttggaactcttcaaagtcttctcctgcaaattcggactctccgggaacgtcggaatctaaagagaaaagaacaaaatcaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacatttatatagattttaattgaattatgacacaataatgaattatttttgaaaaggaaaaaggggattattgcgtcagcgggtcggctcacggtggaccgggtgcatggcggcggatcacggaaacgaacggccgtgatcaatctatccaaaacgggcggccaagatctaacggtctacgaccggtctacgacggacggcgtcgatgacgtcagcgatgacgtcatcaccaacggcggctcggcctcgcgtgctcgccggtgaacgacggcgtggcgacgcaaatgaaggacacctacgggttgctggcgacgcggcgaactcaccggtgaccaaaacaacggcagaaggtcatcggatggcgacgacgatgaggaagaagcggcggcgaccttcggcttgacgacgacggcggggctccggcgatctacagcgacgacgaaggggcggacgaggtcggcgacgacttgatgatcacgacggcggctttcccgagcgatgacgacgaccggagcgacggcggcgcacggctggacgaacggcggcgacggcggcgctaggctacacggcgctagagctctaccggcggcgagagacgaaagcgagggtggcggcgggtagaggagacaccggggtccttttatagcggctaggggtggcggcggaggcccacgacgaccggcggtgtgaaggaaagtctagggttcggggagagagacgaatccgattcgagatcgaatccacagatttccaaacgattttagccgacgatttcaaaagagaaaaggtagagtggatctcggggatcattttccctctatcaatttcaccggatcgagaaagggatgaacgaatttggaagggcggcggcggcgcggctcggctagggttcagccgggcgacggctggaggttgacgacggccctctcagcgggaggacgcgcgagcacgcgcgagcggcgctcgactgcgggccggcttgggccggggagagagagagagaggtttgggccgactttcggcccaaagccaaaagagaactttttaaaacctttttcaatttaaattattcatgaaatgcaattccatttattaaaaatacttccttggctcaaataaatctcagaaaaatctaggaactatagaatcaagcaaagtatttaataaaattttatctagcccacttttatattggaatttattatttaaaattagatcttctcttctaggcttttaaaatcaattctaataattctaattaaacaacaatttatatatttgggatttttagggtgtgacaaacctatccccctaaaacggaatctcgtcctcgagattcggaagaactggcgaacaaatgcggatagctgactttaattcatcttctcgttcccaagtagattcttcctctaagtgattactccattgaaccttgcaaaaacggataactctattcctggttcttctctcatctgtttccaagatacggattggtttctcaacatatgtcagatcctcttggactcctatctgttcaagattagcttcttcggtaggtacccttaaacactttttcaactgcgacacatggaacacattatggactcctgccaaagattgaggtaactccaactgataagcgacctctcctcttctactgacaatcttataaggtcccacaaaacgcggtgccaattttcctttggtgtgaaaacgatgaacccctcggagaggcgtgacacgaaggtacacatgatctccttcttcaaaacttaaatctctgcggcgattgtcggcataactcttatgacgagactgagccacacgcaatctttcttgaatgatctttaccttctcttctgcttcccttaggatatcagtcccgaaaacctgacgttctcccgtttgatcccacaaaagcggagtgcggcacttccgaccatacaatgcttcataaggagccatttgaagactagcttgataactgttgttgtacgagaattccgcgtaaggcaaattcttatcccaacttccaccgaagtctaaagcacaagctctcaacatgtcttctaaaatctgatttaccctttcagtttgtccgtctgtctgcggagataagcagtactaaagttcagcttggaacccatctcttcctgaagcttcttccaaaactttgaagtaaactggctacctcgatcggatactatcttcttaggaacaccatgcaaacacacaatccttgccatatacaattctgccaaccgacttccggaataggtggtcctcaccaggatgaaatgagccactttggtaagtctatcgactatcacccaaatagagtcatggcccgatgacattctgggtagaccagtgatgaaatccataccgatttcctcccacttccattctggtatcttcaaaggctgcaaaaaacctgcgggtttctgatgttctgccttgactcgctgacaaacatcacatactgctacatattctgctatctcacgcttcatacttgcccaccaaaatcattccttgaggtcttggtatatcttagtactaccagggtgaatggagtataaagtatcatgagcttccttcaaaattgcatctttcaaatctttgttgtctgggacacagatcctctcacccaaccatacagttccttgctcatcttccaagaaaccgatagcttttcctcgtctcatattcttcttgatctcatgaatatcaggatcattgatttgagcttctctaacttgatcaatgtcacgcccagaaattcccgaatagaattccaagcagaatgtgcattaaaatccccgtccaggaccggccggggtacacaaacgacaatgttgacattcagatccacgtcttacaaacattatcaaagtcttacataaatgcagcggaaaaacgagatataactggagcaaagccttgacttgatctgcagcgggaacaccactccacaggcatcctcgacggcacggacgaagcctactcctcggagaaaccaccatctgacacatactcatactctagggttggggtaaatagagcaagactgagtactacccactgtactcagcaagtcataccggaataggggtatgatgcagggaattatcaaggggtagctataatggttcatttgcataaagcaggcatttataaacagaagtttaaagaagtaaacagttgtaataattaatcaatattaatcatccactgtccaacgctatcccacgttgcaacaggcccaaccatccacctaaactatccaatttcattagactacactagggtgaaactaatcacggtgaatctggttgaccgcccataaccgcctgcacggctattcgaatagttttactctgatcagaggtgtacaactgtacccacaagacacagccccacgacacgtttccgtgtgccgacatgccaccacgacatatcggaaagaggccgtgacaggacccttcgcataaccccctctaaccaagcacaccacacctcaggtttcacccccactccttgcaaggcagcgggcagtcccctctcgtgcctaggtgaatccggaagcgacaaaggccgtcgtagggcccgccccgctccatcacgcccacccttgcctggatgcgtcagctagaggaaaactacactataagcccagccgttgcccacgctggcttgtggtaagtacgataagttcttccaaggcatcccgcgaaccggtccttaattgccatgggtgcgactagcaaaaccatgcacccacagcccaccatgtgattcattttaattaatcaacaccaaagcggtggtactaatccaacattaccattagaacctacagtctaaacagtaataggatctccctcattgtgtgctagttgaactaaacatggctaagcaattcctagtccaaagtctattcatgttataacccaagctaacaaggagcatggtaccaaaatagcatggttgtaacaataggtgaacatcccatagtaacattataaaacaatgcagtatttgaagaaaaacaatagagcatttgcaatataggatcaacatgttcaagtgacaagcatgacttaccttgctctgctgctggaggaacctcggcgactatctcgaagtacaccggagcgtcggaagaaccagaatctaagcgacatacaaggcaaacaatgcaaacaggctataagactactgaaacagagaacaaaaccatttttaatggattctacaattttttcttgatttactaagacatgattgggcttaaacggagcacggatgaattagttatgatttttagaagattcactgtgtttattactataacaaaaagtccttaaatcatttattgcgcaataagtcctagggctgacgtcatcaagggggggggtcagcgccgacaggcgggacccgcatgtcagtggcgcaaggggtggccggtctaccgtggaccgggaccacgcgggtggtccaccaccggtccacaggatcgacggtccggatcggcccagggccgatcggacggtgcggtggctgcctggctcggctcgactcggcacaaagccggccggccggccatggcaagggcggcggcggcggacggctccccggcggcggcgacgaccgaaggcgacggcaagtgcgggtggcggcggcgcacggggaaacggggaaggaaaggaaaggggagggagtcctcaccggagggggcggcgacgaccggcgacgagaggcgatggagggaggtcgacaagcggtggacggggtccgagacgacctaaagaacgaaaaggacaagattagagagggagagaggggccatagaaggcgggaacgccggccgaaggcgacggacatggcggctctcaccgtcgcacggcgggaatggcgctccggcggcgaacctcgacgaaggaggggtggacggggtggatctcggccactcgaaccaacggaggcgacggcgcggtgtggcggcgagcctagcggcggctagaggcggccggagtggcgggaaaggcggcagcgggtggatgcacggtgcgggagcgatggggaccacgagagagttcggcgagatggggaaaaagagagaggggatggcggtggagcttatataggggagggggaactcggacatggccagtaggggcatgattcgccggccgacgtgggggaggtggaggtggagagagaggcgggattcggaattcgaatcccggccatctcgggcgcgggcacgagcgggagagaggggggagtgggtgtgggagatgcggcgcatacacggacgtggccgacgtggcccggaggaggcgggacgtgggcgcggcggcggttttggcggtggtggcgacgtggggacgggtggccggaggaaggggacgaccccgacaggtggggcccacctgtcggcgtcccggggagagagggaaggcggcttgggccggcccacaaggaggagggcgcgcgcggcggcggcggatggactgggccgacggcccaagaagaggaaaaggagggaaaagaaaaagaaaaggaggaaaagattttccctgggatttaaaattgcatgtgctcaattttaattagttaaaattatttcgagggctctgaaaattcaactaaaaatcttgttagcgtatttcgacatgtagaactcaagaaaaattccacatgccaattctgattattatttgcattaatttattaaggtttactattgctttacactggtattttcttgagaccatttaaaactccaatttaggcttgggaaagaacttcggggtgtgacaaacctactcccccttaaacggaatctcggccccgagattcggaggggctggcgaagaggtgcggatgggcggcgttcaactcatcttcccttatccaggttgcttcctcctctaaatggtgactccactgaatccggcaaaacctggtgaccttgtttctagtcctcctttcgctggtctcaaggatacgaactgtcttctccacatatatcagatcttgttggatatcgatgtgctccgaattggcttgttcttcgggtaccctcaagcacttctttaattgggatacttggaacacgtcatggataccgatcatattggatggaagttatagctgaaacgcaacttctcctcttcgttccaagattttgtatggtcccacgaagcgtggtgccaacttgcctttcgtctgaaaacggtgcactccccggagcggagtaacacgaaggtacacatagtcccctgcttaaaacgtgagctctcgtcggcggttgtccacgtagcttttctgtcgagactgggcaatcctcagcctctctctgacaatcctgactttctcctctgcttctgttaacacttccgttccgaacagttgacgttcgcctgtttgatcccagaagagaggtgtgcggcacttccggccatacaacgcttcgaacggcgccatttgtagactggcctgatagctgttgttgtacaagaattcggcataaggcagacttttatcccatgctccaccaaagtcgagtgcacatgctcgtagcatatcttccaagatttggttgaccctttcggtctgaccatctgtctgcggatggtaggctgtgcagaaattcagccgggttcccaattcctcttgcaatttctgccagaactttgaagtgaattggctccctcgatcagatactatctttttgggtactccatgtagacacatgattctcgagaggtagagctctgccaaccttttgcccgtatacgtggtatgtactggtatgaagtgagcaaccttagtgagtcgatccacgactacctagattgaatcgtgacccgatgatgtccggggcagtcctgttataaagtccattccaatctcctcccatttccattccgggatttgaagaggttggagtaaacctgctggcctttggtgctcttccttcactcgttggcaaacatcgcagagcgcgacgaattcggctatttcccttctcatgctgactcaccaaaacttttctttgaggtcttgatacattttggtgctgcctggatggatggagtactgagtctgatgagccttggtgagtatcagatccttcagttacttgtcgtcaggtacacacaatctttctcccatccaaattgtgccgtgttcatcttcgtggaagtcccaggcttttccgaccctcatattctttttcagttcagctatctcaggatcattcacttgggctactctgacttgatccacgagcgtaggtcgtgcctctagggcagccacgtacccgtgttcaacaagtcgcaagttgagacgctcaagctcctgctgcaattctccacacatgccctcgatgcatagggcattgcagtagcttttcctgcttcgcgcatttgccaccacattgactttacccgggtggtagtgaatgctcatgtcatagtctttgattagttccaaccatcttcgttgtcggagatttaggtccggttgggtgaagatgtatttcagactcttgtggtccgtatatacttcgcagcggttgccaatcaaatagtgcctccagatcttcaaagcatgaaccactgctgccaattccaggtcatgagttggataattcccttcatgtggacgcaactgccgcgaggcatatgcgaccactctgccctcttacattagaacacatccaagcccgtggcgggatgcgtcgcaatagacttggaagtctttcatctggtcgggcagaatcagaactggggcggatactaatttcttcttgaactcctcaaaactcttgtcacactcagctgtccatttaaacttctcatctttcttaagcaactgagtcatgggtcgggcgatcctcgagaagttttcaatgaatcgacggtaataacccgcaagtccaagaaaactccgaatttgcgacacggtcttcggtggggtccatttggtaactgactccacattcgacggatcgactgccacgccctgagctgtgatgacgtgacccagaaatttgacttccgacaacaagaagtcacacttgctgaacttggcatataactggtgctccttcaacttctcgagtaccagacggagatgttgcttatgttcttcttcagattttgaatagataagtatgtcgtcgatgaacaccacaacaaacttgttgagaaattccatgaacactttgttcatcagattcatgaagaatgcgggtgcgttggtaagtctgaaagacataaccgtgcactcatatagcccgtaccgagtggtgaaggccgtctttggaatatcctcttcccgaattctcaactggtggtagcctgatcacaagtctatcttagaaaacactttagctcctttcagcttatcaaagaaatcatcgatccgcggtaaaggatatttgttcttgattgtgacctcattgagtgcgcgatagtcgacgcacatcctcttcgtcttatcctttttctccacaaaaatgaccggtgcaccccaaggtgaagtacttggtcgaatgtaccctttctgcagctgctcatcgacctgcttcttgacctctgctagctcgttggccgccattctgtacggtctcttgtaaataggggcagttcctggtgccaaatcaatccggaattcaatctctctcttgggtgcatggtagtgaggtcttcagggaacacttctggatactcgcagactatggggatatcctccaatttccgcgaacccttctcctcggtggtcacagggttttccaccttaatctgattcaaggaaaccccttgctttggtgagactagtgacttgtacaccacggtttctcccttctcattggtcaaggtgactgtgcgattcgcacaatcaatgacacccttaaacctggtcagccaatccataccaagaatgacatctaggtctttggattcgagaaggatgaggttggccagaaagagtgatctttgaatttctatcgttaccgaggggctgaattgaaccaaagtggagctattccctggggtatgaacccgcattggtgtactaagttcctctcttattaacccatgcatcccgacaaacttctttgaaatgaatgaatgcgttgcaccagaatcaaaaagtactgttgcagggattgagttaacaggaaacgtacccagtacgacctctggtgctacttgtgcctcctccgcagacgcgtggttgacacgagcctggacaaaccttggcccagcacgcctaggcttcgggcatttgttagcgaagtggccaagctcgccacagttgaagcaggaccctggctttgtcccagtctccttcttggcttgcgtggacgaagctgactgtgctggtgccattggtgggcgtggagctgcactgcggttgggctgaccgccatggtggttctggctgccactagcgccctgatggaagttgctggcattgaaagggcggtgctagtggacgatcagggtggtaggtccaccctgctgtccgggagtgaagcgcggtcgctggtggctcccttggttggaccggaactgcgccgccttcctcttcctatccattttgttgcgctgatcctcctgacggattgccttgtcaaccagcctctcgaagtcggcgtagtctccagatatcaactggttggttagctcatcatccagacctgctaggaatttctcctgcttctcggcgtcagtacggacatcctccggtgcatatcgcgcgaggcgattgaactcatggagatactccgtcaccgtcctgttgccctggtggagtgctcggaattctctcttcttttgtgccacgaccccatctggcacctgcgccttcctgaagctgcggcagaactccacccaagtgacttccgtgcctggcggacgtgtggccatgtgattgtcccaccaagctgatgcgggaccctggagctggtgtgtggtgaaggcggccttctcctgatcattgcactgcaggagatttagcttcttctctatggcatggagccagtcatttgcctccatagggttggtggtgctagaaaaggtgggtggtctgacgcgtagaaactccggcagtttggactgagggggagagggaccaaactgctgctgctgctgctcggcttgctgccgcatcctctggtacatctgctggtgctgctgctgcatctgctgcatcatggctgtcatcatctacgtctgatgagccattacttgggcaagggtcggattctcggggagtggtggcggaccattgccggaaacgctgttgggatgcacaccatcagtgcgctcttcgccgttgctgccctcgcctgttgtacggctaccattcctggtgtagaccatctggaggaagagcggacggtggaaaagaagaaaagcagatgctcaagaactaagctttattatataggaatttaaactacaattgttctgatatgaattaaaacacttaaaaagcaagcaaaaatccttattaagacagccatatcataggcacatgatatcgactgtcgactaacccacaagcaagcaacctaaatacgcaaactaacaagcagaagctagacagtcgataaactaatggaaagcgagcctaatgcttggaacggctcctgcggtcggtggagtcgaaggcgtcctcctgctcgtcaccaggtccctctaagcggctcctggagtctggcagatacgtctcgccactgcccggctctgtgccactagaactgctgctgctatggtcgcggctgccactgggagtagcaggcaaccaacccccgttgccactagctgggcccctggctgctgacgctagagcgaaggagagagcgaacgcgggagctgacactggaactggagctggggctagagctggagctgcaggaattgcgggcggaggtgggttcctgggcgcaagctgaatgcacacgggtgcagtcgtcgtcttgcggggcgtggtgcggatccggactcctgctggcgctgggagacccttcaactgagcattctccttcttcaggcgtgctatctcatccttcagagctatgatcctcacgagcttcccatcgttcaaggccttggacgccttgtgtagatccgagtgcatcctgtccatccccctcatcacggcgcacatgtgaccaaaggtggtgtcgttctcgccggctgtcggatggaaagtactgacatcatcaccgctggctcgacgagggtgaaatcggtacgccgtgtcgtggaagatgtagttgtggtgctcctgtagtctggccatcatcaggtatgctacctcctgacaggcgtgatctgctgtgcctccggacgcctcaaccaccatattagcgaggcaggtgcccacaaagccatggacctccaggcggacacggtgaggaagctcgccactgagcggtggaacagtcgtgtactctggcgcgttggggtagcccaccaccagtgtgatgcgagccaattctgccacgaaatcatccatgccttctccgcggtggttgggtgggtggtcggccatctagagaaaacaaaggagtaggatcaatgcatgctcaaacccaattttaaacaaagcaataaaaactcaaataagagaagcgaataagaacgaaattttatgcatggatcattttgcatgagagcgaataaataagacagacttacataacgataaaataatggggaaattagagacatactaataataacaataaaagcataaataccttgcaacccatattcctgagctaggacctaatgcatttcacccatcaaatcccaactgactgtcgaaaatatctcaaataattttactgaaaccctagactaacttgttttgacaaatctcacttaaacgagtgaccaagatttttcccttgaaccacaagaacagaccccaattttcccgaaacaaatccaattgcaaaaaacatatgcaatgaaaaggattcagagggctcttaggtttttccatttggcttgtcctatggtcaaggtcggctctgataccaacttgtcacgcccagaaattcccgaatagaattccaagcagaatgtgcattaaaatccccgtccaggaccggccggggtacacaaacgacaatgttgacatttagatccacgtcttacaaacattatcaaagtcttacataaatgcagcagaaaaacgagagataactggagctaagccttgacttgatctgcagcgggaacaccactccacaggcatcctcgacggcacggacgaagcctactccttggagaaaccaccatctgacacatactcatactctggggttggggaaaatagagcaagactgagtactacccactgtactcagcaagtcataccggaataggggtatgatgcagggaattatcaaggggtagctatattggttcatttgcataaagcaggcatttataaacagaagtttaaagaagtaaacagttgtaataattaatcaatattaatcatccactgtccaacgctatcccacgttgcaacaggcccaaccatccacctaaactatccaatttcattagactacactagggtgaaactaatcacggtgaatctggttgaccgcccataaccgcctgcacggctattcgaatagttttactctgatcagaggtgtacaactgtacccacaagacacagccccacgacacgtttccgtgtgccgacatgccaccacgacatatcggaaagaggccgtgacaggacccttcgcataaccccctctaaccaagcacaccacacctcaggtttcacccccactcctcgcaaggcagcgggcagtcccctctcgtgcctaggtgaatccggaagtgacagaggccgtcgcagggcccgtcccgctccatcacgcccacccttgcctggatgcgtcagctagaggaaagctacactacaagcccagctgttgcccacgctggcttgtggtaagtacgataagttcttccagggcatcccatgaaccggtccttaattgccatgggtgcgactagcaaaaccatgcacccacagcccaccatgtgattcattttaattaatcaacaccaaagcggtggtactaatccaacattaccattagaacctacagtctaaacattaataggatctccctcattgtgtgctagttgaactaagcatggctaagcaattcctagtccaaagtctattcatgttataacccaagctaacaaggagcatggtaccaaaatagcatggctgtaacaataggtgaacatcccatagtaacattataaaacaatgcagtatttgaagaaaaacaatagagcatttgcaatataggatcaacatgttcaagtgacaaacatgacttgccttgctctgctgctggaggaacctcggcaactatctcgaagtacaccggagcgtcagaagaaccggaatctaagcgacatacaaggcaaacaatgcaaacaggctataagactactgaaatagagaacaaaaccatttttaatggattctacacatttttcttgatttactgagacttcaatgggcttaaacggagcacggatgaattagttatgatttttagaagattcactgtgtttattactataaaaaaagtccttaaatcatttattgcgcaataagtcccagggctgacatcatcaagggggggtcggcgccgacaggcgggacccgcatgtcagtggcgcaaggggtggccggtataccgtggaccgggaccacgcgggtggtccaccgccggtccacgggatcgacggcccggatcggcccggggccgatcggacggtgcggcggcggcctggctcggctcggctcggcacaaagctggccggccggccatggcaagggcggcggcgcgcgcgcgtcgaccggcgacggcaagcggcggcgcgggcggcggcagcggacggtgccccagcagcggcgacgaccgaaggcgacggcgaacacgggtggcggcggcgcacggggaaacggggaaggaaaggaaaggggagggagtcctcaccggagggggcggcgatgaccggagacgaggagtgacgtagggaggtcgacaagcgtcggacggggtccgggacgacctaaagaacgaaaaggaaaagattagagagggagagaggggccatagaaggcgggaacgctggccgaaggcggcggacatggcggctctcaccgtcgcacggcgggaatggcgctccggcggcgaacctcgactgaggaggggtggacggggtggatctcggccactcgaacccaacggcggcgacggcgcggtgtggcggcgagcctagcggcggctagaggcggccggagtggcgggaaaggcggcggcgggtggatgcaccgtgcgggagcgatggggagcacgagagagttcagcgagatggagaaaaagagagagggggtggcggtggagcttaaataggggagggggaactcggacgtggccggtaggggcgggattcgccggccgacgtgggggaggtggaggtagagagagaggcgggattcggaattcgaatcccggccatctcgggcgcgggagcgagcgggagagaggggggagtgggtgcaggagacgcggcgcatacacgggcgtggccgacgtggcccggaggaggcgggacgtgggagcggcggcggtttcggcggtggtggcgacgtggggacgggcggccggaggaaggggacgaccccaacaggtggggcccacctgtcgacgtcccggggagagagggaaggcggcttgggccggcccacaaggaggagggcgtgcgcggcggcggctgatggactaggccgacggcccaagaagaggaaaaggagggaaaagaaaaagaaaaggaggaaaagattttccctaggatttaaaattgcatgtgctcaattttaattggttaaaattatttcgagggctctgaaaattccactaaaaatcttgttagcgtatttcgacatgtagaactcaagaaaaattccacatgctaattccgattattatttttattaatttattaaggtttactcttgctttacactggtattttcttgagaccatttaaaactccaatttaggcttgggaaagaacttcggggtgtgacaatcaatgagggtgggcttcgcttctaaggctgcaacgaaacctctactgacaattcccaaatttaatctttcaaattccttgcataactccaacggcaactgtcgtccttctgtagcattacaatagcctttcctgctgagagcatctgctacaacattagcctttcccgggtgataattgtcggctcccaaaactaatgattcggaaaccgacatgtttaactgtttcaagccctggatcagtagattgatacaggttcaacaatctagatcttcatcgcatacatttggtaaagactccaaaggagatatctttatataaaataataggacatttacaagtttgtggctaactattacagcagaagctatatgatgactcaactctgtcgttttactatagaattaaaccatctaactatactactagacttgaagactaggtttaaagggaactaacttatgtgattgaactcccagcttcggcaaaaactccaattaaactctgaaaaagaggggttgaagcaagggtgagtacaacgtactcagcaagctattatattattcaacaatgaatgcatgagaggtaatatctgtgtagagctagatttacttgcagaaggctgagaataaagaggtagaactcctgaaatgtttgatatgcaacagtatttaagaaaatcttgaattatatttctaaccaaagtaccatatgagtcccgatgctcaatccgtaagcacggctattcgaatagattcaaggatattcatactgcagtagatgtacgctttacccgcagtccacgacttgccaataatcattagcttagtcatggcccagtattatgttgttaacaattgtggcacctgttccatgaactctagtccccatgcgctctgaaagtaacgttatcagcagcgagagaagttctggcgttcccagggtttttagagagaactggatgagagaccccacgtcatctcaaccaggttctcataaattcacacacacatcgcgcgataatcaagatatttacctgcgcctcggtaaatatcacatttgcccttcgcggcatatatttgcctccttcgcgaggacttacataagaaccactgtacagaggtaccacattgttaattaacataatatctaggtctgtccccattctagaagctgcggtcgtactcgttcgtttgacataagtacttggtaaacttatatcgaccgagacagtactagccacccggaaatcaaccaaatcttacgtactgtcccaatctaagttcattatgttttatgcagtctaactaggcagggctaagcaaaagctagcatataaccgatttgctatatgtttagattatgcattccaaatcatgaatgactaatgcatagaatagaaatatagaatacaggacatttatgttcaaaggggaggaataataacttgccttgctccaacgcaataaatccaacataggcaacctgattatccgattctcgaaataccataggttgccatccaaaagacaatagactctactgagaaagaggaagaactaatttcaataaaagccataaaataataagaaaacgataaacggttaagagggctagggtttaaggtataacctatctcttttatagggtatagggattatggggctagtatttgctagtggtaggtttaggtggtataatacctagggtttagttgtatgggagtcgtttgtggagtaggatagcatatcggctaggctctatattttatgtggaggctctcgtggtttggacgataggaaatacactagatagttgatatggttaaataggcatgtggctaacatgggtcaaggttggctttgatagaatagtggctaggatttagttgtttatgccgatatcgaggtaggataaatatcggctagggttttaggtgtttgctagtcgtcgctagagttgggcagcatgacgactaggtttggtatcatttctaaccgtgtcgatagacagcatatcggctagaagaataggaggtgggtgcaggtttagtgggacggaagtgttactccgacaaccgtgagtggcagcagagcggctaggatcacacagagctcaagagctaacagtgcggcgtgcaatggaggtcgaggggatagtgaagctccgaccgctgtacgcatcaaggcgtggggtgccaggagcagcacttcgaccttgggtttggttgatgccgggctttacaaccaacgatccgacgttgaggtccgtagactgcgcaaacgtccccatggaaggcgtaaagttccaaccggcggctttttagtggctacagggtattttggaaataaaagaaaatatttgaaaagcaaatataagtttaagttgtaaattcaattataacattaaatcaaatatttattcaaatggtatttgaataaattaagaaaattcaaataaaatcttaaaatagaaaatttgacatcaaaatgaagagtttgaaattagatgaatttaggtccaaatttcactggaatcggatctacggtttaggagacataggcttctaaagattgggatttgaattaaatctagaaaatacgaaaagttactgttgatgggcccacctgtcgatctccttttctttttctctctccttctctcgtcttcttcttcttctcttctctgttccagagagagagccgagagaagagagaggagaaggcgagcggggcggcggcgctccggtggctggagggcggcgacgtcggcgtccacgcgtgttcccgagcaagacacacccggggagggcggtggctggcggagagagtgaaggagttggccggaacggcgcagtcaagagcttgtcttcggcggcaaagagaggtggcggtggtggttgctatggagtgggggggaaggggaaaacgggaaaaatggaatcacctcgtcgaggcgaactcgatggcgcgatggtttggcttgcgaagctccggtgagggagatcgggtggtggcgaccatggccggacatgggagagaaagagagagagatggagctctgattgtatgtagagaaggggagggatggccagctatttataggggagagaggcggtggtgaaaggcggttgtggaggaggagatcgagaagtgcacgggcgacgatggcgtgaagattcgaactacggcggccggcttcgtttccttagcggcgaaggaagaggagttggcggcggcgtgagccgtgcacgacacgcgcacgggaggagggggcggctcggttggggtgtgggctggtttgggccggctcggcttagctgggccggcagcccaagaaggaggaggaaaatagaagataaaagaaaaggaatttggccaaaaaggaagaaagaatggagtttcggcccgatgacaaaaagaaagaagtctaatttgaatacctgatttggataactaggttttgcaaagaatttgaatttggaaagaattcacaaaagagatttcctaatttatttgagtgcaatatttagaggtggagtttgagggaatttatttggaagcactcaaataggaagggaagttaataatattcctcaaaatatttttgggaatattgaagggaattagttgaaggcaataaataggatttgaattctaaaattggtgtgatgtgtatttgtggctaaaagagaaagttgaatgaagagtataagttggaattttcttagcacaagagcaattattcacaatatttgcaataatactattcttgtgccgaagaggaaatcaagccacataaattaaattggtggctagatcaaaaggaggaatttggatatttggatcgagaatcaaaggatgggtttaggatcaaaggatgggctaacaattaattccaatgagattggaattactttggtctaggttcaaggacaaaaattggaggatttcttggaccataatttgcaatagtaaaaatggttttcaaactaaatttgaataaaagagttttagtcgaaagaaggtttaatattcgaaaatagaattccaacaagaaataccaaatatgtttttaaatgaaaaacacaaaagggattaaataccagagaggttttatgcgagttaattttaggaagtcccgctaagtatattttcctaggtttaaaaggttattaagaacataagaatcagcatgatgcaagattagaaaatgacacattttcaggatgttacaataatgaattcccatatcataatccttaatcaattccaaccatctccgctgtctcatgttcagatccggctgggtgaaaatatacttcaaacttttgtgatccgtatacacctccgtacgagtaccaaaaagatagtgacgccaaatcttcaacgcatgaaccactgcggctaactcaagatcatgagtagggtagttcttctcatgcgggcgtaactgacgagatgcataggcaaccaccttcccatcttgcatcagaacacaacctaacccaagcttggatgcatcgcaatacacttggaaacccttctttggatcaggcaaaatcaaaatgggtgctgatattaggcgacttttcaactcttgaaaacactgctcgcactcttctgaccacttgtacttcacatctttctgaagcagtcgtgtcatgggcttggcaatcttggaaaaattctctatgaacctccagtaataacctgcgagacccagaaaactacgaatctctgaaactgtcttcggttgtttctagttggttacggattccacattactaggatcaacggcaactcccccggctgagatgacgtgatcaaggaacttcacttcagacaaccagaattcacatttgctaaacttggcatacaactgatgttctcgcagcttctctagtgcaagacgaagatgttcttcatgctcttctttggttcgggagtaaatgagaatgtcatcaataaagactaccacgaacttgtctaggtattccataaacaccttgttcatcaagttcatgaagaaagcgggggcattggtaagtccaaaagacataacagtacattcaaacaacccatacgtagtggtaaaagctatcttaggtatgtcttcctctttaatcctcaactgatgataccctgatcgaagatctatcttggagaaaacggtggcacctttaagctgatcaaacaaatcatcaattctgggcagcgggtacttattcttgatagtcacatcatttagttcacgatagtccacacacatcctctgggtatgatctttcttttccacaaagatcactggagctccccacggagacgaactcggtctgatatatcctttctgaagcaaatcatctactttcctcttgacttctgctaattcattggctgccattctataaggtctcttatggatcggagttgttcctggtaccagatctattctgaattctatatctctcttgggcggcataccaggtaaatcatccgggaacacatccgggtactcctgtactataggaatctcttccaaagttatttggttcagacttgaccttaaaggctcagaaggcaatgcatgaacagttacaacttgaccatcattgctggtgagagttacttttctattggcacagtctatcacacctttatatttggctaaccagtccatccctaggatgacatcaaggtctttggattctaacagaataaggttggccaaaaatggtactccttgaatctctattctgacagaggggctacgttgtgatgagagtgcttggttactcggtgtactaaccatcaaaggacgtctaagatcttctacttccatctcatgatttcccgcaaaactcaaagataaaaaggaatgcgtagcaccagaatcgaaaagcactgttgcaggaactgagttaacagggaacgtacccaaaatcacatctggagcaccttgggcttctgcggcagcaacatggttgacacgagcctttgtcgctggtgcggaggggttgttctgagcagggacaaccttcgcgcggtggggcttcggacacttgtcagcataatgtcctgggtctccacagttgaagcacaccccgggcttactgccttgctccctcttggcaggctgatgctgtgtcggagctgcaacagggcgtggagcttggttgcggttgttgttgccagcattgttgttgaagaactgacgctgcggacgaacaacagacgaagaacctccctgtggcactgactaaggtcccatagcaagacgcggcctctgactattcccctgctgagccttgaagtgagcaatccggcgtttcttctgctccatgcggttgtacttgtcctcctggcgaatagccttatccaccaacttctggaaatcatgataatccccagtcatgagtgggttagaaagctcatcattcagcccttctaagaacttctcttggcgctcttcatcaatgcgcacatcttccggagcataacgagccagacgattaaattcatgcagatatttagtgacagagcgagatccctgagtgagcgccctgaactccttcttcttgagagacactactcccgagggtatatgcgtcttacgaaaagcagcagtgaactcaagccaagtgattggttcagctgtagtcctgttgagacggaagtgatcccaccattcagaggcagggccatgaagccgatgtgaagcaaaagagactttctcttgatcagtgcactgaagtaggtccaacttcttctctatggcgtgcagccaatcaccagcttcaataggattggtggtgctagataaagtaggcggcctcacgcgaagaaattctaccagcttattcgggggaggtgcatggttgtttccctggttctgctggttctggagttgctgcatcatcagattcttaagctgtgcctgttgggccaggacttgagcaagcgtgggattctctgcattgttgttgtttttgttggggttggggccattcccgttgctgcgagtaagcaccatctggcatagataggagcacaagaagagaaacaggggaaaaactacttaggacagggaatttactagtttaacttttattgatcttaactgagtttcattattacaaaactgaagactctcacaccattaaactcaccagctccctaacacacgaaagcaaacaaacgcatgcatttacatcccaccaatgattaaatcacatgcaagacccacacacacaaccaaacttaaacaaacaaactaacacaacgatctaaggcaacgacttgacaaggcgttctaggtcttccgggcatcagagttgattgaaggctcgttcgcacatccccatcatcttgagtagctccccactcgaccttggaatgggtgcgcttggattcttcttcatcatcatcactcacgttgacgaccggaggatccactggggctggggtagcttctttttccaccacacgaacctttggcgccaactggtagcgagggacgaatagagctctcttccttgctgtaagacgaaccctggccttctgcggtggtgcttctcccttcaatgctgctagctccttctccaaacgatccaccttgtcctccagcttgcaaatcttcccgcgattccggtcttcacaatcttgagctgctatcacaatctcagcacgggtttcatccatggcccacagcatctcaaccaaatgccttgtggtagcatcattctcaatctctgcaggttcaaggtagctgccacggtcacttccctggggttgacgaggatggtagcgatactcggtgtcagccaaccgatcgttgtagctttcgtggagctctcctatggcgatccttgccacctcctgacaagcatgaatgtagcttccccctccagcctcgaacatcaccgaagggatatcttcacgattactgttcaaagtgactttgacacggcacttctcttcatcacaatcatgaggaatctgggcatacaaaggggcagtcccaaatcctatgaggaaagacatcgtacgcaactcctggacaaatcctggacaaatccttcagtaccaaacaagtactcaggcttgtagcacggcatctaaagacagtgaagggagggagttaagacatttatccaattaatagcacaagtttttggattaatttgaataaagttagaaaatcaaagtaataggtaaataaataaagtaaaccaatcttgcaagataagttgaaacagttagaaacaggatcacaaactttgcacttttgaataacagatatcaaaagaaataaaataaaagagagttataaaatcaatatgctaagcttagtttattgcagcaaaattaaataaaacaatgttataaaacttttgctggtaaatggccattagtacagtaatagatgtacagtactaacaacaccggaataataaataaattttgaatgagaacaattaaaggaattataaactgcatgtgccattagtttggtttaaataaaagagaaagagaggagaacaattctacttttcaacatttttagagggcttctataggtaaccatttggcataacctagggtcaaggaggctctgataccaacttgtcacgcccagaatttctatccaaaattccaaacgcttacatgtgtgtaaaccctcgtccaggaatcagccgaggcacacaataacaaattgataatagagtacaattattactctaattaataagcgaataaaatgtcattacagaggtagatagttcctctcaatcaataaagttctaagcagcggaaaataaaagaaacagcgcaagcgactcctctccacaggcagcttgaccaggactaggcctaatcctccacaccatcagtatcactgtagaactcctcctctgatgaatgattgcaaggtgagtatatgacatactcagcaagccacgcagcaaatatgcaagtgcacaggataacaaaggatggcatagtatagtctcatttgcataaatagcatttaacaaatatttcagaatttaataaaacagttaaataataattaaacaatattaatccaacgctatacaacataccctgttgcataggcccaaccattctgaacaaccaatcccggctgcacagttctatctccaaaccaggaattaaccattctaaaccaggagctaaacaagttattaacatcataaattaatatggtgagaaatgtgagactaattacgaaagacattgttagacacgcccataaccgcgggcacggctattcgaatagtttaaactccggccagaggtgtaccactgtacccacaagacacaacctcaacatcatgtcaaccatgtgtcgcgatacttgacaagtacccaaatagagattgtgacaataccctctatataatacaattcaaagcagtgcaccgttcccggatcataatcacccccttataaacaaggtatggactccccagcgacccccgtgggcttatctctgccacttcacagtctggtgctctactatgaaccatgctatacataaagtaaagccgttgcccacgccggcttgtggttggcacggtaaatgtttcacaaccgaaaatcgtgaaccggtccttaattgtcatgagcacaaccatcaaaatcatatgctcacaacccaccattatcaatttttagttggcaaattaattaattaaccaatcatgattaaccatcatgagctaccattaagccatcattaaataatagtgaagcataagttatcccagtagtgtgctaatgtttctaagcataagttatctaatatccagctgaacccatatatataaagctcaactagtcaagttataataacccaaggtatcaaagaatagggtaatcaagaaataacaaagcaataggttatttccacccaatgacattcaaaaataaatgcaattgttgaatagaaacaatagctttaaacgagatcaacatgctcaaaggattgtttgggatctgtgtgacttgccttgctggccttggaactcttcaaagtcttctcctgcaaattcggactctccgggaacgtcggaatctaaagagaaaagaacaaaatcaccaaaacagcacataaacaagcatgaacagtacatgtggatatttttaacatgtagatctcaattttagaaaaatttagagacttgaaccaactaaatccgagctaagatgaattagttatgaattttcaaagattaaatcggattaaaacatttatatagattttaattgaattatgacacaataatgaattatttttgaaaaggaaaaaggggattattgcgtcagcgggtcggctcacggtggaccgggtgcatggcggcggttcacggaaacaaacggccgtgatcgatctatccaaaacggatggccaagatctaacggtctacgaccgatctacgacggacggcgtcgatgacgtcagcgatgacgtcatcaccgacggcggctcggcctcgcatgctcgccggcgaacgacggcgcggcggcgcgaacgaaggacacctacgggttgcgggcgacgtggaaaactcaccggtgaccaaaacagcggcggaaggtcaacggacggcgacggcgacgaggaagaagcggcggcgaccttcagcttgacgacgacggcggggctccggcgatctacagcgacgacggaggggtggacgaggtcggcgacgacttgacgatcacgacggcggctttcccgagcgacgacgacgaccagagcgacggtggcacacggctggacgaacggcggtgacggcggcactaggctacacggcgctagagcagagctattgatgtctccctgtacatgcatcagattgccacctcggaatatgcatggcaagtgcatgcatgtatccttgccgtgcttccaatacaatgtgccagcaactcctctgttctctatccgttgcattgctcattggtgtagcttgtgtgcatatgacgtgcactttgtgtacgccgtccgtgcctctcttacgcatcgcagtccgcagccctcgtggtcaccgtccacgaccccatcgtcccggccctgcatgtccgccgcgccatgccgcgctcgctgacttcacccttccatcactggcctccctgccgtcgctgatgaaccctgagttccactcgacactcaaggctgttgttggcccgatctttcggtgagttgagataactacgatttgggagacacgttgacgacccgactacaaccgtacgagacgttgtgttgcgccttagcgatcgatacacctctccgtgggttgttgatcttgccggtgcagatcaaccctattcctgcaagcaaatcgaagaaacaagcaagaacaagataaaagcaatctgatattgcaaataggaatttaatacaaatgataagttggggttccgaagaacaagcagacggacggtctagccgacacgtgcgctgcaagcaagtagcaatagctaaactttaatctatcaaaacccaagaa

SEQ ID NO: 66983 - DNA, 5133 bp, Oryza sativa
taggagctacaagcaccggacataaaagatccctcatccaaccaattaaccaattaacccacccgatgaaatggctttgcctgaattgaaaagggcttatttggctgatcagcctaagaatacaacttaccgatgaggacacacggtgtccttgtgcaatgtctatacgtcgcactccatcttaccgtgatttcagcacgaagtttttcccccaccttctgcagaaatggcacatccatcctaggtgttgtttatttcactgaagaggtagataaagttaggccatgtaaacaagaaaattattagcgtataattaattgatttttaattattcaaatttaaaaaataaatttatgtaatatttcaaaatgacttctatataaaagtttttgcatacaatgcaccattttacagttaaaatacgtgctaataaaaatcgaggtaaaatctgtgttttaatcagaacaactcactagactaaaaacagctatagagaggaggaaaaagaaaaaaaaaagaagaaatctatccaccacaaaagcatcacaagttgtctcctgtctttgtacaagaggggtttgcgatatatttcgcgggacaaagagacattggagactttatgttctctttccccaacttggccaagtggggttcaacatgtcggcgtaggataggaaatgcgatgtagtcctgtgtggcgactctccccggagacggtgatcgatggatggatacagcgatgaaagctgagtagttttggagacagatcgagaggctgattcccgtacattggaccgtggcagtgcaaggcagagcagatacatgaatctgattacgatttacgagttgccgatttcgtagctctaatttgcagccagccactacagtgaaatatagagaggaccaatagatgatagcagctgcagcctgcaggctcaactcctccaattggtcagataattatctcgacagaatgaacatggccagattcaacctgaccctctcccgcgacaccgcgaggccacaaaccgatcgaattggagggatattggaggaaggtggagcgagattcattcatcgccggtgacctcctagagggccttgaggaggaataggcattagggcgtggaggtggatggacgtacattaccattacccctgtcgatggccacaaaggccaagattagcttcatgtatgaaacttgatgattcatagatgagggacgttaaatgtactctttccatctttcaatgagtgtggaatgggtgggccgtaatgggcttttaggtcaatctgctagcaaattattacggtttcagcccaatacatataaatgacttagggctggttttgtttgaagctaaaacttatcacaccaaaatattggtatttttaacggtaattttggcaatgtttggtttgctgccaatactacacaaaatgttgtcaaaatggtgatgctagcaaaaacttgtctatgttttgtattgccaatattttagcatggttataaccaagcaagcctttgtagattttgagctcctcggatcgtattgtatgtgctagtagcccaccaccaccactactactaccacttatacagtagtcataagagtatgtaggccccatttgtttctgattatgatgcacattttagctcggtttttattagcatattttttaaaccgctaaactttacatttcatatgaaaatgttctaattgctataaaataccaaataagtcattttttaatttttatagcaattaaaacttaattaattatacgctcttacgtgaccctacttaattctcatcttgaactgttttatcaatttagccatagtgcaatactcagtactcaatcatttctattataatcgtagttgtgagtttatgtagttcactcctagtactctccgtcctaaaaaaacaaaccatgggttttcgtgtccaacgtttgactgtccgtattatatgaatttttttataattagtatttttatttttgttagatgataaatcataattaatactttatgtgtgacttgtctttttaaattttttttcatgattttttaaaataaaacggacggttaaacgttggacacggaaactcacttttttttttcgacggagggagtactctctaagccgagtccatgtgcgcgttcgctgacacacgtctccaacgcaaaaaatggagtactcctaccggtagaaatgtacagtactcgcagctactcctgcgatactgcgaggtagcgaaacgccatcgtacgcacgcgccggtcgggcggccgatcaggaggaggcgcgacaggatgggacgcgacgcgacgctcgcgcacctcggcacctgtatatccggtggtcggcccgtgcagccaccgcgagcgtcctgggaattcttaaacgttgccacgtctctcggacaagatgggaataaaatttttttagtctctatcatattcagaatatttcgacactaattataaatattaaacgtaaactattaataaaacatattctatatcttgaactaattcgcgagacgaatctattaagcctaattaatccatgagtagcctatgtagtgctacagtaaacatgcgctaattatagattaactaggcttaaaaaaatttgtcacgtgaattagctctcgtttatgtaattagttttataagtagtacttcctccattcctaaatgtttgacgtcgttgacttttttaaaaatgtttgatcgttcgtcttatttaaaaaatttaagtaattattaattctttcctatcatttgatttatttgatttattgttagatataattttatgtttacatatagtttacatatttcacaaaagtttttgaataagacgacggtcaaatatgtttaaaaaattcaacggcgtcgaacatttaggaaaggagggagttatatttttttataaaattgatcaaactttttttaaaaaatgattagaaacaaatgaaaacaaattctaatatgaatgagagaaggtatattccaacggagagagctaaacaaacgcacgtacacatcgcgttaagtttgtgcagtagatggcgatttgttttctgtttattttggcatctgcaggtcattgttgatttgttggcaattattggcatgaaccggtaaaatactaaaatcaacggggagggttggattgacctggcctggctgcctgcctgcctgcataatatatcccagctggcccattataccatgtggtcactgttacaaatctacaatataccagttaaatttagatagtctagttggcatgcacgcgacgggacaccatactgctgctccatgttggcaataactataattgaccatttagaaagtgcagcacatttcataaaccaacttaatatacaatagtcattttgtaaaatgcaacattatcaatttcaacaacttttagtactactccgcactactctcatctaaaccaagtggcagtagacgggggtgaaaatggtcggaaactataggaatcggtagcatctcttcgaaaacaacgctcggttgtccaataattgatcatatttatcatttaaactattcattgtcaacatcaatacgatacgaaaagaaattacgaaaaataaattttcaccccattgctaatgggcccctaggcgagcgtccatacattatattcctctatcttattgttttgaactgaaacaacaaaagaactgtcaagtatattttaataattaggaataaaaacccaggtgtgttacatcaaaagaaaacaaaagtcgatgagaaaatccaacgtcaaacatgacttgctgaacaagcatgccgcacacgtaacaacacttcacactagcccaccgacgcagcatgcacgcctaatctctctaccttattctctctctccaacgcacatgagatggcaactcatcccatccgtgcacaacgaagagaaaagatgcgggagagtggcttccctttggagaaccccctcccctccctctccctcctttggtgagcttcctccaatgaataagagaacactcaacgagtcccctcctccacctccttcccacgagcttctcccagcaagatctggaaactagctcagctcatttctttgtccgccaccactcattgcgccgccacccccctcgctgccgcggccaaaagtggtcaaagtgctagagtgcccaagcttggccggcctacttcccctcctcttttcccaactttgacccaccaccatcacttgtccatcccggccttcatggcaactgagcccgatccgctcacttccctcctctcctccctgcccataaaaaaccctgacctattggaaagctttcgcgcacgttatgggagcggttgtttgcgaattgggatttctagttgttgctcgctagctaactcccacacatacacgtatatacgcgcgtaagcacgcgcaaaaaaaaaagtgtttctacaacgaatcgacttgttgtcgtgtgcatttggcatgttgccgcacactagctaactatgaaaaaaaatatgtagttgcaaattatatatatagtgaaaatctgtaaactaccgttggatctataaatggacgtttgagatttgtccatgttatccagagtgtaagttttactcccggattcaatcatgagtaaaaattttaccaggagtaattttttttacttttgatgacgtgaataaatctcagtcatctatttttgaattcaatgataatttttagatttgcactacatatatttaggggtgaaaacggtcacggaaattcctgatcgaccaggcgccgtttccgtttaagtggtactgtttccgaccatacccttttttgctatttttaaattttgttttttctaatttctttctgcatactgagcagtttaaataataaatatggtctattaccggcgagcatcgtttccaaagagataccaccgattccgaccgtttccgatcgttttcacccctacatatattacatatatgctttgcgcattgcgctgcgtattttcccagctgactcggcttgccaactcgatctaccggccaatctcgcgttcctcgtggcggagatgagatgagttgagatgagatc

SEQ ID NO: 66984 - DNA, 7295 bp, Oryza sativa
aaggagacccaaagcctttggttcacatgtattttcaccttgacagcgagcaatatctgctcctgccctctatcagtgagaaaggagaaaatattacctcaagcctagttaacgcattaggtggccaacaatgtagcctgtatgaaactaatgagaacatgttcatagtgtttgattactcattgagtccatttcctctgctatcttattattgttcagaagtcagaacattttccttgtcagttttgattggtgctagagcaactactttttatcttataatagttttcagtagtcattcttggagctgctaagcttaatcgtaatgttaaatactgacaaccactgttttgcagatgagatgttggtcttagatgtcttggagagtttagtgactgtacccagtaaaatatcagagcctaagattaatattccttcaggttggtaatattatttcagactcctggtatatctttttttcataacatacgttatctcatgcatgttgcgcatgtgtcttttctgatgtatattgatcaggtacacttggaagggatgattctgcattgtctcacagaagggaggaaggtccttcagttaagagatccaaacaagggaagcaagttggtgaatgcagtgcctccaagacaaggaataaaaggagaaagaagttaatagctgaagaggtaagatatcgtaaatagtgagcttatgttgtatgtacagcatgaatatatatattttttaaaggaaccctttcttgctcatggggaacaaaccaaatttgatgaattgacgcctatatctgagtctactgtactgtcaattagatgcttccattgcatctaacatttagtatatcattgcatccccataaactcataaagttctcggcttggtgtcgatggaaagtcaatcccgtttcatttttatagggtacattttatcctttaattagatgctttcattcttgcatttaaaattagtattgccgtcgcatcccttaaaatcataaaattctgggtttggtgtcaatggaaagccatccttcactttattttaatagggtgcattttgtcagtgtgattataatttatcccttctgagatcgaagtgcaccttaaatcagacagcatttgtgttctttcccgtattgctctcttcaattagtctgatggcacttctattttcacacttctttttgcaggtgcctactgaaggagtcacttctaatcatttagatttgccagaagagcgtcaagttgatgccactgagtgcgccttgaattctgatctggaaaggggaacagttgatttacctgaatcaactgcaaatatttctaccaaaatccctgatttgccatcacaattaaaacctgagataaatatgtcgagaaggagcaaaagaaaatccaaaagtccttgtggttctaagtatgtcgtttgcaatggagcagataatttacaggtacacccaccattcatcaatgctagtatgccacagattgagttcaactgtagtcttaattctggcttactttcaggctaggagattgcagcattgcttgtcatctgagtcacttcgtagatggtgtacatatgagtggttttacagcgcagtgattatccatggtttatggataatgagtttgtgaactacttgaattttgcgaatttgagccatctgtcaaggctcactcggtccgagtggagcacaataaggaggtattgactagcaaactctggaagctatatcattgtttttctttgtcctcacttctttttgttttcgctatactaagtatttttatctgcagctcacttggcaaaccccgacgtttttctgatcattttctggcagcagaaaaagataaacttgaaaattatcgcaaaaaagttaggcaatactatgctctactaagtgaagattcgtgggattctctaccaccagacctagctcgaccattttcaattggtcagcaggtaatcgttcgtcacccaagtacgcgggaactttgtgatggtaaagtggtgatgatggaacaggatcgttataatgtccagtttgataggcctgaccttggtgttgatgaagtaaaggtacaccttttcaatatcagttgcatttcatgattgccaattgttatactatgtaggatattaggtcctttctcataattgtttcttcatatatctgttggaacagattttttttgttcatttcataagaaggaaactactacccatacaaacaagggctcacaagccctacacccaaaacacacccacaaggcgacacatgaccaaaaccaccctacgacagcctagtacaaaggaaaacttggagcgcaagagctccagctaggcactaaagactaacttctgttgactctgcctgcaacatctccattacgtttggattcactcagttgaatatgcagtcatttcggtgtttccaaatttcccaacatctaggataatcaatgaattcagccactgcaaaagatttcaaccattatttttaactataggcagggaaaaaactttctagtatactaaacactgaccttgcaattgaattctgtgattttttagttagtaattcatatcaaaatatgttatcaagcttttgaactacgagtaaattttacatcccagtaccacaaccaccacacttgagtagaggatctgcccttttagttccagtagtgttcataaaattgtagtcttcctaaggataactaatcacatcccacacagtatgctgaatcatccatgcatagttgccaggagttcatcaccatcagtcatgcttcgaatttgagttatccatcttttttaaacaaacaaaaaaaatatggcccaacacaaagctgtcaggtacttcagttatttatatcatggaaataaatttatgagactcctcacgtttttatttttcacttggtaaccatttgtttaacaacaattcacaacttattcatttcatattcatataatttatattcaagaatcttgagatgatattttagcataaagatatactgttatggtagttatatgattatgtcaagacatgtaattgtttctttttcaggacactgattgtatgcctgtaaactggttggataatctgcctgatgacctcaaaaagaggagcttcctttcaaataattcacacaacagagtagaggttgagcaaattccaaagtttacttcaaaagagaactgggatcatatcagcggagaggccgagccatccaaaaccatgcacataacttcagatgaacaggttgaggttttgctgtccaaatctatttttaagaagcattacgatcatagtctatctatccatgggcaggttacgagttatggccatgcagcaaatgctgcctgttccttgactgctccatgaaatgcaaccggccaactgctcacgtttgtgaaatgttctaatgctgattaatatatttactatcacaggttgaaattgctgtggatattgaaagactatccaacaagagtacatctggtaattgtggaccattacagccgctccagtctgttgatgacaatgtacggagtagaggtttgtcagagcacaggaatggtcacaatgatgagctagattcttatattacttcctttgtccaaatgtcattggcacaagccaagcagatggttgacgaagccatgaaggtaggttaaagtttagctgatcaattccctcaaggtatctaattttgcatttctcactcaatatgttatttgatgttttgccaggaaatctctgagaatggtaaaagttctctagaagaaacaggcatatcaaatgaagcgacggattgtacaggcccagaaccggaatctgctgctaattctgaacttccgcgcaacctgatattcaactgcattgccacgcttcttgcaatcaaggtaaaacattcacctgcttcactagcactaatcctccatggttactagaattattccaattcagtacatcttccttttcaattatgcagcattttagcgagggccgacatccacctcctaacatagcaggcgtcctggagcgtgcttgcttaatgctgcgaccaagctgtgcagagaacctgcccatctataacgaaatagagaattttatcgctgtcataaagaaccagatactagctcttgtgccatcggcatcaagcaatgccaggctacccatgtacatgtaaatacttccaggcttccagcagacgaagaggcggtgcctggttgcttgatgtcgagaagaattgatgaatccatagcgtctgggggaggtttgaaaatgtatgagcttggatctacagcatcagaagacggcgggtcatcgttgactgtccagctctcttctaaactgtgtataaactctttagaggaataagctcttacagtttttagtttcatagatttctcaatatggttttaggaatggaggaatcgacattccagttgtagttaataataacgattcctacagtcatgaatacattgtccagttgattcacagagaacaccatcttgatagttaatagattttacttaaatgaaaaaaccatgtgtcacagaaggaaaccatgtgtcacagagaagaacaccatcttgataaacggggtcaaataagcccctagattttactatatgtaaataatgtgcagtgagtcctgggcatgcttacaaaatggctttgacaggtgagatgaaatggaccctattcctgcctccaaacaaaaaaaggtaagacaaaccatgaactctgttttttttttctgtaaaaatttcctgtgtctgcctacaataatatttactatccaaaaatccctgtagtatccgtatgtatcaatgctgtgatttcctgttcctcttgtactgtatatgtatagaaatgtacatgaatgtttgttagtacagactacagctttgagtcagcttgcagagctacaaccactgatcatcatcatcttcttgcttggtcttgttcttcttctttcaggacggtgaagtggaactcgatctgcagccggcggtgcggcgcgtcggcgcagcccttcctctccatctccagctcctccctcagcgggatggccgccaagaacctcttgatgaactccctgcagcactccttcccggtgacgatcacctcctcctccggcgacggcgacgacggcggcggcgacaccgagcgcatctccgacgtggcgtcgaaccggagcatgtacgccttgtcgcagccctcgaagagcctctcgccgagcgtgtccacgacgtggtagcagtcgccttccaccttgagcacgaagaagtggtcgttccagctcacgatgtacacgtcggcgcgccccggctcgccgccggcggcggcggcgatctctcgccagatgtcgtcgaacgacatggcgccggagagggaggcgaagctctcgggctggaagaagccgacgaaggccctgtcgtgctgcacggcgatgggcctcgccctcgccgcgagcaccgtctccaggtcgaagtgcctgttcgggaacgccgccatgtgcgcctcgtcgtcgcagagccgcctccactccgacgagccgtccctgatgagcgcgtccagctccggccgcgtcggcatcgtcgggtggttggcgtgcagcgccgccgccagcacggccaccagcgccgtgcacgcgctctccccgccggcgctgtcgtcgcgctggtcgatggacgcgaagaacaccggcgtcctcagcttcgtctccgagtccctgctcgtgaactcccgagtctcccagcttcccgccagatcatcatcctgtaagacacagatcaccatctcgatcaatcaccaattcaccattgccaatgcaaacatgattccatgatcagaaaaaaaatgctaatccaattctcaccatgtatttcatgggcaattcttgggagagcgactcgctgctcctcttgtcgaagtcccggctcttcctcctccacggtagaagccggcgtttcgacgacaggccgggctccgggctggcgccgccgctcgagctggcgctgctgatgctgatggtgctgctgctgctgacactgctcatgctgctgacgctgctgctgtccgaattcctcttgctcctgctgtacacagccaccttgtgctccctgtcagccagatcaagcagctgcttcaggtcaaggacctcatggtacgtccctgcctccaagctcttcctattgtcccgcattgtcggtgccggagtcgtcgtcctcgccctgctctccctgaatgaaacagtccttccgatgttctcagaaggcgtgttcgcgtccacaagctccacattcacctgaaatcaatcatcacccatacaactcattaaaaaaatgcacaccaaacattttcactagaaatatagtaattgggaggcaaataaaatggagaagatatttgcttacataaagcatggcatcacttgcccatccatctttcctcaccctgatggggacaaccaccagctgctgctgagttgccccccttttctgctgctgctgcagttgcatctcccagcagcattcctccaggcttatcatggctgtcccaatctcctcaagcttcaccacgtccttgcctcttccttgttcttggaatccctgcatcacaaagcaattcttattgccagcctcacttggcgaaaaagcctaagaaaagatgcttgattgctacactgattcctctgtaactttcaagatttttcctgaaatcggcaatggttgatcaccaaggaacaacaattccctgtcatgtagtaagtactagcttgtagacttcctaaagggtgttgttttacaaaggaacctaaaataggttcttattccaatttgggttctcttccagggggggtaatagtaaaccagttccggaagttttctaatttacttttaaaagaacttattaccaaaagatttggtgggtgaagaatgggcgaaaacccattacccccccccccaaaaaaccccctattcattgttcccaatttcaccgttattatgaaaccaaaaattcagaagagaggcattaatgaaaggcacttttaaggaaataaaagcaaagggtctggttcaaatttacccctcaaactttaatatcatgaaatagttcttgccccttaaaattaattaccaagaataactgaagtcaaaacctcctgggccaatcggagcgtgccacgtggccacatcaacctctcctcaatttcaaacctcgcattactcctttagacaaaatgcgc

SEQ ID NO: 66985 - DNA, 17421 bp, Oryza sativa
tcctgccgccgccgccgccgctgccgctggcggccgtggaccccgaccgccgcctgctcgacctcggcggcagcttcacctcgctgctcgcgccggcccagctgcacaacggccacttcaccaccggcttcctgctgggcaccatgtcgtcggcgccgccgccgccgccgccgccggccacttctacaccgtctcccgcgccggccgcacacccgccggtgtcggacagcatctgggccatggggtggccgcacctctccatctaggatcgtcgtcgtcgtcgtcgagctctgatcaccattggcaacaactcgccactaatctagccatcactcccaagtttcatctggtgtgttcgtagttgcaccaaaagttatcttttttgagaggtttcggcccagtagaagaagtcattagcatagtgttaatcgcctaggttaagtaatcaaagagggttaattaggagggtttactcgaattaagatggttgatgcatgatagccatgtcaatccgtgtcgtctcttgtatcaaagcttcagagcttgggctatgaacatgatccatggtggtttttaattaattgccgtcccttttttttttttgtcgtggttgagatgatgcatgcagttcatttcgatctttgaatccatggaattccggtttactgcttgcgttgaatgctgattgcctcaggccttcgagcccatcagttggcctaataagccaaagcaaatatcaaaatgatgtcaaaatattaaaatttgaatttttaacttgattttaaatttgattttaagatattttcaatgtatttttttattgttgacttttaaatcgctacgaataaatatataaaagttttaccatgaattaatttatactctctaataaaatggcttattagaaaatatggacaacctatacgactttttcaatattgttaccactagattatttttggatgattttcttaagtttggggttagacttgtttgatgtacagggcaaaaaccgcgattcaaatctgggccggatcactagtatagattgcggcccagactgcatatggactaaaaatccttccaaaaaaaaaaaaaacagcacgagctgcgctatcttggtttggttcaaacagcacgatgattttagtggctttgttggcgcgagttgggtggtttcccgcgctcgtagcgtggcaatgttgcagcgtgacgagtcaaccaaaaatagcttgggggtctcgaatcgtaccgcactttagccgcaaacggccgaccgactcgactcctccctccatttcgactcggggctccggccggcctcttcttcttccggtgagccaccgacaattcgattcttacatttcgtgatcgatcgattgatttcgtgttgtaatcttgcgtgatcgatcatggtgtgtcaattaatggcaagggcgtggtcatggagccccagcccggctcgccggagaccgccgagctgcccgcgcctatggtgctagagccgccgccgccgccgtcagatgaggcggcggcggaggaggaggaggccggcgttaagcctgataggcaatcatcttcatcgtcttcgtcgtcgtcgtcggaggaggagaaggaggtgtccaaggacgtcgcggtagagaccagcgtcgtcgtcccgtcggtggtcgccgcctcgccggacgatgaggccgccgccgtcgcttccggtgacggcggggacgttatcaaacacgacgatgaggccgtggtcagaccggacgattgggcatcgtggccgcagcagccggctcagaccgtcgacgacgtagcggcggcggcgacgacgacgccgcaggcggcgccggagatccagacgatgtcgctgcagccggcggcggtggcggggttcgatccggagaggatccccaagtccatcttccaggcgaagcccccggggtcgtcgtcgcaggcggagtggagcgtggcgtcgaacgagtcgctgttcagcatccaccacggcgcccggccgtccggcgacctctgcggcttctacgccggcgagagcaggtcgcatttcgactacttctacgacgaggccatggccggcgccgccggcgaccacacgtcggactggaagctggccaccgtcgccgaagggtcgcctggtggcagcgcgcggtcggacgccaccgacggcggcggcggcgcggccaagcaaaaggcggccatcgacttccgccgccacgagagcggctccgccggcagctcgagcaacttctccttcgccttccccatgtacgccgccgacgacgccattgtcgtcctcttcatcatcatcatcacgagaaagaaaactaacccccctcatctccattgcagattggcggagacgacgacgtcgccgaggaagagggactacggcgggatgtaccatccgctgaagaaggaggcggagcagcagcaggcggcgtcgccggcgtcggcgttcgaggagatgacgccggaggaggagcggcggcggcggcggagctggtggtgctgctgctgcggcgagtgctgcggctgctgctggttcgcctgctcgtggtcgtcgtgctgctgctgctgccggtggcggtggtgcagccgctgcagctgcagctgcccaaccttctgccgccgcaactagtgcctctctgctcctgaccaagacatttttggcgggaaaagatgaagggaaaaaaccgagaccaactcggctaatcctgatacagccatagttaaattaattattgctaccagattaggcatcactgcatgagaggatcatatcatatgtatgcatgtgcagatgggtaaaaagatgaagatgatattgttcactgttgacaaggaaatgttatgctaacctgcagatgggctgaggtaacaaacaatatcctggtatccaagagaaaagtacatattctaatgtaggagtatataattccaacattaagtaggatgtacaagcacagaaaacaaccaaaagttagttatcttggcacatttgcgcacagttgctatgggcaaacaaagccctatgagcaaattgagcatccatctgctcaccaacattaatcagtactactagcaatagcaagcctaacagaataacagcttgcaatactttagaagaggctactatgttaacaaaaggtgcgagatgtagtgttagtcctgtcacatgtgatcctttatcttcatgttgatgcacatatgcagggattagttccaggtaccccactgccatctgatccccggataccttagcgtccaaactgatgtcgcggcttggcggatatcatcgctggagtcggcatggaaaagaatggtcacctcgcaagatggagcacagttattaaacaagggtgcaagatgaggaacatccttcaatggcggtagatgaaacaggagtctcctcaaacagcttctaaactggttgctggtgcataacatcaggcaatgcgtcatttcacatgaaaaccgaggggccaacttgacttcgctgatgccggcaaacagctgaagaagatactcgggcttcactgcttcaaaaagttcatatttgtttgtagaagtgggcagctcaagctctaatgtagtgatatcatgattctctgcaaatacttgcaagagggactttagatccaatgactctatccgcagatttttcaaactcacaaggccatcggcttggacatttggtccaagtttatcaactgttaacttcagagtaaacatggatggggtatccaaaatgagcatatctggtcgaacacatttcagctcaagacgaaccaagttaggcgcacggattgttaatgaccgtggaacatttgatacctcccagtggcaagtctttagttgatgaaggtgaatcttagggtccttgagccctccaactccaataagattgaggatctgaaggcaagggaagcactcattcaatttgttgagatcctcatcatctaatctaatgaactcaagtgtcagatgagtcagattaggcattatctttagcccgtcaacggatagccatgcgttcttcagacgcaatttcaaaagactatgacctgcatgtatagccgaagtttcaatctgagaccataccaaggtggaccaaattgactgttgaaatatcaagaactggatgacatataaagtgtatgcacatttactatgcattccagcatcaggtaagcaagatcaagttttcacatgataatgttatgagtacaatagattctactacttgtttctcatcgttcatggccatctttttattcaaacttccaaagtgggctggtgattggcgagcagcaagaataagctaaattttcggaggataataagccacactttcttaagcattatgcacaagtgaaatacaattgcacacacaaactaaaatctaatataagagcaacaggtttaaccataaatttcctttgtgcaagcatttgcttatgtgagaagctaactctaccacgagattttcaaacaaacagagcaatgatatcatcacaacaaggaacatgaaacaagcagtaaaaaaatgcagagataagagagaattacagaagtgggagatgacaggaagcgcctccgccttccgccagcacgactgcggccagtagtcggcgacgtccacctcccggagagcgttgccggcggcggtgtccgcccacgccaccacggcctcccgggccgtgaggtggaggtcgccgccctcgtcgaactccccctcctccacccacgtcgcgtcgtccgggtggccccacccctcggacgcgtcgagctcgagggagcggaggtgcggcccgaggagggacgcggcgttcccggcggccgctcggatggcggagccgccggggggcccgcccccgccccctccggcgagggcgacggagcggcgccgtgcgagcgcggcggcgcggaggtggacacgggagcaggcgtaggaggcggcgaggaaggcccgcgaggcgaggcagtacgccgcgatgtcggccccgtcggcgacgcggccgaggacgtcggcggcgatcgccgccggtagagaatcgaaggggtcgccgccgtctgctgacatgtgtagcccgctttgccttctcagtttctcatatgttcggctcacggagaaaacgaattccccccgtttttaaatatacgttattattaattttttatatgacttttattgattgtcctatttaaaatttaataaaaatacaacataagaaatgatatatatacagggttcaatttttcgttttcagcgtttctattggaaggtgccgatacacctttcggaagttttggtccgaaattttaaacaaaatttagtcaaatttaatcaaaatattaccacattcacagtaaatgaaaaaaaattaaaaatattgaccgaaattatatcatatggggaggggggggtggggtttcgaatagaacctttccagaattttgaacatgtacatatagtcttttaataagatgaaggggcatgaatggtcaattgtcatatccaaaagagctggtaaatactacatatgtctcaaaaaatagaaatatttggtaatgaatatggataaattcttgtccagataaaagttggtgtattttggaatggaaacatccgtttgttaatatttttatgtgcatatgttcactctttttatgtcctcttatggattgtagagttttgaacaggtatgcaaaatatatacataatcgcatctctaatttttttctagttatttccgtatagaactgttatccaacactatatggactcaagattgaatacgagaaaatatatagtatccaaatctccttttcttttttagttcatatattcagttattcacacttcaggaagaaaaaggtttgcgataaaacgtacatctattaaacttgttacttttactcagtaaatagtctactacaccaatttactccgtaccaacaattaaattataaaatcatccatatagtgataaaaggatactctgacatagaaatttatcatattgagcggtgctagcattacttcctcaaacaaaaaaaacaatcctgagtactttcgtagtatcaatcaatttatcaatgacacagtgattcgtgtatcttctgtataatgagtttgtaccttaaagcttcactaatttatcaatctggaaatttaggggattcgacaaaaaaaaaatgcatactttctcaaactatcctgcattttgcttctaattttgctccctacaaaagtttcaaaaactcttcggtatagccatcagtgatagtttgagaatttagcattagctacaaattttcacacaagaaaagatctgacaacatttcattgacgcatgggtagctccaatcacaattgaggatgaggaactacatcaactttggtagtttggttgcctcttcccatctgcttgttctttaagagaacctctcttctcttccgcatgagatatgtcaattgaagaactcattcagctaagctgcgtcctccacaactataaaacccaatgtgggagtttcagtaaatgaatactctatatcttgtaaaaacaccaacaacatggctttgcagactgcgatccaatttccgacctgcaagtctaccataaaagagaaataaaaacaggtttctcaatcaggtgtgcatcacgcaagtgttcatcatctatactactattaaaagaaagtagtggtggtgctgagtcttcaaccatcactgacatgtgggacaagatattgggatttgggtgagtatagtcgaactgcagctctttaattttctaagcatagcatttttgtttgttctttaagatgaaaggtcttgtttcaaccaattaaaaatattttcaacaaggacttaattttgctatttttaataatccgttgcgatcaaagggcatttggctagtattggaaatgccagaacaaatacatcagtatgcaacttcgtgctttatatcacaaaggtgaaaagaatgttcttttccagtatatgaaaatctctgcaatcaaaggacaaaggacaacagtaaatatagagcaaaaggcataaataatcacctagttgtcaggaaatgagggcaagatgaagcatttgaaatccttgtggtttcttttggatgaacagaactgacaatcaacacagctccagcacgcagatacattcgatatgaggagtgtgggggaacatatctacaggtattacagtcttcagctcgtagcatcctttcaaatctttttcctcctgtagacaaattaagtatttaattgaagtggctatgcactaagaactaaaataatatgaagtaatgggtatcttcaataataggacaaaaacataccacaccatgacataagtaatccaaatcccgtgcacaggtagctggattacatgaaacgtacactattcgaggggctttaacttctagtagccacttgattagcttcatatgcatccctggccgattaggatctgcaaatttaatgatgtctattaggatctagcaaagcagtgaaagcattgtagattctactcatcagggataactcgaattgctacaaaaaatatgtactaacagatatgtgccaagacaaacctgatatgattatgtcaggtttcggaaattccttcccaaatgtttcattgattttattaaggtctccctgaacaaatgtagcattgctgataccattcagcttagcgttctttttagcatctgcaatggcttcaggaactacttcatatccatagacatgctttgccctggtcaaatcagaagaacatctactaatcatgcttttcaataaatgggtaaccgaatgacgaatgctcaaagttttgtgctaagacttgaaacaaatgaaaaaaaatggcctcacatagtagcaactgctctccaacagcatgataatagtgagaaaatttaccttctagcaagggtaagaccaatggttccggttccacagaacaagtcaaggataatctcagagccatctcccttaagcccagcagattccccaataagcttgtacagaacatcagcctgcagtacatgcaaccatgcaggaaaaactgttggaaatgctcaagcactagacaccaaaattttagcataacgtggaaataactgatacatgaactggaatgtaagtcacatgacatagatatgtcaatacttcgaacctaacagagcattaacaaacctgttttgtattagtctggaaaaaggagttggcagatatctggaatgtaagtcctctcaacatctctgtaatggttggtttcccatacaaggtatattcttcttcccccacagatgtattgccaacagacgtattcacattattcatgatactgacctacatcaacactacaggcatatcaatattgtaggaagaagtaattaattatttatttggcttaaaacccaacgggatttctgtacagtagaactctgagtgacataatagtcagtacatgaaaagtattttaaacattacactgttcgacatagtacacttaaaatgagaaggcaccaattacataccacttctggtatttttgtgatattgttaacaagaggctccaatagctctggcttataacatgatgtgacaaaattaaccatgacttctggagctccagtggtgatatttctggaaaattaacaaaaaaccaatgttcaaaagtgttcatcatgcaaaaaaaaaaggtaagaaaagaaatgttcaattggtaacaaaaggttaaaaatttatttgtttggggagggaaacaacatgacttgtttggtcatccctgtcctatcaaataaatttacttttaactgaacaattatagagaatgtgtttgtagaccgagatatttggcagcagctaatgaagccaaatgcactaacttcagtaacatgtttaaataccaaaatgatgctgtaccaatgatcgaaagatttgctctgttgtaaaagaagttcatcaatatcctagtgctagaaatatagtgcccatgactgtaaaccgaataacatctgcatgcactatagtctttatagatatactgctacatggtaaaaatgcaggagggcatcatacattcataggtggaactcacaatcagataggacaccataccttccagttcttatcataagatgtttgagaaatccaacatgcttgtgcacatcataaggtgtgagaccaagagctggatccaaccatgtttcttgaacaatggcaagaacctgtaaaaattagcagataataaattaaacatcaaaaggaaagtcctcagaaccactctgctcactagtttgacaattgcttccaactccaaataattagcacgatggtccaggcaatgtatctgtgtacgtacttaaactgactctcaatatgtgtagctttatgcggcatgacacaagcaatttagcttttaaataattatcatgttacacagttctacttatatcattttgtgacaatcataaacaataccatcctagcaacacaagtgaatagtgtttgtttgtccaaagtatgttattccaatgcacaatctcgttaattggtgtcaacagcatgctgcctaagctgctcttgttgggaagttatacaaaggatgtgttgccaatgcaacttcaagctagccaaccaaatctaactataaatgttaaatagtggtgatgctgcaaccaccaagtaacacaattcaacaaaatctaaattttaaatctacaacaaaatggacataatccaatacatcattattgaccttttcttttttaccttatctgccggctcgctctgcagcaagcatttctcgacatgcagcaccttgtcgaagaaccctggcgcgtgcaatccaagcgaatagccatcaccttcaactttttcctccttcaccacctcatcatccttctcctccttccactctctttgcatccatctctttgttccaaaagagaactccatctggaaacaagagaaaaaacaactcatcttttgcgccaaaaaccccctcctaaaccctcctaaacccccacaccagaaattcaccttgttcctgtaccgaaatatctcgtcgcacggcacgatgggtttcaagatagcatcgggctccgagctctccatcttccggggatcgaacttgccaaagttcacgagcagctcgcggacctggaggtgcttgtggcggatctgcgcggcgtacgcgagggactgggccttgcagccgccgcagtcggcggcgagcgggcatggcgcgtcgacggcgtcgcggtggggctcgagcgtccggagcttggcggcctcggcgaaggcgccccggcggatgcggcggacgcgggcgaggaggcgctccccggggagcgcgccgtcgcagagcaggacgaaggtggagccgtccaccctgcagacgcccttccccttgaacgcgagcccctcgcatgtcagctcgagcacctcgttgcgcttcgggaagtagcccttgcggggcgggggaggcggcgaggtggtgggggtaggcgcggggggttccggggagagggcggccgcgacggcgagaaggcggcggccgcggtggtgaagcgggaggcggcggcggagcggggagaaggcggcggcggcggcggcggcggccgtggccatgagggcggcgggtggtggcgcggttcggatggagaatggacggtggagatggcgcggagggagagaaaaccgacgatgatgctggtgtcaccggtggtaaggtgctctgtccaagagggcccacttgacagaatcacagaagtcacattatggccatgaaccctgctgtttagcaaaatcattactactcggagtactaccttttgaaatggggaatcttttcaaatactccaatttggattgtttaacgtgaagattccatgaagttacttgctcaagttttggtcacgctttctagaaacctctgctccctccatctcaaaatataataatttttaactctagaatttatcccaaaaatataacaatttatccaccaacattatcttcccaaccaatcgcaaccctccaccattcatttttcccagttcccacctacctccactactcatttaatcacaaccctacaccattcacttctatctactttcttaataacggtatccaattctaaaacttcttatattttgggacggatggagtaagtgagtttgagaggagaggaaaagagaagattgagaagatacgcaaaacgagatgagctattagcgtatgattaattaaacttcaaaattagattaatatgtttttttaagtaactttcgtatagatttttttttgcaaaaaatacaccgtttagtagttcgggaagcgtgcgcgcagaaaaacaaacaaactttctcacaatctccttgggccgaacgcagtagatttatcactaaataaactatcgtaaaacttcttagatttctcactatcgatcatgtgagaatgatgttactagatttatcactaaataaactattgtaatatgctacaccgtttattaaaaataattctctccctcccttcccatacgcatgcacgccagcgacgacaaccgaacgggagaggtggtggcagaggcggagagggtggagcgggagggtgtggtggcggcttgtcaaccaccatggcgtcgcagccacgctcgtcaccttcgtcgacatcaaacgcccatgtcgcacactctgctgcggtgtcctcgttgtctcatcctgcgtcgccaccgccatgctgctagcggtttccctcgatgaccacctcactgatgccgccatggagacggtctacactccctcctgcaccttcgtgtgctgctccggagctattgtttgtgcacaccttcggcgccgacctttccctttgcttcttccccgtgacggttggttggtctgcaatggcgttgtcgtagcgattcttggacggccacaatagccacgtcctacttgcagtagctcaccatcgccgacacgttggctcgtatcctgaggcgatgtcgctgctcggatttgacatcgtggagaaaggggaggacgacggcagtggccgctctacctgctcaccatgtgctgcttatgtgtcaaggtgtgggctggagcggaccgtcctcgcggctgtgcaaatccggcagctcagcgaaggatccatgctgcggcggagaaggaagagaccgggagattggccgctgctcctttcccgtgggccaccgcacgtcgctcctcttccacaggtcaccgtgcgccgctacctcttctcccgtcggccgcctgcgtgacgcgccctgtcccctcgccgatgaagagccggaggaaatggaggtagagaggggagatgtggaggaagtgggactcactaactattttttaaccttattagtatttgcctgacatgtgggtccagatattttgttttattttttaaattgttaaattttacttcatgtgccacgtaaatgcaatgtcagatgaagaccgagtcaaattagccatgtagataccacgtcagctgaaaccgcccttcaagccgtcttaagacttgttagagcaggtacaatagatgcttcaagccggtgatagctgtccaccgtggcttaaaaaactgagttaaaagcaaaagatgaagagagagagagattcagccgacgactaaattatcgtcaactcctcacgagctccaagacagtgcaaagcttcagtgattggctagcaaataggtgagcagcagttggccttgctatatgcaaatgaagaacgtgcaatgcaataaataaaatgaaaagtaatattcagaaatgtgtttactgcagcttacttttgtataatacgtctctaattatggctgtagatgacatgggattttttggagccaatagctagctatattattgaccttgctcttattttgcacctattttatattttaacagttgagaaacccgctgtatccgtttttccgattgaacgacgaaattcgaaattcggttttcgtaaaaaagaaacctgcctattacctgcgcactgaaacctccgaagacccacggcccgcacatcagcccagcaaggcccacgccacgccgcgtccgggattaccatcctactccttcctttgctcaacctaattttcaaaaagcacatttacacgtagacccctagaacaccacccacctcgcaaatccgtcccccatccccctcgtcgtcctcctccctctacttgtatccagcgcccgccaacgccaagccaccacaaaggcaaacgcaaccgaccaccaccacctccacctccgatccacccacgccgcgggaaaccctagcgccccgtcgacgacgccctccacctggtgcacgcgcgcggggtggcggcggggggcggagggacggacggcaccgcgcggtagagggagagcgggagcgggagcgcgcgcgtcgcaccggtggccgagccgggccgagctgcgtcgcggtggtgctcttccgcgggcggcgagattcagccctgatccgaggaaggtgaggggaattcttcgtcggggtgggggtttggtgcaatctgtgggggtgagatgcggtgcggggggatgaagaaggcttttcggggtttgggatgtcgcggggatttgggggcggtgggtggtttttcggctgggaattcgcggatttcgcggctgctcgtggtgttcccgtggtttttacgagcagatgtatgcttgatctcgtgcggctttcccctctctctctctctctccatggtttgctcgcgttggggggtttcgaaaatttttcctctagtgttagtcctcgagagaagagtagtggatgtggatggggggaattgagaactgcgaggtgcggctttgggtgggtggtttgttttctccttctccccccgagcagatgcttgcttcgtctgcttggatttcaggatttctggaagacgatttggtttccctccccaagttcatcgcgcaaggcgttcttctgctgcgaatctgtctgttttttttttggtgcgccgtgatccccgatgcgacgcttaccggatttcatctctggtagtatcccttaagatcgtggcttcgattttgcttggccttcccctcctcctccttgacttgtgctgcggcggcgtgggacttttgggggttcttcactgtagcttctccggttggcgtcatacaccacctttacctcgctaatcgggtctctaattaggtatctgctgcagagaattttcatttcccaccatatttctcatctcgtggttggggatccgtaattccgttatctactcactggcttgtctaacttgttccatgcaatgctttgaaccaacacgagtgtttgtttggttattgttggttctgcaaagtccaggctttcgctatgacttgtcccctggaaaggtctatttacttggatgtggactgagcggcaattttatatttcttgatgtttggatttgttggcatgtcaaatatagcttatgtgtaaatttcgatgatttttggctatatttataatgttctactcagagtttatgtgaagattttaccaaagtttcttgcttttctactggctgcccggaatctttttctttatgaagtccttgtcacagttgatgacttgcttaatctgattactaaatgggccgcatcatgagttttgttttaatctgacccttgtttaaatttcgtacttggacaattgacattctctttgcagcctggcattagtttagtttgcaaagtcttattttgcattattagagttaggatgtgaaacttagaagctagattaatataacttactaggagtaatatagttcatgttttagttttcgttgtagtctatagtccaatgtatatatgctacactaattattgtgttagtgagctttctttgtttttttgttttttttgggaaacatagtgttagtgagctttctctctcacttgcagcaatatttgttgggcctcaagtcaaggaagtctttttctctctaaaacaagccaaggaaaatttccatgggtccagcaaaaggttctcgcacaattaccaagatcacaataaaggggtatgacgatcgacagcatgacgaggatccaaatagttcaagcaaggttaaactaaaagtaagatgaattgatactttttagatgacacccagtaattgtagtctcttaaaatatcatccaactcagcaacaatgtgtagacatgatctttttccgtttcactaaaatgttttgattttgcagaagagaaaaatgtcagatttaggtcctcaatggagcaaggatgagcttatgcgcttttatgaagcctaccgtcgacatggaaaaaactggaaaaaggtttgctattcaattttccgaccaccattttttgtgttcatgtttcattggtgtctttggtgccaaagtaagaaagttgtttgttgactctgcaggtcagtgcatctgtgggtggaaaatcagcagatacagtagaagccctttacagtgtgcaccgggtgagtttgtgttctataattaatatgccctagctatttgcgaactttaccaccttgcatcctctacagtttacttggttttgtgaactaaagttgataatttgctcatctagaagactagaacaggacagtatattgatgatatattatttatgcagaagttcaagaatatttagttataatatataattcaccttgcagccatgcctagataaatgtaataggttaaatttgataatagaacctaaagtatttacacattgccatttcttgctgtagactttcttatctcttccagaacgtgaaggtactgccatgggatttgttgcattggtaactggtcatcacaatgtttcggtaagcttatgatgggtttacttgttgaatgttttattgagtatgcttctggtttctggatatgccaaatttcagttgtttctttttgagagttttcaatcatgtgcgaatatttgtactatttgaagctaccatgcataggtcagtttcgttatagcaaaaggccaagtgtgagcactcctgatcattgtggttcttttggatttagttataatttttattataacagtttttgccatatgatgatgcaattagtatattgtgacataagaataactatatcatgatgatggacgttactaacattgaaagaacaagctaacagccaatctagagtgcgttgactattgatagtggtgattgttttgcatttcctacatcacagtctctgaagaatgatgagtaccaatgctttgttcttcttatgttcgattctgaattaacctatttactgcaaggtctgaattatctgaatcgacatacaaattgccctactttttccttaaatcacttgaaattcttaaaatagcaggatgaatccaagagtcataaaggaagtgatcaaacagttagagcatctgggaaggtacggaaacgtgaagctacagggcagaaagagaaggaagcacctcatgctcaccgctcctatcatgaaagaagaacttctggattatcttctttcaagaaaagatactatggaggtaagtattgtaaagcaaatatatatatatatttatttatcccttaatcttctcttggcctcctcaaaatgaaattaccaaagaaagaagcaagagctagttgaatgcaagagaacatttctattggataataacttactctactggcctgcattgttttactaatttgtatgcttttccagaacttgtcaagaacattccaagacatccttcagggaaacgtactcctcgtgtaccagttatttttcctgcagacatgaatgttgctcatgctggcataccagaaacagaaaatgccatcaactgtaccaaaaaggctagtggagctaccaataatgagcttgaatgctcatctcatggaagtcctggaatctcagaatcagccaagtttgttcaagggcagactttcctggaagctaaaggaactggaagcttgaaaaagagaagaattgagcagagtatggaacaaggtcagacaattaaagatgagcataaaaccgcaatggtggctaaagaagggaatgaccttactgaatatcagagacttaccaatctattttccccaggtactttgagacatttctccccatcattgatgtcaaactcattgtttcgttgagttcatgtaaatatacgagtttttggttccattttctgttcacaaaactaagcaatatattttatatgaactacacattatttactctgccattgttatatacaatctgttcagcattttacattgtggatagtttaacatcttgatagctactgcaaatagtgcctaagattatcct

SEQ ID NO: 66986 - DNA, 3119 bp, Oryza sativa
aggatttcgaggatcaagctccagatctcgagcaaggcaagccacctttgaacatcttgagcctatatttgaaatttaattatgttgcttgaaaaatattatgcattgataggatcgcacttaatctgttgtcccgtctgcaaggcagatcggcggacctacctaatttgttgcatttgatccttcctttgctaattgatataccatgtccccttgtaaccatctagttgcgtcccgatattcgtgcaccctgtgcgagtatcgacggacgccttcaaacttaaaattctgagtaacttcttgggtaaaacttgggttttacaaaagacttggaaaacccgacacctgggtcggtgcttgcgaactaaatgaatttccaaaaccgcggaccggggaacgtaccgggtgtacggttttccgctcttgcacttaaggaccgtttccttggaatttcatccaaacataagacaagtacgaccacatgggtggaataggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggaggtctcccgacgtggctgatccccacgggttgggtgatccgggttagtaatgtcgtgtgggtaaagtgtaccccctctgcagaggttaacaaactgttcgaacagccgtgcccacggtcatgggcggatgtgaggtgattcctagcgtagttttgcttgactactgcttgtgaaattgctgttgtggaaaggggttcgatgattgaaaaatctgtagctgatggaatcagctaggcccgggtggccgtttgaaagttgttggcccgggtggccgtttgaaaagctgttggccgggtgccaaccttgattcaaatctaaagactgatacattgcacatactccgaccggacgagacgcactgtctcatccgtgtcatttgagaagcgctcacttagttgatttcagaaaagagttcaaatgaaatcaattgcaaaaacaacagcctttccttgaagcctgcaataaacacctatttcccatggcatgctgagtactcctgtactcacccttgctctatataaataattccccccccagttgctgaagaagatgaagcggatcccgctgacgaggagttcttccaggagcaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgataatctgtcttcctatgataccagcactgtttcctgggtctggtatcaatttacaggttaatttggagcgtcacgggctagttccggtcggtactagttcggggcgtgacaagagatggtattagagcacaggcttggccctagggcgaaacccgacgtttaggacgaccctaaggatactaagttcaaaactacttgcgaaaagctaaggtttcttttgttttctttatttccaatagtttgtttctaaaatggttactaatattttctccctctttcaaaattgtagatggcagtgaacgcaagcgtcagctcccacggttttggtgagggtcaccacgtcgctcagcttcgtgacctcgcccgtttccttggcttctcgtgtcccgagtacacggggtactccgtggaccgtgttccccctcgctgtgagctctctgtgtacctttacccccgtggaggtatacacggagctggccttcgcccacaccacttcactgtggccaggcccactctccagatcgcgtaccaggacctctcctggactgcgcttcgtcgcctggcccacgactacagccaccgtctcgggggctccgccttccggcagcttccacgccttccttctggccacgcagacgccaggtacccttgtccgtacagcgagtctcagccagtgctgactcgcatggttgagctttcggaggctcaggccactcagcacgacctactccttgaggcttaccgctcccttgcccgccgctacgccgctctggaggcccatatggccgaggagggtgtcacctcagttgacactgtctcttgggactcaggccgcctctgtcacgccagccacctgtcctcccacagctcccgcggctctgcccgcactcccagtggcccgcgctcccctagctcgcgtgcgccgtactcaccagtgtactccccctacccacacccagttagcccctcctacacccccggacacaccccagttgcttcctcccgccgtggcccacgctttatccgcaccgcgcggaagcgtgttgttggttcttccaccgtgttccgtttccactacccagctcccccaccgccagcggcctgtgctgctgccggccctcgacaggttccgccggtcccttcgcgtcagccgatcgacgtttcttcgactgaggagccgactacaggaggcagccaggctgacgaggagtagaggaggcagtcttcaacagccgtccgtgtgttaggcccttttgttccgccgccaactcttttggagtcgtggcgaggtagtgcgtgcgtgtgtttgttgtgggtgttgtttggtagtctggttctcctaggtggtgtgcgcacagtcaagctcggcgtagctctgtgacttgtccacacccgttgtatcaggtgtttttatgatttgaaaaatccagtttatgcctagtgtgtgctgtctgaggtgctatttactttgctccttgccctcctaagtgcttacctgattcttacctcgccctcttctgggagtttagatggctagccccccccccccccccccccgtgcagcccgtgcgccagcccgcttcggttttgaagaaggtagagttgtgacagaagcaaatcatgagtcagctaatgagcagtctcaccacagcaa

SEQ ID NO: 66987 - DNA, 5205 bp, Oryza sativa
aaaaagaaaagaaaaagaaaagaaggaaaaagaaaacagaaaagagaagagagaaaaaaaaagaaagaaaagaaaagagaaaagagaggagagattagagtgggccccacgtgattagagagtagtaatccccttcttaatcttcattagttgagtattacatgtgggtccgggtggttagaaatctaattaagggaggttctgtagtctcgggtctatgacaagcgggccctaccgggtttaatggccggtttgaccctagtcaaaggagtcgggcccacctgtcatttgcccatatggaattcctttagaaagaaaagtaaaataaaagaaaagaaaataggaagaccccacctgtcagtcactatagcttgtggataaggttgtattataaataaatgaattaggaacagtaccatttcgcaattattagaattaattcaaattggaatctttacactagcataacttattcattttagctccgatttgagtgaaacttgaacctaaattaatctaaattcataagctttccaatggtatataattcactatttgataaaatatatttataattattaaataattaatatcaagatgatgcataatagttaacttaaaaatgtgctaataaataaaattgatattgtactgtaaagtagatgtgagaatatttgtctctagcatgtcttgacattgtagcaaacatgtaaattaattataattaatgtttcaaattaataggagcataggaaatattagtgccattaactaatagatgtccatatataattatacccataacgtccaaactatatataaataatgtttagcctcatattttgtgactaaaacatgaacacacgttgatgagtctttaacttgtttatgagaaataatagcagagcttgtatgattaaatcaccaatatgaaattaattaacgacatctcctatacagtagtatatgttttgggatggaaatcgacccttaagttgtataggcagtaactcactcataaatccacttaaaatcacatgtactatatagcttaaagtaaatagcagctgtttaaataaatgattcaatattaagatattgtgcactcacatatactgtacagtccattatagctatacgttgtagtattaaatcgcttgattgcatatattaaaattaaagaggatatatgacaaacatgtatggtggataaatactaattataaaccttgacctaatataacccaagttcaattgtagattaggattattcattgtaaaattatgtgatgggataatctgtaaccataatatgattaacctaaacaactctaacatacaaagcatggataaatattaaccttttataatttattgtgacaagtaaaataggttcataattaaagtaaagcctccatcaagtaaataataatacaaatgattcactgtaattatttgattgatcctaaatccattcgacaacagaacctctagtatatgaccattttgtttagataaatgcatgtgtagccataatccttccatagccatttgatagactaaaccaccgattagccaaatatatatgtatcccataaatgctatgttggttaactcctaaatagaccacgatgacaatagaaagattaagaaatcttagcccttagcatgattggaatccattagcaaacacgaatagtacattttgttgtgcatatttgattgttgtttgaatattggtttttctcgcgtattatagaccttgtgtatcggttagtcgtgaggcaacgtctgcaacttctaggaggtgaaggttgatcaagattatatcaataataagaattatcctgagcaggcaagtcatcactattctttgaacatgttgatcccaattgcgaaattattttgtttacaaataaaattgcatgcaatgatgaacatcctacttgtgattatgccatgccttgattattgtttaccccttatgccttcgtaaccatgtttacgtatgagtccctagtcaattatgacaattgcttagaaatgttattctagaatcatgcatactcatatttatcaaatgctatatgcttgggcaattacctttgggaaggtaattgagatgcggcatgtggagacatgagcgccacattgccatgatattgatgacatgatttgtgaaaggaaaataaagtaaaacaactgttttcgactggggcggctttgaggatttgggtggtgtccggaaaaggctagtgccgtccctggtcaattaaggaccgagccatgaagttaagcatgaaacgacccccgtacaaccgcacttctcgtatgggtatagacctagcggagtagatagctgagcggaggcagtatccatgcatagtggttttctttaggtgtgtgatgcggcaagcagtctgctggcggatgcccggttcgggtggccaggtagatggcggacgccgttccggatggtcagaggctggcttggcaatactacatgaggacacccataagagaacaatcatgatggactgggttcaacgacaagaagcaatgtaggaatgtgtgtgtttttcccttcccgggtgcgccagaactcctctcactgctagaaactgtgtacgcctagagtgcatgaggatgaaaagttcatggagcgggtactgccaatgcgaggttatcgaaaagctttgccgtgacgcgtctcatgtgttgggacgaggctcatgtgttgggcagtgtggagtgcgggtaaagtgtacatccactgcagtgtgagtaaaacaaatctattcgaatagccgtgctcgcggttattgagcaccgggacatgtattacacttggctagactctaaattcttaacttgtgtgggatgggatattgcatgatggattttatgctgatggagccacttcctgagaggagggaaggtggacgttctcagaaaaccatgacgactcaatggcgggaagctatccttgggattacaatggatggtggacagaaccgtcgttgtttaatgtgaacactggtattaaaacttgatcagtccatgctaggtcttaggcttgtgaaaagaattgcaaaactagctttatgcaaaaaaacctgaagccattccttgaaatacctcatatcatacgcattgttgttgtggtggcttgctgagtacggttggtactcacccttgctatttatatatcttttaggagagtgttgaagagaagcccttgtcggtacgcttgcgtatccaacaagatgatcagagtgcggtcttgttctaggtctcattccccagtcgactgcctgtggcatgttaaccgggcctttatattattttgtcttccgctgttgatctctgatagttgttggcctacctggccctaatgtaagtatttaactcttttagcctgaattcattcgtgatatgttgtgatccaactatgtatatgtgtaccaactactgatccagggattggtacggataaacacagaagatttccgatttccaaaattgggggtctacacctatcctacgacttatggaatatacagatacggtataccttcgcgcatacggttcgtttttgtacgcgttaaggaaatttatctctaattatggaaaatatctccacgagtcaagtgatttccaaagtcctactcggaggggataagatttctgttatatcgtaccagatccgatgtctccaggtttgacttggagatcaagatgatccacgctataaaagggatccctaggcgggggtggaggagatcgaccaaaaccgccaacacacccaccatagtttacgaagccggagtactcggagccaagtcgccgtgagatctcgtcgatcctcatcgattacgatctcgtcggaatcgtcagtttcgtctacttctttgtaatctgtggtattctcatataatcccatactaattggactagggctattacccatcgaggtgcctgaaccaatataatctttgtttcttttgcttgttcgatgtcgtacaacgcagatccctgttccaacgtaacccaatacccaaatcatccggtccgcgagtatcactcgtcgacaattatttttaatgttgtgtttcttttttcacacgcgataagaatttgttttttacttttttggtcgccgggccgaacccaccatgtatctgtctcccgatgcgttccctcctccaattgattgtaaaaattgattcctcactactccctcattatttttttcatgatttttccttttaattctgcttaatttatgtctggtcccaaaactaatgattcggtaaccgacatattaaaactgtatcaagccctggatcagtagattgatacaggttcaacaatctggatcttcattgcatatatttgatcaatgctccaaagaagatttctttacataaagtaatagggtatttacaagattgtggctaactattacagtagaagctataggatgagccaactctaatgttttgctatagacttaaaccatctatctaatctatacttgaaaactaggtttaaagggaactaacttatgtgattgaactcccggcttcgataagaactccaaaatgactctgaaaaaggtggggtaaagcaagggtgagtacaacgtactcagcaagctattatattaatcaacaatgaatgcatggaatggtaatatctgtgtagagctaggtttacttgcagaaagcaaagaatatagaggaagaaagcctgtaatgttttaaatgcaacaatatttaataaagtttggacttatgtttctaaccaaataccatatgagtgccaatgctcaaatccgtgagcacggctattcgaatagattcatttatactttactgtagtaaatgtacgctttacccacggcccacgacttgtcgataatcatcagctttagtcatagcccagcattaggttactaacaatagtggcacctgttccatgaactctagtccccatatgctctgaacgtaacgttatcagcagcgataggagttctggcgttcccggggtatttagagaggactgattgtatgacaccatgtcatcgcaattagggtttacaaacaagtcatatgacatcataatttatctcaaacaaatatttacttgcgcctcggtaaatatcacaattgccctgctcggcataagttttcctcctgcgcg

SEQ ID NO: 66988 - DNA, 2281 bp, Oryza sativa
ccagatgtatcataaatattggctcgaggatatattccacatcgtacctcgaaatactaaacatttcaaggtatcgaggatcatatgatattaaaatgtatcacagagatctcattatgatattgcactagtatcgattaatcgttttagcacaaacgtttagcctataatcgtcaaaccaaagcacacggcccaaaacttagatatatgctttgtgtttcacgatcacatcatatcagagacgtgtatttactgaaaatttgagagagagaaaaagtcaaaagaagataaactagtccaaataaattatccaacctacctcctcgtgactcgtgagcacacctgatcatgtacacaagcccaaccaacacactaggtacaatcacggctagtaaagacatgtatgcatgcattgttgcgctaggtgacaggtgactgtcaagaaaaggcactactctgatgtaggcctcgcagaggtgagcaaagatggtaaggaaggcgaaggagttggggttgaggtgcaagagagaaaggccgtaaaagttcaggatcaacaggaggaactctgaaggaggagggagaaaaccgcagcagacaaaatcctctaccgctaccatgcaccctagaatgggggaaggatccatacctcctgcttcccaggccatggtctgcttcggagggatagccccctccgtgtacagcttcttcagggcggcagcgtcggtggtggattcgttgaggtccgccatcggttggggatcgccggaagaaggttggggattctgggatgtgaaaggtgcaaggaagccaaggaacagtgagggttctgggcaaacggacttaaaatgaatcccagaattcctttaaataggcacactatctgacggttcgtattttgaggaaggagagagattgccgccgaaaattttggagacccgttgcgggtggctgtttgacttcgatttaaattcatatcttaaccgttgaacttccttcagcgttgtcgacaacctcatgtctctacggttttacatcgggatcgatcaaatgggtacgacaagacgctatcaggtgaagtcgcggacgacaacatgaattcatttaagttgaagccgggggttactgtcaaggttacggataaggcatgcctcctattgtaacgtcctgaaaattcctaacaataaaaatcactaaaattttgaatttttttaaaacttttgcatcatgctggttgttatgattgctattgcttgccaaaccgtaaaatatcacaaagaaagtaaagaaaagatctaaatttaagcaatagatataatttacgagaatatgttatttattaataaccctacaaatattagtgcacaagaaagcaagccaaaccaagtataagtcaaatattaatttctattataaatcacagatcaaatattaaatattcgaaccatgattgatagcttgatgtcacaattagctaaagaaatagtaagattaaatccaattcatttgaatccaatctcacatgaaatataagaacacatgaaatgatgatcaccacccactataatgatcgtgtttataaataagtaattcaccggaatatatagattgatacttacaacatttcgccgagctcctcataacatgaaaatcactcatataaaataatggtcatataaataaaataagctttatatataaataagattatgtgagttttaattaaacaattagattaataatgtaccgagtctcaatttactatttatagaataaatggattaaacctatttgtgtaaaatgtattgctatacaaataaactcgaccaatctaccattgtattattaaggacacaacgttatattaaatagaatattacccccaaaatcttcaaaaatatataagttcactttagggccaataatataaaaagaaattatttgtgagatatataaataaaatatgggtaatattaatcttgggtgaatccattggttggaataacataaatattgagtaaacctcatttatgcaaaaattaggatttatagaatagaatttatatggaaaataggctaaaattgggataaataggaaaatacactgctcattgcactctaggtgctcgacgaggtccctagccctacccccttctctgccgtgccccctcgcgtcccctgccccgcgcgcacgccgccccgagccccgtgccgccgatgctgcgccgtgccgtcagccgcctgccgcagctgccacgccgacgctgcctcgagccccgtgccg

SEQ ID NO: 66989 - DNA, 27789 bp, Oryza sativa
tgtcctcaccaaccccaccgcgctccgcctgctctgccccaagcacttcgcacggctacccaaggatgcctctgccaccactgctcctgttggccgcacgcgacgaccgccgccggccggcgagctcgctccctcggctctcctcgccgcaaccatagccagcagtgacgagaaagttgaggagttggagtgaggaagatgaagcccaagggcagattggtccatgatggcatttcagcgtacacgatttggttaggagtggtattctagcgaagcccgtttaagtgatgtcattccagcgaatccaatcttttgcgatggtatatatgcaattttttctgtgtggatgtggtcgatcaccatcaacccggcaggcaggccaccgagccagccgtgggtcggcgtcgatcgacgcttgttttgactgatgcggcatgtctcgccataactcagcagtcaacaacaatgagtacttgctttgaattgcatatgctaaacaaaaaaatttagggggtgtttgggagagagaggctaaagtttagtccctcgtttctaaacaccaccttaaaacactgtttttcttagaaataaagcatactggtagtacgttcattctcgaaaattcatactgtacgcaagattgatatgaaggctaaacaaagttttgtgcttccagaaacgtccgggaaaacaaagaagattctggaattccagatcggagcaactgagcaagcaactatccaaactacgcacacaccacccgctacagctgagatgcccgaaactaggcgttctcctgcacgggaacatgcatgtcagtcaccacgcagctcgctagcctggccaaccttgggtctgaagctacagggacagcaggcatgcaagaggatctgcatttgtgcagttaaagatagagcagggggagggggatagatgcaaaggagatggaggagagatcagagccacagatgtgctgcaatgatgggtgcacactaggtagggaatgagggaacaacctaggcagggagcaaagccatccaacccaacccaacccaaaccaagcaaaaagcaaaggctatgtgcatcatcccttgctcttgcttgtgctgttggccattctcgagaccgcttggaaaagccaaaggcagcagctttggacaaatcctctagcggcctacaggaacgccagggttcttcatgtcacattgtcacgtgactcgcgcgtgcgagatggcgcgccacaccgggagacggtggagagacccatcgaacaagcaagcaagctcgttcatcaagcatggtgtggtgtcttagcgtgcgtgatggccatgcatgcgtgctgctccccagcgacccacacttatcttgaacggcccggcttatggcagcagctagcacgatgtgcccattgaaagcattgattcgtctgatatctcgcctagcctgttgaatggcctcgcgctcgatcgatcgggtcaagcacgcatggaatgggcaaagatggcgcggcgctactacagccgctgtgctactgtgcagtgacaaagatggcagcacgtacgaccatgtcgactagtgtagctgccacaaatatactatttccccgtctttaaaatataagaagttttagattgatgaaatatatcttaatagtatgaatctgaataaaccttttatctaaattcgtagtattataatgtgttttatttaaccaaaactttatatatatttgggaaggaagtgagtaggagctctttattctatcttgttatgtctaatgtttgatcgtccattttattttaattttttatagttagtactttatacgatgatttatttgttttacttctttataattttttttaatataacggcggtcaaatgttgaaaaaaatcaattttaaatgaggtggagatagaattaaatttgaaaatatattgttcactcaattttttaaaatgaatattcgggatgcaaaatttttacgaaaatataccatcgatcttgcacaaccgttgcgcgaaaataacatacacgtgatgtcgtgggcggtatcgcgcagtaaaagtgcgagaccgcgcggtctcgctgaatggaagagcgagaccatcggtctcaccaaatcaaacaacgacattatccaacggtttccatttgatttgtggttaattacttcattaacaattaaataataataataattagtgattaattatcctaattagcatttaattaataactaattaaatcggcatggcaccggtatcgctaattgcttgaccgagaccgttcggcttcgcttttacatcccgtgggaccgtgcggtctcgcgatgttgctgtgcgagtccgcgcagtctagcattttcaccgcgcgatgccgaccgcgatgtcattctacgccatttccgcacaaaccgacggtatattattgtaaaaaaaaaagtttgcatcctgaatatttatgagaaaaaaatagaatgaaattatatttaaattttattcgacggagacacggagtgagttggacttttttagccatcggatcgatcgatgtggaccgggcggcgctgtagacgcagtgatgatgcgcagcgcgcggcgtcggcgtgggcgtcgggggcccccgccccggccggcggtacgcgagccgtacgcgcgcgcgccccatctcgtgattagccaaagcccccggacgccgcgtggagctccgtcgtaccacctcccaccctctccacccaaaccacgattccttcccatccgctgctgctattattccaccctccttttccctcgtctctcctcccagatctcaatcgcacgccgtacgttatcactgtgaatcaggataagatagcgtacacgtgtaacagtgcccctccataatctcagcctcccacccccgttccatttacagcaacaaatatagcacaataaagtaggagtaaagattttcagcataataatctcaccgtgatcgtttatttccccgcgaaaaaaaaaatctttatcttgcagctgtgttaatttggccgctctcgctgtgcaacgtcgccatcggtgcacgcaatcagtagtactgcgcgctgcgctatgggcatccgcttggccgttaccaaaatttggaggcgtgtgcgagcggtgtctcccatttccgggccagatacgtgccattttggcccccgcgcggttgcacgtccactttggctgacctcacgccccgattaattgcgacccgctgcgttatttctgcagcgtccgtttcgtccaagagcagaaatttttaattaaagaaaccgtcacgcctggatcgcgccgaattgaaacaacggagcactatacgtggctcgctcgcgtggggatcgaaccgtgtgtgtgtgtttgtgtttgtcgcgacgcgtgacggcgagaccagcggccgggaggagccgggacggcaagggaacggatccgtcgcctcactcggtcgctctctcgtttctgtgatttgtgactgtcacgtacggctggatcggtcgcgtacgtgacatcacatccagcttgcgcggttaagagtttttcgatctgccaaagagaagatcgggagaaagatcgagaggtagtagggtggccatacgctacgaccagtaggagtgtaacgctagagttaaggaaagagacgtccagagaaaaaaatgaaaatccttttggatgaatttgtccgtagaccagagagattttcttggattttcttccccgagaaaaaaaaaagagaagagcccatagtacggcaatgtgcaatactactgctactactatctttcttccaaaggagaaaaacgggtgtttttgtttcaggcctacaggtggggccgaccacttcgatctccggcgttttcttctggtcgtcgccttgcgagccgcagccggcggtggcccgagcgaagagccagcgtggcgtgtgcatgcgcagggcgcgtgactgcgtgtgcggtgcggtatggccacccagcaaacgtggcggagagccatgcgagtcgcccgccgggtggaggtccatcgtggtttgtcgctagcatccgctggctgaattgccgtacgattgtatgacacctcgctaaaatctgaggggcatctatgcttctccttattcttaaagagttaaattttaaatttttaactttaaatttagagctgattttagggtttttttatcgaaattcattttttaatatttgcttttagatcgctaagagcacgtatataaaaattttattcacagttactcttcggttaaaaatatggtatttggcttattacacgaataaacgaaacgatggggccgtatctttcgactactgctcatgcatttacttgaaaataaactcatttgtcttcattttaagataaactcatttttcattcatcccatgctccacatccatataaaaatataaatatgaaaaatttaaaactagaaaaaccttactttaccaaatcataatacaattatttatcatttatctacttccaatacaacttttttaatatatttttacaaactccgatacaagcgttttttctaaaataaatttattttaagattaatagtagatagcatagatatatttattttgggacagagagtagttaaatatctcagtaatgggaaaaagtgtaacctatctttttctcaaattggaactcgatcaaacggttttatctctatcaaaaggaaatgaagtgagatgaaatattcccacaaattaactagggaagcaaaacagcattcagattccttcgaacttcactcctggtcaaatttaggagccgaaactctgtcagataaacctcaacagtatttgaatttgtatatgtgttagttttataccctcaatcttgtaaattgcatatgtcaatatgtaatcgtaattgcctagggcatcgaagccctcatgttgtctacgcgatgatcaaagaatatcagcatgtcgagatgcttttggtgcgatgtgctattggtcatgggtgtagaatctatggtagaactaattgcaccgtccaaagcaccacggtatcatcatcctccttatcgactgcacgagggaatcaaggtgggggagctcgggtcgaagaatggatatctacaaatttcaattttcgattgcaggggcttatagagaagtctggaagtaaagtttcggcctacgttgagagccatatcaatgttccggagcaaccaaaacaacatttgtaaccatgagttcggatttaatttcatgatttataagattattgtctaattgatactcctcatgtccttaaaaaaagtaaagttaaattctaattaccaatataggcatattactccctccattcctaaatgctcgacgccattgactttttaaaacatgtttgatcgttcgtcttatttaaaaaatttaagtaattatcaattctttttctatcatttgattcattgttaaatatacttgtatgtatacatataattttacatatttcacaaaagtttttgaatgagacgaattgtcaaacatgtttaaaaaagtcaacggcgtcaaacatttagggaaggagggagtatatgtctagatcagaagttggtttttttgaaagacagatgatgtagtttggttcaagtttaacgatcgatagtgttttttaatctataaaattatttttttagtactccatctgtatttttttaatgtatgacgccgttgattttttaatcaacgtttgaccattcgtcttattcataaaatacttatgtcatgattaaagaacatttgatgataaatcaagtcacaataaaataaatgataatgacataaattttttaaataagacgaggtcaaacgtttattaaaaagtcaacggcgtcgtacattaaaatacggagtattactaacatgatcaaataatcactcgattcaatgagttaccgtagaaaggtacccgaaaaaaaggaaaaagggaaaccgataatgcaaaatcacaaagtgcgatatcgcgaaacaaagaacgatcaacgggacagtgatccacgtacgggaaaaccacccatctccggcgacagtgatccacgtatgggaaaaccacccatctccggtgaaccatcggccaatccgcggccccgctggcccacacgcatgcgtccaaacagcccacccccccccccctccccctcctctcccagtcgctacccaaggtttctagaacctacaggaatatgtccaatccctgacggaccccaaacctaccacagtctagagagcctcacgtactagcgttacccaaaacaaatccgtagggcacccctaccccccaccgcgcgacgtgtcctacccccgctgccctctcgctccacctcgccccccgcatgcctgccaccctcctcccctcaccggcacgtgtccccacctcctgcttgacgcccccgtctcgctggaagtgggcccgactacgcgtggggcccgtgctgtcagtgagacgtggcgctgcgcccaccgggatgtggggagcgagagacggcgtcagttaccggatgcgtggtactactacgacccctccgcccacggcggaaccgtggttggggtttaacgcaaccatggttcgactctatcccgaggtgggagaccgtggttagtggagcagtttataagcgcgcaccgcttcggcttcgtcctcctcgccttacacatcgcaccactctctcttactcgtccatacgccgagtccacgagatctcgccgtagtccatacaccggttgatcggaggtcgtgttgccgccggcggtggccatgatgatgatgggggaaggagtcagcagcgtcccgccgtggtctcacctccccgtgagcggagtcgatgtactcggcggcggtggtggcggtggggatgagatgacgccgtacgtgatcgccgcgctgcgggattacctgccggcgaatgatgtcggggtgggggctgacgaggaggaggaggccgcggcgatggccgcggcggtggacgcgtacgcgtgcgacgagttccggatgtacgagttcaaggtgcggcggtgcgcgcgcgggcggagccatgactggaccgagtgccccttcgcgcacccgggggagaaggcgcgccgccgcgatccgcgcaagtaccactactccggcaccgcgtgcccggacttccgcaagggcgggtgcaagcgcggcgacgcctgcgagtacgcccacggcgtgtttgagtgttggctccacccggcgcgctaccgcacccagccgtgcaaggacggcaccgcctgccgccgccgcgtctgcttcttcgcccacaccccggaccagctccgcgtcctcccggcgcagcagtccagccccaggagcgtggcgtcctcgccgctggccgagtcctacgacggctcgccgctgcgccgccaggcgttcgagagctacctcaccaagaccatcatgtcctcgtccccgaccagcaccctcatgtctccgcccaagtcgcccccgtcggagtccccgccattgtcgcccgacggtgccgcggccatccgtcgcggatcttggcccggcgtcggctcgccggtgaacgacgtcctggcctcgttccgccagctccgcctcaacaaggtgaagtcgtcgccgtccggcgggtggagctacccttcgtcgtccgccgtctacgggtctcccaaggccgccaccggcctctacagcctccccaccactccactggcttccacggcaacggtgaccaccgcctccagcttcatgcccaacctggagccactggacctcgggctcatcggcgacgaggagccggtccagagggtggagtccggaagagccctccgggagaaggtgttcgagcgactgagccgggatggtgccatctccggcgacgccacagccttcgccaccgccggtgttggcctcgacgttgattgggtgtccgacctcatcaactgaggcttccaagtcgctattggaagccccttttgtgagcatcaaggatgatggcatggaggaggagaaggtggcggtaagaagaaaatgatggcacgacaaaaaaatccttcattttcttttgtgatttcaagtcaagtttctactaattcctgtacatatctatctcccatgtgaatattcatggttggtggagaggaggcaagtatggaaagatgggtggatttgttttggggttttgaggtagtagcaaaattacccacaaaaaaattaggtgaaaaaaaaaagaggagtagaaatggaggtgattcagtgtctcctgtgtgcatagggtgtgtggaggtgaaggaagcacggaaggaagaagatcatggcggaagaagatggccggatttcggccgccgtcgcggcggcggccctgcctatttcagtgatttctgggggtttatcctctgttcatcgtttgttgcatcatcgactagctgatgaagatcgtcgatcgatttcaatcaagccccccctcttgttgatttcctattttgttgatgtaatctttgttttgttaagaacccccaacagcatattttgtaccttagctttaaatctgaaaatcttttgctgactcatctacctatatgtggtgatgaagcccccctcaatgtattgtaatcacctgcttcaagtaaatgatccaataatattatgttgctatatgtttcattacttccttgatccaaataacactcatcttaatatctctgttcattagtgacgaaatcgatgtgttttgtggagctgagcggggggcgatggtgccggggaacctgccgtgacagagaccggcggagagtgcgacggcggcggagtcgccggcgagtcgttgtcatctttggtggaatcgatggtgcaggattggcctgcacatgctgcagctctctgcttcttccaccgcaccgctgcttggccacaaaaagacacgtcctctttattcgagtatgtacatgtactactacccggtagcgtagcgtccgctttgccttttgcaggcagtgcgactgttcatcgcccgtacacgtcgccggagttggggaagacgacgatgacgccggcggcggcggcacccgaatctgacccggatcgatcggatcgcggcgactccgtctcgagacgaatgggttggtgggttgggtcgcgaacgcatcggtcggagtcggggtcggggtgggggagaaaatatcgggtgcttgtgtgtccggttcccacgagacagcgggcgtggtggtggtggcttcttgttgctccgtttcgtctcgtacactttcactttactttctttttttgatgggcatgtctagtccttttcgacccttcctgtttacgtcacgacctcgcacagtccagcaagctccatacacagtatcccgtagaaaaaaagatggcgtggactacagtatatatactgtaccgaatacttagagcaagtttaataatatagtcaactactagctctaaattcatctataaccaatctaatagctcattcatacaatagttatatactacactattaataactggtctcacatgtcatacacacactgtgtcttagagtccgtactacagctagccagctgttcttctctctgttaatcttcttaaaatatgtttatagctgacttatagtctgctattgtacctgctcttagagcaagttttatagccaactactagctccaattcatctatatagctaatctaatactctctatgtcccaaaaaaaggacaaaccgtgagttcccgtgccaacgtttgactgtccgtcttatatgaaatttttttataattagtattttcattgttagatgataaaacatgattaatactttatgcgtgacttatctttttatttttttccataatttttttaaataagacggacagtcaaacgttggacacgaaaaccagggtttatcttttttttgacggagggagtagcttatttatataatagttatctatgagcatatactacaccgtttcttataatctagaataaaaaatgcattgtttgggtagtttccgattcgacgagaaactaaaaactccctcaaacggaccctatatgtttgtctgacaaagcagttcgtgttgctttatactccgtattatactcgtaatcgtgatgacaaatttgacgtagtaggataaaagaagaagacgattttctgggaaatgatcagatcaatttgacgaagatattactatatgctgccaaaaattttctgggaaaataatactactagttgccgcttcatgtccgacaaactaggagaagaaaaagaggcggagagagcctagtatagcagtacagctgtagtccacacacgcgagtagagccaatccagcagcatggacccccttccttactcaaagcgagggttggactagcctcgacgttatccatccatccattgccatccacacaaacacagccgcatggatcgccttcctccgcacgtcgccgccacgtgacacgaatcatcaccaacgctccagtcacgtagtacggcctagcagcatgcgctgttttggtttggagtgtgtttaattagttcacactaaaattataagtttaattaaaattaaaattaaaagtttatgtgtgtagaaaaaaatttaatataataaaaaaagttgaaagtttaaagaaaaagttagaaactagatcaggccttgctttggtttccaccgcaaaaacaacgagaggttttgatttgcgggacaaatatcacgggcgttccaacgcgtcgatcgtcactgtacatggaaatcgacgtgtggctgcgttcgttctggggtagggagtttgtttgtttccttgtctgcgcacgcgcttcccaaagtattaaacggtgtactttttacaaaaagtttctatagaaaaattgctttaaaaaatcatattaatctatttttaaagtttaaaatagctaatacttaattaacaatgcgctaatggctcacctcgttttgcatatgttcctaatcttctctatctccttctcctcgaacacaaccctactcgctctttactgtatgtgtgtgagctcgatttaggccatctccatcccaattttgctggcgattatggattgttcagaatgttcagtccaattatttgttcggaatgttcagtttgttgttatgcgtggcaaagctagcagcaggacgtacggcactagtggcaggtggtgagagccttgcgacacaaaagttgcaagggagtagtaataaacacagctaatctatgtttattatgcacaaggtacggacccgaccgaaaattggctttatggatgatgaagcaacttgatcaacttgaagaaatatctttccccaatttgcgtaactgcggctacaaatatcttcttcctccgcgcatgcatagctgtaactgtaactgggctgatttttcgataatatttctcctctcgcatgcttgtgtttagatctgactccaactcagtcgtcaactaatttgctcgagttaattagagattaacgtatagcggtggaaatgtacagctctggatccaaatcgatcagcgcctaaactacgactccgcaaaacgcaatggcaggtcggaactgctacgcccatctttcttccacagtatattcattgctatttttcacaaaactagctgggtggcccgcgcaattgcgcggctagcacccatataaaattatatattttttaatatgattttacttaaaaattattaaatagttatctcgttgtcttaagattttgaaagaccaaaacttatcattcccgtgtttctaattttatagtttttaaaagtcacatcagtggctaccccttacttctatcatattattctttattagcttgctcgatctatcaccgtttctattcattcttagaaacctttaaaaattagatgttaagacttatagtttttagagtttattgtcctgttgggctttttttgtataatttccagaaatcctgtcaaatgttgtcattatactcctctacgaccgtccactgcatcttctctttattgtcattgctattttaaaaatcgaacataattatcgtttaggatcatttttctaccttctagaagttttgccaaaacgttagcgactttgtcattgtactcctctacgactccctgttgccgctcttctttattgtcattgagattttaaaatcaaatatgattatcattagggtttatttttttactttttagaagcccgaaccattaaaaatttgaccttatagtttttagagtttattatcgcattgggttcatgttttttataatttttagaaatccctttaaacgctgccgtcctttacgacccgtccgccgcgtactctttagtatcattgggattgtaaaaatcgaatataactattattgaaatttatttttcaatttcgagaagacccaccaaccattggcggctctgttattgtactcctatacgacccgctcgttgcctctcatttttattctaattgagatttcaaaaatcaaatatgattatcattggggtttattttttttactttctagaagttcctgccaaccgccttgaccgattgcttcacaatctgtctgtcatcattccttttaatcgtcattaggattctatttggtgttttattaatagtttttagaagtctcatcaaccgccaccactctgctcctctatcggcatgttacttaattaatctcgtcatgtgttttagattgtcttttctttcaatagttttattttctttttcaccaatattagttatttataaattgtatttctagttgaaatcttatttttctttttctaatttcagaatttattttattttccgtattgtgttcttctgttttttttattttttattttcaatttcagttgtttcaaaattgtattcctactttaactctctttttaatttgcctaatttcggatttttattttattctttattctaaattttaatttatctactattgggttcttataagtactcttatttcgatattgcttatatttaattccgaatttcagttaattttaaattgtattcctactttgaactcttctattcttttttataattttgattttttttattttttattctgaattttaattaatctcgtagtggattcttgtatggactcttcttttaatattccttatttgtaattccaaattttagttatttttaaattatattcctacttgggatcttcttttttttttaattttggtttttattttatttttatttcgattttgattaatctcgtattgtgttcttatatggactcttcttttaatattgcttactccgtttgaatctttagaacatgtcaatatatttttgccaatcactttgcattgcttaatatatttatcatattttattcagtcatagatggacggggaattctgtaattagtaattagttttgtattctaattatctattcggctccaacacatactatatgcatgcaacgtgcatgtccgattcctcatcaatgaaaatattgtaattacttctcagtttcctattagaattgaataagttagagcagtagtttctattcatattcatattcttcaaattaatctacaccgttaaaatctagtcagtttgtgatctaacggtttaatatttttttgttttttctctgattaatgtaggaatttctagcccccatagcgaacgtggtgcctcctttcaaagctgttttaataatataatagatatatatatataaatacttatctttcagaacagaggttgtatttatcaccaaattgttatctttcgtagctctcaatcgatatgatctgctgattgcctcccgtgttaaccttttatctttatctaatatactatatgtgctttttaataatatattataccattgactttttaagattattcgttttattttagaaatttaaagtaaataattttttttgtcactatagaaactttaagcattacttataattttaaagcaggaagaacaatcaaaggatataataaaaatcaatgacaccatatattaaaaccggattgaatatctcatattcaactgatgaaaattcataaccgataaacacatgtatcaatagatacacaacttgcaaaatattgctttgcaaaaaaggacttgatggcggtagggggtaggcgtaaaatatctggtttggtttgggtggtaccaccatgtatgagggtgcgataatatattttcttgcggtagatacgcgcgggtccggccaaatcgatcgattttagcctcatctcctccccatcctgtggataaggcagaccgcacacacagcactcgtactcgtgtcgtatagtacatagtagtactacaagttgcatgcatgcacgtgacgtcgtacgtgcactgtacggcgaccgtattagtaactgccacagcacagcacagcacacacatgcaacaagtcaaaagtagagagatactgtcgaaactagatttcggcaataagaaaaggggtggctatcaagctggagaagtgaatgggtttggagacaaaggatttatataggttcaggccttcttattcaagaagtaataccctactcctgtccggggatgaatccgccgagtatcttattgattgtatgatttggggataatcaacacatgcccctagaggcacccggaccccccttatatatgggaaggagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacagtagcccccgagacctttgcagtcaaccatcatagccttctcaaagataataatccgaatgcttcaaacttttcatgccaaggcctgccgagtagtgaagacgaagactgtaaagggcgaaaagataaagaatatggtgcatcgaatagatgcacctaattaggtgtacctcccaactatgtgattagttaacaaactaaacatatagttgagaacaaaataatagcacaatcgtgcatcatatgacaaaagcatacacggcgcctaaagaggcattcttagccgactgctttttagccataattaaaaggaatccgagtggttaacactctaaaaggttcacgaatgaacacacttgacaggcatcagaatagaaaactctaaagattacccaccaaatattataaaaattatggtaatgaataagtctaatagcctaggctatgactatttaccataacgaaaacaggcatataacataccgaggaaatgactatggtaaaaacaagttatcccaagttaacccagacagcttttgtagcctaaaaaagcttacaaaaacagcataacacctttctgtcgggcaccttttaatttgcattgtaataattccaaagaattatatgaccgcgtaaaaaggattttatcagcattgggcaacactattgtgcgcataaattgccaaagcaaaaaatgcctaagtccctaaggagcacaatgggccacgctgttaaaagtactgggctgaggtactgttcaggcctaaacccattcgtacctccgatacccttaacaagaaatcccgagatccaagcgacacttcatcttccccgccggaactctcgccattttccccactccctgctacagtacagagctgcgccggcaaactagggttcaccattccactcgaatccaccttcgaaaagttcatcaaaatccttcccgtgatccaccgcctcaatccttcacctctccctagccatccctcgaatcaaatcagcgcattcgaaaaaaaaatcaatggcggaagagaaggaaagctttgaaggccaatgggcgccatccgacgtgacggaggagaacctgaaggagatggtggcgcacggcgttctccctgccaaggaaatcatcgggtggcggccagcgtgcggtgaggcttttccgacccccgatacacacgagactgtggtcttctcccatttcttctatggcggcttcgctcttccgacctcaaaatttttccgcgggatattaagcttctatggaatcagcttgcatcacctaaacccaaattccatagttcacatcgccaatttcatccatgtttgtgaagccttcttgggaattaagccccacttcgctctgtttcgccgaatcttctttctcaagccccaaccaaacaagagtaagccatgtgtagtcggaggggccggatttcagctgagggggactctgagccagaagtacttctctatgcccttcaagacctcaaacaaagggtggcacgcaaactggttttatattcagaatcctgagcctgctcttcccgagtactcttgtcttcctccggcgtaccaagatacctggaactctcttccgattggggatgaagcagcccaaaccttggagctgatgaatcgcatgctaaaactcaaagaacaaggcttacaaggagagcagattactcggcacttcatcaaatgccgattggcaccaattaaagaaagatcccgtatggcatttgagtttgacggtaagcatgatcctaatcgtgaagaaccagattctctggattttaaaatcatgaaggagagaatgtataaaatcttctcaaatgccattgtcgtcagctattcacatcagctgccagttgtgccatataacgcattcaatccgcctccgcaggtacgtatctgaaatcttcaacccatgaccaaaacataatcttgtcttcatgttgagttaactaaccgtggaggcatctcactcaggaatatgtattgatgaagtctgaccccccaatcactcagcgccggtctcctcgccagcacaccgttcagggaggtggagggccgacaatcagatcagatccgcaacctcaaacctccaatccgactgggcagacaggttctcgcaagagaaagctggtgcttaatgacgacgaaggcgacgacggcaacaaatctggggacaaaggctcgcccaataaactcccaaagcataccactcccaggaaaaaactggctagtcgtccaaggccaaagatcagaacatcttccaggtataaaactctcggtaccatttcacttcgacatgcttctctcatggaaataatactgaatattgaaagaacactttgcaggaaaccatccgacatagatccaactggaaaagatcctgatccgactgtgacagaaccaagttcatccaaggattctgagccgactgccgaaagccagccgactggcgcccatacttcaggtgataaggccaatccgagtgaccagcctccgactgaaaaccagtcggcagcaactgaaactacaacaacccaagagcccccgactggaaaccagtcggatgtaggtccagatcaagaaactcccgaagttgaagcgcagacgacaacttctcaaggaccagaggctggtaacgactcgttgattgggtctccagataaagaacaaggatcaccccacgctcagctaggaacatcctcaagtaactcatcttctcaagtgatgccgatttaaataacttcagcttattcgtctaatatcttggaaatacatcaggaccaccaggcgatgacgaagaagaaattcctcgcataaaggcggctgatgactctcgtcctcctatcttgctcaaatggtgggacgagaactcacaagctaccggcatcgtcataaatcgtcaaaaagaagatgaggaagtgtgccagctgaagaaggcacttggagaagccactcgcattgtgaatgtaaatcttccgggtgactgcctttgatgactttgttttctcttcagcaaaactaaaccatgaaccatcatgcagagaatccatcttcgcaatgaggccaagaccgcaactttagaaaagctagttcctcatttgggaactcttgaagcagttagggaccagctacatgaggccaaggagctcgccaaaaagacagagaaggaattaagggaccgaattgctcagctccaggattcaaacttcgagctgagtggttcatcaaaaggtaatctctagatctgtcccattaatttacgctgtcgtaactgtatcctcaaccatttggatttcaaacagcgcaagccgccaggatggctcaaatggagaaacaaattgaagccctggaaagagacaaggtagaactggctgcgcaaagggactcggccttgaaggaggttgaaggtactgccagctgacaatctgaacttctctctttttaatgcagtagatttttatcataaatgtgttttgtagaccgcaaaatcaaatctcaagctcaatttgacgtcctagttagtaagatcaagaggcttgaaggagcaagagatgaagtcgctaatgtcgctataccactcgtccaagctatgttcctcaataacagtggtccgagtgtactcgacgcaaccgaaatcttcgacaagctgagagttgctccggatgtatatttcaagaatatcaagaaagctggaagtatgggagctagcacggcattggcgatgaccaaatccttgtacccgaggattgaaattgacgccattgatggctttgcagacaggacaagcgtagaggctgctcttgatcttatcagcaatgctcaaaatgcggctgacaagattgcaagtgacgtcgtagatcaattccgcaacaccgatcttcagccgagtagtaataactctgatgatgaaaggactgattctgactgagcataaatgtagcaaatggaggcataacttgtacaatactggtgtatttatgctgtgcttgataattctagccaagtctttgatttcttaaaagcttttatcaagctttgttgagcctaaaacccaaagaagctattaaaaactttcagtcctcgcagactaagtagaaaaaatcaaacaaggcaatgataaaccaaggaagcaaattgaattgataaaaaatcacactccgttattatgatgatagcccccgactgacaacttcaagaagaaaacttgatgttgacagtcaagatagggaagtacagtgataagcttaagcgtagaaacgacgaagatgttcgatgttccaagagttgtcgacgagtgtaccgtcttcgcgcttgagtcgataggaacctggccgggtgactgcagagatgataaatggcccttcccatagaggagataacttgtgccgatctcgtgtagtttgaattttcctcaaaacgaggtcgccgactagaaaggcacgggatcgaacattgcgattatgataacgtcgcaacccttgtaagtatcgagccgactgaatcaaagctgcttcgcggacttcttccagtcggtgcaagtcatccactcggtcctcctcgtagcgttcttcgcggaaattacgaaagcgcaaagactcgaattcgacttcactcggcaacattgcttctgccccatagacaaggaaaaaaggtgactggcctgtggcccgactgggtgtagtacgcaaagaccaaagtactgatggtagctgttccacccatttgccggcatagggttttagccggtcaaaaactcgcgctttaatcccttgaagtattatgccattggctcgctccacctgtccattgctcatgggatgtgccactgaggcatagcaaatcttaattccaaagtcttcacaaaagtctttaaaaactccgccagtgaattgtctgccattatcagtgatgatccgattgggcactccaaatctatgcacaatgttgatgaagaagtctcgagcgttatctgctgtgattgtgacaaccggtttagcttcaatccacttggagaatttgtcaatggccacaaagaggtgcgtgtaaccgccgactgcctttttaaacgggccaaccatgtcgagcccccaaaccgcaaacggccaagacagtgggatggtctgcaactcttgagctggtagatgaatttgtctggcaaaaaactggcaaccttcgcacgtgcgcacaattttgtcggcgtcggacactgcagtaggccaaaaaaaaccctgccggtaagctttgccgacaatggtgcgtgcggcagcatggtttccgcatatcccagaatgtatgtctttcagcaattgtctcccttcctctaaagatacgcagcgttgcagaatccctgaaaggcttttcttgtacagctcagcttcatgcataatataaagtttgcttcgtcttgaaatccgctcggcttcatctttgtcttgggggagttcttgagaagtcaagaatcgtatgaggggctctcgccagtcgacttcaaccatagctacgtcatgagtgcccgcaacttgagtagtatctttgtgaggtactgtcggcgtataaaggtgttcgacgaaaacatcggagggcgccacctcgcgcttggatccaaagttggcaagtctgtcggcggcttcattattgtgtcgaagaacgtgactgagctcgagtccatcgaacttgtcttccaatttgcgtacctcttgtcgatatgccatcatgttgtcgtcaaggcaggaccactccttcataacttggttgacgaccagctgtgaatcgcctcgaactattagacgctttatccctagggagatcgcaattcgcagtccatgaaggagcgcctcatactcggcgacgttgtgggacgccgaaaaatgtatccaaagcacatagcttaatctttctccagttggggaaattagaaccactcctgctccagtgcccgaaagtctttttgatccgtcgaaatgcatggtccagtgctccatcttctccgcaggggtatcctcctggcactcggtccattcggcgacaaaatcagctaacgcttgggacttgattgaaattcggggcttgaatgatatgtccaaagacatcaactccaaagcccacttagcaatccgtccgtttgcttcgcggttgtgcagtatatcaccgagtggaaatgatgtgaccaccgttaccgagtgaccttgaaagtagtgagatagcttcctggtagtaattagaacaccatataatagcttctgaacctgagggtacctcgttttggagtcggctaggacctcgctgacaaagtaaatcggtcactggactttctggacatggccttcttcctcacgctcaacgaccaagactgtgctcacaacctgggaggtggctgatacatacagcaacaacggctcctgcgggtgtgatgaggctaagaccggtggctcggtgaggagtttcttaaaatcttcgaaggccttctgtgcttcgggtccccattggaaatcatctgttttcttcagtagcttaaagaagggcatcccccgctcgccaagtcttgaaacaaatcggctgagcgccgccatgcatccagtcagcttctgaacatctttctgggtacttggcggtttcatgttgaggatagcagtaactttctccgggttggcttggatacccctatgagacaccataaaaccaagcagcttccctgacggtactccgaaggtgcacttttcagggtttaatttcatgctgaaagcgcggatgctcgcgaaggtttcttctagatccgagattaaatcatccttttgtttggtcttgacgactacatcatccacataggcttcaacgttgcggccgatctgcgttgagaagcatctctggatcatacgttgataagttactcctgcgttttttagtccgaacggcatggtgacatagcagtatgctccaaagggcgtgatgaatgaggtcttcaagcagtcggatctgatgataccccgagtagcaatccaaaaaactgagaagctcacagccggcggtcgagtcgattacctggtcaatgcgaggcaacccaaaaggatctttagggcaagacttgttgaggtcaatataatcaacacacatgcgccattgccccgttttcttccgaactagaaccgggtttgccagccagtcgggatgatggacttctttgatgaagcctgccgctaacagcttggttaattcctccttgatcgcgtccttcctgtcttgtgcgaatcggcggagtcgttgtttgataggcttggcatcttctttgacatgcaaggagtgctcaatcacctctctaggaataccgggcatatcagatggtttccacgcaaagatatctttattgttctgaagaaaggtgatgagcgcgctttcctatttacaatctaactcggcgcctattacagcagttttagtaggattagaaggatctaggggaatcttattagtcttggcttcgctttctccactttttgaagtcttggtagcgggcacttctccttcgcttgccgtggctgcagccagtcggatatcctcccgggcagacgccgtctcgcgggtttgggccatgtcgcaactctccttgtcgcatgtgacggcttgcttgatgtcgctccgtagggataggactcctcggggaccaggcatcttcatcatcatgtaagtgtagtgcgggacggccatgaacttggctaacgccgggcgtccgagtatggcatggtatgctgtctcgaaatcggcgacttcaaagctgatattctctgtgcggaagttttcccgagtgccaaaagtgaccgggagggtgatctggccgagtggagttgcggataatcccggaattactccgtgaaaaggcgcattgcttggttttagctcggagcgaggaatctgcatatcatccaaggtcttggcgaagaggatattgagtgcactgccaccgtcgatgagggttctgcgaagcttgacattacggaccactgggtctagtaccagggggtaccgccccgggtggaccactcggtcaggatgatccgagcggtcaaacttgattgcaatctctgaccatcgaagatattggggcgtgtcgggctgaacagcattgatctcccgttcggtcaacttttgcttccttttagactcataagctagggggccgccgaagatatggttgagctctttgcggtggtcttgaaatcctaccggggtgtcgccgtcgtccttcttcctcgacgtgctttgttcatcgtcggagttcttccgtgtagtcttggtgtattgctccgcgaattgcttgtagacgaaacaatctttggccacgtggttggagttaggatggtgcgggcattgggaattcatgatcttgtcgaacgtgttgacgcgcgaacgctgtcgagaagagtgaatggcggttgcaacaagttcctcaggcttacgcttgcggtccttatgattgttacttccacctcctcccgtagccggcgtatccttttttggcttccaactgggacccgactgctttgatacggtgacggcgtcttcggctttggcgtactcgttggctttttcaaacataagtttgactgtcctgggaggtttacgcccgaacttgccgaccaattcttcgtggcgaatccctttggtgaatgcggcgatgataacgtcgtcggtgatgtcggagatcttgttacgttgttcagaaaatcgccggatgtaatctcgaagggattctccggacttctgaacaacgttgtagaggtcgaattgtgtgccgggacgctcgaaggtgccttgtaagttggcgatgaagtggtcgcgtaattcggcccaagatccaatcgtaccacggagcaatccatggagccaagatcgggtggaatccgctaaagttactggtaaatagttcgccatggccttgctatctcctcctgctgcgcggatcgcgagaccgtagacggtaagccatgattctgggttggtggtgccgtcgtacttctctattccagtcggcttgaagccggctggccaatccactcgacgcaggtcgtcggtgaaggctgctactccatcaaggtcgtcgtcgtggcggtccgacgaatgatgatggcctcgagctgctcggcgctgtatgattgtgtcgcgaagatcgacggggcggcgacgaggtggtgagcgaggccgttccactcggcgctccctatgatggtcgggaggcgagtgaacggaccgctcgtcgtgacccctgctcctgcgattggatcctgcgccagtgatgctgaggcttggataacggtagtcatgagatcggaagtgggggagtcggctgccagtcggcgtgcggacgctttcggagttaactgggaccgaagccgcaatcatggtctttgtctggttcaagttgttgacgacgtgatcagattgattgagctcgttttccttgaggagggtgtcgaggagggtgatcgcggcaaccgcgttctgttgaggggtgcggaaaatcggtgtcccttcaacatcttgttggccgatgaaatcacgtgctcggcggcctgcttccaaggctcgctgccgtcggtcctcagcctccttcgcggttcgctcacgctcctgctgctcacgccgtagccgttcttgttcttgtgcttgacgctcctcctccagtcggcgacgctcagtctcgcgacgtgcttcggtttcccgggcttggcgttgctcctccgtctcgttatcggccatgaagacgccgaagtagagaggggtgtggttgtcatctaggcttccgtcgaagtcgtcgagatccgcgtcgttgtagcgagaactaaactcgtcgtactctacgatgtcggtgggacgcgagtcgacggtgggagagctgtagtagccatccagctgatccgtcgaaaccgtgccgagtggttggaggataacgccgacttccctgaagctaggcgaaatcggtgttgaagccgacttccgtctaggcctacgggatggagacgctgtcgtgatggagacggccgccaaatcgtcggggagcttcatcaggatcggtgggtaagcctcatcatcttgatctggtgacattggagaagatgcgatcccgcccgagtggtttgaagccaactcgattgagacggtcttgaagtaactttcagccgcgtttgggagtccaaacgggactgaaatccggttctctcccgactggtctgactccgagtcaaggagagagatcttgccgaagttgttggtgacgaagtcgaggctgccgaaccgaaacgtctgcccgggtgggaagacgaggtcgtcgatgccggagacagaacccattgcactgatcggcgaaaagcttgacggacccctacctggcgcgccaactgtcgaaactagatttcggcaataataaaagggggtggctatcaagctggagaagtgaatgggtttggagacaaaggatttatacaggttcaggccttcttattcaagaagtaataccctactcctgtccggggatgaatccgccgagtatcttattgattgtatgatttggggataatcaacacatgcccctagaggcacccggaccccccttatatatgggaaagagtccgtgttacaaaagataatctatatccctaacggaatatgcagatacagataaaatacagtcgtaaccgactaagtctcaaggtatttccttgatgtacaagttgagaaacaaacccgagatacaaataagatattctatctatattcggtatcctatattcagtccaaatatcatcgccgtgtagatatgggatatccataatctccacagataccttttccttttttgcgtacatcgatcaaatctacgctagcttctgctgctgtacccgtaggtatatacccgtaaaatctgtattacgtattatagtacggtttatgtacacatgaatgaccaggtggtggtgatagaaagaaaaaaagagtagaaattttatcgggtggcgaatacaacggggagagatgggagggggtgtacataccagcggcgccgcggcggcgtgagtgcgctcgcgatcgcggcgtggcgagtggcgatagatatcgcgcgcggccgaagcggtgtgccgctccaacggcatggataagaggaagggatactgggatagcgtgtgaccgtaacgtatgtacgtctgtggcatggccaactttttttcaggtttcattccgttccgtggtctcgttctgtatacttcctggtttgtgggtgattactgtggcccaaagagattagtgactaataaactgatgaagcaatcagtagtccaaattaccaatttaggccctgtttagttcacaccaaacttctccccaactctcaactttccatcgcatcagatcacatccaaaactttcctacacacataaactttcaaaaaaaatttcaaactactaagaccttattcgttttgaaggattcctaaaggaaatctcaattcctttggaataagcactattcatgcattcggtttgtaaaattcaaagaaaaatttttcataggaacactatgccaatccttcaaaatgtactaattccataggaatgaaaatatccaatctatccacttttgtttagctcggtggaggaaaaattcatgtgttccaatcttttgttttgcatgtgcattcctacattattcctacgtttttcctattcctgtgatttgaaaatcctgtgaaccgaataagctcttgactttccccaaacttttttccaattctaggaaagccttaatagagagagtaactatttttcacaatccgaagaaagctatagggacaaatttctgtccggatcgaagttttcatttcagcaaacgcgtgaatccaaccaaaacagacacgctggttcccttgttttgctgaccctccctatctagctcatctatcaaatcaaatgccctttcgctgtaggagtactgcacacctgaaactgcacccaaagaaccatgatctcctcctgcttgtacttgagctccaggaggaactgctgaccgcaaacttctcaacttgtgtaccggcagcagtagcagatcgacgattctctgggattctgagcactagctactttcgacaagtaatccatatgttgccaaacactcacgtgcccctatggcaagaaagcgatatatgagtatacggttaacaacaagtgtaatactcactagcgccaaatatctagagacggagcgcggagatatttaaagctaaaaaaaaaagagagattgtatttttatctacgtactcgtagtattatggtatatgttctcatatagtcatcgtaaaaaaagaaaaagaaaaaaatgtactagactattactagtcgtttgcccactgctcattataagacgcagcacttattagaaaaaaaacaatttgtatgcaaaactttaatatatgcgttttactgaattaaaagcctacagtgaaaaataaactataataagaaacataaaatataattttaaaactgaactttcgatttttttttttgttgcgtctgctaagcgcgaaagattatggggctgacaaactctctcttaagcaacggaaccacctctaatcgggcggcctggcggctccatttgcccatgttgctattatgatattatattggccatacgtgtgaaaaattattgatctgcctagcaaatgctcttcgtcgtccgggcttaacaatatcagcggatctgctatattgactctctttaatcatatttaatgtttagaaaaaatgatttagtcaaatctta

SEQ ID NO: 66990 - DNA, 10008 bp, Oryza sativa
cactagcgtcgactatgtcttgatgatctgcatacaaaacaaatgatcggaccctaggtacaagagcgaccatactattagtgtctgcatcacacttaaccctcctcaacccatcatttaattgtttgccaggaagcaaccagtaaattttggtgttatcagatttctcatatcctagttcttcaatgaaatcatcaacccacaacagtgaccaagaatctgactcacaatggtcaaaccagcttactctaccatcaacataagcccggtttacactatctcctgatttatctccttttgttgctaactcaattggcagtaggctatcgtgaaactgatctctagcatgggcatcatcgtgggctacaacacaaaagaagattcggaggaatcggaagatgtatgaggggttatttacaaatatgtgtagccaactcacgcccccataacgtgtgtatgcgccaatgtggcatcctaatcacgagccaactcaataagattggtgatgaagtcatgtcttggccttggttcgcacgcactacgcaagtttgtgtaccgaaacgagagtttttcaagtttttacactaaattgcacccaccttacaagtttgtgtaccgcgggcgcaatttactcaaatattaactaaagtccctttttctaatcatggctttcatgagccttaaacccaagtttttacagacaagtgacaggtcgatgaatcaggtcactgtaagagcctgtcaatacattgtgcagagcgtgcagcatcagtgcaccttcagccgtggcttatttctatgggacactatgtcaaaattttgtcgaaatgctgtcgtaattttattcaaattttggtcaaattttgtatctgcctagtatttgtgatttttatttgttaaaatataaaaacatcacaagagatgctcacatttgaattatttataacactcacaaagctgaaaaaatgggggcaaaatcacacaaagctgaaaaaatgagggcaaaactacaataaccaacaagggtatatatgtcattttctctataactaacaccgttagttgtggctgttacaaatgggggtccatggctgcttcaaattcaaaaagtggggtaaaacaaagtgggggtatggatgcaattgccccgaaaatttaacacgaggtagaacgtcatgaaaaaaaatcctttggatctttatatctccttgaatttctgcgtttttcccatggcttaatcaaacggtcattcatatgtttttcttatgtttttcttgtattttgcaattctttattttacacttgcattcctatcataatcatatgttttttctaattgtccgtttttgttcatctatgtgattcaaggaggcccttaaattaatccaacaagcagtatgctactccctccatttctaaatattcgacgttgttgacttttttaaatatgtttgaccgttggtcttattcaaaaattttaagtaattattaattcttttcctatcatttgattcatggttaaatatatttatatgtatacatatagttttatatatttcgcaaaagttattgaataagacgaacggtaaaatatgtgctaaaaagtcaacggtgccaaatatttaaaaacggagagactagtatcggctgtgtttagttccaaccaaagtttggaatttggttgaaattgaagacgatgtgactgaaaagttatgtgtgtatgaaaggtttgatgtgatagaaagttagaagtttggaaaaaaactttggaactaaacacacccatggatcaggatcagtatagagacagatacatgcaatcgatccaacactcccctgtacgaggacaaagcttaggtgcaacaggttacttcccgcggtggccaaattcacacgagcagacagaaaaaccgccacgtacgcttgccaagtcacgggacgatgcttacctccacgctcatcgtcacccaccgtgaatgccttgctgctcgatctctgcacctgcgtttgctgccgccgacaagcaagccacggccacgagcagccatggattcctcctcgatcgcatcggtgaccatgtcctcacgccattgcaagcactctgcactgcaacaacctataaagactcagccgccattgacgccaccgttgcaatctccatgaccagcagcagatcaagaaaatggcggcggcgacggcgagagcgagacggcctcatgtcctctgctttctcctcctcgtgatggtcatgccatgcgcgatctcggccgctgatctggcgtcggacggccgtgggaggttgtatcaggtggccatggaccaggccgcgcgcgccctcgccgaggcccgggcggcgcgccgggacgacccgcgcgacggcgtggcgcggcggggcgccgcccaggcttgggccgactgcgaccagctcgtggcgttcgccgtcgggcacctgaaccggacggtcgccgcggcggcgaggggggttgacggcgacgacgtggcggcgtggctcagcgccgcgcgcacaaccgtgggcacgtgcctcgacgggttcggcgagctcggcgcgtcccccgggccggagttcgccgccgcgctggcgaacgtgtcgaggctggtgaccgacgcgctcgcggccaccgcgctccggcgcgggacggagaatggcgcgcgcgctgcaacaaactcaggcgatggcgacggccggatgctcccgctcgacatggcgaggccgggagacgccgacgtggtcgtggcgaaggacgggacgggccatttctgcaccgtcggcgaggctctcaaggcggcggcgaggcgggcgacgaacggtggcgggaggaccgtggtgtacgtcaaggcgggcgtgtacaacgagaacgtcgaggtgtggaccaccaacttgatgctcgtcggcgacggcattggccggacggtgatcaccggaagccgcagcgtccggggaggctacaccaccttcagctccgccacattcggtacgccacgttcatctctctctctccttgcgagctgtgagtgtgagtgtgtgacactgacatggatggatgtccatgaagccgtgaacgccgacggcttcgtggcgtgcggcgtcacgttcaggaacgcggcgggcgccgggtccgggcaggcggtggcgctccgcgccagcggcgaccgcgtcgcgttctaccggtgcagtttcgagggacaccaggacacgctgtacgcgcacacgctccgccagttctaccgcgagtgcgccgtcgccggcaccgtcgacttcgtgttcggcaacgcggcggcggtgctccagcgctgcagcatccgcgtccgccgcccgccgctcccggggcagcccgccgtggtcaccgcgcagggccgcgtcgaccggtacgagcgcaccgggttcgccatccacggcggccgcgtcaccgccgcggccaggttcggcgcccccggcgcggcggcgtcggcgccgttcgaggcgtacctggggcggccatggaaggagttctcccgggtggtgtacatggaggcgtacatggacgccacggtgggcgcggcggggtggctggcgtgggacggcacggcgttcgcgcagagcacggcgttctacggcgagtaccggaactccggccccgggtccggcacggaggggagggtgaggtggggtgggtaccatgtcatcaccgatcccggcgtcgcggcggagttcaccgccggcgagatggtgaacgccggcgagtggctgggctccaccggtgtccctttcactcctggactctagctctgtatgtatattggcattttgtgctagggactggtgattttgtgtatacagggactagattgaggtccccatcatttgtaaaatcagccgcggataaaatttaaattttaaatttaaagttgattttttatagaagtttattttccagcattgacttttaaatcactaataactaataacgtatatataaaagtttaatttataagttatactgttatttactaatataccgtatactatgtattatcccatttatccgtatatgtccaactgatgaggaactaaaactactgacggtatcctatcttattataaagttataacccactaactctaacactcaacatgcaaatatgccatctcatcatccactaacaataattacatgcaaaactaatacaaacatgcaacatcatctataattcattgaatttacaagtcaacatctaatcatcctccttcacattatttttcagaatatttttaacatgtatatatccaacatttttataatccttaacatatattcatgcatataatcaaagtgcgggatatcatgtatatttcatttacaatctcatacagagtctattaaatgtatttatcttagaacatagtttgacaaactatttttatttgttgttagtaactaatataatttttatttttatctcgattattaaaaaaatttaaaagtcacttaggaatttccgtagaaaagcgcggggaatcacctagttatctcatagctgttccaaagattgaaagtatattgtaagatacacgacgctagcaaaaatagcggcccagaacatggaccggcttgtaaacatactggaccaatatgcaaaggaaaaagttcacctgccatcccttacaccgagtttgttagacatcccttatcctcaatatcagaaaccggcgatggtcggcgctgctccaggtattatccgggacacgatggagcgacatggacggtggcggcggccggagatggcgccgctgcaaacccacgccgccgacacgagccacagcgacagcgacaggagaagaagaacggcgtgccggcgctggggcaggaggagcaggaggcgtgcacaccgcgtgtgccaactccctcttcgctgcaggagctcaccaacgacgccttcagcggcgacgaaagaaaaaggaataagaggatgagaaaaataacaagagagtatgggagattgacaagtggacccatgggcaaacttgtctttaaccaatatttctctctccgttttatagaaaataataaattaatcccgcgggtgtccagcaactaattaccacatttttacagtgtccacgagtagatttactttatttaggtgtctcacaacaaaggtcacaaattttgagttttctatagcaaattttgcctaaactttatagtatttgctctaagtacggtccaaatcctgtagttctacagtatttgtaaagaaattcaaatgcaaggaagaaaacagttaaacagttgaaggttgtatttgcaatttttgtagatgaaaggggaaacgctagtctgtgtgacacgtcactctcgttccggctcggccagtcgccgacggccaacctcgcctcccagtcgctcaccgccgctcgcttcccggcggctcaggcgggcgcggcgatttcgctttactccatataacgccgctgcgggccggcggccgcgggcgtcggccatgtccccgcatggggctatgggcgtagcggcggctgggacgccgctgaaggcggaggagatggccggcgggtgtactggatggatctccgtcggcccgtcggcgacaggatggaacggcgaggtgaggtccaaccgcccaaattttctcttctttttttactttgtcttcaaatctatattgagagcacttactgtttctgcgatttgcattcagtgtccatcttggagctacccttagaaattttgggataagttgcttgattcatgaggttatgcgatttacaagagcatataatgcagttgttttctgttgtgcatctgcatcctagtctaaattaatataattgacatggtttgcctttttcttttttgaaagaaaaagaaggataatagaattcagaatagacatttgtgtgcactgtgcagaatttggcagcaaattgttcagctggaatcaattattgcaaatgggggtcattcagccgcaaagccgacttgtttgaatggccagatgcagcgaaagtctctgacagagacaaagaacatgcaagcaatgaagtccaccgagaaccaaggactgtagtagaagtagcaaagtctctgaagaagaaaatgttagaacttagtccatgaatcacggaagacaagttgagtttgctaaccgagcatcagatgattggcacgcctataaatcagagaatacggtgcagtagcatacagtctgtcagagctttgctactagatgacttcaaaatcaggctgccgatctgtaagcatttccttgtttagttcattcctttccattgttcagaattgagatatcttttcattaaagaagataagtattgaaaactataaacttataaagatggcactaagccaagaatccagtttagaattggttccctgacagtggcttgtcactctagtatatatttgatcagaaaccgcttgtgttttggaattgattagaccaggaaaatagctgctaattctatgcgttgtctgataaatgatccatctgtgctaaaactgtagggatcagaagcgaacttgaagtgaactgagtggcagctacatcagtccagattcaagacagagttccattccttctgtctggccacatgatccagatctacatttgaacatagctagtcaataatgatggttattacaactggaaagattatcttgattttcttagcttgcactgcacatgtcgtcacctgcagttccttatatggaaacgagacagatcgagtggcactgcttgaattcaagcaggcagtctgtcttgatccaaaacaaaccttgatgtcctggaatgacagcatccacttttgcaattgggaaggcatcttgtgcagcttgaggattccatatcgtgtcacttctcttaatcttacaaatcgaggtttagtagggcaaatctctccttcacttggaaacctcacatttctatcaattctatcccttacagagaattcattcagtggacaaatccctgcatcccttggccacttgaaccacctccaaactctctggttgagtaacaacactctgcaaggagttataccagattttacaaattgttccagtatgaaggctctacggctgaatggcaataatctagttggaaaatttccgcagctgcctcatcgccttcaaagtctgcaactttcatacaatcatcttagtggaaccattcctgcttctcttgctaatatcacaaggctaaatgtgcttacctgcacatataataacatccagggcgatatcccacatgagatcggaaagttatccagcctgcaattcttgtatgtaggtgcaaataagttggttggcaggtttccacaagccatcttaaacctttctactcttattggtcttagccttgggtttaataatctaactggagaggcaccatccaatcttggtaattgtctacccaaccttcagctacttgaattagaagacaactgctttcaagggcaaatcccctcttcgttgataaatgcttccaagctatatcgtcttgagctagcaagcaataacttcaccggtgtggtgcctagatccattggcaaactaaccaagctatcttggttaaatcttcagtccaataaacttcaagctcgtaacaagcaagattgggagtttcttgacagcttagccaactgcactgagctgaaagctttctcgatagctagtaatcatctagaaggacatgtgccaacttcattaggtaacctttctgttcagcttgtacaattgtttttgagtggaaatcaattatcaggtggttttccttctggcatagcaaaccttccaaacctgatttatattggactggacaacaaccagtttactggtgcagtcccaaaatggcttggaactctcagtaatttacaacagatattgttacatgagaacatgtttactgggtttattccaacatccctttcaaatttatctgtactgggatctctctggctagactataacaaaattggaggacctttaccagcaagcttgggaaacctgcaaacgcttgaaacattgagcatttcaaacaacaaactccatggtagtgtaccaatggagatcttcagaatcccaacaatacggttaattgatttgtctttcaacaactttgatgggcagcttagtgccagggtaggaaatgctaagcaactcatgtatttatatctttcatccaacaatttatctggagatattcctagttcactgggcaattgtgaaagtttggaaggcatcaaattgggctcgaatattcttagtggaagcattcctacttcattaggcaacataagaagtctgaaagttctcaacttgtctcacaataacttaagtggatcaatacatgctaatcttggaaagttatggctccttgaacaagtagatttgtcatttaacaatctcagcggtgagataccaacagaaggaatattcttgaatgcaactgcagtgcacatcaatggaaatgagggtctttgtggcggggcactcaatttacacctacccacatgttatgtcatgcctttgaattcatctaggagtgaacgatctattttgctgtatttggtgatattatttgctagcctggtgtcagttatattcatatatctattattgctctggaggggaaaacagaagaaaaaatgtacatctttgaccccatttgatagcaaatttcccaaagtttcttacaatgatctcgccaaggcaactgaagggttttcagcatctaatataattggaagaggaatatacagtcatgtttacaaaggggaattgttccaaggcagagatgtggttgctgttaaagttttcagcctggagacagaaggagcagaacatagttttatcacggaatgcaatgctttgagaaaagtgcggcatcgcaatctagttcctatcttaactgtgtgctcaagtctggatactaagggaaatgatttcagagccctggtgtataagttaattccacaaggagacttgtattctctactgcactcaactagagatagtgagaatggtttcacttcgaacatcattacattttctcaaaggctaagcattgttgtggacatagcagatgcattggaatatcttcaccatacaaccaagaaactgttgttcattgtgacatatagcctagcaatattcttctggacaatgatatgaaagcttatgttggagatttcggtcttgcgaggctcaaagctgatgctgcagtaccatctgtcggtgactcaaactcaacttctatgattgcaataaaaggaaccattggatatgttgctcctggtattatttcctgtttttcaatttaacttgagaattttttgtgcttctaccaacatttggactaagttatccttgattgatgtctacagagtatgcatctggtggtcaagtttcaactgctgcggatgtttatagctttggaattgttctccttgaagtattcttacggaagggaccgacagatgatatgttcaaggatggtctggatattgcaaaattcgttagtatgaactttcctgacaagatactagatattgttgaccctgtattactacaagacgaactggattgctcaaaggaatctccagttgccatgaaggaaatcttttctgagggtttacattcagtgctaaacattggactttgctgcaccaagcagtccccgtacgagcgcatggacatgcgagaagtggctgcaaagctacatggaacaaggaggcatatctctgaggcaactaggtaatataatgtaagatatgtaccctgcctatagctgtgagatactctgctaccttctcgcatggcatgtttaatattgtcactctctcttatataatgaaatcacaactcttgttattgctgtaataatccgagcactacatttggtttggaatcttacacaattacactgcagatacatggtattgttggaaactctgcactgttatcatat

SEQ ID NO: 66991 - DNA, 13893 bp, Oryza sativa
tgattcctagcgtagttttgcttgactactgcttgtgaaattgctgttgtggaaaggggttcgatgattgaaaaatctgtagctgatggaatcagctaggcccgggtggccgtttgaaagttgttggcccgggtggccgtttgaaaagctgttggccgggtgccaaccttgattcaaatctaaagactgatacattgcacatactccgaccggacgagacgcactgtctcatccgtgtcgtttgagaagcactcacttagttgatttcagaaaagagttcaaatgaaatcaattgcaaaaacaacagcctttccttgaagcctgcaataaacacctatttcccatggcatgctgagtactcctgtactcacccttgctctatataaataattcccccccagttgctgaagaagatgaagcagatcccgctgacgaggagttcttccaggagtaagccggctacgatgagttttagggtttcggcctagttcccaagtcgcgcctgtgttgtttggtccaagtcctggcttccgtttcccttttgtaatgcagttgtgagctcgggatctgtccgcagcccaacatgactgtacctctactctataataaagagacctctgttgctgtgataatctgtcttcctgtgataccagcactatttcctgggactgatatcgatttacaggttaatttggagcgtcacgggctagttccggtcggtactatgttgtttatatatctataactaactattttatggatgggttattatattgcctatggatgatatgtatgaacttttgaagttagccgttggctatattattaaacttactctaagtatttctaggtttttcttagcaaaattaagttagtgggaaaatattcccttttactagttaccttagtggtcaaattttgaattgtttgtatttttttctcaagcatttgattggctaaaaatgtactatagattttcatgcattaaaatcaatgctatagaaaatactactatatatctgaatatacaaattttgaattctattccataaatggttagagcaggttcaatagcagactataagccagctataaacgtattttaaagtgataaaagaggagaaataagagcagtatgctacagatttatagccagctgtaacacgtactccaagatatgtgtgtatgacaggtgagactaaacattaattatgtagtatatgtttataggtaattattatatcaattggttattaaattgactatagataatttgaagtcagtagttggctatacgttagtataaagagagtactactagtacaaagttttaaaaggttcagagtaggaatacactcctcctagtatcaatcaataatgttgaggcctggtttaggccgagtttagttctaaaatttttttttcaaacttttaacttttctatcatatcaaaacttttctacacacacaaacttccaacttttccatcacatcgttccaattttaaccaaactttcaattttgacgtgaactaaacacacccttagttcccaactttttattcaaacttccaacttttctatcacatcaaaactttcctacacataaaatttcacctttttcatcatatcgttccaatttcaaccaaacttctaattattttagcgtgaactaaacacaccctcctaagtagagaaccgtatttatgtaccctcctcaagtagtatgcatcagctcaagctgcacgaacactgaccagtccgtttttttttactgtcagtacacaggacatcccgatcccggggtacaaaaacagttgtccactgtcacccttgccccagccatcaatctgtgtctggacctgatcctagtacaaattttggtaccctaaacattattactgcattcaaccttgcaaaatactagtatgcccatactgtactggattgccattgtacacaaacaatgcaacaccctcggcctaaacctttgcaatctccaggcgatttgctgctattgcaatactagtactgcattgctgggccttgctgccgctgcatgtgtgaccctggttcactgcaccgggggacatgtatatgattatctagtacttgattgtagaaaagtgataaaaaattaaagaaatgatacaagcagtataatagaataaagttttttttgaaaaatattttttaaaagtgaaacaaataatctattttaataatctagtaaaataagctgaaaagaacatgaccttagggctctattggagccgaacaattttacgagaactttgtaggaaacaaactgttttctatgaaaattctgtaaaatttccgtgttccaaataagcccaaattttgtcacttacttatactgaaacttcactatactgcttatcacagttcaaaagtccctcctgattaacagcgatcaaactaactgctccatataatgtagtagtaaccttgaagcaggttactagacaagcaaaagcaactccaatttaatttgtccacaggaacacctttttactgaacaatgaggactgctgctatgtagtactcctacttgtctgacagagagacagaaaggaacagttggtaattaacctgtgttgacaacacaacgcaaaattgacgacggcaccacctttttgcactcctcaaacagtcgccgcattcaattaattaagataacattactacaattaattttggtaattaagctactattataataccaggttagctgtaagatgaagcttacaagatactaaaagaataactgattctcaaccaagacttcatgccaaactaaatacgcacttctctgaagacaaatactaccagatgatggcatcatcacaccaatctgaaaaactacctttgaagctacgtacaacaacaatggcttccaaagacaaaagagaaaggattaatcatgagattccaagctacagccacgagtacattcctatcaggtgtccctgacacacgatctaaatggattaattatgcaaagatgacaagacatcacatacataaaagctaacagaaaaaagataaaggtttcacttccattgcatgcaagccatgaaaagtaaatagacacctcaactcttttaatcctttttatttgtactatgaaaacgattgtgcaatagataaatttatatataattcattatcattatcaatccatcacacgctaaaaggactggaggcccctctaacggggacacaaaaacttttggaaaaagaaaggagaatggataaataaaggtggcatgcacctttggatggtgagcaccttaaaattgagggattaccggtttactcacgactatttgtcttgtccttctaacaatatcgaatatgttttgtcttttgttaatgaatgtatcggccaatctagttttgttttcatgcgatttatatttcaatttacctcttgctgagacaaagtgtgaaaaccagagagagatatactatatccggtcatattctattatattccctccgtctcattttaaccgcagttatgaatttctatgtccaacatttaaccgtctgttttattttaaaaaattaaaacctatatatcaagagaagctcaaaattgttaatgtgacttagtggttcccattgaatttggactctatatctacctgggtgaaaactcaacttatatataaatttgtttgcggtaataatttgtttgaaatttattatttttatatctcacaaataaagttgaggttagataatattttttataatattgtgtaacatcaacttatctatatgtgcgattctttttataatttaggtgaccttttagttaggatttccaacggatatttaccctattttacctttacatttacatgttatctcccctctctatctctctctctacttagaaatgcagaactacaaatctcgaaacatggccggttactaccggtatttgtgcttatttcgtttcatggaagcgagcatctgtcttgtgtcctatgcctcctgtctagcacatatatatgttgccctttgcaaaggaaagtttgtttaaattcttttctgctctcgagaaaggattcaaagtaaaatccaaagtaggttcccttctaggggtccatacgggacggaaacaaaatgatatgtatttttcattctcgaaaagagaaaactaaagaatttgagtttctactctagcattggatacccgtaggaacatgacaagttttgggtttgatgcatgttggagcattttgtagtattgtactcctagctactccctccgtcccataaaaaactaacttctggctacgaacctagacgtagtgtgtgtccagattcataaccagaagttgattttttctgggacggagggagtagctaagagcgctactatgtatcatttggctagtacaaatgtcaaagggttggctccacatttcatggcgaaattaaaacactatccctattatccgaaggtcatagtatttgtcgatgacatgggaccgggagtatcatgactagaggcttgggcaggagcaatcacccacgtggcctgaccccctcggggggtcgggcccgagggtgatgtgaccgcccctctctttgtctccccgagggatcggaccgctcccgtttcggccccgagggccgaggcgcgccccgaccccttgtgggttttgcgtcgcgtatgggttaggtgagcacagcggggctcacctaaccgcatttattgtggtttgaacgagcgcgtcacgccgcatgtaacgcagtgcagcgcgctcgtttatccggtctgtgaccggtcacagaccgatcagatcgcgggttaggtggcaacaggcggtctgacacacgcctcgccccatcccgtcaggatgagagcctccaggcactcgtccctagccggagccagcgtgctagctcctgaagatggcacgttggtcccggtcagatatatgccaggcttcatcccaaccattacaagcaagacattgtatgaagaaggacgaacatgcagattgataaactgacgcgtggtggacaagaatgaccgatttgtgaccggtctgaccctggtcatgtcgtcggcagacagccatgatcccacgttgcacctgcttccggcggagtagaggtaggtatgggccatcccatcagaaggtcattcggacggcaaccattgcaaatctccgcccattgatgaaggaagggcgggccaagttttagtaaaaagaggatgggtccccatcgaaaggagaaataggtagaagtggtgcatgtggtatccccttgagatataaaaggaggacctagcccacttaggagggggatcagaggttggagactcccggagaatccaggagaagatcccacgagaggcaaaaagaaggaagagggtttctagagtttgatccctcttgctctccagctctttgtagcttcttcatacacagatccaccataacacaggagtagggtattacgcttctcagcagcccgaacctgtatacatcgcccgtgtcttgtgcgtttccactttcgcgaacattccacagaccaggagcttagaacctcacccagggcccccggccgaaccggcaaagggggacctgcgcggtctcccggtgaggagccccacgctccgtcagtattattcgagataatctgatctatttatctatttatttttggtcttataaggcgttcatgtacatattatttcacccctcaaactttagtttgatttgtaagttacatcctattattactcccaaattgttatatgaaattaaagtaccttttgttcaacataattcgataactgtggacaatatccaaactcctctagaaaaagaagtacggtgcgatggtggtgaatttggcatgtcaccacataatccttccatatatattgttctttttaatcacagtttagaacaaaaatacaacttttattggaaaattgattctagtcacaagtcacaagggcatcaagcaactacatagacagatgccatcaatcacaacacccaattagtccatccatgtatcttctcaaatatgcaattgccccttatgtttttgtaccagcataacgtacaacagttcatatctcacttctgtagttctgttggagaaaaggtagcaaaaggtagatctattattggttaatcaatgcatcaattatagagtactaagatgttgcagtaaacttttttgggcaatcaagatgttgtaataatgaatcactacgtactgtactattctttttgtgtggtgagcaaggttaataaaagtagaggtgattgatatatctaattttatccacataatctctcattagtaattaggagacagcatacatagtatattacctctatcacactaatattattttattcatttgctcccaatctactagtaggtctcttgtgagaggtagcagctcatcctcacttctgtgagttctctcttcacctcataattcaaacttacataaacattcttatggctagcaattcaacgcgtattttacttgctctttaacccatataacactggcaaccctcctggaattaccactaatcccaactttaggctggcttatggaaatgtagcctcattatgagaaaaccaactacttgcgccgttaaattttgataaaaactacattgaatttatttttcttccaggagacgaatgattatgtcggcattagccatttattccgatttatgatagattcagctatcctgatgaaacatgatgtggctgataaagaaagaaagaagggaaaaaaaagaaaaaaaaagaaaaggagatcaacgaattattgttagttaaatctaagaaggaagatctaatgttgttttcagggattaaaaaagaggaaaaaatggtcaacacaccattaaagtgaccaaagaagaaatgctggcgagttgctacatagctttcagaacagatagaaataagtggcaacgcatcatttagtctagaggtgcaacaaggtaaagaaaaatgttgcacaaacacattttcctgagctaaattttgcagcagcaaactgagactgatgaatggagcaaaatcctatcataacttcttatcagccacatcatgcataaagtatttccaggctcgaagagatgaagataacaaaaaaaaggacattaattctttctcacattaataaagaatgattatactgcatatattaattctttctcacattagtaaagaatgatcatacattgttgtattcttcatatcatttcttgccttcttgggttctgtcagggaagaatccactagattcgtggtgaccagtaattcataatttcatatagcaattatgcataacatgcatttcactacatctgtgaaaaatctgcatgcaaaaacaaaaatggagcaataccatattttgttagttccacttccagcccagttcctcagttcctgagaaaacctgagactgtcagttgattgcttttaggtccttgactccatgtacgccgtactttatcgtcgatgtccatctgtctcttcactcttaatctgttgataagctaagaagttcaatcgtgctgtttatattttaaattagagccatgtgtggaaaatttatctcagacaatcacactttagagcgtctcaagtaaatcatcaccacaacccctgttagaacaactgcacctgccatcaggccataatgagcaggggtcaactgacttgtgtgtgaagatgtcaactctggaggttgctttgtcacttcagaagtgtgctttgtcacttcagaagcgtgctttgttacttcagaactgtgttttgtcacctcagaactggaatttgactcatcagtgtacaacctcaatgactgaaattgaaaatttcactccggtgaagcaatagtcataatccaatgaacaaaaaaagaacgcaatgtgaaaacagagggaccaatctatttgaggattacagaaaagacaaaccttcaatccagaagatttagcatggagcacagccccggtaagatcagtatccgtagtgagcaacaccctatcaccttcatcatcatcatactgtacggaacattatcaaaatttagcttgtaattgtggctgaggtgtgataattgagctgtaagtgaagtgcttgtaacagttaagggtgcattcacaatttcatgggataattagttaccagcgctactcaaaataagaccgctttatgccagtcaacttataaatttctataatacaggcaacactatatatagtctctatggtcaatataatgtctataagaaatcaggatactgagatacagatatggggtgacataagataaagataaattcttattcttgaagtggatggtggttaagtactttcttacatcagttagcattccatataaaacaacagaacttcttgaacgatgatcagactgacaacctttttttttttttttgcttccaaacactaacgaaatacataaaataagggacaacaaattaccaaaagttgaactgtgcccttttcgccatcaatgcctaatctttgcaccacagaagacaccagctcatgtaaactctctgaacctgcagagacggaacaaaccaaactgttagttagagcagtacaaccatagtttaacattcaaccaacttgtaacacctaccacatgcaaatctatgcatacgtcccttctggtcctcaatcttaaagacaaatgaattgccaacaacaggaggattaatgctactcctgccatctccagcctctgatggcatgagcaaagatatttcactgaacaatgcaaaaatgcaggtaagaattgcaaatttgaaaaagaggacaaaggacaaaaaaggaagcgttaattaacctgcgactatcaaattcctcatctgggggctccaaagcaagagctgagtcccaaaacttttgcattattgtgtttgccacaccattcgtggtctcaggacctccttcaaccttcacacagaatgatgttagatgaacggaaaccataaggaaaaagcaaggaatgagaagcgaaaaaatacgcatgtgcagagagaccattgaaatggctgcatgggtaatctgcagaacatccaagcaagcaacaactctcccttctgttcatttttaaaattaaaaagttcagtcagatataaaatactagtaccataaagagaaaccttaggctgaagaagagtcaagtgttacctccatcaacaacaggaatatgcaagaatttgccatcgcgcataatatgcagagcatcgagaattgatgtgtctaatgtagcacattcagggtgtgcagtcattaccttgagcaaaacagtgagtaatgctgttagtctagaatgaattgtataacccatcggtagtttaaatcatttaaaataatattcaatctggagaaacaaccttttctacatgagttaactcaggagagagattttgtgtcacaacgcgcataagcacatcctttgagctgaatttcacaatgacatagccattagtgccttaagaaatataaaataatataaactctagaataaagaattattccataaaagtattgaaatgcttacgtaaaaatcccttgcaatgaatttcctgcagtgataaccactgagttaacccgtaattcatgcatttttcgtgctgctacacaaacaggatcccatggtgaaacaattgctactctgcaagttaaaaaagaggtaactcccatgattcaaaccacattatgttggatgatccattttataccaccaagtttcattcagtgtctacaatatactactgatgtctcactgcccacatggccacatgtcatcctcacagtgagtggtctactatggatatgaataaaactcagtggcatggtgtggatttatcccaaaaatggaatactaataaaaatttcatgtactttgtgttctccgagataatggttgacaatgaaggtttaagcatcctttctcttagagtttctattacactggaatgatctgcaaatggtaaacacagtaatttggtcagctaaacaagaccagaaaacagtggttaagtgaaatctatttagaaaataatgtacaaatgtatacagtaaagcatcaaacatcaaacatagttccaatcctgagaatcatctcattattctttgggataaactgggtattacaaattgctcataacctagttcacatggctactgactgcagtatacattttctgttcttgtgtagcaatgaacatttagagtgaaacaaaggaaaataactagtcagcacaatatgcaacagaaaacctggcaagttgtctcccacttgacgctcaaccccttctacagcagctgctaatgcacttccctgttctgctgccttttccagtcttgatattgcatcatagaggcattttgcaatgtctagcatggcaataacctcaccattttccaccactgggaggtgcctaaattttcctaaaacgtgagtgtttcatattagctctaaggagaggaaaatgaacatacttggaatacggagagacagtatataaaacaattggaatgatgagcccatgttattaaaataagaaacaaactttctaacaatgaccattgatttcatagcatagctgttactgctttattaacaagtgaataatgctttcttaatatgcatacaggtcattgggattgtagaatgctgatgttcagaggttaaagatatgcagttgtcctatagtaaattaaatttagccaatgagactctcaatactggaagaatgtctagaaattagaaagttcctctgaaattaatttagattattgctaaaaggaaatgcaacaaacttgaaaagacaaactgatgaatgcataaaagactgcaagaaaagagaaaaaaaaatggaagtactcaaatagtttaatagtcttgaccgaatagattttcaaagagattatactgtaaacagggaaagagaatgctgattgaagcttctcagaaatacaaaaatagtgataattttaaacaatatggctagtccaacattgtcaacaaggatttactgatcacaacattattatccaaaacattctcacaataagtagctacaacaaagataactaatgcatatgaaatatactccacagcagcttgtaggagttaaaggaagtgagttcaattgacccaagtccgaagtatctgaaccaaacaggcagatcactgggtctatgctttaagattacaagataccttggaccattttctgcagtgcttcaatagcaagtgtgtcagacatgacataaacaggagttcgtgtcatgatcttggaggtgattgtttgctcaacccgcaacccctctgcaatcacccttttagctatgtcctgtatccaaattaagcaaataagaaacgaaacgataaagaatctccttatctcctttaagctagaagtaccagccatgtcctatatcccaattatgcaaataagggcgaaaagataaagcatctactttaagctttaagtaccataagcataagatactttggcatgtacttatagtattaaatcattgctgtgatttgtacaaacttacagtcgaacacataacataggcacccgcaaagaaaaaagaaaaaaagaaaacacaacatggttgggccgcagtcgaatacataagaagcaaaatacataaataacaattgattcatggagcattagtcaaagtatttaaactctcaacgattcattattgaacaagtcagatgtggcaaagaggagttgtgcagtcctaagaaaaagttgcaataacataaagcgtccatctttaagaaatctaggcacttgatgtagacacaagcaaaactctatatggagtttcgtagagtacaattataccaaaacccacttattagccaatcgcaaccacctccagcttagaaaacacatcacagattgatttgaaaaataaaataagaagaggaaaattactttatcggtgacgatgccggagagtaatccgttggcgtccgtgagcagcacggcgtccaccctcctcgccgccatccgctggcaagcctccgccaccgtcgtcccctccgggatcgtcaccgccttcgtcagccgcagcttcttcaccgtcctctcccctctgaagaaaaagaagaaaaaaaaatccaatctctgtaaggatcaaaggcggcgaggagagagagagagagaggcaatcttggtacgcggcgtggctgggggagggcgtggcttcggcggtggagatagcggcgaccgcggcggcgggatcatcggacttctgggaggaggccaccgacggcgggcggctgcgggtgcggcggttcagcgccacgccggcggcactcatggcttcgtccgccgccgcctccgctgctccggaatcagcgatgtagttggcagtgggcggagagagggatcgtcggcggcggtggcggccgccggaaaaattggagggggggagaggtggccggttcgactgggctcccacacgccacgattgatgaataccccacgtgggagttttttcacatcgatctcttgatgacgtgtcaatgtcaggtgggtcccacacatgcacttgatgggaactaataaccagatggaaaaagtccactttgaccgaatctaatagccgaatctaattcgtacccctcaactaaaaaaggggataggacgactcctcgaactattgaaaaatcagtgtaatttaactcctccaagacagttaagtacaaattgcggagattcgcacccgatcggaaacaggccatacgagaagaactcgacaaacttctcaaagctggtttcatcagagaagtcatcaatccagagtggctcaccactccagtaatggtacgcaaagccaacagaaagtggaagttgtgtgtcaacttcaccgacctcaacaagacgtgtcccaaggactacttcattctttccttgaatagaccaatcggtagattcaaaagccagttgtgagctcttaagttttcctaatgcttactccggctaccaccagatcagcatggcaaaggaggacgaggagaaaacagcgttcatcacaccctttagtgtgttctgttatatgaagatgccgtttggattaataagtgcaggcaacacataccagcgcgggatccaaggagcacttggcgatcagcttggacgaaacgtcgaagcatatgtggacgacatcatcgtcaagatcaagacaggcgaataactgatcgatgacctaagggaaacgttcgacaacctctgaaaaaaaaagatattcgaagtcatactttagtatgatttatcactcacctgtagtcattgttaagaaccttcggttttcttagaaagcggaagaaactaatattctgatgtgctcagattcatatgtgacgggtgattagagaaggttctagttttagcaggattgagatcaaatgcagtagctactaggactgcacggtaactactgcacacaatctgagccctctatgtcaaaatctaacggccaaaacggatttggcacagtaaaatcagaacagtacctttccatcactacagtgttttgctacagtgctcggatatatctgggacgtccattttaaatcatgcgatgctagtttgactgcttattttgcagtcccactggctactgcacctgaatcggatccgttttagcatgcaatatgtaaaagtgaaaagaaaatgaaatagtgctttgttttataagctctttattggttggtagatatgctgcttaaataaaattgttacggtggtaatatactacctccgtcccaaaataagtgcagg

SEQ ID NO: 66992 - DNA, 56834 bp, Oryza sativa
gtcacctgcactcccgccgccgcccatgtgctcccgcaatcgcgtgcaacgaccgccgccacccacacgctcccaccgccagtcgccgagctcgctccctaagttctcctcgccgcagccgaccactgagctcccttggttttcctcgccgccgtcggccggcgagctcgttccgtcagttctcctcgccgccaccatggccatcggtgacgacgaagacgaggagttggatggaggaagaagaaacccgagggtaaatctgtccaggatggtatttcagcgtacacgatttggttaggagtggtattatagcgaagcccgtttaagcaatggtatttcagcgaatccaatcttttgcgatggtacctatgcaattttctcatccacatgatgagggacgcgtgaaccgtgcgatcgagccacaccgcgtgaccccacccaggcacccacccatcccgtccgtccgtccaccatcaaaccggtaggcgcccacgcgaccacgcggcgccccgcctgccctgcctcctccacccggggcgcgcgcgacaccggcacagctcgtccggataagcgcgacaccgcgttttcgcgtagagtacctgggaatcgaagggatcggacggtgtgcgcggctggaccacgcaccggatccatccatcatccgtccaccgctcatcgctgcagcctatcgatccgtgctcgtgcacgtacagtgttcctctgtgcctctgcacagtaccaattactgctttacttaaaagcgacggagttggctataattgggacgaaagccaatgtgcacgactcctccctggtctggtctcccggtttgggttgggagatgctttattttgccaggtttgttcgtggttatctgctgcattggcttggctgcgtgcgctctgtacgacccggcctagagtacgtacgtacggcgtactgtttttgtttttaatgcagcgagtaaactctcaaatccgtagatggcgtacaccacgtttgacaggatggggacttggctgctgcccatgctgtccatcgatccctctctaagctagcgcacggcgtgttgcctgccggggggtgcatggcaagctcgatcggtttgacgccgtgtaagcatcatgtagccaagatgggaggccatgggggctagcatggtacgctactatacctatacgtaggaactgcctgtggtgtcaaaggctctaggagtatatgattggtggacctaaggcccgtcgtcgactttgaacggctggtgtttgaatcctctagatatgtagataaaaattactacctctgtcccaatatatataagtatagtcatggatatccgtgtccagcgtttgaccgttcgtcttatttaaaaaatttgtgaaaaatttgaaaatatttagtcacatatatagtactattcatgttttatcatctaatagcaataaaaatactaatcataaagaaatttcaaataagacgaacggtcaaacgttgaacgttaacagtttaaaagtgcacttattttgggacgaagggaataagtgtttcacgtaaaataaagtggtaataacgtgtgattaattgagttttaattattacaaacttaaaaaatagattaatatgatattttagaacaactttcatatagaaagtttttgcacgaaacacaccgtttagcagtttggaaagcgtgtcacgagtatccaaaatttatcctctccctacagaagaaacagatgggggtctaaacactactcccttcgtttcaaaacaaactaacttagaagggaatgtgaccattcctaccaatctggatgtcacttttctagatttgtggtataaggaggggtcacatccgtttttaggttaggttttttttatagagagggtagtaaatagtggagcatttgatatttaattatggtcttgttactagttatttaaaaattctataattaaaccttttatatctgttgctaacacataaataataggcaaatatcgtgataactgacttgtcaagataggtgatgaacaatatgtttacaaattactatagtaaatagtaggatgctagagaaaacggttgtcacgcataggctaaagaaaaccttgaacctgtggaccaaagtaaactccttatatggtgtttttacgtaaaacgaagtgttattaacatataattgattgagttttaattattataaatttgaaaaatatattaatttgatattttagaaaaactttaatatagatagttttcacaataaacacaccgtttagcagtttgaaaagtgtgccacgaaaatcttaatcttcatccaactctggttggagaaaagaatgggtagtcttacaaccgcgcacaagacgactaatcttctggagattgaaaactgtgctaatagtaactcagtagggatcaatccaatatggcttgcatcaagtcgaatctattgctctactgtactctaaattaagttgttttatataaacccacgttctcaccaagcccttcttctcaaattgaaatgcgttatgcctatgtaaccatataccttttactctatccgttttatattgtaagactttttgtcttatctagattaatctattgatcaatttatatgttttccatacgtctaaatccattagcatttatgtgaatttgggtaatactagaaattcttacatttggagaatggaggaagtattatatattaagatatacgtagcaacctaatactcaaaatgaagtggtactagtctaattaatcaattttgagtattacgtaggtggctacatttttgcacatggagagcagagaaaaatgacttctccttttactgtttgaaagttatttttagcctcagcgtttcgcttattcatatgtttatccacaccgcttattagaaaaagaaatatggtaatacttttacatacacgtctttagcgatttaaaatatctaaaagtaagtgatgtaaaattaactacgataacactacaaaactagcttcaaaattaatctttaaaatttaaaattttgactaagcatcagtgaaacaatgagaccctttatatggttatcatatctcttttaaggttgtgttcagattaagacttcgcacggatgtttttcaaacggttaaacattttatagaaagatatacatagaagttacttttaaaaattcatgttaatttattttattttttaaaattataataattaaatataacatcaaccatactaatgattcacctaaatttaggtatttttttaattttctttttccttctctcgaacgcatccagactctactactgctcttcgatacagggatagatgtcctaaaaggtaagcataggagaggaggtggtggattattttaggaggtctgacatggtgcttagagcctaaggtttgaccggttccttccttcaccttcagttccttccctccccgtatgcgataaagatcagtcttctcctgaccaagcgcctttatcctctttgtcctttgggtttgttgccctcacatggccatgcttattccacaaccgcattcatctctgcttaaacacacccaacaaagcaacctcagcactatcacaccagctaaataccctagtattagtagtttttttctaaatcgtgtactactaaattaattaaccattcgtctcggtcgcctggagtggtggtggtttgctttccacttcgagatcctgggcgtgtcctgcacgtgtggctttggcatgtgagctttgcctagcttattttagctttaccttagctaccttaattatttgtatctgtctgggcgtagcaccctgcagattcttccttatcctcctgtagtatggtctaactatatgatggtcatagctaacccataatcatcaaaataaacaacaccaggttagtacagttgctgtcgatctcctctttgattaattcttggatggtacgataaactatagtactcctatgtaggagtagcctggtatctctctctagcttttctttgtgggctaagctaattaaagcaatattcaaatgtccacccaattaacaaacccgaccaagtcgttaatctccccagactcaaccgcataaaatactgttctttaggcttgcaagttgcaacatctttccacccagaagtactgcacagggataaaaaattttgcgtcgcgatcaggttaagcaaagcccgtaatttgggggccgctgtatatacacatatatatggctcacggtttggggcaaagttagtaactccccgtctctaaatatttgacgtcgttgactttttaaaacatatctgattgttcgtcttattaaaaaaattaaaaaattattaattcttttcacatcatttgatttattattaaatatacttttatgtatatagatagttttatatattttataaaatttattgaataagacaaacagtcaaatatatttagaaaagtcaacgacactaaatataaatattaagggacggagtgagtaattaatcggcagccgtggtgacaaatcgacgcatccgaaacgaagtccaagttcgtgcccaatgggtggctggccctgtttgtgggcgcaattatatgagccgagcgcatgcaaaattttcctgcggaatcgcgctttttcagctgcacggggaggaggtgaggtgatgggggaggaggacccctgtgtgttgttaattgtggagcacgtaacagcgacgtgctgatgtggccggtttggtggtcgcattatcctcccccctgatctagcaaccgcgacatgatcaataattaattagtctatgtgctcacaaattaagtagaatcttgtgtgtgtggagcaagcagacaaacgtacatgacgttaacttcgtactagtacactgcaaaaacacgatcatttgctagccgcttacaagatgggacagctacggagtgagtgtggtttaaatgactattttcttctaaaaagattagaaataatccacctaaatttaaactctagacttaacacggttgtatttcaatgataagtgacgtattcgtgataactttatcaatattataagatatactagtccaatctttcgaagatgcttgtagagataagatttgcgtgcatacgtttataggagatgcatgtgcatgctgaacgtctttctatatgtaaaaaagatgagattgctaaatgaacgatcaatcagttcatggccgttgattgcagagtggaacaccctctgcatcgatcgatctcgccatctttgtcgtccttgatagaatgacacgataaccagtcgaacgatcgtacgtagcaatcgtaacgaaccaactgcttgacgtttccctgttttgggcctatatatacagaaatatcctcgtcagcctcctgatcgccaaaagaccggccctagctagctcaccggcttttgttggtggcgacggcgtgcctgccggttgaccatcgccggccagcaagccaatccggccgtcggcgtccgacaagtcaatcctacctaaaaatgaaccgatgcgagtaagaacggcccgaccggccgacgtggcacggcaacgacggcgtcacaatccggataagatcagttcccatccacggcgtggttatatgtggtggtcggaacatgaagctagctagttgtaataaaaaaaatttagttagggcagataattaattaagacgctataaaagcgtcattatggccgcattatggattgcaacccaagcaaagtatatacagttaagacaaaaggttaaggccagtaaaggttactccaggattacatctggttaactaataatcggagtaattaaattaaacagaaagcaggggagcttgatggcgacgtggcggtctggtggacagatgcatggataagaaagtgtgatcgatcgaaccggctggcttaatttggctaatgcacggctgcaggttaagctagtggacaaggtgcggatggaatgtttggatttcttttgtctcaaggctatagctttttttgatcgatcgatgcttttttagttgtgtggctgagacgaaaggctaacatgtgcccaactcgatgccggtcttgccacgtacgtacaaggagggtagattgtatatagacagatgctaaacaaaaaaaagggctgatcgatgagtgtgcgtttgactgtttgagccgtgcccctcctgccggtcaattgggagttggtaggggacagtttgggtttttcttttagagatgactgatgagggagaggcagcgagggcgtttggttagttggttggtgcgcgagaagattggatgatccgagagtcgaggaggtagttagttagtagtaacacgtaatgcggttgagtcatcgacggatcagatggagggtgggacaccggtacgcacccctacgtggtgcggcgcggcgatctcccacatgcgacggcatgtgcgcccgcgacgcggcgcatgcaggcgagaccccccccacacgtcgctgaccctccctctccaaggcgcgcgtcgcgcggggggcgtttgcacgtgaaacgcgagtacgtggaggtggagagagcggaagacgatgggatcgtggatggcgtgcggcgcgcccgggacacgtacgccgcgcgcgcgggggaccagcatatgccggcgtggtactgagtcgagaccgacacgatcacacgagtgtccgccgcatgcacgcagttactagtgccacccaacccaacccaacccaacccactgggtgtacgtcatggcccaggggttggttaggccgtttcctcggcccagcaaatctcattgctcacaattgtgggccgtccacgcatgggagcatatgctaacgggccgacttggtgctaagatttttttttttgtgcgattgagcataataaaatttgatgctgtcaaattgttgaaggataacagattaaacattgctttacgaatgacatcatatcaaaatttggtagtttcgaaacactaccaaattttaatttgaaggtatcaaactaaatacatccactctatcaaaaatttggcatcaccaaaacttaccaaaatttgataaattgacaacaaagggcatgttcagattgtagctaaaataaacctaaacaagttttgccaatgccaaaattttggtaagatggtaatattgccaaaattttggcagaatttcttatgtattgaccaaatttggcaacaaactaaacatagacattttttttggcaactttgctaaaaaaatgataggtttacaatactatttttgaaaactaaactaccacaaagcctatatatttaaaatgaatgtaccataaaaccatggattaagtaatagagttatcatttttcgctaacacgcaaaatgattgcacatcaatatatcagaagaaaagagttatacttacacaacgcaatcagccagaccgacttatgccaggggaagggagaaaagcaaaataaaaaactgaagcttaaaaaactactgcggcggctaaacctaaactccaagcagcgggaagggccgagccacgctacactcccaacaaatcccaaaaaacggcaacgccgactaaagaacacatatagttaatagagttatcataaaactacatgtttaaacgccaatttttaatcacaaaaatacaatatttgtaactcaacatcacaatagtattagcaatttgacctttaaaattctagttttatgataggtttatcaaaataaataaaatatttatagttttgtagattttactctaagacttttctttttagctgccatctagtaatgctgatgtcattgctaccgtcaagcaatttttttccccgagacatgtcattgattatgtcactgtaatggtcacacattgtagtatactcctatatgctgtactcccatgaaaagtcatgagacggcctgtgattggatctttcattatactttgtcaaataggcgagaggaaattcaatcctttcttcttcggacaatctacattggatatacatgttcatatccgtacattcgaaattcagggccaatttggattgctaccctactaaaatttgcagtagtaaaccaaacacctctactaaaactctacctatgccataaatttggcttggcctataaacttgtctcttatgggcaaattttggcttcaatccaaataaacattttcaactctaccctaccaaaattttggtagtaccaaaacttgcccaagatttggtactaccaaaattttggtagggcatcaatccaaacatgccctcattttgtactttgcatctagatgtctcatctcaggagtagaagattccaagtttcacagataagaatgtcgttgtgaactgctgaagcatccatgactatactgtatatgcaataactgtgtcacaataatttgatagtaatctgtatattgatatctggttgtaaaatattccaagttgcaacgatagatgctgtcacttcctgctgccaattcttgaggcatagatgactgtgcatggttactgtgtcacaattatttgacaataatctgcatgaaagcgcattacagccacagaatatatcctgtgttaactctgacgaaccaatcttcttttgtgcaacctacactatgcgtcctaccttttgctattcaacaacgatcacttatgaaacaacatgcagtagtgtgtctcaatctttgaaaattctccatgtttagtgcagaatcaaactatttactgatatattgatcctaaaaagatgggggtgtttgctgaactgtcgccgtcaaatttcttgtctccacagaagtcttcactgatttatcatcttcctttatccaaaaaaagaggagccatcttttcttctctttcgtggcatcactttgcaataatttgggctccctgtttagatagatagatagtatactgtagtgctacgcaaactagcgaaaattgatcacgaaagagacacgaatggttgccctatacgtttcttctattggagcacatacttgagcttcagttatgtcaaccattttcaaggttgcgttctatccatctcatctgaattaactttagggtcaacctaatttttttttgggttatctgtaccaacatatgatgaacaaaaaaagggagaaagataacacaagttggggttcaccaaagtcaaaacctgactccaattgtagacgcaactaacacatgatttccctgaacaacaagtacagagaggataaacaagaagcatatatatgaacttgtaggcatcttttttttttctccttttttcggcagaagattgagattgcttcacgaacaaaagaaagggcacaatcatcgtacacacaggacaatgtgaattgtagcttaggtctctgagaacacacgtctcgcatagtttcttcaacgaaaacgtcgaaattaatgggccagtattccttgctgctgctgatggcacagcttcagaacaaaaagaagaagaagaagaagaagaagaagaagaagaagaagaagaataagaagaaatggatctcatcgtctctgccgcctctgatggctccatcacggcacaagactttgctcgcccagaattaggtttccgatcacatctccagtcgagaccatccatgcatccatcatcatcaattcatcatacagcagcagcagcagcgaagtcttgcagaccatacatacgatatccatggccagagaaagcgatgtatcaagagctaagtagccctaattattcgatctcttggtagtactttttaccagcaattcagattcagccatcgttttgtatgtgataagtgtgcacgttacgagaggatcgatgtatctgaataattggaccagatataatctttgtccatttaatttggtttcagtcgtacatcgtctggtacgtgtgtgccacgtgtgcaggggagattgaaggcgacaaatggggaactgacaggtgccatgcatcatggcctcgacccttcgccttcggtggccggcttgattgatttcatgtcgttgcatacgtacgtgtttggccggtgttcgtccacttcacccgtcgttgatttgcagctgattttacggcggtgaaggctgagcgtacgtgttggtccaaaaagtgtcaactaatatgatataccgattcacagaattaaattttttaatacacaaattaaagtacatactcgtatcttttaataagattagaaagggtagatgctctacacagttacaacaaactacacacaacgactctagacccatcttgcacacaggttggtgcccatcatatgaagattgaggacccccaaggctgccaaacccgttagtgtgcagactcgcgaccaaactaagcagaccttgcgattcaaggcattatgataatggtgtgaacgaatgaatcaaacattagaaagttgataagtcgatctaaagaagtttagtaagaaataccgatgaggaaaaagtttttataaatatcatgtgccgtttagtaatttaagagaagtgtcaatgataatttacactctactcataatttataatctgttagctagaactaggcataaacacacttgtaggccggaccgctgcaccatggaccaagtatataaggtattgtcgtctctattatgtgatatcccataatctaatgggagaaataaccgaagtgtgtctctgtcaatctccttataaaaatgttagtttcacaagtgttctctatttcaaacgtgtttccccaccatcaataatcgctatggggtcagtccaataatttcaacaagatagaattagctttgatctgcaaagataaagaaaaaaaaaagacccgaagaaaagctcattatccttacccaaccctccctgaactaaaataatcaaagataagatcacagaacaccaactttatctaaattttcttttgatctcttcttctcccatcactttatatctccaaccatttgagttgttaattaatcaacacaagtactctttcagcatgtgcagggggcctacgtgcgactccagttccaatcctgtggtttgcaatcttagcctttgccttcactctatatatcttcagttctttacacaacaccatatcctaatctttgattctttcctttcattatattctctctttgctagtacctttctagctagctatcaccctcctaaatagagcaattgtttactcccaaattggcaagtaagtgtgtgcttttgttaggtacagcgctcttatcgttgcaaaaaagatatgatgaattactgtgcctgagtgaacagaaaacaatcaatatacatctcatagttttaatatatattgaattgatttgtttgtgccttgagctaagttaacatgcatccatcagggaaagcgatgcatgtcgcagatccaaccaccgttgcagtcgtgcgactttgggcaacgaactcgagaccgccacctggcatgtttgagcggcttatcagatatttgttcgtcaggattcatgatcctatgatcctatctaatcttgggtgagattgacctgaatgattgataactcgattcattgaatccatcgtttcaggggcgaagaacttgtcgattccgaactgaattcatatattgtgagaaaagagttgtccttttcttttcagaaatatactattgtggtaagatttgaatataagttgtgatagtaatttacttcaaaaatatgttactgttgcgtttgtgacccaaattcctttacgaaggtaaggtggtttaatttaatacagtacattggataaagaaatctcagctccaaagcaaagacctctccctgcgatattaaaattaaggagagaatgagagttaccccatatacttaaatcagttaataacctttttaatgcttctatatatcctatacacgagtgtttgctctccatagggtgattcttaacccatattcttgggaaaccaatgaatgcctttttctgtgcgagactaaggctctgtttagtttgcgagacgaaaaattttggcgtgacacgttagatatatagacatacatttgaagtactccctccgtttcagtttataagacgttttgattttagtcaaagtcaatccgctttaagtttaaataagtttgtagaaaaaagtagtaacatttttaatcaaaacaaatttatttaaaaatatattcatcaattattgatttgatgaaactagtttagtattataaatagtactatatttgtctataaacttagtcaaacttgaaatagtttaacttttaccaaagccaaaacgttttataacctgaagcggagggagtattaaacgtagactaataaaaaaacaaattacattccgcatgtaaactgcgagacaaatttattaagcctaattaatccatcattagtaaatatttactgtagcaccatattgtcaaatcatggaacaattaggtttaaaatattcgtctcgcaatttacacgcaaactgtgtaattattatttttttaatatttaatactccgtacatgtgttcaaacattcgatgtgatagggtgaaaagtttttatttgggaactaaatagggcctaggataaactctgatcggtagttttctggcatttatcaccatatgctacaagcacgtttgctaatacgtagtagtactacacacaaagtaaatactatatgttagtactttatgtgtgttatccgatgggcgatgcaaacattattattctcgaagaaggatattacctcacttttttttttcttacctcatgcatgaatcaaagagccaatgtaaggttgcataatctgacagatttccttaagaacatccgttgaaagaaaaatagtaattctggacatttaaaccttggtcggtagctttctggtatttatcatcatgctacaagcacgtttttattatgtagtattgcaagcaaagtaaattctatgctagcacgtaaatatatgttatccaatgggcagagtaaacagaatagtaagagttttttttgcggtcctaagagaaggatagtatctcacggtatctcttcatggctataaaatctaaaaaaacatcgtacaatattgtacagtaatacgaagaataaagaaaagtggtagtactatctacaaaatatatattcttcgtatttggtgggtagcagcctagcagggacgctgtgagatccattcaaaatttaatctaacaaaattgagcaactgaatccatacgtacataccaaactggtgcaagaaaaggcaaaagaataataataataaaatggatttgcgcactagccagtgatttgcctgtccttctcagtgtccactgcaaactgaataagtgaatatggtgatctcatctttcaccttctcctccccataaaacaaacacaaaccaaaccaaaaaccaactctttttgaatctcctttgtgtcaacataaagaagccaatcaaggtgatggctagagggagcatgtagcagccgttccttttattatttgcaagactagattagtccagtaaaagcttcacttcctaatagccttataaaaatgatacatggtggaagatggcattgtgtttttgccaaggggacacacacatacaccactagcaaaagcttctccttttaggcacaaataattcagtaatctctaagataattccttttcttcttcttctctctctctttaagttcaagtgaccctgattgtccccaaaaaaggcgtcctcggcgacgaactgggctgatcgttctgacggacagtcgagatcttgagctccagatcaggtggctggagttgcagttgcacctgaggctttgccaccatcagagaaggatggattgttcttggttgttcgctgctgctgctgctcactgctggtgatgaacagcttggcgtcagggttaaggatggaggaggcagcagcatggcttctggctgtgccatgctgctgatacccagtgacagtgcagggaatcccatttcagcaggcacagaggctgtctcgtgtctcagtttcagacgttcattcacactcggagccttttctgcatcctcaatctgaaagaaaagaaaaaaaacatcaaattttcagacatgttaggttactgtaactcactcatataaatacatgattcttgctgtctgaaactgtctgtgtagatattgttgcaaagatgtttgaagtttaccacgtcaaagaggctggatcttctcttcttctgcgtgaggctgctctgcctgaggaaatacttctgggcatggctggccacctgcgtcggtgttcttgtcgtgacgaagtgccgggaaatgccgcgccagtcgcctttcccgagcttctcgagccctaccaggaatttcctgtgctcctcttcagtccatggaacacctgatgacagttaactgatgagtttgacatgttcagaatttcaggtgtagaaaacacagcaatttagaggatttttttttatctgttgatatctgcaaaaacaatctagtgtttggagttcaagaatctagatgcaaatgattaggacgagacaactaggataaatcaggtctttgtttgtgataaggatgagagtttcaggttgcaacttgagagacagaaatctgattcttaggaaatttatgtcagtcatgcatatattcctgtaccaagttggaagcataaaaatgggcttgtatggcagacagcaactggtggcaaaaattggagaaggggacataacaaaagaagtcaaataacttctcatcaacaaaaataaattcagtcttaatgatgattagatcactgtcaggtggctgtaattagtgctaaaccacaacaaattagtgaagcatgcacaaaccatatgtctctcaagaactcacccttcttcctctcctgagctctcgccatgaggccatcggagaggtacccgttggccatcttctcgccggcctcctccaccgacaccagcgacgacgacgacgacacggtcggcgacgagttggaggcggcggcggcgaccgcggcgtagtacgccggcgacggcgacggcgacggcgacgataggcactccatgctgaagcacttcttcagaggcgcaccgccgacgtgcaactgcaccccgaacaacctcacgccaccggcgccaccgccgccataaccgccgccactctcctgcaggctcctttggccggtgcaagtcctggagttgtggccattgttcccgcagctggagcatttcctggccatgctcgccgccgatggcaggccaagaaccacaagaacagcaagaacaacaagaagaagaagttggagggaagcaagaagaacaagaagaagaggagtgggaattctaaggagttgagataagatggtgcatgtggagatgtagcaatagcagcatctagtagcttaataagggaggagaaagaaagatgtggtgtgggacaagcaactagctgaggagctaacacctggtgccaatggaaggggacacacacattggcatcatctccttttatggtattgacaattcaatccaaatgctggggcaccatgatacattgattctactatagatgctgctgctgctgccctatttaactgcacctggaatccacaggaatctgaaagagagtctctcctctttggatgctattagtgatatttaatattatctatgtcaacatcatgttgcatatgaaaatcatgtttgtatggttcatatcaggaatcttatacctttgcttgtgcatttttgccactgcacctgcctttttatcctggcaaggtcaactgattggaaaagagaatttgttttcttcatggcctgaaattgtttttaaaaatagacagagagtgagtttttttttaatgttgtgctgaacgtgtatgccatgccacaaaagaaattgggtaaaaaaaatgttttttgtttgatctagaagcaaaatgatggcatcgatattatcgaaattgtttcgagattagattggattgagtagctattaattgctttcttagtttggaccagaacaatttatagagaaactttcattttgtgatgtgaaactaagacctcagtgtccgaggtgtatgctgacgtcatcgttaagaaaagcatactttggtccatacatgtcctttcataacgtccggaataatattatgttattttgtttgttgccacacaaaaaaaaattctagaaacgtaatgagagcgatttgaagtggaaagtctattttgtcagctcgtctagatcaaataataaatcgataagaaacacactgcaacctcagctaacctcccaagattaaaaaaagaaaattcaagattcatttgagatactagtttgctctgctttgactaagaatattcagattgaaacagtataaaattgaggatgagattttaatgtgactggatgtgacaaaaaaagagggagaatatgaagtagttggttaaggtgaagatttcttgtgttgttcttcaatttgtcccatgtcaagaataaagggcattggccaaataacaagaaaataaacacagagcagagaagcccttattaatgcaagcaagcatacttatcaaggttaggtgccaagatccaggattggacgaaattaggaaaaggtctcgctataacaaccacaaaagggagagattccggtactttggaccttatgaacctgcatagcattagaaactatgtgctattttttttgagtttcatgaaataaaaaaatcaggcaactgttctatttgttcttctccttgtatataaatccaactggatgagttacagtctgaaattggtggattattaatttactagaaacatctgtactttgtgcacccaacttaggtatgggaaattcttagtttttgatgaactcatctttctccttatcaacagcaaggtctctctttagccttttaaattccatgactagatttggacaaccaccacattagagttagttgtaatccacaccaaacgaaagtaaataaaacaaagttgcgaaatgaaggggggcacatccaaattatcacttcaattgcattttaaaattttttgttagtatatacaaatgggcaatatcccagcttaactttactagtcaattaagcacagcgcaattgtgctttcctggcaaagcccttatttccgtgttcttggaggcttatgttgtgaaacacatggaaaaaatcctaccacttctgaattctttatttatattgtaaaaaaaaaaaagcttctcaatggcatcatgcaaatgctacaataccctactgaaccaatgatttgaagtggcacaagagacactccttcaaaggaacttattatagctgtgttaggtgctagaggatctactgtagtgaacaaaacatttcctgttgaagtgttgatcatctgtgcctgttcatgatagatgagatgccatttggatttcaatgcattattattattgttattattggattctactggtttaataggtctacgtgataatgatatgcttaattgatgcattgcaaagtgcttctagctccttggaataaaatgatattgcacaactgagaatgaaaaagaaacttcaacggcatgtcctcttgtacagtagattcatcatcttaaagtgaagagcaatgatactctgtgcaatgatccatccatcaatccatcacagaagcaccattgcaccaaccttgtttcttgcaaagttagagcatctccaacagcctctccaaatcgaactctccaaacacccatatagccaactctccatctgatttaactagtcaaactaggcactcactccaacagactctctattaatcctctccaaaataaaatcggacccacatgtcagcccctctcccctcttcttcctctctccctccccttctttctcttttcttctactccccttccttcccgtcgaggcggccgacgtatggcgcggtggtgcggcggcgctgggaggcgggaggtggaaggcggcgcggggaggcggccgggaagcggcgggaggcggcgcggggaggcgggaggcgcggggaggtgggaggcggcggtcgacgaccccgacgacgacctcgacgatggcgcccccaacgacgacgacggtggcctcggcagtggggcggaggtgcggcgctggaggaggttgggcaccgacgcggcggaggccggaggggcggcatggggaggcggctgggaagcggcgggaggcggcggggaaaggcgggagacagcgggaggcgcggggaggtgggaggcggatgaggtgggaggcggcgcttgacgaccccgacgacgaccttgacgaccccgacgacgacctcgacgacgaccttgacgacgatgatggcggccctgacgacctcgacgacgacgaccccgacaacggcgacctcggcgacgacgacgatggcgcccccgacgacgacgacggtggcctcggcactggccactgggggcggagggttgcgctggcggagggtggggaaaacgcgtggggcccacgattggagaggcgcttttggctggccaaagttggccagcgtggggagaagtttggccagccagttagctaggctgttggagtgtgtttttgatccaaaattgctaaaatttaacttgaagagtgggataaggaggctgttggagatgctcttactgctgtctttctttctccagtgattctgccccttgtgagtgacaaatccaggcatgaaaaggaagctgtgacaaggtaggaggggtatctatatccaaagcagatgttgagtgggggatgctattcttggtgaattaattgcaaaggaaccaaaaccagtacagtttcagatagatatccagcaccagaatcctgcatcttgtctggttctcctgcaagaagttgtactgaagaattcctttcccttctatccaactcttttttcggagaagaatccaatccgttgggaaaatccatctctttttctggagaagaatccaatccgtttggaaatcattaaggaatatcaatttggatagcaaaacactacggagcatgtccatttcagccgcactttatgtcttctaaattattcccatatttcctttttggctgaaacactttactgaatgtctgaaacatataaacacaatacaaaaaatgcagtacttcattttaagctcgagatccattaattgatagagaactgcatccggtcgcgtccaaattaacgtttgtgtcaccaactcgccatccttaataattctcctactcctcaatgtttttttgttggaatgtgatgtttgatctgccaagaacggcgcaaaagtcatcacatgcaccatcatcaatttattaaaccgcagtttgcccaacacaggactcatcacccatcaaagacataatgttaagatctcaactcccccaaaaaaatcttaactccctcgttaagatcgccccatgaaaattgaatctccggtctccaaattaaatagttgaatactactccgttccagaatataagaggttttagttttgtcataagtcaaagttatctagctttgaaaaaaatttgcaccgacatgtacatcataaaattagttttattagatattgtagatattaatatatttttctacaaatttagtcaaaactagataagtttgatttaggagacaaaactaagcctctcgcattctgtaacggaggcagcattatcttacaccaaacgtgtctccttgtttttctacattttttctcttctaaatattgtcacgaagaaaatgtgaggtcaaatgacctggtaaaaccaagtacctggttagtaactacgacaacactgttcatatcattcagtctagaagaaggccataggtgagaggtgacaaaaacacatgtatggcatgcatccaaggaccagctgtgaaatctacaggcaccaaacatgcacggcagggttcacaatcacatcacaaaaaattcctttgccatgaaaacaactgaacaggttttatgaaagttttcaaactcgatcgagctcagctagttcacaatggtcaatggatgcaaaccatcaggctcgtcgcttctctacgcgtttctttcgatacacctggacttgccgggcagcagccactgtttgacagctgaattgactgtctctgaaacctgaccaaacattccaaaaaacattcagagtttcagagagtttatggcctgagagatcatcatactaccaagttaccaaccgtgtgtttcagagtttcagtatgaaagaggcaggtttgatctgaagacacagagcatttcaacagtcggtggcagaactgaagacagtctttttttttttttttgatggcgaactgaagacagtcaagagcagaggaagcagatgaagaaatggttttcagttcaattgaatggatgagtggatagagcgagaccatgggccggtatgcggcgccatacatgggctgaatctccggcccacacagcacagcccacaagtcacagcgaactctccgaccgttgggggtcggaaaagaattctccgagcccctactgggtccaagacaaccgttggatggaggcgtacgtgcggctaggatcaaaagcttgtaatgtaggcccattagaattgctgcccggcacggcccaacccaacgccgcgcataggaataagttcactttgtgaccctcaaaagtagtcgaaatctaatctataatcctaaaccacaaaacaagatttctcgacccccaactctcaaaaccggtgcaatttgactccctcagcggttttactgatgtggtgcctacgtggcaatattgactcggtcttcttttcacgtggcgcttaggtggcattagaaataaaaaaaaataaatgtgggacccatttatcattcaccaaaagtatgggtgggacccactgacctgtggggcccacataaatcatcctctcttcatcctccccttctctctctttctcttcatcaaccttcgggcgagcggcagccgtgggacgagggccagcggcggacgggggccagcgacgggcaggagccggcggcggtgttgtcctcgtcgaagcgtgacggctgtggccggagctaagaagggtgacggagcaccgacatcggcggcggcatcgggtagtagcctccggcgtagtacggcgtcgcattcgctgcgaagtacgggaggtgaaccggcaccaccatggccggctccgcccagttgtagtggtggtggtactggtactccactgccaccgccgctggttcagatttgtcgccgtcgccgctgctcttggtggtggcgtctttggacgatgccgtcttcccaccggcgcggccagcctcgtcggcgcgtgtggcggcttccttcctggccgtgcacttgctgcattcctgcttgcacgccgccgccgtcgctggcgacttgttgcctttgccgtccttgccttcgtctttgcgcgcgctcttctcgtccgccggcgaggtcggcttctcgccgccattgctgttgctcttcttgccttcttccgaaggcgcagccggtgacggcggcggcggcgccatcacctcggcgatcttgccgaccttcgagagcttctggacgagcaccctgctgtccacgtcaccgacgacggtcaccttgtcgagcgacgggttgatctcagtcctcagcacgcctgcaaaatccatgcacacaaacacaaaattcagcatctctgacgaagcacaagattcatgcacacaaacacaaattcagcatctctgacgaaacaacaaattttcagcgtctcagatgaataacaagaacacaggagaagtgaatgatctcgatacctttcaggcttatggctttcatcaccttcctcccgcaagcatgagcaaggagacggggagtaaggggaggagaccgctggtgagaagacggaggcgagagagaggggattggaatcggtgagctcgagcttgccatcctgccctccatcttcctcccttgatgcctgcttgctccccaccatcggctcatggtggcgtcaccggagcagcgtcttccccgggagtgaggtccgccgccggctcccgctcgcagccgttcccctcgtcctcccactaggggatccggcccctcgcctgcccgccctcccgtcgccaccgtcggctcccacccgctgccgccgccgccgccgctggcccctgtcccatggccaccgcttgctgaacggaagagagagagagaggggggagggggggggggggaggatgaagagaggatgatttatgtgggccccacatgtcagtgggtcccacccatacaatgacaaatgggtcccacacatatttttttatttctaatgccacctaggtgccacgtcaacgccacttgaaaagaagaccgactcaatattgccacgtaggcgccacatcagcaaaaccgccctccaaaaccaccgagggagtaaaattgcaccggttttgagagttgggggtcgggatatccggtttggtggtttagggttatggattagatttcgatcacttttcagggtcacaaagtgaacttatccccgcgcatatcatcctacggctgacggcccacggatcacggcccatgggcccggctgccccgccgcgccctatatgaagcgctcgagagcgccggttcacctcgtccccatccgcctcctccgccgccgccgcgtacatgaaaccctagcggatctcctctccgtcgtggccatggcggagcaggggtggttgttctgttcctgcctctagtttctcctatcttcatctacttgattctctcgcatcttagtgattttggtgattttgattttctagtttttgaatttgtgattttggtggtgtgttcttgatcgcctttgagagaaccgggtggatttattgctggtgccgcgtcggttccgttgcgggcgtagatgaatccttgtgcttcagattcatccgacgagctccatccatgtcgtctcctcgtgatgctgggtggcagggtgattttggaacattttctttttttttacttctctcccgcgagatctatgtttgtttgtttgcgtttgtgcaatggtgtttttgctgggttgatggccttcataatcccggattaactcgcttagctgttcttctgattcatgggaggccgagatcgatgctggcagtttcgctgatagccccttcctcttactggaggtgcttcattagtaactggccacacaatacacaaatgatttcaaaacttgttttctccgtttgtttttttgttttgtttttgcgaaaagtttcgcttgggatgcgttgcgcagaacgaacaaaccatcttctgaaatccaccgagatcaatagacagggtgatgtttatattggtagaaatacaagtaatcataaaagcagtaaatttggatatgccaaatttaacagaggcatcgaacgattgaacatataagaatatcatccaaagatgttcaactgttaccgcaagaacacggcaataaccttctttttagtgttgtgcggaaatatgttgaacggttaattgacaagcaaggattaaccttacttataggcctgttaatttgccattatgaaacgtgataaagacctagtaaaccaaagagaattacccctacattacgaacttacgattggtggcgtgcgtatgactcgaaatggtcgagcagcttttgttggagctctgaaacaaaggcaggacaacttgtggatagtacacgtcaaaattggaagtttggttgaaattgaaattggaatgaattggaagtttggttgaaattgaaattggaatgatgtgatgtaaaagttggaagtttgtatgtgtgtggaaagttttgatatgatggaaaagttgaaagtttgaagaaaaaatttgaaattaaacaagggcctgatgagaggtctgcttagctcatgcctgcgtcagtggaccatccctgacgaccttccaatcttcgccactactcgctccatggtgcagatcaaggtgacaagaaaccagaaacaaaaacagtggtaggaatctgcgagtcttgtgccaatggttcacattatcaatgtacaccgacagcagcgcacacagcctcaagtttaagaatggcagcgtgtttaaacagatgtaaaaataataatttctttatgaaactttttcacaacaaaattctgcttctatcattttctctcttctttttctcgtatggaacgatgtgatgagatatacatgtgtttctgactacaaacatatgaacaaacagacccacccttctcccctacaaactcactcccacctctgcctaataacacatcgatacagattatatcagttaaccacaatgaaaagaaaaaaaaaactgccattagctgcatcactggaggtaccaaaacttgctggcagtgaccatctgaattcagactagcccatgcagtgttccaccttcatgagcttgtattgtcaggccatcaaggattcattcatttgccaattgctaaactttgagcgagatccgagtcttgatgggcttcagcttcactcccatgctctccggtgacagaagttcaggcgatatacagaatgggttcagtgtgctccgggggctgctatccagctgggaaggtctgtagagcccatatcccatgaggaagtactccatggggatcaacatcgcgtgcggttgctcctcggtgacgagtgacccgcatgcctgaacctgcgatttagaggcgaaatgcacattcagaacttgccttactctgcgtatggatcatcaatttgctatgtcagctgttaaattgtgatatggtctttatacctcgactagggcgcaatatctccggtctagctttgtggtcatatggactgcgtcgtcgtggaactgtgagttctctcccacaaaaatcagtgtccgacactgaagcttcttcaacgcttccgtcaggtcatgtctcctgatggatggaaaaattcacttgagtatgttcaaatcctgtttctttgcatgttcaggcaatgcacagaagataatttgtccacttactcgtttatcgcctgaaggaatcgccatacattagatccctgtcgctcatgaagtaactgcataaaaggaaacctattgcttcagactaactttctataagtagacagctaccaatcttgtcaaaatcatatcagaaagctgacgaggagatgaactacttacacttctacaggcttgcacaatctctgattcagggtcttgtccattcccacgaacttcctgcacatagcatcagaaaactgttgagcgaagctgatatacataaaaggatgcaaataaaaagcagctaacagaagaccaagtataccgtgctaaaataccgctgaagcaagcattccttgactagcccacgactcccataatagtaaagcaagtttaataatacctggtacataagagtttgaggttaattcacagaacacattaccaatactgcagtaccgacagatttaaatgtatgttagtaccttattgtacaaccactcgctccaagaaggggctttgcatagcggcgaaactagcataaggccaatcactctatcccggtattttgtctgtgacaatgtatacatacattcttaagaaaaagaaaaagaaaagacaaggcaagctttgaaataactgctcagagtaatacttactgcaaagagggtgagaatgtaggcaccggcagtgacacccaaacacatcacagatcctaatctgtatgagcaaagccagaagcacagcattagaggcgtcgatcaagcaccagccgattataaggcgcaatttggccagtgtcgtgatacagtacccgaagaaatcaagaacatccgcgacttgatccacaagctcatcaacagatggcacgggcacatcggatgaaattggagccgctcccaactgtaggacaaaataacacatgtaagtatcagagcaaatacgggcaaacagtgaatgcttacataatattgggtaagaaagagccatcatgactgacctcatgaccttgaggagtgatgtggtaaatacaaaaattgtgaagcaacagcgacgcggcctctgggcagaagaacaatccttgaaagcaagacatatctaccaaacaaaaaaaaatagcaacatcagctaccctgccatggaaaaattagcaagctttcacctacaaacttgaaaggtcatcagaaaactcacaatttagagctacatccgggtatgttatgagcgccggcttgtcttcatctccaaatacagaaacagatacagagccatatctggttcgcactcggtgttcctggtaaaaaaacacaggacacaaatttagcccattgggatttgacaatcctatttgaaacaatagtataatgaataatcaatcagaaccagcaattaaccaagaggtattgcttcccctcggtgaaacctccaccgacattgcttaacaaatagaagcaacataagagagattctcgttgtcattgcgttgataagcactaattggaagctgtagcgtaggggcttccgttcttaattaacattaaaagcaaacaaagatgctacatttttgcgtgtatttttgtttttcctctcttcctgctcctacggctcgagtaacattgcaaccataacaaaacgaggagctgcaagaactagctattactgaccaaaatcataggcatctaatctaatgctcctaatttgtgcaatgtccctgaacaagtgaacagtaacgaaaaggagctccatggcacccccaaaaatttgaagcatttgctgctctaatcaagaacagcaagaaaccaaaatcagggagcaggaatatccccgctcctaccttaaccaccatgaaaccaaaacacaaatccccaccaaaccaagcttgaaggaggggaatcaagcaagaaacgggagagaccgaaagcagagcgcacggaccttgccgccgaaggagatccgctccacgtcgatggacaccgaccggctcgagtcccccatgccgccccgctccccttctagaagcttctcctcctcctcctcctcctcctcctctgccaccaacctctcctcttctctctctctctctctcctcgctgcctaaattcctcgcatatatttgctcgcgtatatatacaaccgcgagaggagagagagagagagaggagagggtggcttggcttggcttgcccagaatgagcgcaaaccaccgacggcggtgagctcaccggaggtgaccagaatatggcgggagagagaggagaggagagggagggtggattgcctgtttcatgggatccacccgttgaaggtgggccccacctgtcaatgaccttcctcctcacgcgtttgaccggtggtgtgtggggttagcgttttcgcgcttgtgacagcttgggccgatcgtcgcttgctacgggcaccaaacgggttgaccccccgtggaaggcattaaacattttttccccttctttttcatgccaattttgacgtatttgtcgttcaagctaaatcttttatttagataatcgttcaagctaaatctagcacacgagatatttgtggccattatgaataaaaagtcgtttttcgaaactgtttttcataccatcatttttggggttttatttggaatcattttggtagacattatatatatttattctgtgaggagcctacgtgcaccttccatataagaataagttcattttttgttcctcctatttatctcgaaataagtttattttattaatcatatcagagtttgtgcaagtagactacaaatgcatttgagtagactagcaaactactcatgctttatatgggtaaaagaatatactagtatattataatatgttatagacaaaatacattttttatcacaaatgttagtatcacttgtttgcttattaaaatatatgatattcacttgtttgaaacaaatattggactctattccataatatcaaaaaatatcaatggctaatttgaactacaaaagaaatggtgggatagcggtgacagattcactgccagcaccactaatgttttttaaatgagtatagataaaagagaaaaataattatattgaggtttgataaaatagggtagtatagtctcttttttaatgtattggcatatgtggtttggtttgaaagttgtatttattttcgaatgaagggattatagttttgtaaagtgtgactgtgtgaattgtttgagggacctaaggaatggatatatatatatatatataatgaaatttagaaaaatcatttttatttgaaattggacacgggaaggcagacactatgagttcgtgtagtaaaacagggtgtgccttttgtgtgcgccagctcaggctggtggcggcccatcagatgctgagctggatgggggcccacacatcagtctaacaaaaggtgcggacgtggtacactcgagcgcgtcatgggtttctcctgattggccgcgtccggtgggggccacctgtcagtggtaagtaatgcgcccccatgatttgcctcgtgagtcgcgacaaaattaataacactcctactagtacaatctgattaattactactaatagatttttggagatacatataccgattgttttgggatttttgaatataaatcacttttctacccaaatggtttttgcactacttttattctgtttgttttttatgtgagtcaattaaaccagcgaggaaatctaaacggttagaaaatgtatgttatttcttaaaacttgtttttttatgcaatttcaacacgttgacccggagaagtatttttagccggcaaaataatatattccaatattatttccgaaaacaaaaataagaaaaatattagatcctttaattgtcaagttagtattgttttagagcctaacaggtggtcggtttggttgacttgccagctgaacaacgtttctcatacttcttttttttttctccctgccctaatttttaaacgcctcccctttcacacacaaacaaagcaagcttaattagattcttaatctttagctttctttcagtttgtttggtcgtctttgtcaaaccttttggatggatggtaaaggggagctcaagctaaaccaggacaccctaatttcattttcggccaatgctttttcattgctacgaaaggtggtcaatatttttttttaaaaatgtttttttatcaacttctaatcacatatgcatgtggagatgatctcacaatgccatactataataaaagatcttaatttttttattccgaatgtgagatcataagatggaagctagctagggtgcgttcggacgtaggtttcaacttctattcccttgttttccacgtgtacgttttttaaacagttaaatgatgagtttttttttaaaaaaaaacattagttttaaaatcatattaatttatttaaaatatttttatagctaacacttaactaataacgcgttaataagccaccgtgttttacatgtataggagagaagttcacaatcttctcttccgagggcatcctaaggccccgtttggtagagctcctaactccaactcccaactccaaactccaactccagtgagagctagctcctctaggagctgaggtaggtaaaaaagtgtttggctagattactcagctccatatttctacatcctttgtcgccatttcatcgaacaccttctaggcgtcgccttgacgttgccgccgtagccagtcagcccacgagccaccgccgccgagaagcccacgcatctccgccgcctcccaagccgctgcgcaagcgccgccgcacaggccgccgccgtcgcccaggctgcctcctgccgacgcccccgcacgcgagtcgcctgccgacgccgccgccgcgtgctgcccgtcgtggccaccgcaacaccgcccgcagccgccgccgccgcctgccgccgccgatgcgccgcggcctgctgcccccgtatgctgccaacgcagacgccgccacaaccggttgtggccgtcgtcggaggatggggaagaagatgggccgccgccacctgctggccccgccgccgcgccgcccgtcctcgtcccccaacagccgctctccgccgctgccgcagccccccgccgccagcctccggccgcgcgtgcgtgccgcccgtcgtcatcccgcagccgccgccgcccgccgctgtcgctgcccgtcgccgtcaacgctgccgcagcccgccgatgccgccgcactagctcgggattgagaggaagattgggggaggagagagaacgggaggaaagaaggggtgaaagggtagttgagtggcattttcgtgtaaatacactaaaatattagaaggtagtgggtcttttggggtggagtggagctgtggagcagcaaaaacccagctccacccccgtagttcattttctaggagtagctctgccaactccactccaaaaaaaggtgaatctggaccgtttggcacagctcccgctccaggtaagttggagttgggagctagagttgtgccaaacggggcctaagacagtgatgagctcctcctagtaattagcaagtgcccataagccggtcataaatgtgatccacgtgaaacaacctacagatgccacagatctcaccaccgcacgctccattgaatcatttgcaaggtcgcaattaatcatcgcagatgcatctgaagctgagaggcagcagctagctagcagctgggacctgcaggtgatggattcaggattcgcatatcgatcgtgaatgaatgaatgattccctaattaacccaaagtgttagtgtcagtgtcagtgtttaatttgttgctccgaagaaaagctagctcagccttttgggagctcaattcgacttgctagctactaatgacggattactgttgattaattaatcttcaactgcagtaatgcttgctagctagctagtagtagtactgtactcaactggtaaattaattaactggttacactttgtaggcttgtggatggatctgacgaggttgattaattagtaatttttctgcagaaattgcaaagctagatcgatcgattgatcgatctatcgagcacgagtggcacaggggatcagtcggtcggtccaaggtcgccatcagagttcgtcggttggtctaattacccaactgacctagtagcaaaatactactccctatcattttttaatagacgacgccgttaacttcttacatgtttgaccattcgtcttattcaaaaaatttacataattataatttgttttgttatgagttgttttattactcatagtactttaagtgtgatttatatcttatacatttgcataatttttttaataagacgaatggttaaacatgtgagaaaaagtcgacggcgtcatctatttaaaaaacggagatagtactaatctatagttatttgattttaattgcagctgagatcgatcgagtggtgctccatgtctcctccgtgagagatcgaaagcttcttctttattaatccttaattctgctcggccatcacgtcgtgcgtgtgtgtacgtgcagtaatggccggcgatcgatctccctgtccatgggtggattaattactctctttaatcttcttcttcctcctcacgtcgttgctcagatgataataattcgtggatactacgataggaaggcttagaaattagcttgaatttttatctttagaaagttagcttaattttcactgttgcgattcagacgatcagtgatatgatatgatgcaggtgttgtgccgcagtaagcggtaaccagcaattggttagttatcagttgacttgcaattaagtaggcagacaccggttaaactttttcgtgtcaggattattgttaggtccaatgccaacaaaatactactccgttagttttgtccatatacatcatttcgatctcgcatgctgtttattcggtcaaacctgtcaaaattttgcctaaacatcgcgacaatgaagccaatcaaatcgagcaatagtcgccttgattggctcttctgtcaatggacagatggagagagagagagagagagagagagagtttcagtacgtgacagatgcagatcgaattcgatcactttcatggaaaaagtttttgctgtgaatcaaacagatcatgcaggaaccaaaggatctggaaagaaaaaggatatttgagcacaaggaacagcgaccccaaccttatagcacaaataaagaaagatgcaagaacatggataatggcaggcgcaaggcgacttgaagaattccttctaagttaaccacaacgtttatgtaattttgtatagctcttttttgcctctaggagatgtatttttttacgcctatatctaatgaaatagcacaatctcgtgctgattccttaaaaaaaaacagatcatgcagattaatcttgagagttgagagctactcttactgttcatgcatgcacggatgcatacatggacaaaataaaagggactgacgatgcaaatctacaccactcaatcaattctaatccgagatctaccaaatgtgcatatgcagaacaatttgccatcgagaaaccttgaataattacagcgaaacagtttattcaggaaggacgcccaaaatgcatggcaaaacacaagtagttctgatgttttttttcatacattatctatgacactaacatatcatctgtaaataaagcagaatgagattatagtcatgcgtgtaatgtgtatgtgcatacctgtgtatgacaggctgacagcatataccttctgaattacgtacactgctgaatttcttctttgattaatctattgccttagagtccagattttgttcttttttgtattatctgttggcttcggcctgttagttatcaattgactacacttcattggtcatttggaaaaggaattacaataaacaatcatcaattaagctggctgctagctgcatgacaggccagcagttgcaggtagttccagaagtagtggcacacagacgagtagggaccatataccgtttagtttcagcaacattttgtctataatcaatcggaacaagcaacctgattaaaataagtgcagggctacacaaccaattaaaacaacaagaagacatgagactttggccatctctttgaacccacaaattacacgtgaaacaattcagtagattcagttcataaaactggataagttacaagcaagtttctgacactttgacctgaaacttgttagctgggcaagttcagaacctctcaaaaattacagtactaaactgatccacgtgataaacattatcaccaagaactcctttaaataatctccttgggctgtcggtgagcaaggttagcatcagcagcatggcactgatcttcatcgtccacacaagcatatcatggcccattattcagtacagtactcggcactgtgccagtggcttcatcgtccattgatggagcaatgcaggtgaacgatggtgatgatgttcaatcgctgtaccggcctgtgcatgcatgcgaatcattgaaggcgaaagaacccatcggtaagtagattgcctgtccattcttgacgaccagtagtaaatagcagccgtgcgatcctgcaaataattcaagcaagagcactggtgagttgcagagatcggaacaggaggcgcccacgcggctctcgtcagaggaagaatctggaggagaggagacatggcgctaattaggagtccagtagcagtgatggtactgcgagattagggttctaattagggtctggttaggccattgttgcagcaagttaaggtactagtttgtagtttgcagagatagtagcttgaatgcatgaaggattgggtttttcagaacttgaaactgtgcagacaagttagaaaacgtgtgagatgtttggaactgaatatggcccgagagatttttgtctgaaattcttctagggtggtttggtttgacgaagtttgtggaactagcagcttcaatgcatgaagaattggtttttcagaacttggacaagtttgaaaaatcatgtgagatgtttggagcttgaatacggcctaacattatttgtccgaaatccttccaaagtgtctgaaaatttttccaagatacagcctaggttgtacgtagattcttcctatgtgtggatggttgcgaccttcaaattatcaacagcagcggcgtgtagcgtactattggttgcaagctaccgggcgttgcaacagtcttaacctatgattgattggcacatggaagaacaatcttgggatctcatatctgagtatatatatattactgcaaattagttaacccattactaatccatggctagaattgggctatatgttcttctcggactctcccgacaaaccgattcaggctccgcgttgaaatgattagacacaaccagcttagctagctcctaattttagtatttaaaatgaagatgaattctgcatgcggctacctttgctgcttaatcatttgataggctgtttgtcaatctgttctgcacttctgcctcttctttttctggcagctccattatttgcatgttgtcttatcaaccgcattcagaatttaaattttagaatttaattttaagttgatttttatgtttttttcatcgtagtttgttttataatattggcttttcaattggtaaaaaacaccgatatgaaagttttatttataaattatttatattactactagtaatatttttttttctatggcttatcaactatagagcaaactatattctttgtgggggagaaaataagaagcagccaagactggttgttgattagcaagggccgaacgtaagggcacaaaaagattaagcccatgaatgcaagatgagctaatattgtcgggttaaatatatttgggccttttctagaaaaagaaaaggtatatgtggacctcaacgcgcaggcacattgaatagtgggccaaagataattggaccgaaaggcccatgggcttcccttaggcaaaaggtaattggagctgacgattgccttgattgtcctttagccatatttatgtggttttacttttatataagttaaccacctccaaaaaattttctagatagaaaacatcaattttaaccgtcaacagatatctacatcacaagtatcacaaaatactattacatcataggggtagaatgtacgtgtgtgtttacatagataagtgtgtggatgttatgagcgtatgtgtttctacgtgtttcttaaaaaaaaaagaagaagaaaaaagcttgcatcatgggtgcatgttggtgagccaacagccaagtagcacaactgcaaaagattccccttttagatggacaaatgacaaacatcaacaggttgaatgaagttcagtggatatgatttcattttcgtctcaaccttcaaccaaagttatattgtccatacatccatgagccgtctgttgcagcgtcgaaaaggcataaaaatcggagcatcatatcgctgaaatgaaagaaaatgactccagtggtcaatctccacacaaccattgccaaatatgttatgttccttgaagaaaacaaataatatgcatgtttaagcaggttaagaaagtcatctatgtaaggtaatgtatatattatactcctatataatttgacttgcatgaatgaacagccgtcgccgattttcctcgccggaaacgaaccaaaactggagcagaagcccacagaatgtcactcaaaactgcccagaatacaggagatgaagtcaccaaaagcaggttttatcatagtctcatctgatgagactgacataactgcgtaaacaaaacgctgatcgaattagtcaaacaaacaaaatcagtgctttaccagtgtagtgtcaattctaaaactgcaaagtcaaaacctttcaattatatttcgaccagagaaaggaggacacatgaagctgcaagtgagatcgatgcaattttttttgaaaaaaatctcaagattgacttaagaagatggccatctcaagattgggctaaaataacatatagcccaattcggtcgtctgcattataggagtattatctgtgccaatgtcaatgcacctcttgtcaaaaacactaattttcttatcccaaaaagattgtcaaaagcattacgtatacatggagtgataatgacaccatggtaataaactagtttacttgtggagtgttgatttgcatgtatactatatactccctccatctcaaaatgtttgacgccgttgacttttttaaaaaatatttgatcgtttgtcttatttagaaaatttaagtaattattaattcttttcctatcatttgatttattgttaaatatacttatatatataatacatatagttttacatatttcataaaagtttttaataaaacgaatggtcaaacatattttaaatagtcaacgccgttaaacatttagagaaagagggagtaatataattgcacacaagagagatactcttgcatgcatgcgtacaaggagatcaggagatcccattggaagatcgatactcctcgttatttctaatttgactggttccaatgcatcatcatcgattcatcgatccaatattgtggcgtcatttagctagcaaggggatcgatgtatttaattagtagtcaatgagcaagatataattagtactctactattattttgtctcctaaactttggggttaagtgcattttgcatctttgaactcttcaacgatatattccaggaagatttttcttataaaatatgctttgtttataagcaaatcgatcatcagcatattcgagtcgctagaagctagcatttgcagaattgcaggactgcatatatttacactgctgccccgtatgtttctgcaggataaaggtcattttggtcttccaaactattttgccagagcacttaacccctgaacatttttccagtttatttaatttacacctcgaattattgaaaacggttcaccttactttataatgctatttcttttttttttctctctgtataagtcaccatttgcacaatattttgttaggactgatagagacgcattttaacttacctttaaacatttttagatttttttttcacttttacatatgtaggaaacaagaagacgggtgtaaacatcgaggttttaaattttaagcaaataattataaaaaaattgaaattatttccaaattttgatgatggcatcatctatggatctaaaaagttttagcttaaaatatgacttgtataaaaaaatagaagaaaaatgctattgaacagtaaagtaaaacaattataatagtttagaggataaaataagccaaaaatagtttagagtggtaagtactccaataaaatagcccacgggagtaaaatgtacttttttttattattagtttgtgtaaacaactaaacacgattaagcttctctactactccctctatactcataaaggaagtcgtttaggacaatgtttaagtcaaatcttgggaatataaatcattaataattctcaagttgttgagtttgaaaatgtaaaaattatatgaatagatttgtcttgaaaaatactttcataaaagtatacatatatcatttttcaataaatatttttatagaaaaaagaagtcaaagttatgttttggagaccgtgtcgctgtccaaaacgatttccattacgagtacggagggagtacctcttaattagaaaaatacactacctccaactttccaagtctctgaaagtgtgcaagtaatgtgcatagactcttgcctgtagaaagaaaaaatgcctagtggcagctggtgttgaactgttgcaattaattgccacaatggatggaccttatgctgttgcgaagagtcctcgtcaaccagattaccagcgctttgcacaatcatggtcagcactagccaagttgctgttgttttgatcattcttgttaagatagccaaacattttttctagtggcaagttgccctttcagatatgttgtctgttgttcgcacacggcgacctcgcattccttcccaatctcttgcagaagaacacattaaactagtaaccaacttgtaattgcactgcagatccaatgcatgcagaatgaaaaaacaatgcacaactgtacaccctatgcagctagctgtgcattctcaagatatatcatgtatatgtatatatatagcagatataaatctgtaagcttcagccaagcatggaattatggagtagtactgtaagaaaatgacttagtgatgagtccattatttcagtaatttaagtattggttcttatccattatctaaaaaaaaagtattggttcttatgccatacacttatactacagagaagaaaaatcttctcactttgaaatacagctcagcgtgcaccatgacttatattgaatacagatatgttcattaagctccctccatctcaatttctcattgttttagcatttaaattttttatcaaaatacttgccattatcacatttaaaagcatttttagaaatgtctgtcccatcctacccttcattatctatgcagtcatacgtacgtactagttctcctcacaaaaaaataattgttaatatggaaaagatgattatgatgtaattaatgaggatagcaacgtaatttgtcgcacctcttagtttaatatgagattccctaaaacgataagtagatggaaatagatggaataggatttaccttgttatatgtttcatagcttatttctcactgatatatgaatcttacgggagagatgatctgaaaaaaatgtcctaacttcgaagtaagtcggtaacaaattcccagacgatgcctatatggtatgaaaggaatggtcggctaacatccaagctagtcactaacttcgtcaactagcttaatgtgagcatgacaaatcagaggctaggaaacaaaaggttatctcagatgatcaagaaccaattggctggtcaagtcatcctatcttttccatgatattgtacacatctggttaatgcgtattgaattcatgacttgaaggaataggagctatttgtgcaaatctagctacctgccatttgtttaacatgtgtttttgttgatttgaacatgataagaaataattatatatggagataatccaaaatataccattgacaagagtctaattaatttcacgttttaccctcgactattgcaagtttctgggaatacgaccatacaaacgtcattaaacgtcattgtttaaggagtgctattgtcgtcactgttccattcatgggctttcgttagccacagtggaaagacccgtttgtccttgtgaaggctgtacacaatgtattgtcctacttattttgataccgttaaaattatctttcagagttcctctccacgcaggcaacccctacgtgtgtgccgtcaccgtgactttcaagcgggttgtatgccgcgccaacacccgtcggccactccgccagacagcaccactgctgccgggggaaggaaagatctacttttctttggcccaccaaagtctttcccaaatttgctttggtaaggtttgtgaccttggtctatgacaatgagggcaatttggttattaatttggataaaattaacatttgctaacagaaacccatgaacggaagggtgacggtgatgacatttcttatataaagatacctgtactaccgtattttcttatacttacactcgctgatggcaaaacgtaaaagagaatcccttatatgccactagaatttgaccagttcccttatatgccacttaaaattggcttctctcttatatgccactagttcaatttttttcacacttttatgccactcccaccactatagttttagttgactgttagtcaaatgttagttttttttcttaaatgaccaatataccctctcaactaaaaaatgtgtaaacttcaaaaaatcataactaatttattttaaatcctttttgagtaaacaaaattttgttagaactagtgaaaaatgctatttatattaaaaatattattggaaaactgcatatttcatgcttatattgaaaatttatttgtgatggtaatggctaaaattgcatgtgatgcagaaaaaatcaattttcatatgttgtatcaagaagctatattagtactaaaatacatattattggttgtatactaattctcaagggcaaatgtgtccttttacaataaagttaacggtcaactggcggtggattgacgggaatggcataaaagggaggagaaacttgaatcggtggcataaaagggagaagccaagttgaagtggcatatacgggagctggttaatttggagtggcatataagggattctctcaaacgtaaaatcagatgcatgtcgatggcatttcttggattttctattatgcatgactcttgttcttcgtatcctcttgtattagactagcacactagcataaagccgtcagagttgagttcctaagcataaaccatttgggatgaccacaattctcaccataggttccgttgttttgagctaatggacgagaaacgcccaggggtcttccggctagctccacaaggtggtggactagacgatctaggttcgaagcctcaccccttttaattatttgatattaggtctttccctaatattcgcgtttttgttttgagctaatggacgtaaaaactatatacattactatttcttagacaaccatttctaatttatttgttaactttatactccctcattccctaaatgtttgacgccgttgacttttttaaacatgtttgaccgttcgtcgtcttattcaaaaacttttgtgaaatatgtaaaactatatatatacataaaagtatatttaacaatgaatcaaatgataggaaaagaattaataattacttaaattttttgaataagacaaacggtcaaacatatttaaaaagtcaacgacattaaacatttagagatggaaggagtaatatattttatcagctagacagcttattcgaatagaccttaagcaaaaccttttttgacgtgactacttttgtggaaaagttagacaaaaacttcagaccattgaaatgttttgcatccccatcatcttagcttttggatgcacaaccagtaacctaaattctagagacagaggttgacaactgtattgttattggagatgtgagcccgtgattaagacagtacaaaaatcctctccggccgccgcaaaaagcccctgaaacttgcagattctccagtcaataatgtcttgtctgcacatcggccgggtcagatcgatcgatcgaaaagtctctcagcaaattctccaagaacatatgctcgatcgaagtgtcgaacacctgtgcgctcgatcgaattattattccttcacacgcggagaagacgaagcaatggaggagtacaacgtcgtggaatcgatcgatcgatcgacggcgacctgacctgtcctgcgcatcgatcgatcgatcgctgcacgcggctcgcgatcagccaagtggacttacgccgtcagttcgtctccaatgccaaattgccaatcaaaatgcagttggatcgatcgatcagttcgtaactcaaagcattccagttaatggggcataataagccaaccaatcatcaatcaatcaatcatgcatatgccgtgctgacgctttacacgaccgtgcataatcgatgattagtgtacggttaagtactcaagggagcagccatctctacttaattggttaattatagttagcagcagctgaagctgcgctgtactgaagtttcccttgccgatgtttctcccaacaagatctcccaatgcgatcagacacaggtaattaagctagccatgcacgcatgggtagatgtgtgatacgcaatgcaacaaattaaactcgagatctgctgctactgatcggtgaggtttgcagtggttggggaggaacagcaaatatcaggccaacctggcaattcatattcaggcaaattggcgagacgagacaggggaatatatttgccgggttcctgcgttgcctgggtgtgcctacgtgtaactaacgtgttggtgctagtgtggttgctgcttgctgctgactggtcgggcgagagatctcttttggttcccgtgctattcttgtcgcgccatggtaggctggcatgggaaattctgtcgtctcgctgctgcaagctaggccgtgtcagcagaggttgagccggaacagatccaaacatactggagaaacacaagtggtgtggtgtggtggtggagttatggtgcatatgacttcacccatcaaagtttaaatcatggtgtccacagatattacgtgcatataatatgtacgtgtgcgtctgtactctatcgtataattttgtttaaaaaaattcaaacatactccccgtccaaaataaaaaggcttatctcttaaaaaaaattagtaagaaagaaagaaagtgtccagtattaataagaaattaagtagagtatcgatgggtactaagtagataacatatactcctattaaatagacaaaacttatccatttatatgtttcttctatccaaaagtattaggcatatttttagtttttagtttttctaaaagagatgattatatttatagactatagtttctatatgctagatcataacctaaggaatcatctggcaatattcatttgttgtatgcatgtataaagttctttgattttgttacatgaggttgagttaattcctccttgattttggtgacaaagaatatatgtcttgcatttttgtcgggagtactaattatgattaagagtgtaatcaacctgttttgagataaattttgaactctaaaaattaatttattttacgaaaaagagagtagagcggaactaccatattcattaggctaaactccaaaatttacatataatttcctactagcaattgacatcggaagtgaagtgttaagtgggtttattcggttgaatacggaatacccatgttttagaaaatagctctctatttaaacttaaaactagcgagatatatcttattttcatcactgatatattatagtataaagtttgaatagccaccatcaaaatctaccacacgcctctagccaagccgccaaggtaaggatggactcaacattcaggggttcataaatacagccacgcaagtcaccggagatgggaggggagatgccatggcagaaacattgttgggtaataggtgctcaaatttgtccctttttagtgtgtagatcaagtttgaacttgagtttttgtggagtgaagaatatcactctgcattgtcaaatttatttttgaaaattttcacagccattcattcatatttaatttaagaaaaaagaggtatatgagggacatgcactcaagtgactaaaatccattttatatccaatagtaaaattcattgacatggtcatactgatttaatatgatcattgccaggacactcggatttgacgttgtacatacatgatgcgcttccaaaattaagttacatcgaaatgatgatctcaaccaaataatttttcttatcctaacatgggtggttccttatagaagtgctatttattcgacgagggtgaccgattaacgtagggttgggttgacatttatatttggggctttattttccattcaaccatggacctttctggaaaggattcagaattgattgtagttttgataattacagttcaaccatacggtatataaatgaaaagaagtcaaagcaaaactgaaccacaaaagtcaatcaactaaaaaaatgtccagagtgatatgcagttaggatatcacttgaacaaccagatggggagcatggcaagtttgttttttctttttcgagggaatggcagtttgttgctgcaaaatatttttcaatttagaaatactgaacccctgttggatcctagtccttactgttactgtaacagtaatattttagagttttaaatttttttaaagcaataataaaagtaccaagtgtactcatgcgtagggaaaaaaatcacagcaagaaaaagtatccattattaacaaaggagttatgtaatttttttgtaggaattttacatgaattccctaggagctgagagacgatttgatctcatgatcatctaactggagcataaggagagaattaaccttgaatgagctagaccagtcttatctgtattaatttgtcgtctctccaacatgtgagagagacaaatttggttacaaaactaatggtacaatagataaatgaaacaagtgtatgtcaccacttaatccccataatataactacctttgcaactgataaatatgttttttttaataatttaccaaaaaaattacttatacttcctttaatcaattaactaactaattaaccaaattaactaaaaattattgctgttcttgctgctggcagctagcttgttgctttgttccattccacgtgtccatgaagcggcttatcctgtggagtgcaagatccagcgtgtccaagctcatgttggcgaagcacaccctgaaccagccggcctccgagcaatggcacgacgaccccggcgagatgttcagcttcgcctggcgcagcagcttctcccacagcctcagctcgccgccgacgccgccgccgccgagcagcagccgccgcatgtccatccacacgaacagcccagcattgccgcgcaggcacggcacgccggcgcgcgccagcccggccaccacgtgctcgtgccgctcccggagccggcggcggttggtgcggatgtactccccggcgaacgcctcgtcggacagcatcgccgccagcgtcttctgcgtctgcgacgacaccagcgtgaagctcgacatccgccgcgccgccgtcacgacggcgtcgttgtaggagtagaccacgccgacgcggaaccccgggaggcccaggtccttggagaggctgtagacgatgtggacgcggccggcgatgccgtcgccgccgcgcgcctcgacgagctccgccacgctgacgaggtccggcgcggcgaagacggagccggagtagatctcgtcggagatgaggtggatgtcgttgcgcgacacgaagtcgaggatgtcgtcgagcatcttgcgcctgaccgtggtgccgagcgggttggaggggttggtgatcaggacggcgcgggcgcgcatccccaccgcggcggcctcgtcgtacgccgcctggagcgcggcgaccgtgacctggaacccgttcgcgctgtcgcaccgcaccggcacgatgttcacccccgtcctccacctcaagtccctgtcaaacctgcacgccatggatgtcagctcagcctgccactctgctcgatcgatcccaagctagctagatgcatggcaatggcaatggcaatggaacagtggcttacccggggtagtaaggggtagggatgagcagggcgtcgccggggttggcgaggatgaaggtgaggagctcgttggcggcggtggcgccggcggtgagcacgatgtggtcggggtcaaacctcgccttgccgccgcgtatcttccccatgaagctcgccatcgcctgcaagcaacaatggtggccaagcaagccgccgccatctcgatcagtccaccatgcatggcgttcgagccaagcaaagcaagaattgcaaactctctctctctctctctctctctctcacgtaccttcctgaagctcttgaggccatggtaatcctggaacagcgcgttgtccctgaagctaccggcgccggcgccgccggtgctccagccggcggcctccgggtggtcacggaggtaggcctcgaggaggtcgaaggagacctggttctcggcgaggcccatctgtatgacgccgtcggggttatcgacggcgtggtaggggtcctcgtcgtaggccttccacccggcgaagtacggcgagtcctcgccgtgcgccgccgacgttgccacctgcgacagcggcggcgccgacccggcgaacgccgcagcaggcaacagcttgccacccatgatgttctctctcgttctctcagactgaattaatcttgcagtgcaaaatttatatgcaatggcagtgtaggaagcaacactgcagtacaagaggcaatcaagcaaattaaggtttttgggtgtgtgagatgagatgatccaaggttccaagtgtgggaggggtatatataggcaaatggaagtatatatacctatgtgaaaaccactcatgatcatgtgattgagatgtcagaggctgctcatagctgtatgcatataggagggttcactgttgagagatgaccggacttttttagctttcagaggattaaagaattggagctcgagcttgaccaacctatactaactactaagcttgatgattctttttgcccaatgattgattgctcactctctctctctttctccctgactgacctttcagtaaaggaggaagttagcaatacagacagtgtagcgtagtacagctgtaatcagaaattcagatcgtcgtctgcaaattaaggcagcttccgttgtcgccattctccggctgatcgaagaaattcaacagatgcagcagcagcagcagctcaagccgtcaagcccgtgcgatcgtgtctacaggtgttacgccttatcttctcctttaacccaaccctttgtttaatccaggctaatgcccacgtcgtcatcgtcctcttcatcgtcttaacaaaaccagctaagaaaaaaatttatgactatagctctgttaccatattaagttttaatttatcgtctgcaggtttgatggttatgaatgtcactcggagtaaaggtaacgaaggcatttaaatattttataatgtgtttgacctccaaatgccagcgattaaacaaggttattcaaccctgtaaccatggacgacttgtctagctagctatctcgagctgtacgcggggctaaggattgcactgaaattaatctcatatttaaacaaaccgatcagcaatactctgttgagatgccaatcaaccatctctccctcgaattaagaatcaacatatataaggatggcctctgctcaccgattacgagaccagccatttgattatgcacctcatgatccacgaaagtactatgatagtacatccgttgccgaatcattgcatgttgcaccgcgatatatattcacaatcttttttcagtccaaaatcctgtttgctatatatattttgaattatttaggaccattattagttatgtattacaaggtgttttagttttatcgtaagttaaacttcttcaactttatcataggtcaagtaatatcgacaacactaaattaatttatttaaaaccaatcatcaactatatcttgatgatgtatttatttggattatcaatgtcctgggtaaaccttccattcataaatataacgtggtttacacataatgtcaataaccaaattttaacttaaacatcagatacttatgactgaaagaaaagaaaaaaaatctctttaataaaatttatgtctcgtgcagaatacaatacgatttcatctttcgtttcatcagaaaaaatctgggacggaaggattcgaacctccgagtaacgggaccaaaacccgctgccttaccattggccacccccatttcgggttttatgcgacactaataaacagtattatgtttatttcttattcgtcaatcctacttcaattacataaaaatggggggtattctcttggtaggattctagacatgcgaataatatagaatccaaaaaatacattgatcattacatggaattctattaagatattatatgaaagtcgaatttcttccactctcatttgagagtacgaatacaaggaggtattttgtgtttgggaaagtccgtttgagaactctatccatagagtagtataggccatactttctttcttcctattttgattctcgtgaagtgtcctttcttcctacagctgatagggtaaaatcgttgttttgacgatccctatgtagaaagcacccttttctagtaaatattagaaaatttgatcctttcttatttttctttctatagtggagatagtcgcacgtaatgacagatcacggccatattattaaaagcttgtggtaagaaggggtttcgttctagtgcccggaaataatattccaaagcctttgtgtgctctccattgtttgtgtgtataaggcctatgttatagagtatataacttcgatcatagggatcaatttctagtcgcgtagcttcataataattttgcaaagcttccgcataatttccttcggattgagccaacacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcagagaaaaagaggtatttttgttcatggaatattgatagagaaaaaagccgactatcggatttgaaccgatgaccctcgcattacatttatagtgtaatgtgatgcctccggtactacttgaaccgtaaaatttctcaacattgaaatattgtttgcatgcttggaaaatgcagcgtataactactccctccatttcaaattgcttgtcattatagctttattagtttatcgaaattcctatagtttaatatcataaaattcatgtttttagattcactaaaagaaatatatttcatgttgttaactatacgaatttataataattggtcaaagatatatcgtttgacttaggataaaattaaaatgataattaatttaaaatcgatggagtagcttacttggaccaaacctgtcattaaggagtacgaaactttattacaacactgaacctaattgaaaaccagaaaagcttcaaaacctagcagctggaattggcacaagaatggaaacaccgcggtggttttgcaaatcagctttggcagaagaaaagagaaaaccacggaacctcttcgacggttttgggaaattgacatgttgtatatttaaatattccgccgtgcctgattgaaaagcaacagcaaataatcgacaaaaattaagtggctaaccccacgtcagcaacataagcatcaccggcgttggtagcactagaaaatggatggcagatttcggcaatgtttgatgtctccttgttgccatatatggttgcacttttgggggggtaattaaacataacaaattgtagttaggtgctctggttagtttaattcatgttgccgtttaaaatgtccatatgcaacatgcatggtttccttagttagactttgagaaaaaaaattcttgagcattatattaattagcaaaattattgttttcttaagtaagctaaattttgtgcatgcgtgtggcccttgaaaatgtaaaggtaatcttaatcgtccttgaagatcttgtttatttaaagacaaaaaaaactctttttttgcagtgtttttggtgggctctgaagggagaaatgtggattagtctaatgtcagacaacaattcttcaattaatccctgcagggagcatttcctaccttataagcagaatcaaatcaaacatgacatctctgttaggtgagtttccagctgatccctgctaattccctatggatccaattgctagcttgcagaatcagatcatgataaaaagtttcttgattacaatctcatcttcttggcattacctaagatacattacagattgtcagttaggtgccggaggagtctacgcataattttaagcaagaaatgcattattattgtacattatgtcatgaagagattggctcaaacacaagctgtgatgtactaacaaagctgagtcttggagacacttggcagagtgcatatacgtacgaaatacgtatgtaaagaaaccatcgtataaacatatatacgtcgtacgttttgagttccagtcaatgtgcaaagatgtccatcagatctctgcatgtccattaaattggagctttgacatgtacacttatttagcttgatgccatgctaattaatctacagatagataacattaggtttaagataatgccataagcatcatcctctctctgattgatcagaccagtgtatactccaacagaattgtatatgtgctcatgtgcaccacttttgagaacactagctagctgtctggtgtgccgtgtgctacccaaaaggcaactacgacagagaaccagctatgctacaactttatgtatgcataatgaaatttgacaattaattagcacacgttggtggagtagttgtttacatttgattgtgtgattcagctggatcttacacactacagtacaagtgcagcacaccacttcagagtccagcaggcatatgatgttcctgcaaaaggagagacaaccaacaaacagagatgatctcctatagtaattaacaagacaattatacattattgtgctactgtcggcaactcggttaatttgtttacgtatcagacaatatgcagttcatgaacttggtcacttcccctttgcttggttaaatggaagtattcgaggcgttaacaagtgaacaagaagacgagcaccaagtgccaactgatcctataacttgaaacctgaatcggcgagaacttctgcaaattgcatcctcagctgcagtaaacatcgtaataatatttactgtaattttttatttatagataacggaatggaacctaccgtgaaagcagacggtcaaaaaagaaaaccagagagaaacgtgtcacaatacaaacagtatcagggtctcatcggatggtttgtttggctgaggcttgggcttaggcttttcagccaacacagaggggcccgcatggaagttggatcatatgtggtggctaattctaggaactctctagtggctgtacatggaaaataaaaatgccaataccacaaactaggagctacaagcaccggacataaaagatccctcatccaaccaattaaccaattaacccaaccgatgaaatggctttgcctgaattgaaaagggcttatttggctgatcagcctaagaatacaacttaccgatgaggacacacggtgtccttgtgcaatgtctatacgtcgcactccatctttaccgtgatttcagcacgaagtttttcccccaccttctgcagaaatggcacatccatcctaggtgttgtttatttcactgaagaggtagataaagttaggccatgtaaacaagaaaattattagcgtataattaattgatttttaattattcaaatttaaaaaataaatttatgtaatatttcaaaatgacttctatataaaagtttttgcatacaatgcaccattttacagttaaaatacgtgctaataaaaatcgaggtaaaatctgtgttttaatcagaacaactcactagactaaaaacagctatagagaggaggaaaaagaaaaaaaaaagaagaaatctatccaccacaaaagcatcacaagttgtctcctgtctttgtacaagaggggtttgcgatatatttcgcgggacaaagagacattggagactttatgttctctttccccaacttggccaagtggggttcaacatgtcggcgtaggataggaaatgcgatgtagtcctgtgtggcgactctccccggagacggtgatcgatggatggatacagcgatgaaagctgagtagttttggagacagatcgagaggctgattcccgtacattggaccgtggcagtgcaaggcagagcagatacatgaatctgattacgatttacgagttgccgatttcgtagctctaatttgcagccagccactacagtgaaatatagagaggaccaatagatgatagcagctgcagcctgcaggctcaactcctccaattggtcagataattatctcgacagaatgaacatggccagattcaacctgaccctctcccgcgacaccgcgaggccacaaaccgatcgaattggagggatattgggaggtaaggtggagcgagattcattcatcgccggtgacctcctagagggccttgaggaggaataggcattagggcgtggaggtggatggacgtacattaccattaccactgtcgatcgacaacaaggccaagattagcttcatgtatgaaacttgatgattcatagatgagggacgttaaatgtactctttccatctttcgatgagtgtgggatgggtgggccgtgatgggcttttaggtcaatctgctagcaaattactacggtttcagcccaatacatataaatgacttagggctggttttgtttgaagctaaaacttatcacaccaaaatattggtatttttaacggtaattttggcaatgtttggtttgctgccaatactacacaaaatgttgtcaaaatggtgatgctagcaaaaacttgtctatgttttgtattgccaatattttagcatggttataaccaagcaagcctttgtagattttgagctcctcggatcgtattgtatgtgctagtagcccaccaccaccactactactaccacttatacagtagtcataagagtatgtaggccccatttgtttctgattatgatgcacattttagctcggtttttattagcatattttttaaaccgctaaactttacatttcatatgaaaatgttctaattgctataaaataccaaataagtcattttttaatttttataacaattaaaacttaattaattatacgctcttacgttaccctacttaattctcatcttcgtctgttttatcaatttagccatagtgcaatactcagtactcaatcatttctattataattgtagttgtgagtttatgtagttcactcctagtactctccgtcctaaaaaaacaaaccatgggttttcgtgtccaacgtttgactgtccgtattatatgaatttttttataattagtatttttatttttgttagatgataaatcataattaatactttatgtgtgacttgtctttttaaattttttttcatgattttttaaaataaaacggacggttaaacgttggacacggaaactcacttttttttttcgacggagggagtactctctaagccgagtccatgtgcgcgttcgctgacacacgtctccaacgcaaaaaatggagtactcctaccggtagaaatgtacagtactcgcagctactcctgcgatactgcgaggtagcgaaacgccatcgtacgcacgcgccggtcgggcggccgatcaggaggaggcgcgacaggatgggacgcgacgcgacgctcgcgcacctcggcacctgtatatccggtggtcggcccgtgcagccaccgcgagcgtcctgggaattcttaaacgttgccacgtctctcggacaagatgggaataaaatttttttagtctctatcatattcagaatatttcgacactaattataaatattaaacgtaaactattaataaaacatattctatatcttgaactaattcgcgagacgaatctattaagcctaattaatccatgagtagcctatgtagtgctacagtaaacatgcgctaattatagattaactaggcttaaaaaaatttgtcacgtgaattagctctcgtttatgtaattagttttataagtagtacttcctccattcctaaatgtttgacgtcgttgacttttttaaatatgtttgatcgttcgtcttattcaaaaaatttaagtaattattaattctttttctatcatttaatttattgttaaatatacttttatgtatacatatagttttacatatttcacaaaagtttttcaataagacgaatggtcaaacatattttaaaaagttaacggcttcaaacatttagggaatgagggagtatatgtttaatactctaaattcatccgatatgacatgggactaaaatttagtccctgatttaaacaacatctcattgcaacgatgttactactactcctgctgtaggagtactcggcatggcatatgcagtttgctctttgtcttgcaaacctggatggcctcctccatcgttgtgcaatcggtgctgcacacaactcactctgccgcgtcctgctcctgcatgaggtctgggagtgggagggagaggctgctgctgccgctgctgctgcagaggctgcagctgaagaccgggcactcaggggaatctgggcggttggcctcctctgccggtggcagccacagccacaggagtgcagccgcaaactgacaatttcctgcactccactccactgatccacagcatcagccagccgttgcccagtccaacccctgcactttgcactgcatctgcatctccatctgcatgccacgccacgacgtgcctgctgcttggcttggcttggcttctgttgccgtttctctctgctgctgcgacttgccaaacccaaaccccagagacagagagagagaagagagagctgtgagattggttgtatcggactttgtcagttgggcaggagcatatctgtacgagttgatgcctctccttccttgtgtttcatggcgtgccctgcgactccagactagctctacagtagtagtactgccctccctcttgtctgtctcccggcccagcacgttcagatcatttcagttaccactcgagtaagagcaagtttaatagtatccagccacatgctctaaatcatctatagttaatttaatagctaataaatacaatagttacctataacatatagtacacaattaatacatagtttttcttatcatacgcacatgtatcttggagcccatgctacagctggctataaatctatagcccgctgctcttctctctcttcttttatctttttaaaatatatttataactggtttgtagtctgctattaattgtacctgctctaataatcatagatcaacgttccttctatacgccgcttttaacaatacacagcgtacactacaggagtattactcatgtactccagttcaccattctgcatttgtcttctcctgctctggtgcccggttaactggcctaatgtattcctatggaaactaaacgacatgcactgctaaatcaatcgtggcatatctaatggagttcaattacttccacggactaaggccataatattttctgattgagacgtagatttcatcttgatattttagcatatgttttttagactcctatatatacaatgagttttagtaaaaacattctatataaaagatggaataaaaaattttaaagtctaatcatacattaataagttatctcgttttagtcacgctaaaattctactattatctttatcgaaacgtacgcttgcggagtacgcgcgggatgaatgtgggcaaaacacgcgattcacggtacacgtaatagccactcctcatggttgatgtatgtctattcgatcactttgagtactgacccctgatcactacttcgattctgacccggcaccccttccaatcgcatactacaccctacccaccgtgtactaatcgcggttgctctattaattcaaaacgagttttacacggtgctctgcaatatttcccatgtgattatatatatagcattttggcaagtgaataaaattgttctcttctcaaacacgtaaaaggtttgtacgtcaattcattaccaatagtaaaaagcaccatcagacccatcatttcggcgtacttgtaaacggaaaataatttgtgaataaaacttttatatacgtgtcttagcgatctaaaagcaaaaactgaaaataaatttcgatgaaaaaaaccccgaaatcaactctggatttaacgatcaaatattcaaattttagctgataaatataagcataagcaaaaagataaacccacaattctatagaaagagtagtaggagactaaaaataatgtggtattacttgtaatacacccatcatgttgttgtgatgggcttagttagcactaaactaatgacattgattgcattggcaatcaggcactgacacaaggatccgtatcctttgtcctatagtgcagtactcctagagaggtgaaggagagaagagaatcaaacactgatcagccatagctgccgcaacattctgcagcaacccaaccaacaaacccaccctccgctttgactggcggtttcatttcagcaaccctgcaagccgcaacgctttttgtcgccttcccaagaatagaagtccggaccattcaaacccagtccagtctccctctctgccacctgcccccacctgtccctgctgccacactgcgccgcgacgccatcggagagcagctcggagctcagagatgcttcttgtacatgtcctctcgctccatctcttccacttccacccaccttgtcttcttcctccacctcctactacttatttgcctcatcaccgagaacgccagtgccaagcttctttgtcttgttgcgtttcttgaatcttcatctcttcttttcttttctggtaatggaggtggcggaggggaggacggtggcggcggcggcggcaggtggtggaggattgggaggaggggcgaggacggaggcggaggggttggcgtgcccgaggtgcgagtccaccaacaccaagttctgctactacaacaactacaacctggcgcagccgcgccacttctgca

SEQ ID NO: 66993 - DNA, 74145 bp, Oryza sativa
gcactgcttcaaattgtatttcattatctgacatgctgatgtgagtgaacttgaatcttgtcatatgcaatctacagaatgttcacatggtggtcaagtttcaactgcctcggatgtttacagctttggagttgttgtcttggaaatatttattcggagaaggccaactgacgacatgtttaaggatggattgagcattgcaaagtatgcggagatcaatttccctgataggatactagagattgttgatccccaacttcaactagagttggacggccaagaaactccaatggcagtcaaggagaaaggcctacactacttgcactctgtattaaacattggactctgttgcaccaagatgacaccgagtgaacgcatcagcatgcaggaggcagctgccaagctgcatggaatcagagatgcatatctcaggggaaactgaagaagcagtgcagttacctcaatggttttggttttgtctgaacgcattatatattatatatagcattatactagcatgcatgtgtgcatcttgttctggttaaatagatcggtattgccttgaataaagaagtggccattgtcctagagcagcaaatgtttttagattgctgtttgattcatttctaattttgaaacgaggttacataaacatcaggtgtttttcgtcgttcactgtgtgagttaaacttgagcttgtactgaaggatgaaatcctacacaaaacgacatcaatactcttgttttttagcagtttggaggtttggtcatctctggcagactggtactaattgaacctactcctatacggctaatgggttcaataccgagatacagtaagggacacaactataccgagagtgctagctggatagtgctatagagagacacccttctttcaaaaaaaaaaaaagctcactcaatatttatgtattttttttcttcttagagaagtttctcttaaattacttatccgatttataattcgattataccgttgtgttcgttgcaattaaatctttacaacaagatcttacataattatattttgatgaaaaattatatattacttttatcatatatctaaattacctttagatttcactaaattacttcttaggcatataaaagtaattcaataaaacctaaaagtaatttatatatattatagaagtaacttataacaaaaggaaagtaactttaatgaatacctttttccataggacatgaagtcatattttatccatacaacgaatttacttctaatgtcgtgacaaagttacgtccgttttattttaagttatttttataatatatgtaaattacttttagactttatttaatttacttttatatgtctaagaagtaatttagttaaatctaaaagtaacttatatatatgataaaagtaaattatgtatataataaaagtaatttacaaatataaatatgttttcatcataatataattatgtaagatcttgttatgaagatttaattgtaacgaacacaattgtgtaatcggattgtagatcggataagtaatttgagagaaaactttgtttgaagaggaaaaagggcatgcatgcatgtcgtacgagtacgatgtagtagactccatgtcttctccatatttaggtgtcgctggttaagataaaaacgagaggcctctccaaatagatttcacgtacaataagctattaggctaagcattattttcaaaaatacctaaaatacccttgcagacatacaaaattaacaattgatttatttcattagaagtttaaaaaaatatgaaaatttttacgtggcctcattacacaacatgggagtttgtatagatgtttcaagtttttttctggtatatttaatttttagaattttttttgtggtatatgagagaaaatttgcttatacgagagaaatatcttgtgtagtgtatgaaagatgatttatattaaaaacatcaataaaaaatattttatacagcatataacatataagttatactttttctaaaaaaatataaatgtaaaataacctatatacaaacttccatgttttgtaaggaggccacacaaaagtttggtaaaatttgctacagagtatccttctaaaatttgctataagttatacattaaacggtaggagatttgccgtatatattagaagaaataaaaccaagagagtgcagaaacgaaaacaacaacaggccacaacaagtcctgtgacagaaatttacaacccaagggaaaaaaaagactgtgaaccaggttctatcaacagcagtagagcctggattggttgattaggtctatattctctttaattagaaaggccacctgaagctcgctttttgaagaatcctggaaaatcctcctattacgttctaaccaaatattccaccacgttgttaaaaggacactcagaatttgcttccttcgtgatttaggcttgatcgtgcagagggtgctccaccagtcttcaatggaagctgctgtatgttgatgcggtgcttgaatgtcgaaccatctactaacatggtttccaaaccaaaatcgtaaaggggcactcttttgctagatgtgtggcatcctcgaaggccccccctgcataaactacaaatccagtagtttacagaaaacatgattttctctaatgatgttacagagcgacaaatatttatagttttgccgtttgatttgtttcttttcatacgaggtgatcatatttaatttacatcatggatctcctagttcatcgttcattaaattcatatatgaggccccattacaaatattcagaccgctatgattggtgaatttgtggatagatgtataatgtaaaacaaaacccgtttcatattataagtcgtttaatttttttctagtcaactttataaaaaatatagtattatttttaatcaaaaaacaaacgtattatcaaaatatatgtaattttatatccaataaaattaaatttgatattttagatgctgctaattttttaataaatttgattaaacttaacaatgtttgactaggaataatatcgaacgacatataaatatgaaacggagggaataccaatcaaggccactgctatttttttcctttcatctttaaaactttcatccaagattttatatgaaaaagtatccgctaagaatgcacgttccaaataccaatcaaagcggcgcaaaaaaaaaagacagaattgtaattctgggctttacgtgggccgtaattggacccgtcgatccccttgacggaaaacccaaccgacgccgccgcccgatccatcggcggccggcggcggccggtgggtgatgctcggcggcggacacgaggtcgaggactccttcgacccctgcttcaccgacgcccacaccgtgtcgccttcccgcacctccactccgcgcctcctagcttccgcctcgtcactccgccggcggtgtcgccctacgcgaccacatcgccggtgggcggtggcgtcaagctctgtcagggcggccggagactccgcgctcatccggataacctgcggatcgccggatcatctgcagcatatacaaggtaaagtaaaactactatctcccatttaattgctaggttacctaaataattgttagtacatatctgaatgcactactctacgattacaagacgagaaggacttattatctcataatttaattgcaggattattattatggaaaattacgggtctgagtggctgagattttcgtttctgatgaatctcactgatgttgaacaatgatcacagagcaagtcgcctgctgtcgtgtcgtcgtctcaggttaatcgtatcccagaatggagttaacatgggaccgatcaatccaccaattgttagaatcatataagaattcctttcaaaaaaaaaaacaaaagagagaaaagaatcatataagaattacttgtggaactggaagtataataaaaccgttggcgtcatgttgtcaagggtagtatactgtatactggagacggaggctacattattggccacttggtcatcaggtgagatgaacaaacaggttagctctacatagatcaataatataattgcctaatcaagacaaaactatggacaaaaagttaggtaatcctccattttcactgaagattagcctcctctctgaagaaaaactggtgttgagttgaattccatgggctggtagctggttgagttgaaggccttagcttgccatgatagtgcagacgccatggctcttactgctacaaaaatgaagcagccgacgatggccacgaggctggctgcaggctgcaccctctcgctggtaacccctcacgaatgcatatattgattgatcttttaatttgtttctatgttcatcattttgttagttccatggaatagtatataaatgttggatcaatcgtctgcttttggggattgtatggaatgagcctaactatacctacaggcttgtttctgtctgtaaacttattgcgtactagatacagatgattagaaacactatatttcccttttttggtgagattgtcagaaattattacttctgtgttacctagaacttatttgttcagaatatcagatagctttgctagctttctggctttcgtcctcctttcaggtctctgacactagagacttttattttccaccgattggtgatcatttatcttgctataagcctttatgtttcatccctgactcttctgtctcaatggcagttggattgatcagcccgtatcagcaaaggatttttcatgttgctgaatcttgccagaggaaaggatatcaattctgtctgtggagacgaagtaaataagaacaaaagctttcttggtactttacatttgtctatttgccaacattctctaaccatctaaaacagcttctgaaattttaggctcttgcatgttctttaaaaaggattactaaccgatatgtattaatccctttctcttttgtctatgcatataagcaagacctaaatttattcgtccaaggagctggtcatgaagatcactgcaattgggttgtttttgttggtgcttatagcgagctgtcctgtccaaatcttctgcagttcgtcgtatggaaacgagacagataagctctcactgcttgagttcaaaaaggcaatcagtcttgatccccagcaagccctgatttcttggaatgacaccaatcacttttgcagctgggaaggagtcttgtgcaggaagaagacaccccttcgtgtcatttctcttgaccttagcaaccgaggtttagatggacaaatctccccttcacttgcaaacctaacattcctaaaatttctttacctagacacaaattcattcacaggagagatccctctatccctcggtcacctgcatcacctccaaaccctctacttgagcaacaacacattagaaggaaggatacctgattttacaaactgttccagtctcgagattctattgctcaatggcaatcacctagctggacagttgaataatagctttccttctcagcttcaaaatctgatacttgcagaaaataatcttactggaaccatcccttcttctcttgccaatatcacaggactaagaggacttagtttcatgtcaaacaatatcaagggaaacatcccaaatgagttttcaaagttcgtcatgatggagcttcttgctgtgagtggaaacatgttgtcaggaaggtttccacaacccatcttaaatctctctactctcactaatctttaccttactttgaatcatctaagtggagaggtaccatcagatctccttgactctctacctaatctacaagaacttctactgggtcacaatttttttcgaggacatatccctctctcattgggaaatacttccaacctacgtttactggacatatcaaataacaatttcaccggcattgtaccaagttccattggcaaactaaccaaattgtctttgttaaatactgaattcaatctactccaagcacacaaaaaggaagattgggagtttatgaacagtttagccaactgctctagactacaagttctttcgatgggacataaccgtctagaaggccatctaccaagttcgttagggaacttatccactcatctgtgacaacttattttctcaggaaatcagctcaggattttttccttccggcatagaacacctctccgacttgaattctttaggactagataataatgaattaacaggttcccttcctgaatggcttgagaatcttaaaaagttacaaaagttaaccttgcaaaacaaaaatttcccttcctgaattgcagttattccgtcatctgtttcgaatctgtctcaactagcagttctcggactatattctaacaagttggaacggcacataccaagcttcgtaaacctgcaaatgcttcaactactagtcatttccagtaataatcttcatgtcagcataccaaaagagatatttagtattccatcaataattgcaattgatttatctttcaacaacctagatgggcaacttcctactgagattggaaatgctaaacaactcgtatctttgggactttcatccaacaagttgtttggagatattcctaacagtttggtaagttgtgaaagtttggaatacatcgcgtttgactctaatattctcagcggaggcatcaccacttcattaggaagcatgaaagagaggattaggctttcgacccaaaacgaggaagaattttcattaaaattttttaattataatgtattgcgatcccaatatttcattatatttctcatcctccaatagctattgtattactttaaaaaaacatcattacccgttgcaatgcagacattttttttagttttataaaaagaaaaaaaaggacatgcctgacctagcaaaatagatttgtagcttgttgttgttgctgtagttaagtactaacacttctctcatgcatagatacatgatgcaacggacctcgggtgcggtagaccccgcggtctcaggcggtccactgtccagcagcggcgataagccaccagccacacatgaagaatcggcagtggtgtggagctttgtttttcaaagtcaacgggaagtcctcgcgcccaaggaccattaccagatatgccgagcgcgcaatgtggctgtccaaacccaaacaagcctatccggttggttatcaaccaacaatgtggcggagacaattggccagaaccactcatgatggccgctcatttactcaatggtgtacaaaactacttgaccgaaagacgcgcacaaagctagctagtttcctctgagatatgaatctttgattccgtgtagcttggcagcaacctcctgcatgctgatgcgttcaatcggtgttgtcttggtgcagcagagtccaatatttagcacactgcgcaggcagtgtatgcctttctccttgactgccattggtgtttcttggcaaaggtccagctcgtgttgcagctggggatcaacaatctctagtatcctgtcagggaagttcatctctacatgctttgcaatgctcaatccatccataaacatgtcttctgttggccttctccgaataaataattccaagagaacaactccaaagctgaatacatctgaggcagttgaaacttgaccgccctctgagcattctagagtttcatccagcaagagttaagttcacacaaatcagcatgtcagataataaaataaaacttgcagcggtgtaatacaagaaaaacaaactaatacctgatgcgatatatccaatggttccctttattgctagggaataagttgagcttgaatcccctagagatggtgttgaagaaccggtcttgaatcttgcaagtccaaagtctgcaacatgagcaatcatatcatcatcaagaagtatgttgctaggcttcagatcacagtgaacaatagttccttggttgttatggtgcaggtactccaacgcatcagatacatcgaccacaatgcttatcctctgagccaatgtaatgtggttcagatatgaagtgttttcatcattttgtgctgagtgtagtaatgcatgcaagtcacctcgtcccataaactcataaaccaaggccttaaaatcatttccttttgaatcaatacttgcacatgcagttaggataggaactaggttgcgatgccgaacatttctcaaagtattacattctgcgatgaagctcttttgtgctccccttgtctctaggttgaatactttgacagcaaccatattatcatcttcgaataattttcctcgatatacataactgtatcttcctttgcctatcaaattggatgttgagaacccccctgttgctctgaaaatcatattgtatgaaacttggggcaaatgcctagcaaacgagggcaaagataaagattttctgttctgttttcttctccacataagcacagtaaatttgaccatagaaattgacacaatgctggctattgggatcactactttcagtattattgatttcttgtgcttagatgaaaccaaagccatgataggacatgcttgtaggtgtaactcaggtggcccaccacaaaggccctgatttccatcaatcctgaaagctgttgcattcttgaaaattcctttcgtgggaatctcgcccttaagatggttgaatgacaaatctagttgctcaagaaattgtaaattgccaatagaacctggtattgaaccagttaaattattgtttcagtcacagtctagtccgctacacttttctgctcaacatgtctctctttggcctagcccgcaattggagctataagcccagctcgcacatactgtcgtgttcaagctctagaaagtagtcccatgcaatccccccatcaaattcggccaaatctttctcaattttttaaaattgattgagggcttttgatgcactcgaccactctttttgtttttcccaaaattgaagtgaatcagtaacactcgggataaaaacatccagggaagctccagctgccggccatcatcggcaactgttaaataggggattgaatttggtgaattaaagcagtattgaaagggaaaatcacgaggaaaacaaagatggaggagtgaggaatcgatttttacaatcaattaaaggagtaaacgtacggggaggtacatgatgttgcggtggctgaggcgcgctgcgcacgcggatcagaccggaggagatcgaacaaaaaccgggcaacgaaaaaaatgttccacgtgaaaaaaaactgcgaaaaaactagacggccattgaaaaaaaagggcgacaaaataaaaaaaaaacgagcggagacggaccaaaccgtaactcacggtattatgaatatctaagaagtaatttaatcaaatctaaaagtaatttacatatatgataaaattaatttaaatatataataaaattaattatatatatgttttttatcagaacatgaccatgtaacatcttgctataaaaaattatttacaacgaatataatgtataatccgattgttgatcggataagttatttgaaagaaattttatttgaagcttacctattaggaatcttttatttatactgttgcatgcttgcacactttgacgtgagaaaaagatatattgctacattttaccatttattggtataatagttggttttgattaattagtgcacatgtactcggagaaaactacacgtcgggcgctcgatctgggggtggggaaatcgggcagcatgcaaaactaatttaaattgttttttctcttaaattatttatccaaattatgatccgattacaccattaaattcgttgcaattaaatctttgaaacaagatcacacatggatgtatttcgacaaaatttttttagcttattattgaattatttttaaatgttgcacgttgttccaccaagtatatcggaattgtttcactaagtagatcgaaaatgtttcaatcgtttaaatcggtcgttgtttcacctatataaaaacaatgttttagcaaatagcgaaagaatgtttcagatcactgcaacatttgatccatacatagtgaaacattataagtacactaggtgaaacatttttggtggaacaaaaattgaaatgaattcccttaataaagggtttccataatatgtaggtgatttgttgcaaaagaatgtttcaattcactgcaacattagatctatacatagtgaaacattgtgagtatactatgtgaaacatttttggtggaacaaaaaatgaaacggatcacctagttggacaactgaataataattttccccctaagcttcaagtgctgactcttgcatataataatcttactggaactatcccttcttcctttgccaatatcacaggacttagaaaacttgatttcacagctaacaatatcaagggaaacatcccaaatgagttttcaaacttcctcatgatggagattcttcttttgggtggaaatatgttgacaggtaggtttccacaagccatcttgaatctttctactctcactaatcttcaccttagttttaatcatctaagtggggagctaccatccaatttcctttactctctacccaatctacaagtacttgcattggactacaatttttttcaaggccatatccccagctcattgggaaacgactccaacatacgtgtactggacataacaagtaataatttcactggagttgtaccaagttccattggcaaactaagcaaactgtattggttaaatctttaatccaatcaactccaagcacataaaagggaagattgggagtttatgaacagcttagccaactgcactaggctacaaagtttctcgatggcttataaccgtctagaaggccatctaccgagttcgttaagcaacttttccgctcatctccaacgacttcatttaggaggaaatgcaatatcagagtcttttccctctggcatagaacacctctcaaacttgattgctttatcagtaggaactaatgactttactggtacccttccagaatggcttggaaatcttaaacagttgcaaatattaagtttatatgacaactatttcacagggtttattccatcatccctttcgaatctgtctcaactggtagctctcacactacaatttaacaagctggatgggcagataccaagcttaggaaaccagctgcaaatgcttcaaatattcaatgttttgtacaataatcttcatggtgtcataccaaatgcgatcttcagtcttccgtcattaatacaagttgacttatcttacaacaacctacatggacaacttcctattgacattggcaatgcaaaacaactagtatctttaaagctttcatcaaataagctatctggagatattctgaatgctttgggtgattgtgaaagtcttgaagtcatcaggttagatagaaataattttagcgggagcatccccatttcattaggcaacataagtagcctaagagttctcaatttatctctcaataacttaacagggtcaataccggtatctcttagcaatctacagtatcttgagaaactaaacctatcattcaaccatcttaagggcgaaatcccagcaaaaggaattttcaagaatgctacagctttccagattgatggaaatcaggggctttgtggtgggccaccagccttacacctaaccacatgtcctattgtgccattagtatcatctaagcacaataacttaattttactgaaagtgatgatcccactagcctgcatggtgtcacttgctacagtcatatctattatttttatttggagggcaaaactgaagagagaatcagtatcgttgccattttttggtagcaatttccccagaatttcatacaatgctcttttcaaagcaacagagggtttctcaacatccagtttaattggcagagggagatatggttctgtctttgtagggaaactttttcaagaaaacaacgttgttgctgtgaaagttttcagcctagagacaaggggagcaggaaagagcttcatcgcagaatgtaatgccttaagaaatgtgcggcatcgcaatatagttcctatcctcactgcatgctctagtattgattctaaaggcaatgatttcaaagctctagtgtatgagttcatgtcacaaggggacttatataatttactatatacaacaagacatgatagcaactcttcaaagttgaaccacatttcattggctcagaggacaagcattgtgctagatgtatcaagtgcattagagtacttgcaccataacaaccaaggaactattgttcactgtgatctgaaccctagcaacatccttctagataaaaatatgattgctcatgttggagactttggccttgcaagattcaaaatcgattcttcgtcaccttctctaggtgattcaaacttaacatcttcactcgcaacaaggggaaccattggatatattgcaccaggtactggttgggattttatcttgtttggtatatattgctacctattttctttttactattatgtgacatgctgatgtgtgcgaactcaaatattgccaatgaaattgtagaatgctcagagggcggtcaagtttcaactgcctcagatgtattcagctttggagttgttctcttggaactatttattcggagaaggccaatagacgacatgtttaaggatggattgagcattgcaaagcatgtagagatgaacttccctgacaggatactagagattgttgatccccaggtgcaacacgagctggacctttgccaagaaacaccaatggcagtaaaggagaaaggcatacactgcctgcgcagtgtgctgaatattggactctgctgcaccaacccaacaccgagtgaacgcatcagcatgcaggaggcggctgccaagctacacggaatcaatgattcataccttagaggaaactagctagggatctctcatagcattgtgttcatctttcggtcaaatagttgtgtacaccattgagtaaatgagtggccattgtcctagtgaaatactgaaatgtggctttgtcaccacctgcgacaaatgtttatgttctaatatactgtttgatttgtttctgcttgatattaggtggccaatacatcttgcatcttccataagtcattgtatttcagacctcatgttggcttaacagtaccatagcttgtatagtgaatgaccaagaacacaaaaaatcacatgatggaatgctcatgtcccgtcctttgcattgttagcagttggggcctttgcataaacattcatctgcttgcttgtcgtagtttatcgtccactcgtatagctttggcagacaccggttacagcacttgcaggtcgaaaggctttgatcctgctcgaggtaacaacgatggaagaaactagaaactagttaaactacattgtgcaagcatctgacatgaccatcagaatttccgagtactttgccctgaactgaactgatagttggcagatggcattgcaggatgcctcagccgctcctcactcacagcgtgtcttgtccagctctttggctactagcaagatagcggtgaatgccgtgcgccaggggcggggacgggcttggccgcggccgttgcctctgtagagcaccgcggtcttcactgccagagagggtggaccggcctccacctacgcgggccctagacggcgttgcctccgtagagcatccggccttcagtgctagagggggtggacctaactccacctacgcgggccctggacggcgttgcctccgtagagcaccacggcctttaccgccagaggggatggaccaaactccacctctcatgagctccggacggcgccgcccctttaagccacatggtctccaccaccgagggacgtcgccctatcgagcgttgtcatctgccacgactgaggaggtcgccccaccgttcacttgagccccttcagtgtggtctccaccgaacgttggggtatccaacgtaaaccttcaggcacaccacaacacccgagtaggggctagaaattatttgctccccccgaatcccggagccagcagatgagggggtaccgttggggaataaccccaagcctagcatatactattagagaggacctccatacttaggatgttgtataaactaatataataatagactagaacatcccaatagcattgcccctctaatgtaattgataagggtaacactataattttcagttacatataaataaaatgagccctccaagtgcaagggaggaggatcttctcgcatggcatcgagggaggagtgatcctctctcccccatcttctctcccaaggattcaagcttgggctctctcccacggaggaggggggcccttgccatgcatgttggactttgttccaataataacgctgcttgatcaccaatgacgagctgagccaaggtgcaaagaacttcggaggtgaatgcaataagcacaaatgtcattcatcggcctaaacgatgagcaaacagttcgaatggagagggaaaatcatgtggggatatcacgtaagtgtataataatttagaaaaatattggggccctattgaaaatttgtaactttttctttctttgcgaacacaaaatatgctaacttggaagtagaaagtttctatctatataaatttcttaagaaattattcataattcattcgtgttaccctcgaatagggatcacaacatcattaaaaaaagtaattcaaaaaatcatttgtataattatgaacaaactaaaaacaacaagagaaactcaaaatattatgaatgtataagaagtaatttaaatcaaatctaaaagtaatatatatatatatgatacaattaatttaaatatacaataaaattaattacaatatatattttttcatcagaacattatcgtataacatattgctataaaaatttatttacaacgaatataatgatatattccaattgttgattggataagtgatttaaatgaaattttatttgaagcttacttattaggaatcttttatttatactgttgcatgcttgcatactttgacgtgggaaagagatacattgctatatttttaccatctattggtataatagttggttttcattaagggtgtgtttagttctttgggtataaagtttttgaagtacacagacacacatttgaagtattaaacgtagactaataacaaaataaattacagattccacctgtaaattaactgtgagacgaatttattaagcctaattaatccatcattagtaaatgtttactgtagcatcacatttttaagtcatgacgtaattagactcagaagattcgtctcgcaatttacatgcaaaccgtgcaattattttttttcacatttaatgccggatgtacgtgtctaaacagatgtgacgtttttgataaaatttttttatctaaacaaggcctaattagtgcacatatgtgtctcgaggttttcgcaggggctcgatccgtggcgccggggagtatcgcctccgccatcgtctacgttgccgacaaccagctcggtcgtcgtcctcgtcagcgacgtcagctcgactggagaagactgctactccgcctctgccaaatcgatacccatcgatgagacgtatcagctacgccgcgctgaaccaatagcccaaaaactgaatcgttttccctgcctctgacctactctctccgttaaaaaaaaaatctagaataggtgtaacatattatagaacaacgaatttgaacagatgtatagctgtgtttagttcagcgcaaagtttggattttggttgaaattggagatgatgtgactgaaaagttgtgtgtgtatgacaggttgatgtgatggaaaaggactgaagtttggattcaaactttggatctaaacacagcctatgtctagattcgtagtactaggatgtgtcacatctagtactaggttgattttttatgggacggagggagtaccattttgtcactctctgtgaatttgggcctgtctagatccactggcaaaattttacacctgccacatcaaatgtttagacatatgcatggagtattaaatataaacgaaaaaataactaattacatagattgagtgtaaattgcgagacgaatcttttaagcctaattgcgccatgatttgacaatgtggtgctacagtaaatatttactaatgccgaattaattaggtttaataaattcatcttgcggtttataggcggattctataatttgttttgttattatactatgtttaatacttcaaatatgtatccgcatatttaatgtgacacgctaaaactttacccccttgatctaaacacagcctttgtctcacggaagtatatctgttgattgttgactacagtaaaatcgtggatggatgtgtggttgctggtacatcactcgttacaggaggggagggaggactggaggagctcctctgtagctctgctccttttcagcacaggtcgtcttcacaggtaaggctgtattagttccacgttaaaattggaagtttaaaataattggaacaatgcgatggaaaagttagaagtttatgtgtagaaaaattcgatgtgacggaaaagttaaaagtttgaaggaatctaaacagggcctaaaatgagccaaaagcctgtctcacattgggttcaaactaatgctgccttcttttccgcatatctaaatgataattttttcctttttcgttattataattttcaaattattaaatagtgtgtttttaaaaaacttgtttatctttaaaaaattcaaatgaactcaactttagagtttgtaaaagttaacgcttaatcattgctgcgctaatggcttatctcattttatgtgccaccaccaaatcgtatattcaaactagtcccaaatcactggttttgagcccatctttgactagtaatgatataaaaaaagggggaaaaatatgatatcagaaaatggtcaggactgcctatcatagttttggcttcacatggttctaagtttgtttcttgcgtcttcaccgtgttcgatccgttgaagtttctaccaagtcacatgaccagcgttttggaaagacaacaaatatggagatgttttattacagcctcaaggagttgtaaaatactattttgggggagttgggatggtgacaatttctgcaggctgagggagactggcgctgattggctccagattggccattgtcatccctgtaccaatcacaccctgcccaactctgcttgaggactctcccttttggttcttgcaaattttccatgtggaagatttttccatagcagcagcgaggacctgctagaagggacagattttcagataatgcttgcatcaaccatggatagaggttgagaggggttctgaagaggaacctattcccaagcaaatggctataagtaggtagcagctgactggcaccacctatgtactgcactctgcaccaactgcccagcacagcgtgtactccttacttggtaaggtacacttttcgtccctcgtctagctagtattcatcggcattctatctgattgagcttagtaggtgctgtttgccaaaattagaagtttggttgaaattggaacgatgtgatggaaagttgaaagtttatgtgtgtaggaaagttttgatgtaatagaaaagttgaatgtttgaagaaaaaatttagaactaaactaggcattaatatgattcatgtgggttttgattgtgcgactggtgtagtggtgttccacattacactcttcattagtgccaataggagttagtatagccatccttcaggggtcaatatttttccttttaaattattttctgtaggaacaactaagaaagcaagttttcggatagaggaaaagctgaatattaattaattcttcctatctgtacttcttgacacaccaatattaatatttttcgccaagatatttttaatcacatccactataaatatagtaggtgacgatcttccatgttccttcaaaaagaatatcagttcatactttttttttgaaacggaagccaggctaagctggagttatattaaggagaatagatagtatttacaatatcaccaacaaaggtgaaagagagagaaaacaagggaaacaaggaagaaaagcaacaaggaaaacctaaaagaaagacctaagtggatattctcgcgatgtttttttgccccacacatgctccaaagtttgatttcatcttgaattttggcgagtagttgcggcatggttttctcttgattttggaaaaccttcctgttttgttcacaccatatttcccatgccaccaacatgtggattgactcgagtgctttggccttgcttttgcctccttgagatgttcttctgatccaccattccaacaatacttcgttttcatcgtgttggtgttctatatcgctgcagttcagtctactcaggaccctctcctagatctgacgcacaaaattaagtgcaatctttgaaaagatgttgggcggtttcaaggttcctgtagcatagttggcagaaatagttgtttggccattgtctgatctgtagcctatctgctgtccaaactctattttgcaatagaagtcatgcaaagtgtttgcatttggaaggtgcccattgcttctaaatcagttttgcagccgctaagcttatcctgccattaaactgtgctatgtaggcggactttgcgctgtattttccatttgctgtccaccgccaagttatggtgtcctcaacaccttctgtgagtgcaacgccgctattccacacgtggtagaacacctcgaagaattccttgactagctcaaccgtgagattgtgcctaatgtctagtatccattggtcatttgctagtccttcgtagacagtcctacctttccttttggcatggttgtataaggctggggctaactccttcaatggttgctctccgatccaatttgattcccagaaactcgctttgcgaccttcacctattgtcaccttggtggcggaggcaaatagccttttgtccatttcgtcacaagggggaggtgttcctgcccaaggtttgtttgggctctcccaactgaaccatagccatcgcactctcaaagctcgtgcaaatttctctaagtccaagactcccagtccccaagtttggtgggtgcacatactgttggccaatttactttgcatttgcccccactaatctcttggtcgccagcccagaggaatctttttctaattctgcccctatcatgcaataaattttttgggggtttcagtgctattaggaagtatgttggtattgaggttagtactgaagagacaagggtcttccttcccacctgttgcaacaatttccctttccaacctgcaagtcgagagtggagcttgtccatgactggttggagatgcgctctcttgattcttcctattgtcaaaggtagtcctagatatgtgatggggaaaccagttcgatttccattgaaattattcagcacgtcctgaagatctatgttttcacatcttataggcaccactgagctcttgcttaggttcacctgtagccctgtggcacgtccaaagttttccagcaaggtgattagactgtccacatcagctcgacttgggttcagaaagattgctgcatcatccgcatatagcgatgttcggaactttgccaccctgtttgatattggcgacaagatcccttggtctttggccatatccagtatcgtttgcaatgggtcgattgctaatatgaagaggtagggtgaaagggggtccccctggcgcagtcctctcttgtgcataattacttctcatgttgttccattcagcattaccttagatgtggtggttgatagaattaaggcaatccaatctctccaccgtgtactaaatcctctccacggtagcatttccaacaaatattcctaggatatagagtcaaaagcctttgcgatgtccaacgtgaaaaggaggcttggtttccttttgttgtgcatcgatctgaccaagttgcgcacatataagaatttaccttgtatgcatcgtcttttgatgaaagcactttgggcatgcaagaccaggtcatccaatctcatcgcgaggaccttcgatatgagctttgccactgagtgaattaagcttattggtctgaaatcatgcaccagttgtggtgaatctttttttgggatcaatgccaaaatggctttgttgatgcatccaaaatttccgcctgcgagtctaaagaaactatcgaacatctgagaaatatcatgttttatgatgtcccagcaccccttgaagaatgccccagtgaaatcgtcaggtccgggtgccctctctgtcggcgaccctttcaccacattccatatttcatcctcagtaaaaggaccatccattgttccttgttgtattctctgcactcataacgcatcccaattaagtgtgcattctcttagtttcttttcgcctagtatggaggtgaaatgatcatgtagcagcttggccttgtcctcatgtgtgtatacagctgcatttctgtgttgtaagcagtgtatgaagttcttccttttcctagcattagcttttatgtgaaagaaacgtgtgtttgcatctccttctttcagccacctaacccgcgatgcttgttttattattgactatccataatctcttgcttttattatctttgcatttaactaagacttagaataatttggcagagaaggctggtcatgaagatcgctacaatcagacagtatatgattttgcttatggctagcaatgtagtccaaatcatgtgcacctcattatatggaaatgagacagatcgactctcattgcttgagttcaagaaggcaatcagtctcgatccgcagcaagcgctgatgtcctggaatgacagcacttacttttgcagttgggaaggtgtcctgtgcagggttaaaactccacatcgtcccatttctctaaaccttacaaaccaaggtttagttgggcaaatatccccttcacttggaaacctaacattcctaaaatttctgttcctagacacaaattcattcaccggagagatccctctgtcccttggtcatctgcatcaccttcgaaccatttacttgagcaataacacattagaaggagcgatacctgattttacaaattgttctagcctcaaggccctatggctcaacggcaatcacctagttggacaattgattaataatttcccccctaagcttcaagtgctgactcttgcatctaataattttactggaactatcccttcttcctttgccaatatcacagaacttagaaatcttaatttcgcgtctaacaatatcaagggaaacatcccaaatgagttttcaaacttcctcatgatggagattcttattttgggtggcaatatgttgacgggtaggtttccacaagccatcttaaatatttctactctcatcgatctttttcttaattttaatcatctaagtggagaggtaccatccaatatcctttactctcttcccaatctacaagtacttgcattggacttcaattttcttcaagggcatatccccagctcattggtgaacgcctccaacctacgtgaactggacatatcaagtaataatttcactggggttgtaccaagttccattggcaaactaagcaaactgtattggctaagtcttgaaggcaatcagctccaaacacacaaaaaggaagattgggagtttatgaacagcttagccaactgcactaggctacaaattttttcgatggcttataatcgactagaaggccatctaccaagttcgttaagcaacttttcgactcatctccaacgacttcatttatacggaaatgaaatatctgggtttctcccctctggcattgaacacctctcaaacttgattgatttatcattaggaactaatgactttactggtacccttccagaatggcttggaaatcttaaacagttgcaaatgttaggtttatatgaaaactatttcataggatttattccatcgtccttatcaaatctatctcaactggtatatcttggactacattttaacaagtttgatggacacataccaagcttgggaaacctgcaaatgcttgaagtattaaacatttccaacaataatcttcattgtataataccaactgagatttttagtatcatgtcaatagtacaaatcgacttatctttcaataacctacaccgaaaattttctactgacattggcaatgcgaaacaactaatatctttagaactttcatcaaataagctatctggagatatacccaatgctttgggtaattgtgaaagccttgaatatatcatgttaggtataaacagttttagcggtagcatacccatttcattaggtaacataagtaacctaaaagttctcaacttatctcacaataatttaacttggtcaataccagcgtctcttagcaatctacaatatcttgagcaacttgatctgtcattcaaccatcttaacggtgaggtcccagtagaaggaatattcaagaatgcaacagccttccagatggatggaaatcagggactttgtggtgggctaccagagttgcacctacctgcgtgtcctaccgtgttattggttacatctaagaacaagaactcggttatattgaaattagtaatcccactagcctgcatggtatcgcttgctttggccatatcaatttattttattgggaggggaaaacggaagaaaaaatccatatcattcccatcactcggtagaaagttccccaaagtttccttcaatgatctttcaaatgcaacagatagattctctacagccaatttaattggaagaggaaggtttggttctgtataccaagcaaaactatttcaagacaacattgtggttgccgtgaaagttttcaatctagaaacaagtggatcgcaggagagcttcattgcagaatgtaatgctttaagaaacttgagacatcgcaatctagttcctatcttcacactatgcggtagtattgatgctgaaggcaatgatttcaaggctttagtgtatgagttgatgccacgaggggacttgcataaattactatactcaaccggagatgacggtgatgcttcaaatctgaaccacattacattagctcagaggataagcataattgtggatttatcaaatgcattggaatatttgcaccataacaaccaaggaactattattcattgtgacctgaagcctagcaatatccttctagatgacaatatgattgctcatgtcggagattttggccttgtgaagttcaggaccgattcctccacatcttttggtgattccaactcaattttttcccttgcaataaagggaaccattggatatatcgctccaggtaatttgaaaattttatcttgcttttgtattactacatatttctttaacatacctagctatatgagctatactttggtcttatatatgcattttacagaatgcgctgagggagatcaagtctcaactgcctctgatgtttatagctttggagttgttctcttggagttgttcatatgtaggcggccaatagacgctatgtttaaggatggactgagcattgcaaagtttacagagatcaacttctctgacaggatacttgagatcgttgatccccagctacaacaagagttggacctctgcctagaagctccagtggaagtaaaggagaaagatatacactgcatgctctctgtgttaaaaattggaattcattgcaccaagccaataccaagtgaacgcattagcatgcgagaggcagccgccaagctgcacataatcaaagatgcctatctcagagggaactgaagaagtttttctggtaggaatacggataaggcttgtgtatatttgtattaagcttgggactgaagaagctagcagtgctattatactttgttgtttgttttcatttctctatgaatacattacaacaaaaattatcaacgagggatttcccagctggttgagtagatctcaaccattgtctcactaagacattgtgttccctttctcttagttacactggagaacaaatatttatagtgaagagtattgtttatttgtttctccttcatacaaggtcaatgaagtttggcaaatcagaaattcagaaaatactccctcagtctttttttatgtctaacgccattgaattttgaacataactttaataattgaattttgaacataactttaataattgaattttgaacataaatttaataattcgtttaattttaaaaaaccatataatcattttttattacaagtacattaagcatggtttctattttttacatacttagattaaacgaatggtcaaatgtatatataaaaatcagagatttgttctggtccagcaaattatacctcaatgcaccagtacttggtggtacctgattgaatctaaccgtccaatgtccaagggcatgatgggaatggatcgggatcaggtgcagtccctatagagactgcaactttggcagtagccaatctgaaccgttcaaaaaaaaaatcagacggctggctcacaccaccgcactagctagcacccaaaaggtcatcttcttcctcgagcggtagagccctctttcttctccatgtcaatggaagtgctctgtgcttcttcttacttcatgacaagttgacaactacgggaccttcgtacaaaccattgttgtgaaagtgttcaacccgtcaaggagattctatttttcgtgcttcatcatgatgttcttctatgaactcccataaagtgataatctgcactgccactgtcaaacgccaaggcagtaattaacctgcgagtagaccaagccaacctcgcctcctcctcgttcgatcctacctagctacccgtccaaatcaccaccaaaccacgagcatcaggcaagtaacaagctaagcagcacaactcctggccttgagcccttctcacccattgatacctccgccttgttggtgaccacgctccgggtgccgcctccaccgctccactcttgaagcccactggacatggagaggactaaagggttgttaattcgtagacgtcggatgcttcgtggatggttagatcaggtgctactgctaaagttgcagtaacaatagcaacttcacctgatccgaatccgatgggaatcatcctggactccacgccacccatcctctcgcaggcaccacaatccccccaacacttctccccactgcaaaatactccatgggcgtttgacgctgccgattcattccctcccatcaatgccgctgcagcacacctgttttgtcggcatgagtagtgctgagccatcagttccacctacatgcaggggcggatctatagtgcaatgaccaatgtcaggcgacactgatggcttttggtaaaacctatagcaaaactgattatctatatattataacaccatgatctaaacataattagtatattatgacactaatagatacgttatgacaccaacgaatcaattttctggatccaccactgcctacatggttgcacaagaacccacgcaggcttcccgccgatgtcgaggtgctgcagcacgccggcgtgctgtgtcgcgtacggcaaccactacttctagacaagcaggggcactagagatggttctcttcttccgctccgtcgtccggccgcggtggtgggacaagccagaccccgcctggacggaggacacacagtgacaatgcgatgcatgcacagtgaggattgattcggagtttctgactaatggtagtacataacagattaacagatatataggtacattactaatatggtactcccgaggattatgttgccatttgcaaatctctgcacaatgttgaatagttccacattggttgtggaagggcaaatgacctaagatataagtgggggagctcctcacctcaatggctagcttttagggtgggaaaaaccctttacaatcctacaattggtatcagagtctggctaggttaacatctctggcccgatggatacagtgtgtgaaggcccaatgtgtgaaggggccatgtacagtgtgtgaaggccggtagggcccgaatacggtgaagggctgagggacaccaatgtgtgaaggggacatggacatggccctcgacctcccgctttagggcatatcgcccagagagtgagtgcttgtttgctccattgacgacgactcccaggtgtgcttgtcttggtccggctcgtctgtagatagggacgacaccatggcagcgacggcagccaagggtcacacagcggcggcggcggcacgcatctggccatctgggggaggaaagacgccgctccaatccacttcccaaattttttttctatgcgaaaataccaccttacccttccaccggtgcggtaccacataaacgactaagcagtacatggtggtaccgatcaatattagccgttggatccggtccatctaacagctaggatttggtaccgcccaagcatgctggacagtaaaaaatctcacctacattttctttttgctacaaatcaaaaggacctaatgtgggctcttaattctcactagtaatctctctgagtctgtagtatcagcactgctggatgtaatttcattcaatgtaggtattgatctgcaaacaatccaggtcgttaacaacaacaacggttcaaaacaaggagcaaattgcaaaaatacgtactatcaacgacacagacagggaccattcgctgcatcccagaaacagcggacgaattattacagaaatccatgggcgtgaaaattcttgtcttttcaaattaggcttgttaaacgcatctataagtttttgcattcaatttttaccgtccgtcttatttgaaatttttttataattagtattttttttgttatgagatgataaaatataaataataatttactcgtaactcatgtttttaaattttttaaaattttcaaataagacggacgatcaaaattggacgtgaaaaaccatggttacgtacacttaaaatgggacggatgtagtactttgcttctactacatggagctgagccggtgagatagattgaagatgaggatcaaatcaacttcgtcaaacaagcaaatcattaattagcacataattaattaaattttaattatcgtgaacttgaaaaagttagatttattaataatattttaaaacaatttttatataattttttttataaaaaatacattgattagtagtttaaaaaacatattagtagatgccgatataaaatctatatcttaattagaaaagaattgggcaagagtatctatccacatgattgttgtggtgtcttacttccatttgataccagggtaatccatttcatcatgctcgtggcgtgcaatgagtggacaacagtgaacagttattccccaacaaactctttacgtatgtagttcttgccctactgctacataataagagaggcattacataatttacaaacgattaattcactaaaggaccgttatttctcccaaattgcttgaagacaaacgtctgtgatgaggagtcacgtcgtcatttgactggagcaagatcgaaccgtctgagttgacttaatagcactgatggtaatttatgctatagaaccgttcctgatgactcagtaacacacgctttgcaaatttacactcaaatgacccgtccgtgatgagtacaacttgtatacaggactgaaagtgtgaaaagaagcgggcaatccttagcggatttgtgctatgaagtttgggcgtaaactcgtagcaaaatcaagattctgcagtaactaattaacgaggtggtggaataatcaatggggatgttgctgccatcgccacgacgatggaagccactggggggtcctgtctagatctacactctctgcagtcgatcgagacgcttttttttttttttggcatttgcaaatttgacaccggtttttttaattttgcaagggtgccactcgaatggtagttctagtggtatttttggaattttctagtggtattcttacaataacgattcaaagtagtgttaaatttgcaattgcccttttttttttcatcgttaaaacgacaatacaacttgttaaacgcccaacaataatgtccttttcctctctgaattgctagttacgaattgttttagattggattgtttgtgatactaagttttcaatttaaatagttgtatatatttggttggatatagaagtcaggtaaaatatacccttctctaaaaaaataataaaaaaaagaaaacgaagtcaacagtatagctatgcaaactaagaattagttgcggagtgcacaatttgttcatcatattgcatccgttttatttacgcttggcatacatatagtccaatgaatataggagttctctatttgttgattaactgattcttttaaatctcagttactttttttagaaacaaatacttttttcataataacaatgtgtgcttcaacattatatcctcacattttgggataccagattaaaataaagagagaataaaactgagctcctcgacaaggtgatatgaataaatcgagctacatacatgcatgcatgtatggttgacttagaccagtcagtcgtcgattgatatcgccgataaatgttagtcatggcaatgtgttagcacgtaccgtggtccgtgggtagaaacttacaatcttatccttttttttataatagaaatatattatatctccatgcctcataagacatacaactataaatttgttacaatcttgttatttgggattatagacgatgtattaaataattaaagcatataaaccaacaagatatacagtacatcgtgatgaaatgtttgcagtactttttatctttcgtgcttgggaaaatgggagatgaaacgaatgagactggagggtgtactttgagaaccaagagctgtctgttttgagcacatatgaacaataaaattaaaaaaaattgacttaaaaaaagtcaagggagtatattctaaacctaccttttggtagaaacttacttttacaagcatggcaaagataattcttaactatcttccaaaaataaaataaaaaaaggatgccaaacatgcactcgcgactgccaatcgattgattaattaggttgtcctcatgcaatgcaaatgtcgattgacgacgtctacccttatcggaatgacttattagcaaataaagactaatttatgagtaattagtaattcaaaagtaaataataatgtaaaataaattatgataaaagaagtacaaaatcataaaattaagttataaaattaaaattttactccctccgttttacaatgtaagtcattctaatattttccacattcatattaatgttaatgaatctagacatatatatctatttagattaatgttaaaaaaatatctatttagattcattaacattaatatgaatgtggaaaatggtagaatgacttgtatcgtgaaacggaggaagcagttcatagctataagcgtaaacgtaacgacgaggccagtcaatctcacagcgacttcttccacttaaattaatgtcgatctcaaactacccaagtctgacgccttcctactaaccaccttattattgtacaagctgcaactcatcgcgacgtcgaagcaaggcccgcaaagtcagtcagtaaagtagtagtagactgatgagattacgtttcaattggttcgttgtgcctataaattaaggcacataccatgcgtgcaagtatgtatcattctgccctcggttgctttactaagctagttttgttgctcgatcgatccatcggtgttccgcaaaataatttgttattttggattcaatcaatcaggtcttcagtcgcctttaaacaattggacagcttgattcgagtgccggcagcctgcagccgacctagctgtaagcatctctgcttgtttgttccggctatttcatttccataatacattaataaaaggggtaacaattaagtatggaaattttgttattttttacagcctaaccctgacataatatttgtgtctcgttaagtttatttttcacctatcttacacgtacatatcaatataaaattaaaaaaaagactataataactttactttatcaaatcccaatacaatagccttactttatcaaactttgatgcaataattactctaaaaacaagggccccttaaatcgtaggaatgaaaaaacggaggaataggaaaatataggattctgacaggaatgtaaatgtaaaacagaggattgcaaaacacagaaaaaatataggaatgatcgtttgattggatttcaggaaaaacacaggaattggatgagagagatagactcaaaggattcttaccaagaggttagacctcttgctaagttttctccaaaacataaattttgtaggatttggaaaacttcaatactttgaattaaagggctacatagtaaaatttcctatagatttcaatcatatgaaattcctttgattcaaatgtgccctaaacttatttaggacaaatagaaggagctaaaaccaaacctattacggaacagaggaaatgtatcactacttggctgagttctttaccccactttcccaactcacatatctcgttttccgcgcgcacgcttttcaaactgctaaacggtgcgtttttttaaaaaaaattatatatgaaagttgctttcaaaaattaaattaatccatttttaaaaaaaattgctaataattaattaattacgtgctaatggatcgctccgtttttcgcgtggaggagacgtgggttcccaacccgaaggagctaacagagtgttagcttgcttttcatcgcatgtgccattatggagcatagtacttccaagctagtgtaagactctgcatctaattaggtttcaaaaataaaagactctgcatctaaaacctgcattaactagagggatcagttcctcagacgaagacgggggtgatggtaacatcttgccatggtttggtcccaagtgttccagatgtgattgtagtggtcatttttggtaccatattaaaagttcatgcggatgaaggcctgtttataatctttggtgctcaaaccatggtatattaggttaaccgccttacacgaaacggtttactatacatacgtgcatatctggaattttataaacatgctgttacaggtaaccattatgcaattgaaaaatgctatgtgtccacggggcgataaatcattgtcgtgatactataatatgaatagattcttttttctttgatattttcgatacaccgttttatgtgacagccgaaaaggtgtttattgcaactattgctaacacagattcagtatcaccatgataggaaaaagtaagaattacaatagtatgaattaccccctaaacgacaaaaatagacatttgacatctccaattcatcgaaccggacaaattacacccctaacctgttccagagtggttttgatcctacgtggtgtaaacttggtgatccagttagctaaaaaaattataaaaataagtaggctccaactatcagctacatctctcccatcttctcttttcttctgccttcttccccttcgatctctctctctctctacctctggacggagcaggcaagagggcggtggactaactccctccataggctggcgatggcgacaacctccatccttcaacttgtgtgactccctccatggagctggtgacggtggcggtctccatcctctacggtagaggatgccgccccaaatatccatgctggaggcagtgactgcagagcttgctggaggaggaggtgacgacggagcttgctagagaggaggcactggtggtggagcttgctcgaggaggcagcagaagtacgcgaagctcactagtagacggcataacaagcatgctatcgtgtcgatgctttcccgccacatgcgttcgccgacgagggggtgaggggattcgtccggtttgatgaatcagggtgtcaaatgtctaagtttgtagtttagggggggtcatacgtattatcctagtagttcaaggggtaattcatacttttcccaccacgatatgcatatgtttcatatgattttaagcttgttgcaactgttctgaacactaaaaacactcgcaaaaaaagttattcctttcgaattatcttttgctcggccacaagtgtttagaaaggaaaacaaatccgaatcataattaattcctcatgtaggtaactaagtactacttcttaacaaattaaaagatgaatacactttttaacacctttactagtaatatactccctcagtttcatattataagtcatttgacaatttttctagtcaaactttgttaagtttgactacgtttacagaaagattcaacaacatctaaaatatgaaattagtttcattaaatctaacattgaatatagtttgataatatgtttgttttgtgttaaaaataatactataatattctataaattagtcaaacttaatgtagtttggctagaaaaaaaagtcaaacgacttataatataaaacggagggagtactattctattcgttcgaaaatacaaggtgtccttgttttccacaaagtcaatactttaaaattttggctaaaaattaaataaaaatacatgtgtttagtgtcatgtatatagtatcactaggttcgtatttgaatgtatatagtatcactaggtttgtatttgaaaatattttcacgtgaggctaattttgtagttgtttataataaaaactaatggttaaaaatacaatgttgcagaccatgtagaaacctaatacgtcttatatttttaaatggagagagtaggtgacatttttccatgtttctttacaagaaaaaaaactatttcttcacattatggactatttataatatcttactttaatttattatatgtagaaataactaagacctagaatttggcagtggtggattggtcatgaagatcattataattggactgtgtcttttggtgattatggctagcagtgtaatccaaatgtcacaccctaaaaatcaaaaatatataaattgttgtttaattggaattattagaatttattttaaaagcctagaagagaagatctaattttaattaataaattccaatataaaatagggccagataaaatttcattaaatactttacttaactctataattcctagatttttctgggatttatttgagctaaggaagtatttttaataaatgaaattgcatttcatgaataatttaaattgaaaaaggtttttaaaatcctcttttggctttgggccgaaagtcggcccaaaaccttctctctctctccctcggcccagtcggcccagtccgaccgcagcccagtccgcccgctcgcgcgcgcgcgtcagcccgctgacaggtggggcccacctgtcagggccgtcgtcttcctcgcaccgtcgcccggccgaaccttagccaagccgcgccgccgtctccttccaaatccggctgcccctttccgtttccgatgaaattagtagaggggaaatgatcttcgggatcttctctacctttttccttttggaatcgatcgccaattcggtttggaaatccgtggattcgagttcgattcggatcgatctctctcctccgaaccctagttgttccttcacgtcgccggtcgccgtgggccttcgtcgccgcctccttgcccctttaaaaggacccccaagcccgccgctacccgtcgccaccctcgccttcgcctctcgtcgccggtagagccctagcgccgtgtagcctagcgccgccgtcgccgccgttcgtccagccgtgcgccgccgccactccagtcgtcgtcgtcgctcgggaaggccgccgtcgtgatcgccaagtcatcgccgacctcgttcgcccctccgtcgtcgccgtaggccgccggaacaccgtcgccgtcgtcaagccgaaggtcgccaccgcttcttcctcgacgccgtcgccgtccgttgatctaccgccgccgttttggtcaccggtgagttcgccgcgtcgctctctacgtgctggtgccctccgttcgtgccgtcgcgccgtcgttcgccgacgagcatgcacgcccgagccgccgccggtggtgacgtcgtcgctgacgtcatcgtcgtcgtccatccgtgagccgcggtggatccgatcgatcttggccgtccgttttggataggatcgatctcggccgcccaatctcgtgaaccgccgccgtgcacccgattcaccgcgaaccctagccgctgacgcaataattcccttttccttttcaaaaataattcattattgcgtcataattcaattaaaatccatataagtgttttaatccgatttaatctttgaaaattcataactaattcatcttagctcggatttagttggttcaagtctctaaatttttctaaaattgagatctacatgttaaaaatatccacatgtactgttcatgcttgtttatgtgctgttttggtgattttgctcttttctctttagattccgacgtttccggagagtccgtttttacaggagaagaatttgaagagttccaaggccagcaaggcaagtcacacagatcccaaacaaccctttgagcatgttgatcctgtttaaagctattgtttctattcaactattgcatttattttcgaatgtcattgggtggaattaacttattgtttgttatagcccttttgttcttgattactttattccttgataccttgggttattataacttgactagttgggctttatatattggttcagctagatattagatatgattgcttagccatgcttagaaacattagcactattgggataacttatggctcactattatttaatgatggcttaatgatagctcacgatggtcaatcgtgattggttaattaattaaattgccaactaaaacctgataatggtgagttgtgagcacatggttttgatggtcgtgctcatgacaattaaggaccggttcacgagtttcggttgtgaaacattaactgtgccaaccacaagccagcgtgggcaacggctttaccttttgtatagtatggttcattgcggagcaccagactgagaagtggcggagataagcccacgggggtcgctggggagtccatgccttgttttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacacctctagccagagtaaaactattcgaatagctgtgcccgcggttatgggcgggtctaacaatgtctttcgtgattagtttcacacttctcaccataataaaagatgctataactggtaataatttgtttagctcctggtttggaatggtatattcctggtttggagatagatctgtacagccgggtatggttgttcaggatggttgggcctgagcagcacgggtgtgctgtttagtgttgattaaaattgatgattaattactctactgttttataattctcaaatgtttgctaaatgctgcttttgcaaatgagccctatattatgccattctttggtatccttgtgcacttgcatatttgctgcgtggcttgctgagtatgtcatatactcaccttgcaatcattcatcagaggaggagttctacagtgatgctgctggtgtggaggattaggtgtagccctggtcaagctgcctgtggagtggagtcgtctgcgccgtttatcttttttttttccgctgcttagatctttatgattgagaggaactatctacctctgtaatgacattttattcgcttattaattagagtaataattgtactctattatcaatttgttattgtgtgcctcggctgattcctggacgagggttcacacacatataagcgtttggaattttggatagaaattccgggcgtgacaccaaaccatgtgcaattcattatatgagaacgggacagatcgactctcactgcttgaattcaaaaaggcaatcagtatggatccacagcaagccctgatgtcctggaatgacagcaattacttttgcagttgggaaggtgtcttgtgcagggttaaaactccacatcgtgtcatttctctaaaccttacaaatcgaggtttagttgggcaaatatctcctgcacttggcaacatgacattcctgaaatttctctccctatccaccaattcattcacaggagagatccatttgtcccttggtcatctgcatcgtcttgaaaccctcgacttgagcaacaacacactacaaggagacatacctgactttacaaattgttccaacctcaagtctctttggctcagtcgcaaccacttagttggacaattcaacagtaatttctcccctcggcttcaagatttgattcttgcatctaataatattactgggaccatcccttcctctcttgccaatatcacatcgctacaacggcttagcatcatggataacaatattaatgggaacatcccacatgagtttgctgggtttcccatactacagatcctctatgctgatgggaataagttggcaggtaggtttccacgagccatcttgaacatttttactattgtgggtcttgcttttagttctaattatctaaatggagaaataccgtccaatctctttgattctctgcctgaaatgcaatggtttgaagtagactataacaacttctttcaaggaggtatcccaagttctttggcaaatgcttccaagctgaaggtttttgatatatcgaggaataacttcactggggttataccttgctctattggaaaacttaccaaagtttattggctaaatcttgaaaaaaatcaactccatgcacgcaacaagcaagactgggagttcatgagctgcttagcgaactgcaccggcttgacagatttctcagtatctgataactgtctagaaggccatgtaccaagttcattaggtaacctttctgttcagcttcaacaattccttttgggaggaaatcaattatcaggggttttcccttctggtttccaataccttcgcaacttgattagcatatcaatcgatagcaataatttttcaggagtccttccagaatggctcggcagtctacaaaatttgcaattaataggcttatataacaattactttacagggattataccttcatccctttcaaatttatctcaattaggatatctctatctacagtcaaatcagttttatgggcatctaccaccaagcttgggaaatcacaaaatgcttcaagaattgactattggatataaaaatattcagggtatgataccaaaggagatattcaaaattccatcattgcttcaaattgatttatctttcaacaacctagatggaagtatcccaaaagaagtaggtgatgccaagcaactcatgtatttgaggctttcgtctaataagctatctggggatattcctaactctttaggtaattctgaaagcatggaaataataatgttggatcggaatatatttagtggaagcatccccacttcattagacaacatactcagcctaaaagttctgaacttgtctcagaacaacttgtcaggatctataccaccatctcttggcaacctccaatttcttgagaagctagatctttcattcaaccatcttaaaggtgaggtcccagtaaaaggaatattcaagaatgcaagtgccattcgaattgatggtaacgaggccctttgtggtggagtgccagagctacatttacatgcacgctctatcataccttttgattcaactaagcacaagcaatctattgtactaaaaatcgtcatcccattagctagcatgttgtcacttgctatgatcatatctatcttgttacttctgaacagaaaacagaagagaaaatctgtagatttaccctcatttggtaggaaatttgtcagagtttcttacaatgatcttgccaaagcaacagaggggttttcaacatcacatttaattggaagaggaaggtatagttctgtgtatcaagggaaatttacggacgaaaaggtggttgcagtgaaagtgttcaacttagagacaatgggagcacaaaagagcttcatcatagaatgcaatgcactaagaaaattgcgacaccgcaatatagttcctatcctaactgcatgtgcgagcactagttccaatggaaatgattttaaagctctattgtatgaattcatgccacaaggggacttgaataaattacttcattcgaccggagctgaagaattcaacagggaaaatcacggtaaccggatcacacttgctcaaagattaagcatcattgtggatgtagctgatgcaattgagtacctccaccataacaaacaagaaactattgtccattgtgatctgaagcctagcaacattcttccggatgacgatatgatagctcatgttggggactttggccttgcaaggttcaaaattgacttcatgggatccaatgactccaactcaatttactcaactgcaataaagggaaccatttggatatgttgccccaggtaatgctcatttccatattgtgtttttgtttccctctaaattgtgaattgtttcagcatagtatcatttcgagtaaaccgttcccatccatggcggtccatagagtatgctgcaggtgctgaagtgtcgacctatggagatgtctttagctttggagttgttctactagaaatatttttacgaaagaaaccaaccgacgatatgttcaaggatggcctcgacattgtcaagtttgtcgaggtgaactttccagataggttaccgcagattgttgacccagaattactacaagaaacacatgtgggcacaaaagaaagagtcttgtgttgtttaaattcagtactaaacattggactcttctgcacaaagacatccccatatgagcgcatggacatgcgagaagtggctgcaaggcttagtaaaatcaaagaggtgtttctcagtggcaactaaggtatatggccttgttatctatatctccatgattgtttctcatattatatgtgcattgttctttccttagtaaaataacaattaagaaggaaaactgatgctgagcttacattgcagatatcccaaaatcttaagtctgtggactggaccctgtagactctgtacttgtcaatacatctttggcaactgggatgagtgcctgaagctacatcttttatgtctcgctatatatacaactagctctgtactccacgaagttgattacatgcattttatttccctttgtgatgatgaccacaaattattgtacttgattatatttactaaactacttcttccgtctcacaatgtaagactttcttctagcattgcccatattcgtttagatgttaatgaatctagacatatgcatgtgtttgatttattaacatctatatgtatgtgggcaatactagaaaatcttacattgtgaaacagagagagtatcattgtgaaatggagggagtataatttaacggatgtcatgacacatgatttatgtaatttccaccaccgaaataagttgagtaactcatttaagcatcttgtaagagaagtgactaaattacacccacctcgcaagttatagtcttgatgtgttttactgttttttttataaaacaaatcatagtggtagaaaacagagacttatttgctaatatcctaagcggccatgtttgtggggacctaataaaaaataggactacctattaatctttcgatagacttgagcttcaaatcttacagaattttcaaccaatggatatagcttattttgaaagaattaacaaaaagaaagggataaacatttcaaaaatcataaatttagagaaaaaaacatttgtaaaatctaattttggtgcattgtaatagagcgtaagtgcactataactaagttctgtaacttaatataactacaagttgcccagcgaaaaaaatataactacaagttagatctacataaacacaaatcttgatgcaagatcttacggacaagaagaaaaatcgaaagacaggagcccaaaaatctgtagcaaagtgaaatagcaaaaccgataaaaaaaaaagcattcttatatgggcatcagatagactgttcagctctgcggcgagccatcgaacggcggcggcggcaatagtgaggatgcgtattggagcgtgacggctggagcttgtgctagccgatgccacatccgccatgcgagccggagttttaggtctccatccaggatcggacgacgtacggctaccaatgcggcgacctagccatgcatggccggcggcggcgatgagcgacgattttctccgctttctctggcccatatctcacggaaaatatatcaatccggcggccgcggcctcgattgatcacatcgccggaaaccagcccgacctgctccttgtcggcgatctgtaacctcaccaacgccaccgcactgcagcaggcttctactcctgcattttcttcgaatcgacgacacctatcagccagactgggattacagcgctgaggtttttgttttctgaaactctgaaccattttgtcactctgaatcttcttcagaactcttactttgtgaattggtctcgcagaatatggtgatttgttaactacagtgaatcatttacaacttgagttcagcagctgtatatctttttaagattggattaggtagttgctcgatctgttctataagcttcagtgcgaagtgacaaaggacatcagactaaaatattcagtagtacatatatactaatgttacaattccatgtccttgatcagtgaaagtgtactgaatatcagatgttactaatatatactacactaattttacaattacatatgtatttgatcaaggaaagtactaaccttaatccaacacaacaaattccagggaagcagtagaaagacttgacgaagatggacaggataggtgggtgactatgtctttgatcagtgaaagtgtgctgaatatcgaatgttactaatatatactaattttacaattccatatgtatttgatcaatgaaagtgtgctgaatgttactactaaccttaatcctacacaacaaattccagggaagcagtaggaagaaatgacaaagatggataggataggtgggtgactgaaccttgcgcactctggtacatacaacactcattacagggaagcagagtgcatgggagtggagatagtgctaaagccatcgacgttcgtcttcacccacagccatgcgagtggagcacttgactgacaatcacgatgtgttaggcagtcctccgcacttcatgtcttcaactgcagattgtgcatcctttctgaagaaaactggcgcctgattggaatctttcgtgcagttgactgcaaatcaagtctttgcatgccaagattgtgctaattaaagccacggtatccttctgttataaaaggaagcagtcgaattgtcgatgaccatgagccccatgagacaggctagctgctcctctcgctggtaatctcagtcatgcatatcaatctttcatttaattcgtttctgttcatcattttgttgttgggatagattggtgtatgttggattgcatgcttttggggatttgtgtgtagaatacatctaattatattcacagcacattctgtctagaaaggtaatgcatatatatacagatgatttgagacattttggttccattttatctgaggtgatgatcagcaattactaaatactactagctctgtttttttaatatatgacgtctttgactttttgacaaacgtttgaccattcgccttaattaaattttttatacggatacaaaaaaaagttaagtcatgcttaaagaacatttgaaaataaatcaagtcataataaaataaacgataattgcataaatttttaaataagatgaatggtaaaacatatcttaaaacgtcaacggcgtcatatattaaaaaaacggagggaataatacttgagattttacagtgtgtgtcataaccacaaaccatattagtttgcatgtctagcatattattacagtgcaaagtacattcagctcattaattggcacctaggagctgagggtttcccataacaatactcccctatatgttgattatgaagttcgatgagcgagctgacctctaagagcaagttttataattgaggtggctaacacctctaattccatacatatcatctccgtataacttaaaaggtaacttatataataggtaacctataacacacaaacctcaataactctaaaagaaaatctaagaagtgctatagacaagcgtctcaatctaagaaatgtcattgataaatctaacttcctagaaataccatcatatgagtgcctttgtcccaaaaatgtcatcgccattagattttcattagcagcccttcatgaaatgctataaaaagattattttaccatacgaattgttgaaagccgatgaaaacttccgccttttccgtcagtttacactaatttgtaggctgctctttacactaaattattgtaagttaacgaatgggagaatagctactttagtccctaaagtttctctgtaggatcagtttagtccctaaccttttaaatggtccaaagaaatccttaacctttgtcataaggcctataatagtccttgggtccaccaaaatcatcatatggatatgccatgtcatcattcatgcaaatctataatgaattgtccaatatacccttacgtatatcatagaaaaataaatataagggtgaattagacataaccataggaaaaaaatacctcttttttcacccttttgaggtatatttttgctcttacatgtaccatatatatttttttaacttttttcttttgttttttatttacctatgcataggaaggtgacatggcatgtccatgtggcgattttggtgggaccaaggactatattagcccacataacaaatttaaaggacttgtttagacaatatgaaagattaaggactaaaatgatccaggagcgaaactttagggactatattagctattctctcttaacgaaaagagcaaaagttttaatcgtaggggtaaaatggtctttttaaaccacttagcggatggctgctaatgctacctaaaggcgatagcatttcttggacaaaaacacttatagatggcatttctaggaagttggattggtcgatggtatttattggattggggcacttgttgatggtatttcttagattttctcaaactctaatactcccatatttgtatagtttgtataggggttgccccttatatgagggatggttccttccctctctcctttctccccacctcatcaaataagtctacaagacatcttaggagatttatagtacttgctctaaggtattggctcttactacttgggttcgagattttctagaggatgatgagttgttccatttcctgtagtatccctgtttggggatgtcagtcatttagaaccgaacagagacccttggatcgatgcctatatttgctctagttgcttactactccctccgtttcacaatgtaagtcattctagcatttttcacattcatattgatgctaatgaatctagacatatatatctatctagattcattagcattaatatgaatgtgggaaatactaaaacgacttacattgtgaaacggaggaagtagaaatctagaataaggaaagggtcttgcagaaggagagataagacagagggatgaaaaccaaatataaattgagtagcaatttcacaactcatcatcataataccagataatgtaacgattgtcacccatttcactgcaggattttgaagaaaatttgcatatctgaattgcacggcttttagaggactagagttacattatttcacatgcagtggcataaatcattggttttttctcaaatcttattgatctagaagagagagcgtgcgttcacttcaggaagtaaccattgaaatccctcaggtacttcgcatgtcaacaaataaatatttgccataacaccagtttgcaatttaagtttcgtgccttacttgtatcttaaccatgtcatcaggcacttcgtttgctagccatgaagtttattgaacccgggaaatttctcttggtgttcttggtttgcagtgcacatgttgtcatctgctcctctaatggaaatgaaacagatcggttatcactgcttgaattcaagaatgctatcactcttgatccacagcaagccctgatgtcctggaatgacagcaaccatgtctgcagttgggaaggtgtcaagtgcagggtgaaggctccacatcgtgtcatttatctcaaccttagtggtcaaggcttagtagggacaatatctccttctcttggaaacctaacattcctaagatatataagtctccaagaaaatttactagctggacaaatccccctgtcacttggtcatatgcatcacctcaaagttctctacttgagtaataatacactccaaggagagatacctgactttgcaaattgttctaatctctgggcgttattgctgaatggaaatcacctagtggggaaagtacctacagatgcccgtttgccgcctaacctttattttctctggattgtacataataatctgactggaaccattcccacctctctatttaacattacgacattaactaaactttctataggatttaatcaaatcaatggtgaggttcccaaagaaattggaaaatcacgcgttctgcaactatttgctgcttctggaaataagcttttaggaagatttcaacaaaccatccttaatatctcttcccttgctgatctagatcttgggtccaattatctacatggagagttgccatccagtcttggtagttcactgtccaatctacaggggttggctttgggcaacaacttcttcggtgggcatatcccaagttccttggcaaatgcttctaagctatccatgattcatctgtcaagaaataatttcatagggatggtgcctagttccattggcaaacttcaggaactctccgtgttgaaccttgaatttaatcaactacaatcaagtgataagcaaggcttggagttcatgaatagtctcagcaattgcaccaaactacgagcattatcacttgcaaaaaatcaactagaaggagagataccaagttcattcggcaacctttctatgaagcttgaactcttataccttggaggcaataaactatcagggcgttttcctgcaggcattgcaaatcttcacagcctgtcaggtctagcactgaattcaaatcgttttacaggtccagttccagattggctaggaaatcttaaaaatttgcaaataatattcctagcggcaaacatgtttacaggatttattccatcatccctctcaaatttatctctactagaaaatgttgtcttggactctaaccagttctatggccatataccccgaggtttggaaagcctcaaagtactacaagtactgagcattccaaacaacaatcttcatggtagcatcccaagagagctcttcagcattcctacaataagggagatttggctatattccaatagattggatggacctcttcctattgaaataggaaatgctaaacaattagaacatcttgtgctttcatcaaataacctatccggtgttattcctgacacacttggtaattgtgagagtattgaagagatcgagttggatcagaattttctcagtgggagcattcctacatcatttggcaacatggaaagcttgcaagtgctcaatatgtctcataacctcttgtcaggatcaataccaaagtctattggtagcttgaagtatcttgaacaactagatctgtcattcaacaatctcgagggtgaagtaccagaaataggtatattcaacaacacaacggccatatggattgctggaaataggggtctttgtggtggggcaacaaagctacacctacctgtgtgcacttatagacctccaagttcaactaaacacttgcgatccgtagtactgaaagttgtgatccccttagcttgcatagtgtcacttgctacgggaatatctgtcttgttgttttggaggaaaaaacatgagagaaaatctatgtctctcccttcattcggtagaaattttcctaaagtttcattcgacgatctttccagagcgacggatgggttctccatatccaatttaattgccaggggaagatacagttctgtgtacaaagggagattgttgcaatatggagatatggttgctgtgaaagttttcagcctacaaactagaggggcacaaaaaagcttcattgcagaatgcaaaactttaagaaatgtgcgacaccgaaatcttgttcccatcctaactgcatgctcaagtattgattctcaagggaatgatttcaaagctctagtatatcaattcatgtcacaaggtgacttgcatatgatgctatactcaaatcaggatgatgaaaacggttcagcttccatccatattgcatttgctcaaaggttaagcattgtagtggatgttgcagatgcaatggagtacgtccaccataacaaccaaggaactattgttcattgtgatctcaagcctagcaacattcttttagatgacagcctaacagcacatgttggagactttggccttgcaaggtttaaagttgattgcactatatcatcttccggtgactcaattatttcaagtgcaattaatggaactattggatatgttgctccaggtaaatcctatttttcatggtacactatgtttcgttgggagtgttctcttcctattttaatgtttggacttaactattctcatgtgctatatgctctatgcagagtatgcaacaggtggtgaagtttcaaccttcggagatgtttatagctttggaatagttctcttcgaaatatttttacgaaagagaccaacacacgatatgttcaaggatggtctgaacattgcaacatttgtcgatatgaactttcctgacaggatatcagaagttgttgaccaagaattgttagaataccagaatggtctatcccatgacactcttgtggacatgaaggaaaaagaaatggagtgtctacgttctgtgttaaacattggactttgctgcacaaagccatccccctatgagcgcatggacatgcgagaagtggctgcaaggctgcgtaaaattaaggaggcctacctcagcagcaactaaggtaattaacctaattcaatgatatgcactcgctgtacatatttccaaggtagtttatcataatgtgtgtttgtattatccttttcttagctagtaaaatgcatgtgtaaataaacatagggctgatgctaagcttacattgcagataccctgaaatcatcagcagcatgtggaccctcagaccctgtatactctgtattctacacaatattggcaactgcgatgattggacggaacctacctcatgtgtcttgcattttccattgggtgttaatatggcactataagcttttttttatggcaatgtaacatacattttaccagtatacatttacgttgcagtatttctctttgtgtattgaggagagatataaaagaaatcacctttctgcttctgctttcttgttacgaaccagagatgagatctgaacaatagaggtagagcagaggaaacaggggagacagaacagagttggtagctttaggaggaaggattgtttggttatttcatattcgatgctttctctcctattacacgagtgcttatatggatgcactggttacagctgtcgagccaacccattcaggcccagagatccgaacattcgcctgtctcacacgcttaggacgcgcctgatgacgaaccgggtttgaagacgtagtcgttgtcggatcacaaacagtagccgtaacatttctggatgggtgtatcgtgaaagtctggatggatatcaatgatagtggtacataataccataaagaggacttgactgataacattatgaacattccagtaaaacaaaaatattgggtcattgctaatctgaaacgcttaggccttgtttggctaaggggttattagagaaatgatttcccatccaccaaaagatatctttaaatcctaactgttcattctccctcttccattttatcctaacccttcacttattttcttatcccaatcccactttcttattacattatccaaacaaacccttagtataatactacctccatattttaatgtatgacgccgttggctttttatccaacgtttgaccattcatcttattcaaaaaatttatacaattatcatttattttattgtgactcgattcatcatcaaatgttctttaagcatttatcatgatataaatactttcatatttgcatgaaaattttgaataaaacgaatggtcaaacgtttgtcgaaaagtcaacggcgtcatacattaaaatacggagggagtagatagtaggaacttgtttttgtaagatgttcgggctgccctcattagttgttgtacgaaatacaaacagggtgccccatatgaagagtctttaggctttacatgggccatgatgggccacagaatcgtcatcgtgagattccatctctgcagcaaagccagcgggaggcaacagcggcgaggcagacgcgaaggtttgagggatctgctggccaatgcgacccacatcctgagattgcatggctccgtccaggaatggaccacggctgggctaccagagtaccagtgcagccacgaccttgggatgttgccggccatcgagacgacgtccacctggtcctcttcctcgtcagtgatgtcagcttcgccgacatgtggctgacctccacctccgccgaattgatacccatcgaggaaacatatatcaactgtgctgggattggattactgctgaggtttgtctgtttaatttgatcattaatccatataaacttggtagcacacggatcggacaaaatcaggcgatataaactggctttgggctttacatggggctgtgatgcagtcgagccgtgcggcgatcggcggcggatggtttcagcgctccagccaggaacggacctcccggaggcgatgagcagcgctccacgccctccggatcaggtgaatcctactctcatgatataatgtttcccttttaagttgggagcgttttcttcctattttaatgtgttgacttaactactctcgtgtgctatgctctgtacagggtatgcagtaggtggtgacatgtcaacctacggagatgtttatagctttggaataattctctttgaaatatttttacgaaagagaccaacagatgatatgttcaaggatggtctgaacattgcaacttttgttgagatgaactttccggataggatattgttgggacaaaatccaacaagcatatatgtgtatcacttatgtattcaatatgcccagctgtgagcaatgtttacatatttatacaaggatgtacaaggggaaattatatcgctaccctaatcgctgatctatctaggcggctggctggtgggccagctttagggctctttggtaagctcctcggtgacaggagggctgcgcccattaagggagcgccgccgattcccaagggcgcctgctattacccgggtaaagacgtgctccgggtaatagcgtgcgctgtctgccctcgttagcggcatcagaggtggttggcagatgcgtagtgcgaatttatagcgtcccactacgcatctgatcacccatcttacgcccaaggctctcgaagctctagcttcctctggagccctcaaacagctccggagaacctagaaggctttggagtccttggatggctccggagcccacgggcaactacgggacaaacctacaaagggattttgcactctcgcagcgaaggcagacgatttacaatgcaaatcaataaagatggacgaactaggctagaactatgtgcaatattgaaaaagtgattcaattggctaaattagattgtgtgtagattcttcttccaattgaactagccttgtcccttatataaggatataagggttggtcttgcctcctgcagatcatcctccacgcctaactcaggataaaaaccaatggaaacccgaaacataccctcctgagtaaggagtcctgacacccaatgaaaatatagactcggtatcggactctaccggtctgaccacgcgcacaagtagtggtctgaccggccaacatatggcggtcagaccggccttgtgagggaaaccagcactcttccaaattttggtaatattttcctaatttaaacctaggtgccaaatttaggtgtaaacaagtcccaccttaatttctctcccctatccacacacattgtgttatattatatggttacaactactatggcttgataaagggtctaaacactgtttcccacttcagttgaataaattgctattctcgaatagcatgagtggtttagtgctaaaaataattttgtacaagtactgagttgttatatttagaattaagtttgaattatgttttagggctaagggagtagacgaaaaccaaaggctttcaattttttttttattgtagatccacggggttagaccggagggcacttgtacataactgcatatctgtgacggtctatcccgtgtttggtcttgcgcaccatcacaccgtcatcatctttaatggatcgaaataaacaccgatacaaatatacttgttcatacatatttcatgagcatatattacgagctcgtcaccgataagacctattggtgacggacttatgtttcggcacaaagtttatctttgtcgggtccaaacctaaccacgtggtgcatgcaataaccgtgtgcccctgtggcctgtgcagtgtgcatctatcagcagcgcatgtgttcagcattaatttgttcgacgatcaattctcgaccccaatctcctacagtatcaagcttgatgcatgcttattgacttgactcaagactcttcagatggtcgatatttagctaattaatgagtgacgatcgcgatcaatcctaggaaaggaaatggcactccgaggtacaattgattttaaaaaatcacatatacgtaacaacgataatatttacattatcataaacacacataggatatgacaactaaaaataaaacaacaacagactaacagggatactatcttgataggcaggggcggatccagcatgggtgctgggactcaagtcccctctatcccgctggatcaccattgatagaagaggagatgaaaggggaagaatatggagaaaatgaagggtagggggactcaagaagaaattaggagatgagtcccctcttaaatcttgttctagatccgcccctaatgataggcactaatatgggatatgaaccaagactccacttaaaacttctccaaaaatactctcgctgtaaagaaaaattgaacaagaataagtaccatccacaatactcagcaaacaacatcgaaaaaaatattctctccattttaaaatataagacacaaccaacctttaacccaaagaccaagaaataattattatcacctcatagtttggattaccctgataaatagaatacatgcacccaataaaattagagatcttcatggtggatgatttaaataataatattttagtgaaaaaaaagtggtagttaatgatatgcatgcatgctcaccttatattataaaacaactttaaaaagtagttatgccttatattatgaaatggagggagtatatgaataatgcaagggtataaggaattgtattatagggatgttttgcagtaaataagcattttaaagcagttgattatttaaacattttaaaacaaccatactatttttttcttttaaccagaaaacagtacgggagccccactatatactaattataagcaattacagggtttatgtacacaaggaagattacatagcgtccatccacggaaaacattgctaatttgctgccttcactactgcgaaactgatctttgctaggtcgacccaaaaccacaatagtcccggtttcaaaaagaatcgggcctaaagatcatctttagtcccagtttaaaaccccacagccattctatgacctttagtcctgattggtaacaccaaccatctttagtcccggttcatcccaagtcagtggcctgtcagggggctgaggatctttagtccaggttagtgtcacaaaccaggactaaatatcaccactttagtcccggttggtattaccaaccggaaaaaattaaacgcgtagtatataatccctctctctctctcttatcctctcctctacaaccggcctctcctctcctcagatcgatcccttcctcctctcctcccctcccctctcctcctcccccctcctccccttcctcctcccatccccggccctctcctccccctcctcccttgccatccggcggctggcggggttgcgctcggcgggcaggcgaccggcagtcggcggggccgcacacatggcgagtggcgagcggcggcaggcggcagccgctaccagcatcctttctctttttttttcaatttgtgattcactgagatatataattttgtgattcgttgcatggatctgagatgtataatctgtgatgtatttgatttgtgatatatttgatttgtgtgtataagtaacttaagatctgtgatgtgaatgttttgtgatgttactttgatttgggatttggggatatgcatcccactcgatttgggagaaaatacaggattaaactatggctagagaaacaatgaaaaaaaaagaaaaggagacctacgcactggtactgccgctgccctctctttagtctcggttggtgttaccaaccggaactaaagataccttctctctagtcgcggttggtaacatcaaccggaactaaagaggcatcttaagtcccggttgaaaaaccggaactaaagggggttaccaataagaagtataaacggtttctccacccgtgctttgagcagttactaatgtggttcagtgagatatttatgtatgtatgatgattgtttgttcgcctgtgtatattaagaaaccgccagagtaaatgtaattttgtcgcatattaatccggtgatatacattctaaacaagggagacatcctgtgcatatttttccggtgatttgtccactgaataacggaataattcagcggattaccaagtgtacgatcgaagtcgcgagctgggctacgaacgaaacgtattgggtcaaaaatggacctacaatagtagtcggactccgccgtcggactcgaggccaccattaccgctgctaactaacggctcgtttggcagaggtttaaattctaaatttaactttagaagaagttagatttgaagtgaagttgtatagcaacctaaattcaaactccacctttttagtttattttatgatagcgctccacccaatttcgctcctattttagataaaactaaaactatttagctagatttgagctccagaagagatggagtaggagttagagtcgtgccaaacataccataactttaggtcttgatgccatcgactccaatatatttgctgtaaaattggtgatttaagttagtaattggctgatttgctgttggctagtaattgttgctgctaaagtattatttgtagtgtttggtgctatacggctatgtattgctgttgatggttaaatggttaatcttggttggcttgttgctgcatgtttaatgtgtgttactacttgctccctccgtcctataatatactggctctgtttgaccacttgtcttattcaaaaattttgtgcaaatataaaaaacgaaaagttatgtttaaagtactttggataataaagtaaataaaaaaataataattctaatttttttaataagacgagtggtcaatcggtgtaaacaaaaatttaaaatcccttgtattataggacggagggagtactagtgtattccttatgtaaaatcaaatgtgtttttgattattattctgtgataaacaattggcatcggagattattggttttgttatttggaatttattttcgaagtggttttggagatgattggatttcacaggtgaatctacatgtactgctgtcatttatgtgtccggtcagaccgggcagtggttgccggtcagaccggcgtgtatagggcggtcagaccagcgcagcccacggtctgactgaccgacgctgtgtcggtttcggtttcgggtcatttgtttggatatccgtgattgtttcatgattatggcttctagatggatactatacgtatgttgatactgttgtttgctactaatgagtcaagttggagatagtttggtctcggaatatggtttctttgtttatttcatgtgtaggtgactcgatgcctcgggagagtatttgcggtgatggaccgggagtcggcttggggataagacgacgtctgtggtggtcagagatcatgcgggatacttaggctagagttgatgcacgtggttgatggagatttcatatggcatacgatggaggtattgtgtgtgtatgggatgcggagccgaatttggaaggagtccaaatttgttatgattggttatgtaaagtttgtttcttgtactagagggtttcctaaggtgtttaaaatttttagtataagtttggttcgtggctttaggctgtctatctcgggtataaatagagggagagcgtgaggcttccctgtatcgcttttgagagcaattgagttgagtttttcaattagggtttcgagtttagtcgaaatttttgtaaggaatgctgttggtgcactttgtaaacacagagagaagtaataaagtcgtcatccactttaagagttcttcgatttgtgtttcaccgggtttcgatggtctaaccggcggtcagaccggcggcaagcggcggtcagaccagcggcagcgacaggcgcagcaggcgacttcggcggtcggacctgttgatctataccggtcaggccagcggcattcgagcggtcagaccggcagatcaatctcggtcagaccgatctccatcgatttcgagggtaacttttatttccgccaaaagttttcagtttttgggtataccacccattcatcctccctctaattggcttagttattgtgatttaatccttcaccttactgctgcctccttctccctttgaggtttaatttcgggtatgggcacctggcgaatgcctcgtacccgtatgaggacggccggagacgggaaaacccctccccgtgtgcggggatgaggatgggaacgacagaaatttctcagtccggtgatggggatgtgaatccgacggatacccgatgcccaactcgcagaaaagattagtagtaattgatttgatttgaattgacaagaacgctaccgttgggcgttggccattaattagcaaactggtgacaagaacctgctgacagcctgccttggtgccatttgccaactagcatgagctgcccctgcactgcacggtgcacatcgacgcagcggggccgctattttctctttttatttttataaacatgtttcctggttgttaaacactccctccatcctatattagtggtcgctttcagttttttatttataaaatttgattattcgtcttatttaaaatttttttagaattatcatttattttgtttgtgatttgttttattatcaaaagtactttaagtatgacttatcatttttttatatttgctctaattttttaaataaaatgaatggtcaaacgttacaaacaaaaagtcaaagcgataagtaacgtgggacggaggtagtagattgtaagatattttgactttgatcaaaatcaaactattttaagcttgactaagtttgtaaaaaaaataataacatttttagcccatgacaaatttattatgaaaatatattcaattatcaatttaatgaaactaatttggtattataaatattactatatttacctataaacttagttaaatttgaaatagtttgacattgaccaaagtaaaaacgtcttataacctggaacaaggaagtagtatgtttggtaaaaaaattttctatagagaactatttaaaataaatccatttcgtaatattataataattaatacttgattaattatatgctaatgaattatctcgtgttatctgtaaaaaaaacttttagacaactaaaccgatctgaacttatccggctttgtgctgttcctgttaaggttcctttggaactcgctattcatctactttctctgttttatattataagtcattttaatttttctaatatttcttaacattaaataaatatattattaaaatatatttaatgttatattaattaaactatgttggtattatagacgttactaaattttcatactctctctattacataatataagggattttctgtcacatccatacaaaatcccttatattatgggatggagggagtataaattattaggcatatcttgaaaagtttgattaaaataagtcaaacggcttaatataaaacgagggtaggattttagttgatacatgaagctagacaaatcattaacggtacgagtaataaagtactaataattattacgaacacataaaatatatttattttatattttaaagaaaattctatatagaaatttttacataaaacataccactataataccatttagtagtttatgaatactcgcatagaagtttctttctccatttcaaaaatataagacatagaccacctttaacctaaataaaaaaataattattatcatcttctagtttaaattaccctaataaatactctatccgttaagtcattttgagtttggtcaaagtcaaactattacaagtttaattaagtttgtagaagataataataatatttttaactcaacacaaatttactatgtaaatatattcaattattgatttaatgaaactaatttagtattataaatattactatatttatctataaacttaattaaatttgaagtagtttgactttaattttaactaaagttaaaacgagttataaccttaaacggatggagtataatacatgcatctaattattagagatatttagtgtgatagatcttaaaaaaaggaataatttagtgggggcggagggagtatacatgcttgcaaatatgtatactcaaaatcctataatataagggattttaagtttttatttgtaacgtttgaccactcatcttatttaattttttttttgaaattattatttattttatttgtgacttgctttattatccacggtatccacggtactttaagtataacttttcgttttttatatttgcaaaaatcattgtaagtagggagtactaaatagccgtacttaatagctggtcagtctttagcgtgacttcggcgtcaaccatgtcactgcaccttgagcactgtgtagtgtgtactatgcatgctgacaacatgcacagacatgttggtcttctcgccaaccgaaagtgtaaccgattgcacgaacctgcatgactttgggtgctttgagtaatgtgcatgcactttgaggcctctttatttaaaggaaattcatataaattttaaaaaaatttattcctaatgaaatttttcctatatagccctttgaatcaaaggaatggatcttatggaatcctatgaaattcctatggattgcctaatgccatgcaagttttggaggaattttaacatgaggtaaaacctcttggaaactttcctttgagtctttatctctcctctaattcctgcgtttttcctgtggtccaatcaaacgatcgttcctgtgtttttcctgtgttttgcaatcctctgttttacacttacattcctatcaaaatcctgcgttttttctattcctatgttttctcattcctgcgattcaaaggggccctgactatgtcaatggccataaaccacacgtttatgattacgttagatacgcaacctaaccaatataaggatgttagatggtatattttttttaaaaaaagtatatatataagttatttaaaaaattaaataaatcaatttctcagttatataatagtaaataattaattaatcatgtgttaataagttttctcgtttcacatgtcctcgaaggttatgttgtttctccgcctttcccaactcacctatctctttttccatgcacactcttttcatactactaaatgatgtgtttttttcaaaaaaaattatatataaaagttactttaaaaattcatattaataatgcactaatgagccactccgtttacgtgtcgaagagcttactccctccgtcctaaaaaacgaatctagtactggatgcgacacattccagtataacaaatctgacacattctggtatgtctaaatttgtaatagtaggatgtatcacatccagtggttggttttttatgggatggagggagcagttaccaaccatcctgaaggaacacagccatttaatgtctttctatttggaaggaacaaatgtactccctccgtctaaaaaaaggcacacctaggtttccgtgtccaacgtttgaccgtccgtcttatttgaaaaaattatgaaaaaaattaaaaagacaagtcacgcataaagtattaatcatgttttatcatccaacaacaagaaattactaatataaaaaatttttatataagacggacagttaaacgttggacacggaaactcaatatttgtctttttttttgggacggagggagtatagccagtcaattacgtgcgtgcatgtcttgtactaatattttatactgaaagtgtgaccatggctagatgcttagtaaaatacaaaatattctttggattttcttcatgcccgtaaaaataaaaagggttaatttcatccatgccactgtaaatgttacaaatcaaaaatatgccactactattcacgttatctgcttggtgccactgtgaatttctaaaattggaaccatgccactccatcactcttttcgtcctcatgtctcccccccccccccccccgcatctcccctgccgtgccccgtttgccgcagcatggcccggcatcggtgtcctccgtggcagcgccgttccccgacctgatgcggtacgcgcggagttgcagctagcgcggcgctggcgcagatcctggacttcgcggcgcagcgactcgtcggggtctcgctggcgatgccgtgcccgctgtcgacgatgacacgatgtcatcaccgagcgcgtagcctcacgtcgtcacggagagaggatggggaggacaaaaagagtgacagagtggcatagttccaattttataaatttataatggtactcaacagataatgtaaatagtggtggtatatttttaatttgccgcagtggcatggatcaaattaacctaaataaaaagggtgtgcatctctataggtggcagtcgtaaattgcaatgacactaataagacacatcattagtgatgggtgcatgttgggaaatccagcatctatgtgaagttttcaggtgactagtcgacaacggctaggtaggttattacatatattatacttgtatgattttgatgaataagagtaataccagctttagccaacatgagtaggtttattaccttctaatgaagaggcggaaccttttgttaccttctaatgaagaggcggaacctatataaaaatccttgtttccatctttttatacaattttgcatatacccatactatgcaaataccgtagttgtgatctaaaacatcgacaaagctgctaatcaagtctctttaacacagggatactctgcgggtcaagacagaacattagtagactgttgtgaccactcactggaataacacaggaaaatctcacctggaaaaaaactgtctacaaattaatataaatatgtttcaatgcatttgtgacccattgttgtgaattcttattttccaataaatacttcacctttttcacgatactttgatatggattgttttctaaagcatgttttgtgcatggactatggttggaggctttatcagtcagctaataatctaggtcgtactccttctaaaaaatgaaccaggattggatgtaacatttcctagtataatgaatataatgaatctggacataagtatgtcctgatttgtagtactagaatatatcacatttaatactaaattatttttttatgggacagagggagcagggtattattgaaatgattcccattgcaacgtacggacagctaactagtaactaaaaattggaataataatataatgaactagctagctagtacgtagagtagttcataatgttacctgggttagtggcggagcatgcctaaaaaattttaggtgggttatacatggggtggtagttagtagcattcctacactaatcctagctagccgatgcaaggtatactgggtagcatgtgtatttttagttgttttatgatagtatattaattacaatattgcttgataattagattattagtatgtaccaaaacctacgtaatttttgttaaaggtttgttactggcagcagtcggcagtggcgatagatgaagctagtgctagggttaaattcctcactgcattggtgagtgcctcggtggttatgtgtgttcgtcgagctattcaagtttggatcgcttgagatggttaccgcagcgggtcaccaacggcatcgcacgaaaaaatcaagttatctaacgtaattaatgtgttgttcatcaggaattaggagacgtgctagttttgtctgacgattaaattgtaatgaacaaaataaagccttctcgttctgatcagatattggagtagtgtgtagcagtagcataaaagcgactttgaaatgtaattagcaatagttttagcaagtgattgaaaataactcatgggagctgtcgagctgatgagatgtcatgcactaagtagcagtaactgagagaaaatcattgagattaggtgccactgatgggatttccttaactaccaagcaacaaaccggaaaaaatcgaccactcggttatctttctggtaggcaagcagagtggtcgattttgtaatcgggattggatcgggcacggatattatcggatacgaatagaagcatggataatatcgagtataaatatggaacgaatatataccaagacgggtaagatctagatacccgaatatgacttgaaataatgtggccggacgggcggtagggtcctggcagcaggtaagctggccatcagatggcccaccatgccgtatggggcccatcgcctctaatcaaggtgaaaaaaggatactccctccgtttgaggttataagatattttgatgttggtcaaagtcaagattttttaagtttaattaaatttgtagaaaattatagtaatttttttaacgcaagttaaatttattatgaaaatatattttattattgattcgatgaaactaatttagtattaaaaatattactatatttgtctataaacttagtcaaacttgaagtcaaacttgaaatagttctgactttaaataaagtcaaaacgttttataacctaaaacggaggaagtacgaagtatacaaagtagtactattcatcaataccatgaatctggtcaacagaatataattcaactacgtgcgtcgcccctataaattaagtgcgtgcgtttactgatggctgcatattagtttgtgtgtgcgctaagtaatcgcccagttaggcggtcatctctggtgcttgttgcgcggcctcttccgtccacgcaatatctgcggttgttgctggatccgccggtgcttgcaaatattttgcaaatttctgctgacctgtaagcacacatctcatcgactccctaatttcttttggttctgttcaggctttgccaattccatacctcccgttcatatgaaatgcaccttgatcccaaaagaataattcaccagccgtttataagaaaaacctattatccttttaaagtaataaaaaaaaggagcccccacgttctctctcatgacttagaaattctgatattaatcggagaaaaagaaaattagaatccataagaaataaaatttaaaaataataaaaatttagaattaaaaatagggaatataagaagaggagactagagcccatacaagtatacaatttagaactaattgaaactcgaaattaaaaaataagaaaagtaaaacctagaagtcagagtccctatagaaatataatttaaaaataactaaaattggaattagaaaatacgaaatatcagaacaagatttcatagctcatacagaataatttagaaaaaaagacttaaattcaagattaaaaaataaagaatattaaaagatgagtttagagtccatatataaatacaattagaaacaacagaaattcagaattaaaaaatagaaatattgaaagaagagtccagagtccatataggaatctagaacaatttgaaagtcaaattgagaaaaaaaataaaaatagagcttagagtccatagagaaatacaatttagaaataactaaaattcaaaattaaaaaaaataatattgggagaagaatctagaatccatataagaatataatttagactctaagaatataatttattttataattttaaaaataaggaatagtggaaaaaacttagagtccatataggaatacaatgataacagaaatttggaactgaagaataagaatattgaaagaagaatatagagttcatataggaatttagatcagttgaaagtcagaattaaaaaatttgaaaaattaaaggtagaatttagagtctatataaaaatacaatttataagtaactaaaattcaaaatttaaaaactaactaagattgggagaagagtttagagtacatatagaaatacaatttagaaataagtaaattcgaaattagaaaataattaataactatcaatacaatacaaaattcaaaattgtgttgttatttgtaatatattttgataataaaatatgctatattatatgagaaaaaataacgatgttacatgctagttctttagaatggctactgtagaggcgtatggataacagtaaataaccaaattaaagaatacatcagtattttcttaacaatgtacagatataaaagaaaaagagaggaccctcagtaaattttcctccctccacattctagcaaaaactcaggaaacaaaaaaaaacagaaagaaaaccactccgatctctcgtttcgcgaagggacgaggcaaatgcgtcgtcattagcattgatgtcaagcatcatccacacacactggtgaagcaatcaagaagcgagacatgcagcctccgtacgagctcaaccttgtatatggctcgagctcgcgccgccgcagcgagttcgtccagtacgccggccgccgccgctagaccttgagcagttcagctccggtgatccggcccggctgcggcgcctcccaagctcgagacgttgaagccagcgtcgatgctggatcccacacccggccgcgccgcctctcccaagctccgatccgatattcagacgtcgatcggtgttcggagaccgcgccgcggccgtgggagattccatttccattggagggcgtgtcacgtgtgagagatagggggagatccgggttaaggttaagatgagatacactacataatttttttcccaaatgatcaaaatctacttttacatgcaattgagccacagtcagatcaaaagtgtctgcgaaaatcgctacttttttatatggatggcgcacccgtacacgaaaatctaattttcgcttgcggatgcttatatcatcctcactcaaaaataaaaatcctaaaaaaaatcaaaaccgtagctaggtgcggtccgccgccgccaccagatccacgcacgggtggcctcgccgccatcgccctcgccttctctgccaagtgggggaggaatgttcccctgcgcgtcgatggtgggggcggccgcgcgaccgccgccggtcgtgctcctcccgctactgtcgctgcccgttgcacgaggtcgctgctgcctgccaccgctcaagcccacccaccgccactggctagctagtcagctgtcagcacggctctcaggagggaagtcgagtgagagagagagagagagaggagagaaggtgagaaatgagatagagaggagtaatatgatgaagagaggggatgaatgaataatgataacttgaaaagaaaatttagtgctaagagggaaagaggatgtaagttagacttttagatggaccttgaagagcctcgcccgcgaaaatacatttgccgcataggaaaataggcttattttcgcatacagctccataagagattcgtttgtgaaaatagatttttttgcatgcaggcctttaaaagagtcgtatacgaaaatggaagtctatttttacagacgctaccagctatggtccccctaaaacctatatgggttctcgtacataaaaatcgttttatttagtagtgttaaataaatataatcacttacacttatagttttatatgttttatttttccgatatttatattcttgtgttttgattctagtgaacaggttagaaacgcatcgaaacaaatgatcgaatcatatacttttccacgaaaatcttataaaataaacaaccgtataaagtttttaaagaaaaataagcacaaggttatacctcatgttttctctttccaattactccaaattccctttgtttatactatgggtcaatcctacgatagtttttaatattcttcaacgtagaaattcaatattaatgcatgggcatgacatttaatttttacgttttatgtgtttttccaattccgtcggtggatttggatatcatctacttcctctgtttcacaatgtaagtcattctaacatttctcatattcatatatatgtctagattcattaacattaatatgaatgtaggaaatgtgttagaatgactgatttattaacatcaatataaatgtggaaaatgttagaatgacttacattgtgaaacagagggagtagcttcatatagcaagtcactataccacggattctttttctttgttatatatagaaaacgcacaatgtaatcacaagcaccacactcatatccttgcatcttttaacacatgcttcaaaaggcaggagtctaagcataattaacacacgatatttcacttcacgtcatgtagcctccttaccaagtcacatataaagcacttcgtgaccgtgggatggatgacattcttttgacttaatctctctaggacttataacacatttggtattacaaataatatcaaatggaaaaaaaatcatcaactacaccccgtcgagctgtacaacttaaatatagagaattatcatggttagggataagtcataacttttatcctatgactcacgggatatacggatatggcacaccttcgtatgtacgacaatattccgtatataaaaaggaaatcgacaagagactatggaaataatcgcgcgggtaggcacataacagagtcctgctcggagaggtttaggattttaccatatagtgcaaggtctgaggtctccgagttctacttggagatcaaggtgatccattgtataaatacataccccctaaggggtccaaggtatcgaatcatatcactagccaacccgtcaccacataagcaatctgtaggacttgaagcctactcgcttagagatctcatcgagactatctcgtaaaggatctcgtcggtaatctcgggatcagttgttcttcattgtactctgcggttttctatattaatctcatataaactggattaggttgttacgttacgagtggactgaactagtataacccttgttttcttgtttgcttgatatcatatcgtgtagatcctcgtaccaacttatcccaatacccacattatccggtctacgggtattgtcacaccccaatccggcaccgccgtacaacggcacctgataggagcgtgtcgtaggaaaaacggcgtgaaccgcttcctacgaaaccgcgatctcagtaccagtcccaggacatagcgctggtacccacggtgacaaatacgaatcattgcaatccttaaaataattagaggacttatttaccttaacttaggttgccgctcgggacagcccgagattacaaccgacgacacggacgaggcaacaccaacaacggcagcagcagcggaaacaacggactaacccccaacaccacaggcaacggctgggaactaggacgaaaccctaatcttcacttcacttcaacttcatcttcagagctggcagaactatatttatatagagagcaagggtgagtacttacgtactcagcaagccaggggaacttaggtggttaatgcaagtttcaaagaataggctgttatttttcaatcggttttgttttcaaggttttcaacaatctaagtgtgtgctttccacaaccagagcgagacaagtctcagctcagtcggggtgagaagtaacaaatttatttatcaagatttgcacaactcccagagttggcctcaaagctggttttcccaaaccaaaccatttttccaaacttcccaataatagtggtccccaaacgaccaatcacttccagggacttccggtcccgctgtcccccggacagctaattgcttcccaagcattaggtttcccaaaccttaacaccttttcataaaacagggtaaaacaaaaactacgctaaggaatcacctcacatccacccatgcccgtgggcacggctgttcgaacagtttaataacctctgcagagggggtacactttacccacacgacgttactagccttggtcacctagcccatgcagaacagccacgtctggtgactttggggctttcacgacaaggcatttcgaaagccgacacagggttaccatatgccaacgagaggggacccagaccaacaacaagttaggtcctagaccatactgcgccaggaagcccgggggttctccccgacaccaccccattgaatccacatgtctcttggcatcaaggctcccttgattagctatttactcagccagaggtgtcccattccacccgtgtggtcgcactattgtatgctcggatgtaattccaaaggaatcggtccttagatgcgaccgcacaagtattccgcctaggaatggccttgtgtcgcgagttttatttttaaaactcattttctttcataaggcaccgacccaggcgtcgggttttccaaagcttttgtaaaccaagttttacccaagaagttacttagattttaagtttgaaggcgaccgtcgatactcgcacagagtgcacaaatatcgaggcgcaactagatggttacaagggaacatgatataacaattaacaatggaaggatcagatgcaacaagttgggtaggcccaccggtctgccttgcagacggggcaaacagattaagtgcaatcctatcaatgcataatattttgcaagcaaattaattaagttcaaatataggctcaatatgttcaaaggtggcttgccttgcttagggtcttcacgaagcttcacaaatcttcgagaattccacttgaagaaaaatatccggtaaccgcaactaggcgcaaacaatcaaaaacctaaacaaagaccaaataaaatatcctatttaggctaattaatagtgccattagatagatcacaatttaatggaattattggaagtggaacggggtaaatcggagttacggatcaagagatatgaattttggaggtttaattggaatttatggacaaaggaaatgatttattggaatttatagaaataatattctcaagaatattattgacagtcactgacgtgcgggaccaagggaaattatttagggaattttggaatggagaattggtttatggaggcaaaggaaaaaggattcaataaatcccttggaaaagaaaaggaaagagggatgggatttatacttcctccttggaaaagaaaaggaaagagggatgggatttatacttcctcggggtggctagggcgcggcccgaggggtttacaaggcttagccggccaatgggctgagcgcggccacggggaggcggcccaacaaagggggcgcgggggggggggggggtgagagaggcggcccggtggacgcggtccaccgcgcggggcccacgtggcggtggttgggttcacggtggggagggcgcacgcgggttgcggcgctagggtttcgggtgcgtgtggcttaggagcggtgcactgggtggacaaacggcggcgggcccacgcgcagccccatggcgcaccgtggtccgcgcgcttggaggggaaagcggggctggccggtttgactcggtctagccaagttggcaccgacgtggcgcctacgtggcagccacgcgggccggtgggaggaggaagaaaggggaggccgagacggacggcggacagcggccgagttcaccggagccttgcgggacggatttggtcttcggggagcacaccggagtgacgagggattcgagagggagcgatccaacggctcggattcgccggagagaggccggcgacgatgaatcgcggcggcgcacgccggcagcgagaaaagggggaaaatccaccagagcaatgggagttcgattcggcggggtgggagcatctccgatgttcaaggggtgcattcccggcgtcggatggggtagagaagtaccgaggagggccggcgacgagcggcggcctccgggatcagacggcaatggcggtggggccatgccgggcggcggcagggcttggggcagcatccacgcgcgttcgggagggctatcgagccgctacgcaagctggagtggaagaggaaaagcggggagggagaacgggggctaccgcgtcgggagatcgctgggaagagcgtccgacagcgcggcgggaccgcctcggcctcgagccggggaaggagatggagagaaggcgatcggagtccctttcggctccgcgcgcacgccgacttcccggcacgtgcaacggcgaggaaggtggtggcggcaaggcggcaagaacagaggaagagcggggagcggcttggcttttataggcggagaagaggcggtttaggagggggaaccgacttagatggtcaagggagctcggctatcgcgtatggtcaaggtgggggcggcgaacttggcagtcacgggcggtagagggggggtcgatggtgccggtcggggaaaaagcaaaaggggagggaggaaagggggctctgcccatgccattctgggagaaaggaggagggagagagagctttgcctccgggagttggacgcacgtggcttggagcggccgggcacacgtcgcagggggtgcggggccgagcggcgcaggcggcgcaggcgcggcaaggctgacggtggcggtgactggtcggtcggccatgcacgagcgcacgcgaaggcggtggcggttcgaatcggcaaggcgctggcgcggcgaggagcgagagcgagcgagagagagagagagagagaaagaacgagagagcgatctcttggctcggctcggcgcgtgcaacacacgtgcgaggctgagggaggggataggcaggggggaaatgggccgagaagaaacggcccacaagccagagggaggcaaactagactttttcaaagagattgaattggagagaatttggagtttaggtttgaattcaaagatgatatttaggaacatagggtggagtcaaggaatggattcaaaacgggaattgaatatttttgtagtcggagcgaatattcggtaaggattcaaaggagactccgtatccttggggttgggacaatggtatgggatagatttcaaaggtagttagagaggtcaatagatagatagatagctgggtagacaggtcgataggtagactgataggtagaaggatagatggatagataggttagataagtagatagatcgatcgataggcagggagggattcaaggtagggatttgatatttttggaaacgggaacaggtatttggcgagggttcaaaggaggcgattaacctttggaataattgaactcggaattagaatcttgaggtggaggattttgatggcgatgagaggaaacaacaggatttgaattgagatccaaggcacgacttagactcacactcaaagaacaaaaattttcgcaattaggattttcagtaaattagcttttaacgtctcgcgaaaagcggggcgttacaggtatcccccgtggataagaatgtcttcatccaagattatttagaaaactcaaattctcatattcttttaaaaaatagacaaaaaatattgggcccctaaacaatctcaaatgaaaagttttcacctataaagttgtagaacctgtctagagaaaatacttaggccatattaaaagaaatattgtaagggtctcaaaaaaacttttggtttatcacaatcggacttaaaatgactttctatacatttttaaagtttggactttataaggaactggatattagaacttgcaacaaacttttgtgcacctaaacgatcttaaaaataaaatgtttcgactatagagttgtagacatcatcgagctctataattttgatataaaacttgtctccatcccaagtcatttgtaaaaactaaaaaaaatcattttaaaaaatagatccaagagcttgtaacgaatatttggaccccctaaacaatctcaaatgcaacaatccagcaatttactctgtttctaagccacagtcgcaccgactctgcatcattaatttcaggcacccgaaataatccactccatatcagcaccctgcttccagtccgtttaagaaatgtggtgtaggatttggtatgaccactatccatccaaatccactccgttttacttccggttcatgatcatgtactagaattaaaggctatgcaactctgagcagcaaatatttactagttacaactaaatagttacacggtagaaattttcacttcgtttgaactaatatagttgttgtatgaataggtaacaaatcaagcaattcttgagagggaaaaggtggagctggataattcttccaccaggtactcactacaaattaaataccattccctccagaataaatatattacgccttggataacacatctggtcaaaattttgaaactttgtctcatcgaatttaaaaatacttgatttgaaaacatagaattggtatgtatagatttgtattgaaaaatactttcatgatatcataaactgattttataacttattctaattaaaaattgcgctcaagattacaactcaaagtccaaaaaagattcaatgctatattttttttatcgaatggagttaatatttacccatactacactttttgagcaccttatttattactctgcagatccaaaatataggtcattttaattttctcaagtcaatattttactctgtatgatccaagatgagttgagaaatatccaattaagctcgtcttttttcttttgattcctcattagtcttgcaaattaaattaatagtgaagtgaaatgaggaatcaaaagaattaaggtcatgactaatttaatttgatcctgatgagttgagaaaatatccaattaaggtcatattgaattcgggaagtagttattatgataaacagcattcttggctgctttttcacaaaaggatatatagattcacagttgttagtttagatgtcatgtctttacccgtgcatataatcaagaccttaaattgtacagaggtagctggtcatgaagattgctgcaactggacagtttctcttggtccttatggcatgcagtgtaatccaaatcgtgtgccaatcgttacatggaaatgagacagatcgactttcgctgcttgatttcaagaatgcaatcattttggatccacagcaagcattagtgtcctggaatgacagcaatcaagtatgcagttgggaaggtgtcttttgtagggtgaaggccccaaaccatgttgttgcacttaaccttacaaatcgagacctagtagggacaatatccccttcacttggaaacctaacattcctcaaacatctaaacctaacaggaaatgctttcactggacagatccctgcatcccttgcccacttgcaccgtctccaaaccctctccttggccagtaacaccttacagggaaggataccaaaccttgcaaattattctgatctcatggtgctagatctgtatagaaacaatctagctgggaaatttcctgcagatttacctcatagcctagaaaagctgagactttcatttaataatatcatgggaaccatacctgcttctcttgccaacatcacaaggctaaaatactttgcttgtgttacactagtattgagggcaacatcccagatgagttttcaaagttgtctgcgctgaagttcttgcatttgggtatcaataagctaacaggtagctttccagaagccgtcctgaatatttctgctctaactgaacttagcttcgctattaatgatcttcatggagaggtgccaccagacctgggtaactccctgcccaatctccaagcatttgaattaggcggcaaccactttaatgggaaaatcccatcatcaataacaaatgcttctaacctataccttatcgatgtatcaaacaataatttcagcgggggattggctagctcaatcggcaaacttactaaactgtcttggttaaatcttgaggaaaataaactccatggacgtaacaatgaagaccaggagtttctgaacagcattgccaattgcactgagctgcaaatgttctcgatatcttggaatcgtctagaaggccgtctgccaaattcatttggaaaccattcttttcagttgcaatatgtgcacatgggacaaaatcagctatcagggcaatttccttctgcctaacaaaccttcacaatctggttgtgatagaattgtctggaaatcgtttttcaggtgttcttccagattggctaggggctctcaaaagcttgcaaaaactaactgtcggggacaacaactttacagggctcattccatcctcccttttcaatctaactaacttggtccacctctttctatactcaaataagtttagtggacagctaccggcaagttttggaaaccttgaggcccttgaaagactgggaatttcaaataacaactttgatggtactgttccagaggacatatttagaattccaacaatacaatacattgatttatctttcaacaatctagagggacttcttcccttttacgttggcaatgcaaagcatctgatatatctggtactttcatcaaataatctatctggagagatccctaacaccttgggcaactctgaaagcttgcaaataatcaagttcgatcataatattttcacaggaggcattcctacatcgttaggcaagttactcagcctgactttgcttaatctgtcttacaacaacttaacaggaccaataccagattctcttagcaatttgaagtatcttgggcagcttgatttttcattcaaccatcttaatggtgaggtcccaacaaaaggaatattcaagaatgcaactgccattcaacttggtggcaatcaggggttatgtggtggggtgctagagt

SEQ ID NO: 66994 - DNA, 27200 bp, Oryza sativa
aaacaccccctcagtactctcttgttgaaatgaagtggctactaatgatagcttgcaagaaaggaggagatgatgaaatcatggtgcccacaaatggtgatagagattgtgtgagacagtggatgaggacactgagcatggcattggattggaccccatttccatcactgtcaactttgtgatcatctaccaaacctgcaaggataaactcatgttttaatcagggatgatatatgttctttgtttatgggagatgatatgtatgcctgttaataacttgagatgttgcaagaggtgtgatcatcagatcatggactcattggtggggtggttactgttaaccacccttggttttcactgaaactgactgatgagttttctgagaatgagaccttgagttgcctctgcaactgttggcaatttcaatttataatggcacaactgaagaaagtgtgatgttgagagattcagtgtaggaacaagctttaaactttacttcgcaccatctgaccacctttattattccctaaatttaaaatttaaactgaaattcaactatgcatgccatccgtcttacggttcgtcgaaaccgacttcgtctaacgtgacaaaacttgaagatattcagaatgattaaggatttgtcgcttttgaaatgcgcaatcaagggcaactaatatttacacgtgtaaagtagatcaaaagcttgaaaactacgggtttttttttaaagatcagcatccgaattttatggccagtgcagtcctcttccatgtctgagacatcgttctccttcagagaaaatgaccctgtacgtaatggccattcatgatgcttttccgcgttacacttggtcagtcactcaagctaagcagttgtgaatgaacacagaaaactttgaagtcaagtaacaagtggtggatcgatctatattctacttcccgtcccacaaagacactatttttcagtttttagatacaacgtttgattcttcgtcttattaaaagttttctatgattagtatttttattgttattagatgataaaatatgaatattacttaatacatgactattttttttaaaaaaaattcataaatcctttaaaagaaaatccaagaaatgtcattgacaagcgtccaagtcccaaaaatatcatcggcaagtgttagttccaagaaatgtcatcatacaaacgactttgtcccaaaaatgccatcgtcgttagggttccgtccatcctgtgccattaagttctatatgatgaacagtgtatttaacggtgtaaaataaatgaaaccctaacggcgatgacatttttgggacaaaatcgtttgtatgatagtatttcttagaactcacacttgtgtcaatggtatttctgaagttggacgcttgtcaatggcatttattggattatctctttctttaaataagacggacgatcagaaataaaaaatgcagtcttcgtgggactgaggaagtagacttcaaaagttgagagttccaagcttgttcctgtggggattgtttagttggtcaattcaattcctaatcacagtcaaaccgtgtgagcacattgataagcttttgaccaaacaagtagtggttttcatagcactactagtacttattttgaattcatgtcgacaatttacaatttacccagatgtgcaaatctagcaatgatggaaaaagtgtaatcaacagaattttttttttacctactcttccttgtcagtcatgtacagaaggatacaaaatatgacacagaacaataatcgagggtgtaacgagcaccactatttctcactaattcctgaacagctaaaagaaaatgtaagctcaacagatatcataactatgcatgccaactcagaaactgtctgtttcttgaaatatacctctaggacagggaatcaacaggagacagagtcaagaacacacccatctttttctgtgacattgttatcttttattcctttttgcacatggaagaacagtctgatggatgaaataaacttttttttccagctagaaagaaacttcacaagaaatatcttgcatcgctgttctcaaaatagcataaacaggagccaacttttaacatggtcaagatggcatcgctgttctcaaaatagcataaacaggagccaacttttaacatggtcaagatggtgaccagagagaaaaggtgagtgctactgctacacatgttagtagcacttagcaccatctgccacgcacgtctacagctaacctgaagcactccgcgtgggctaattaaactgagcagcatctaatctagtcttgtgacccgttcaacacggtcatctagtcttcaaaaaacttgatcaattttatgctgtcaaatataatgaaagggaaaaaaaaactccatccacacacacaaccaatgatcccaggtttcatctcctgaactttgaaaccgttcgagttgcctactccatctgttctataaaaaataaccatgttgacatatcgttcgagttgcctactccatctgttctataaaaaataaccatgttgacatatcatagtattacgaatctggacatgtctctgtctagatatctagtactaattggctttttatggaaccgagtgagtaccttaaagatatatttgtgtctagcttgcataggctgtgtttagttcacgtcaaaatttgaagtttagttgaaattggaacgatgtgatggaaaagttagaagtttaagtgtgtaagaaagttttgatgtgatggaaaagttgaaagtttgaagaaaaagtttggaactaaacacgaccatagttccacgaatgtaactcaaacaattaaaaaaattaggccccccttaaatcgtaggaatgagaaaaacgggcaaaacaaaggattacaaaaacatatgaatgaccggaaaggaaattttctatgaggttagagctcttgctaattttcctccaaatttttataggattgttcattccatagaaattttaaaagatatgataggattcaatcttttgtttcaaagatcttcctaagattttttttcctataggattaaaatcttccaaaatttctatgtttttcctataaatcaaaggagcagtgaacttagaccattggcatagttgagggataaaatacaaggtttttttaaagaaaaattgaagtgtagatagattctctcttctatgaagtcaacgttacgaatcaagttcagttgacgtggtacacataaacatctcattagctcagaaaaaaaatggagtttaaattattgccctaaacaatatactcctatcctaccaaaatatagcaacctaattgattatacaacacctaacaacacaaattttagccatattcattaactccgggacaggggcaacgctacagtcgaatcattggggttagtcgaccctgacgattttgtgaacatctcgtagttatttttagtttgtatcagggttcacctcttcgacttagtattggattccgaaccattgtggtatgacttttcttttccaaaatttgataaattttggtcaaattttactgtttcaaatttgaattctcaaaatgaaacttaatttggaatctacttttgtcccatatcaaaacatcgaaattgtgtggtttccaacatgttttggttgaaaacataaactttagttagtactgaccccggatagtgctccatggaaaggtaactttttacaggacagtgctgaacccacggctgatatatatactccatttgtccataaaaaataatctagtaccggatgtaatatattctagtaccacgtctgaacaaaagcctatctaaatttgtagtattatgatgtatcacattcggtactagattgatttttatgggcgggagggagtattttattgcatgtaaacattcctgagcagtagagtaagattctgttcccagcaaagagagcttggtcactattctattgctgtccagtttagctatctgctcagaatctacagactgataatatataagaatccagagttcttgagtagtaatgagtaagtacatctgaacctcaccagccggctcatcatcatatccatgtgagccattgcaggttttccatcctgagcgctgctttggaaccaaattttatcagctaataggatgggatcaacttgcagataagatgcctctgaccatatcaccaccaccaccactagtgtgaaatggagactttaaacagccattccatgttccaactttcacaggtcatactagtttctttcagactttcattaggcatggaaatcataccaacagaaatgtagccaccgccctcaaaatccacctcacaagtccagcggtgttactctaatcacataccaagaagaagaagaaatccaatatctatatacaaaggcacacaaggcctaactgagcccaatggcatcgtgccatcgtcagttcaccacgaggccattggagccaatggccgattctcgacgaagttcgtcgcctgcccatagtgagaattgtgcagcaggatcagcttcaggcccttggcgggctccatgggccttgggatcctcctcctggctccatggtggctgttgtagtagttctcctccagggtagtctcgtccaggcacgaccaggctgaacctctcggcgcgctggccgcccacatgaacctgctggagcacgggttcaccagggtctccctgaattcctttgctccctcgcaagggaatcccttcaataagacagaaacacaatgaactcaattttaaatgggtggagtatggtttatactctggttcagtggctctaatttgcatgaactgcaaggaccgagtcaagttaaggagtttaaggttacctctgccatagctttgatcttaagcgtgacgctgttggacaggatgacgatgttctggtttccttttagtttgttgaaaaggagggcgcagtcaagaacgcgatcttctgttttcggggagacgatatctgagaagcttctcggggagaacaaggctatcggattgaaggtgccggcagagatttctctttctccattgttgcatagcgctgtaggggttgcaggtggagttggtgctactggcagcatctcggttgaactctgaacatggatccaccagctctccttttccatgcactcattgatccattggagcatggaggtggcctttgataacattctgaacaatctctcccgctttttcaagcactcaagctccctgatcactgacaaaagggtaaacaagctttcagctaacaaacaagaagcatagcatggaagatgcagtcggttcagttaaaaacaagggtatggattacaagtgacaactgcactaaactcaataaagcatattgcactgtgagcgacaaacatagtgagaaatgcaatgcaatggaccactttatacataggtgagcgtgcgcatgctaaacagcacaagaaccaaacatacaaggttaattgcatctatttagtactatctccatcccaaaatataagggcttttggcaatataaatgcatagccaaaagcccttatattttggggcagaggttgtaagagaatagcaagacagttaaagctacagaagcaacttgtcattcactcaacatcacaaaatccatggattacaggtagtaaaatctagcatggcatatttgttagaactaagcagcacgacagaatgacagatcatgaattcagatataaacagtacataaaaagaatatacgctggaagatattgcaggcaaccaagttaaagcattggttaaatgtctagtagaccgaaaggtaggtggacgggtgaaaaatttactatgataaagctcttaacttaccaatcattggtatgaccaattgagttccttttaagcctcttagcagcatgatggacttcctagattcatcatcaagaagacattccatatcagttaccatggtccagactttcattccttctttggtcttttcagactcttgtcctttgtgctgttcagcaacaaaaattaacttagttcagattccttatcagaagaaaaaaagggaaaaaatatgtaaaaaatggaatattattgacaagaacttactggaacattattcagttcaccctccaacttcattgccacatcaactgctctaggattaacctgggtactatcaagtgaactagtgtgtcttaagggagaattcgacaagagtgtctggaaggggagcctatcaaccacccttttctttgtgatagtactttccattcgtgcacggttttcagacaaatcctttgttttccgagaagcagaagatactggcgtcaagttctctttgtcagagtagaaggcctcttgatcttggtcagcatccactgtgaggctctttggaagacatctccttgctttaatgcctcctgaagatataggtgtcaaattttccttatcagaatagaaaacatcatcatctactgcgtgacaaactttggactttgctgataattcattgggttcttgtctatggatcctcctttttgaagtgcattctacagacagcgaattatccacccttggtccaagaaccttcctaccaatgatgggcttcagatccctggaggctggtgtcacattctctttgtctgggaacaggtttccttgtctcacaggggatatagtatcatacttttcaggagaaagcactgaggtttcctcgtctgtaaggatgctatctttgaaatctagatgtgcaattgtcataaaccctgcatggctcttctgcatatttgcatcaactgaagttagcgggataagattcttggcgataagttcatttgaattcatctgttctccaatgctcaatatggaactttcatcatctgaaaagtcgttatgttccaaattaagaggggaaatggaatccatcaattcttgggaaatggtagtgggcttcaaccttagctgacttctctccactattatatctcctgagacaaagggggtgatgttctccttgtcccatggactgttctcttcattttcttcatttcctttcatgttcgaaatttcaaatagattctcactgattgtgccttcactctcagagtcctcaggagccacaaaaatcttactttgagcaaaattctcattgcttgtgagagttgcatccaagttaagaagggttaaaccttcatgccctgtgtctttgttgctgtttgtattttcatcagatatgtcttgcatgaatggattttctaagatgggcccagacaactccttatgtacagaagcacaaagctgtaggattttgctgtcagtgaagtcatcgcctttgaaaaccagaggggaaacaaaatgcaataattctgatatcttctgtggattttcacaaactgaatcttgtgagatacaattcacagagttgaaatcattatgctctgtctccttagcaacactcagcacgcagttttcattatctgaaaatgtttcatagtccaaattcagaggggcaacataatgcacaaattctttggattgaagatgatttgtctgttcctgattctcctccatcataattctgtccaagatattcatcttttccttttcttcagcttctccgacataagaattattaaacaaaaccatgcaggcttcacattctatcccacagttctgagaacatataggattctcattttggttttcttctttctgatagctgtaactcaaaggagtaattctttccttgcttctgccagtctcaatgcggagggttttgactgacttcaacttggacctcctggcatttgaagtgtccttttcgcctgacttgactgatcttccagcatcttccactgtggcaagcattggttgtgtaatcgaagattcaacagaatatataacatggttctcttcaatcaaatttccctcaatccttccctctctgctgtcatcaaattctggaactgaagattcttccagagcaaataaatcagcgaactcaggtataggtggtgctgagggaatcacattagcatgaaaatcaatttgttctgacacaacttgttggcttgtctcctgagaattatatcagatagttagccttccagaatatgaactcaaaattccaaagggaaagaaagaaaatcaagtagtagaacctaagtcaacagtgcgattagtatttgactgtaagcaatggagattttgatttggtaggatttaacttcaacatgcaaaatatataccatgcatccagtgcaacacatgggcgtataacattcagacaaatagccaaactaattgtttagcttgagatgaaagttatttttataatcaatgcatctaaagtaacaaccattcgcaagccatatgaaatcactttggagcaatttagatagtgcacaatataatcagcagctcccaatataacacatagatttttaccctaatctgctcacatgcacaacgcatttaggccattatgaagtggccgagattttcaaaaccacaacgcagaagatttctatagatggtaaaagcatcactaaaatagcattaggcagaactccagaacgacagtgtatagcaaaagcagctaaaagtcatcgtttattagaaacttgacatttccaatgaaaggggcaggggcactactctaagcaactactaattcaaaattgctgggtactggattatttagttatcagttaagaattaacagagcagagcaaatagggaatccagtagcacatattagacttcaaaatagtttgtaatgcatttcataaaactgtgagcatagagtatcaataaagtggatgagctaatagtcatttgccatgaaagaatttagcatgtattttattattttggcaatcagcagcagccaaggacatttctatcgcctgcatcatatgaatttcggcaatcaagcctattgcttagcgtttcaaaacgctcaacacatatgtccagaattctaccaaactatagaacatgataacatgacaaaacacactgataatttcagcatccagttacatgagtttacggggatcagacctgatgagtctcagtatccgctgactccttttgatcaggctccaactgcttgcttgcctcctgagcatttcaacaaacacttatattgcaacaaccatgcccccaaaataatcacagctatggcactgatcagaatagagaatctgctacctgacaagtactaagctcctccttatcctcctccagcagcggtggcagcagatcctccatgtcaaatgcttccgggagcgacagccagtgaagccggtattccctcctcgagctcccaagccgcagtacatcaccggctgtcagctccaccggagtgttcggtgggatccttcgtcccgagatccaagtcccatgcactgtgtaaaattcacaggacaaaaatgggtcaatgccatgttagcttttgcctcattttgatccaaatcgcaagcaaatattcgccatcatcgcaggagctaatcgagtgataatcgaaatgagctaacgcacgcgtccaccaaaaatccccaaatgaagcctcaatcaaaaccagccacgcgcacagggagatcgagggagaggcggagcgagaggcgcgggggaggagcggaatctcaccggaggagaggtcggtgacggtgatccgccgctggcggcggcgggagcggacctcgaggtggaacctgctgacgctggggtggtcgacgaggacgtggcactccgggtgccgcccgaacatcaccggcggatcctcctcctccccaccccgcccccgcgccgcctcctccacaggcagcggcgacgggggcgcgttgaggaagatgttcttcagcacgactccccccttggacaccgcgaacgccgcgatcggggcctcctccccctccgccgccgccgacgccatgctgcaggcagggctagcgatctgcgcgtgcgccgcgatcggagacgaggcggcggcgcgactcgctgggtttgaagcgttgggattttttgggggatacgaaatctgtggagactagtagtagtagaggcgggggatctcgcgatcgaggagacgttggaggaggggagaggaggcgccgggtgggttcggatttggaagcttcggaaatgcaacggctagaaattttattctagaaaaagatagagataaggacaaacgtgcgcgttccgttgggccgggcctgtaagatgtttggcccaatcagcattggctcatacgaggcctagcccatttatagggttgggattatttttgttggtaataagtttaggtatcttaatttgttgccgagtctaaatttcgtccctgaaccacaatactagatagataggatgcgtcactcaactcccataaccagttgaaataaggtccttatgcggtttgcacaatgattttggttgacgtgacttatttgattaggtcttcgttccacgtgggattgacgtgacgcttatgtggtaattcaatccggaaaaataataaaatcatggggcccacatgccaattacaccacaaaacaataaaaaatggtgggggtccacgtggaccctattgtcatcctctcaccttccctcttctctctcctctctcttccacattataatttttaaatattataatataattacaatgcaagtgtatgtaatttacatttgactattttttaaaagaaaaaattgtggcaccataaatataagcagtcccttctcttttttctttcctttttcctcttccaaatttctctcatcataaatatttttattttaaaattatcatcgtttaaggtgtatatgctgtgagattgttacttcgcaaatgcttttcatctatagttaaaaaattttactaattaaataaccaaaatttaatctttggttgatgaggtatagcaaaatgttttaacttatggaatagatactagatcaatacttcaacacttcccatcagccgacgaggatgcctgacgatgaacccaagtgtctgtgtcaccgacgcggcgccacgttgaagttcatcgacatcggcaacacctgcgacaccacccagggttggaaattttggaccaaaatttcggtcatttcggtcccctccgatacgatattacttcggccgaaatttttaaatttttaaattttttcatgaattttggtaatatttgttcaaattcaactaaattttgttcacaatttcagaaatttcggtgacctccgatcaaagtgaaccctgacaccaccctctgcgaccattccagtggcgccttcatcgtcaagacatggacactaaggatgaacgacgacgacaacatggcgtggaccatggacaccatgattgatgccaccaacgcctacgctaccaccagcgcatcccacgtgtcaatccggagtaccccgtcgcgagcacagacgacgctggacatcgagaaaattgacattttgccgttgtcaagatagagtttcactagaatgccatcccacaagttagcttcgttaaaataccactttcaaactagactaacacggtacaatgccattttttcaacttcttcacaattaaacgatttttccatattttgtttcgtgaaggtgaccaaaatacccttctctccctctctttcgttcccatcttcccctggcatagtagccgccggcgccgccagggtgggacacagctcaagcgggacggggagagtgaccaggagacagtgtgccgccgcgccccttccctgccagctcctcggcggcgcaagcaaggagtccatggtcgagcgcgctggcccgccagccgagcaaaggagaaccaatctgcggacgacatcagttggataagcatagtatcatacatacaccaatatacaggcttgctacttcgcgtgacacacagggagctaccaagtaccaacaatcagcagtacgcacatcctggccagaggagcaaggtcgacctcctcggtgtcaatagtggccgacggcaagcagcacatgcacaacagaagggaggcgtcggggcagtgcgcggccgcggactgcgacgaagggcgaactggaaatggctgcaggagaacaaagaccagtggagggcggaacttgttgcttctttcggcaggagaacgaagaacaggactcggcaggttcgatcgatttatccaggggcattttggtgagtcaagttatgaaattatagcaaaataattttaattaggaagaaacggagaaaatggcattgtagcgaataccacttggttgagagtggtattttaatgaaaccatatttaaagatggtatttcagcgaaacccatttttaaggagggcataatctctattttctccgctgacatcacctgagataccggggttggcctgtgatgatttaatttgttgagggcctatatgcattctttgccatgacaattaacgatttgtttagggctccctatgagtttgagaaagaaatgactgttgatggaaattaaggccggtgaaacttcttctgtctgctctgtgcgacagacataaaaaaaatgcatgagatactttgttgtaaattacttctggtagtactacactgtgcgcttttgatattggtataccaatggtagagatcctaattacttgcaaaaagaaccttgttgtaaatattatatgtattctacaatataataaatcatataataagctacatagtcacaaaactacacaccctgtttgaggagctcgagatcctgataagtaggttataacaatataaaaatattgggtttttcaactactgacttttaatttattttttagattatatgactacatactctcaaaatataggtgagaacctataccgtttagaaagctaaagattctagaagttgtagctaccataaactccccaaacaaaggcaaagtttgatgttgaaaatttaaggatgaatagtcagttcactccttcaacttttgctcagaggtcgaattagtccttcatgttttataatgtccaaacaggaccctaaagattatcatgcggcttaatatagtccttacacccacttaaaacgccacatggacatgccacgtcattcgtgcatgtaagataacatttaaatgtccattttaaccttcaattttctatcaaataaagaaaagaaaaacaaaaagaagcaatcataaaacaaaaaatgttaatttttttttatctatcaatgctacatatttttgccaatggtcaaaagcttttttttgtgtgttttctcaatagtttttctttatttcatatgaaaacataagggtgtaaagaacatttaaatattgaatttgcatgcatagatgatgtggcatgtacacatgacatgtttagagggtctaaggaccatattgaatcacacaatgaacttaaggtacttgtttggacaacacgaaatgttagggactaaattgatccttaagcgaaagttcaaggatcatgttgggtattcacccaaaatttaacacaaatttatgtacttaagccatgaagctgtgaaattatggatttagcattgaatttattgcaaaaggacagcattgttgtcccgttgaaactttgaaatatgtgtattgtaatgaaattggcaccaaaactatagttttcatatactatgattcaatatatagttttatgataaatttgatggttaacatgtagtattataatattgtgattgacatatctacttaacatatccagcagaacttcaatcatcgtttcttaaaagaattactcatctacttttggttcgaatttatgtaatcaaattcaataagtcaaattatagttttgtctgaagtaactcctctcagttctattgtgttggtgctttcatctttaagggtgatgtacatcattgtcaattttctttgcggagaaacttacgattctttataaagtactttaaggtatctaaattttacactaaaaattttgatacctcgaaaaacctatagtatctagagatactaagttttacaataaaagatgattatattaggtcaccgtgcatggaaagccccattgactagttgctctggaaagaatggtactgaaggtgaaagtcactagtacaagaataaggcttcaggatacaaagctgattttttttttcggtgcgcttgcaccaaatcaatattttcctgatggaatttatcattagtgacgggcatgcgagcactgacaagaaaacaggattatctattcttggcgtgacagttatctctgtgtataaaattacatagtagcttttgtttcaaacatggttagatatctacatcgatggtttggttgctcagcctataaatgaattgaagagttgtagattaaggaattttgtgaaatgagtggcatgaatgaactgaagtgcgtgatgcagctagctagccagaccggccgctctctggtgttctctctctagcgcagttgtgagtttgagcttctcctgtcgcttgtgttcctgtttaattttgctattaaaatttgaattgcatttgttcatttggcctcctggtaagtatggaattcatctaattatatcattttcctccatactagctccataaaaactgatcagaaacatgaatcttgtcttctagaatagatttgatcatcagttgacacgtgctatatactccctcgatgtctctgtcccaaaataaatgcgcacttctagttcaaatttgaatagaggagcctattttttgtttgggttagttggaaaatccatatcattataaatttcacggtttagaaatatactattattattcacctatttgtaattatatcatttcaattttaaagtattagagatatgccactatatatctttttactgtactccctccatccctaaatgtttgacgccgttgacttttttaaacatgtttgaccattcattttattcaaaaacttttgtgaaatatgtaaaactatatatatacataaaagtatatttaacaatgaatcaaatgataggaaaaaaataataattacttaaattcttttgaataagacgaatagtcaaacatattttaaaaagtcaacgtagtcacacaataagagacggagggagtattttctaaccttttaggacaaatctacccctgtcttctccattcaatcgttcatcctttctttcctctgatcctctctactgtcccctttcaacctgtcatcgccgcgtccaccgcagcgtcgcaccccgccgttgcgctacggctcctcggcctcctcgccggacatcgctctccggatgtgaggactgaggcgccgccggatccaacagcagcaagcaagccctgtctacagccttccaatgttgaaatactttattttgctgcaaccctctagcatcctgctccaaccttgtagcgcacaaattacaaatactttgttcttgttgcagccttactgcgtcctggcatcctgcttgtctagggattgttcttgctgtatgccagagctgagaggagagagaaagggaggggaagaaagaagaggatgaggaggaacaagagaaggtaatttggtttggaaatcgaagtgaaagggtaagtagtggtatatcccaaatacttgttaaattataatggtacggatccaattagccctatttttaaacagagggagtatctaatatgtcttgacgcccattctgcaaaattaatatagctatcatgcaagggcaaaagatttcacatgcttgttttgacttgtatttttggtgtaggagcaattaagaaaggcaagtcctcagaaaaaggaaatacctgattattaatttttcatgcaggtaattcttaacaaaattagaatgaatatttgctaggacatttttgaacacctttactattaaagtagtaggtgacacttccatttttgtccagaaaagaatgcttggttcacacttagtatttataactattcagagtttcttgcttttattatctatatgaatataactaagacataaattcggcagagttggttaattggtcatgaagtttaccacaatccggcagtatctgttggtgcttatggctagcagtataatcaaaatcatgtgcagctcattatatgggaacgagacagatcgactctcactacttgagttcaagaaggcaatcagtatggatccacagcaagccctgatgtcctggaatgacagtaattacttttgcagctgggaaggtgtctcctgcagggtgaaaactccacatcgcgttatctctctaaacctcacaaatagaggattaattgggcagatgtctccttctcttggaaacctaacattcctcaaatttctctttctacctgcaaattcatttactggagagatccctcagtcccttggcaatatgcatcacctgcaaattatctacttgagcaacaacacattgcaaggaaagatacctaatcttgcaaactgttccaacctcaaggtgctatggctgaatggaaacaatctggtaggacaaatccctgcagatttgcctcaacgctttcaaagcttgcaactctcaatcaacagtcttactggacccatccctgtttatgttgccaatatcacaacgctgaaaaggtttagttgtctgtataataacatcgatggcaacataccagatgattttgcaaagttacctgtgttagtatacttgcatctgggtgcaaataaattggcaggtcagtttccacaagctatcctgaatctttctactcttgttgaacttacccttgcttccaatcatctgagcggagagttgccgtccaatattggtgactctgtaccaaatctccaaaagttccaattgggcggcaacttcttttatgggcatatcccaaattcattgacaaatgcttccaagttaaatctgatcgatatatcaatcaatagtttcactggggttgtgcctagatccattggcaaacttaccaaactgtcttggttaaatcttgagctgaataaattccatgcacatagccagaaagatctggagtttatgaacagcttagccaactgcactgagctacaaatgttctccatatatggtaatcgctttgaaggcaatgtgccaaattcttttggaaaccattccactcaactgcagtacatacacatgggattaaatcagttctcaggattaattccttctggtatagcaaacattcccaacttgattgctttagaattgggtggtaatctgtttacaactgtgattccagattggcttggaggtctcaaaagcttgcagaccctaagtttatttaacaatttattcactggacccattccaccatctctgtccaatttatctaatttggtagaacttggtctaagcacaaaccagctcgatgggtacataccaccaagcttgggatacctccaagtgcttgaggaatttactatttcccataacaatattaatggttgggtaccaaacgaaatcttcggtattccaacaatatcattaatttggctatcattcaactatttagagggagaacttccttctgaagtaggcaatgccaagcagctcatgtacttgcaccttacatctaataaactgtctggagatattccaagtactttgggtaactgcgaaagtttggtagacatcaagttggaccagaatgtttttactggaaacattcccataacattaggcaacataagtagcctaagagggcttaacttgtctcacaataacttaagtgggacaataccagtgtctcttggtgacctagaacttcttcaacaactagatttgtctttcaaccatcttacaggtcatgtcccaacaaaaggagtgttcaagaatacgactgccatacaaattgatgggaatcaggggctttgtggtggtataccagagttacacctgcttgaatgtcctgtcatgcctttgaattcaaccaagcacaagcattctgttggactgaaagtagtgatcccattagccacaacagtgtcacttgctgtaacaatagtatttgccttgtttttctggagagaaaaacagaagaggaaatctgtatctttgccctcatttgatagcagctttcccaaagtctcttaccacgatcttgctagagcaacagatggattctcggcatctaatttaattggcaggggaagatacggttctgtatataaagcacaactgtttcagggtagaaatgttgttgctgtcaaagtcttcagtctagagacaaagggagcacaaaagagcttcattgcagaatgtaatgctttgagaaatgtgcggcatcgcaatctagttcctatccttactgcgtgctcaactattgattccaggggaaatgatttcaaagccttagtgtataagttcatgacacgtggtgacttgtatgagttactatactcaactggtgatgatgagaacacttcaacttcaaatcatattacactggctcagaggttaagcattatagtggatgtagcagatgcattggagtacctccatcacaataaccaaggaactattgtccattgtgatcttaagcctagcaatattctcttggatgataatatgacagctcatgttggggattttgggcttgcaagattgaaaattgattcaacagcatcaacttctgctgattcaacttcttcaattgcaataaagggcacaattggatacattgctccaggtgccgcccattttcatacagcactatactttttttttccattttcaattgagaattgttcatgcaagtttcattaacatttttttaattgaagtttcattaacatttggaataattcaataaactctccttttctaaatggtctatagagtgtgcatcaggtggtggtcaagtttcaactgttgcagatgtttatagctttgggattattcttcttgaaatatttctacggaagagaccaacagataatatgttcaaggatggtctggacatcgcaaaatatgttgagatgaactctccagatagaacactaaatattgttgatccagaattactagacgacaaacaattgcaagaaattcctgtaaccatgaaggaaaaatgcattgagtgtttagtttcagtgctaaacacaggactttgctgcgttaagatatcccctaatgagcgcatggcaatgcaagaagtggctgcaaggttacatgtcattaaggaggcatatgccaaagcaatctctggtaataatggcattatttgtatcatacggagtactatataaataagtatgcaaacagctgatgcttgaggcttgcattgcagattcgcaggcagttatcagcgacaaaacttagtcgctgacgaagtagaacatccggcacatgaggttgcatgctgtttttttctctcgtatttattgtaaggattctgacgtaatctgatggagaaagcaggcatgcatgcttgcagtagcaaatatgttatgctttttccactgaaagttataaataaatttggctttgtgacattattgaattataattatgagaaactggatatattttgtattgttgccaaaaatgatgacattttcctcccacaatttattctaaaggttgccagtaacttctccagaatgaccacaatataacataatcttccagatcaaacgcatgcaagaaagggtagagatatgatattcttgtaatttctaatgcatttatataagaaaaggatgcagttcttgcagtattatcagacggcatggaacagaacattttcagcagggactctcagggcgtcctgatcctatttaattatgaaatgatgcaagatgcaaggaagaatgtagtgtatacctccaattttgtcctaacttttactgttccatcctctctgccacaaagaattaggcaatagatctgctcagctctgcacagaaaaaaattggggaggggttggatggacgtgaggcagtggctcggcggcaggcaccagcgctggcaagagaggctgggaagcagcggcgccggcgccggtgaagaaggtgggcgaggaggaagaaggagggcggccgactaggctagggagaaagtaagtgcacatccagaaaatcattttgttggtgttataatatatctatactaattatacttagatcatggtgttataatatatggataagcagtttcagtacatgtttttcttctgctgtagatccgcctctgggaggaggagaaagaggtggccatgggaggttagggtagggaggtattagttgccggcgtagcgtagcgctggggtggtacaaggcggcgcggagatctccggcgactggccggcgacaagtttcgccggggaaggggatgcattttgcaggaaggtccttaatatttttgtgaaaaaaatgacacttactaatggtcctgttttgcaaaatagcccctgcctcgttgctggtgggctgacatgtccacatccagcctggcccaaattaactgctgatagggccgggccgatagagtatgagaaacagaattacgagcccattgtcagtgtagttaacgatgaaactgtttggaaatgccatcgctctgcccatcaaccgtgaataattttccgaatcgaaccatcgattttattaattgggtattgtagatctcttggaattcgacggatagatcgatcgagctaggaactcgaaaatattaatgcgtccaaataaacagaaatttcaaagtgctctcgagaaattaaaattatctaaatttcatagtgccatccgttgattcctagtcaaactcatctaaatccgctagccgcggccatggaaacccaaccggagatggcggtacccacggtggccggtaatgctcgagcacatcggcgaactcgaggtcgatcacgaggattcctactccaactcctgcacagccgacgccgtcgccgccaacaccgcggcggtgacctcgctcgctgtcagaccccggatattcagagaaagaaatggaacccagaaatcgcttttgtgtgcgtcgcaaggacctaaactagggttcctacgctagtaatcaccgactctccccattgtgtcacatggtccttttgctctgtgatactgtcaggtcatagacaaacagtatagccagcacagtaacaagaacaagctagcatggtgaactacgagtaacaattttttttcaggaataacacaaccccaaacaccatatcgaaaattattaacttttaagcatgagtcaccagccttcctctcctagtactacacatgacaaacagtaacaaacggaaacaagacgatctctacgcataccctttgcccggcagtggccgccgccccgcgccgcgtccttcctcctcggcctccttgcgcgcctgctcgacgcgctcctcgacctccccctccgtgtacccttgctcctcgagcgcgtccctcagcaggagcagccgcagctccacctgccgcttccggtcgtgctccaggatctccttgctcggcttccgcatcccgccggcgtcgtcgaaccccggggccgggggcggcgccttcgggggcccgcccgccgacgacgaccgcggcttgatgaagaacttgttggtctgcacgtgcccattcgtgcccgacccccgcgcggtctggagaccgatatatgccgttgtacattgcggcggcggccggggaggtggtggtggtggtgggccggcgtaaccctagctagggtttcgatcggtttggttcgtcgcgagatcgcaaggcaatgtttggctaatgggaaatggaaatgatttccaccaacaaaaagacatctttaaatcctacccccatttcccattatccaaacacaccccaaattcgggagggagacgggatgagagagagagagaggaggaggaggaggaggcgagcgtgatcttattcggcggcgcttcgtgggacggagaataataattcaagtcggtttctgccccactcgaattgatgaaattttggattaaagtgtacgcttttcaaactgctaaacggtgtattttatatgaaaacttttgatatgagagttattctaaaatatcagattaatccattttttaagtttgtaataattaaaactcaattaatcacatgctattaccatctcgttttgcatagagcacttaatcatcttcatctatatctcaggagattcaaacaccacctacataggttgcttcgtggcgagatgacgctacatatggggtatttgtcggcggaaagggaaatatacatgttttttcttaaaaaaaactggaaatatacagttcaaccttcgttgtttactctatgctgataaacagacaaaaaaaacgaagaaatcaaaatcaaatttataggtaaaacttttatgttatatatttttaaatgtcaatgtaagaaataaattttaatataaatactcaaaactaacttaaattttgaaaattgtctgcactaataaactaacaagcaaacgatgttttcaatctcaccagtaaaaaggtccacaggtatgcaatagggagggtcgacgatacaaacatgccttgtcctcatcggcttcttctttttttcttttattataccgtaagtttacacatgcacacaccacagtaaacgcaacacactcacgtacccacgaactgtctatgcgtaatattcatggataatactccctccatctctaaatatttgacgccgttaacttttttaaatatgtttgatagttcgtcttattaagaaaaattaattaattaatatttcttttcctatcattttgattaattgttaaatatacttttatgtatacatatagttttacatatttcacaaaaagtttttgaataagacgaacggtcaaatatgtttaaaaaagtcaacgacgttatatatttagagacggagggagtattatttaaatcttattggatgaagttatacaaccatgaattcaacatcacaccactaacgcttctccatgagttttctcaaggtgaaatttgcatgtttatgaatagaccttgatttatttaattttttttcgggggaacagaccttaactgcagctttcaaaacatttaggacctctttgattcaaaggaaaattcatagaaattttagatgatttcaatcctataaaaatttttcctatataaattttggagaaaatttaggggcaattgcatccacacccccactttcgaagccaattgctgttttacccccactttttagggtttgcacttttaccccctttttaatttgaagcagccgtctacccccatttgtgacagccgtttggtgggtcccacgattttgtgttaaaaaatacaaaaggaaatttaaaaaaggttttaggaaatatgatattacgtttatacccctaagggaatggataggaatataggatgagtgagtctcctcccaggctgacaccaccatgcgtcgttttcctggagatcaaaaccctagcgccgactgagaccgggcggcggcgtgcgcgcggcgcggaggctgcggatcgagggcgcgcgagagcggaggcgtcggccgcaggaacattgttcagagaactctcaatcgtgtgtagtggagtactagtgtgtatggtcactgaaatggcacttttaaggaggtgttgctattgccttttgcttcactactcggctccatttatctaaaaatattaagagtaaattgtgtccgcggtacataaacttgttaggtgggtgcaatttagtgtaaaaacttgaaaaactctcgttttggtgcacaaacttgtataggtgcgtgcggactatgactaaatagaatagcaaatctaattttgctgagttggatgatgagtagaccgccaactaagcattcacgtaagaaggacaggtttgcctgctcgtaagcaatggccctgttttatcagaaaaccccttctattgtttggtatttcgatcatgtataatttttcagtgaaacgaatctgagaggtgttcatagcggcggggagctggggaggtcgaatccgcggtggctgtagtgatgggggtcgagcccgatagctacgccgtggggggagtcgagtccgacggtggctacaacgggtaggtcaagtttgacggcagtggctgcaacagtattgccgagactgacgatagtgatagatggcgaggaggtcaagtttagtgggagagcttagaagttgatgctgcggtaggcatttgagtggcttgctttaggccaacatcggttatctcagactctgacaattcatatagcaactttgaagcctagctccaatgcttcagtgcagacattgaagcagcaaggaattaagccattgtgccgtcagattaacagcatgaacattaaatccactgaagcaacaaggatataatgcttaattgtacacattgtgacaaaatctgaacacaatgaaacacgtgagtgcatattttgaacagaaactgagatcctgaataaaattcagtgaataacctgaatgaaaactaaatgcataacttgacatgaatttgattgtgcactagtaatgtagctcaaaatcgataacatggaaccaactttatgaatgcatagtataaactactgtttctttttcttgggagagtttttcttcttgggtgctgcacttctcttcctcaatgtggccctgccttgtttggttgatgtggttagtggtagttgaaccccttctctcctattagtagcaatgaaagcagactctggcactgctcctggattcaccctttcttgatggttgctagcagcctgtaaaagattatgtactaattttatgatggttgctattagctgacaaaatgctagcttaatgaaggattgttttttctttgagaacttaatgaaggattgtcacctccttaataaaagcttccaccacagatgaactcagatagttagaattttgctggggtatgctaagcaggtgcatttcctgaaacaaatatatgttctgtttaaaattccttgttagtgtagctaaacatatacacaagcaaaatgagcatcaatagtacctgagtgatgacaggttcctgaaacaaatatacaatgagtttaaaattcatagttagtggagataaacaaatacacaagcaaaataagtataaatattacccgagtgatgacaagctcttctgaatcaacaattgatgaagtcgccatttgctgcataggttgcttctgaagttttaagtcagccttcctctgtttacaactagttttgttgtgaccaccatttttgcagtagctacaatgcatctctactccatgctttgaaattttagtcccaccctctagttcttggggctgttttctcctagttttctttggcctccccactttcttctcatatactggtggcttcacctctatacccggcatcttctcccagtggatactatctctcaggggcattatgtgggacctataagcttgttcatagcacctggttgaatagcaaaatgacactacatcctgtggcttgattctttcatgtcttagacaggaaatggcatggttacaaggaatcccagtgagctgccacctcctgcaatcacatctctttacattaagttcaacaatgtattgagatcctctgtcgctaacctgaaatgctcccatcccagcaggcaaaacatagcatgtattagctatctctgtatttttctcgaccttccgttttatttttgggcagaggccacatggccaattcctttctagttctttttgcttggtgtacaacctgttcatgatctgatttctaatcctctcaagcatagacaaaataggcatctccctggcatcaagaatgtacttgttaaacacttctaagttattgttaagaaggatatcacacttcggaaagtcactgaaaaaggctcgacaccattggtttggaggaatttcttcaaggtacttataagcttcactacttaatgccttcatcttttccatattggcattccactcgggcacagtgctagatcttgtaatagcccaaagttggttctttagtgtctccctttatgtaacacttgaaaattttaatatagatgcctcacacagaatctttgttcagcatgagaaaactcccttctcacagctggaacaagcccctggaaacgaattataaagaattatagttaggaactaaaatgtaagttatgtatattatgaaaaatcagacgaagtcataccttctgcctatcagtcatcactgtccatgcagatgtattctcaatgccaaggtctttttttagagtgtcaagaaaccaactccagcttttcaagctctcaactacaactactgcaattgcaatgggaaaaatgcagtcatttgggtccataccaacagcagttaggatatggccaccaaattttgttttaatatggcatccatcaagacaaatgataggtctacacccagacataaaccctctcttgcaagcatcgaatgacatatacaaagtatggaagcaaccaaaatgtaggttcaggtagaatgagctccctaggttagaggttctcaattcttgtccatagtcccataattggttgtactgagatatttcatctccatatatggccctcatagccatccttctagctctacctagcttgtgcctagatggtgttaagtggagttccttctgaattttcttagcaaagctcatcggtgtcattttgtcattatctctaaattcctcaatgtacctttttgcaagatacttagctgtgacggccttgatctcccactgtttagagcaggtgtgcttctctatatattcccttaccactaagcatttgactctattatccatagatgcagacaacatccatggacaaccttcagcacacttagcttcaattcttgttttggtattccgtgtcttcttaatagcaactcggttctttatagtatattgatctattgctttcctaagctctacagcatctgcaaacatcatgctaaccttgaactcaggtgtctccatgtctacatcagccctaaaactcttaaaactgaacttgatttcttcttcttcttcttcagaaatatctggcatcatcaacctttcatcttcagatgaaccatagtctgaacc

SEQ ID NO: 66995 - DNA, 45168 bp, Oryza sativa
  unsure (1)..(45168): unsure at all n locations
accaatccctggatcagtagttggtacacatatacatagttggatcacaacatatcacgaatgaattcaggctaacagagttaaatacttacattagggccaggtaggccaacaactatcagagatcaacagcggaagacaaaataatataaaggcccggttaacatgccacaggcagtcgactggggaatgagacctagaacaagaccgcactctgatcatcttgttggatacgcaagcgtaccgacaagggcttctcttcaacactctcctaaaagatatataaatagcaagggtgagtaccaaccgtactcagcaagccaccacaacaacaatgcgtatgatatgaggtatttcaaggaatggcttcaggtttttttgcataaagctagttttgcaattcttttcacaagcctaagacctagcatggactgatcaagttttaataccagtgttcacattaaacaacgacggttctgtccaccatccattgtaatcccaaggatagcttcccgccattgagtcgtcatggttttctgagaacgtccaccttccctcctctcaggaagtggctccatcagcataaaatccatcatgcaatatcccatcccacacaagttaagaatttagagtctagccaagtgtaatacatgtcccggtgctcaataaccgcgagcacggctattggaatagatttgttttactcacactgaagtggatgtacactttacccgcactccacactgcccaacacatgagcctcgtcccaacacatgagacgcgtcacggcaagctttttcgataacctcgcattggcaggatctggatccttagtttttccttgcaggttgggtagaggatgacaaagtgtgtcagtcatgaaaagtggatcaaattctattttaatttcagtgacgtcatacgttgtctcatgttgttggaagcccctattatgttgcccatgaggtcttcatgagtgcctttgttgcaaactaccatgtctaacgtgtgcgatttcatcaagagagtactgagtgggtgtgtccacctatggagacaataagtctttaggnnangnanttatgtctcccaaacaccccctgaaagatggactgagccttggacaaattcatgtcaagctattatttaggaatttttgtgacatggaaagttgtcaagcttgccattttgaacgccaaatcgtgggtgaaagttagcacgagtacacaattgtgtgattaatttgcttcagtggttaatgtcagcaaatgcctatgtactagtatttcagatatatttctttttttcacatcaaaatcatgacgaagttagtgaaaacataggattgaaataattcatttgtggaggaatagaacttatcattgcacatggatttggaatttgggatagtgttaggtggtcctgaattctgatcggagctcccacctaccgacccaacaaattcgtgtctaggtggtgtttggatcagggacttaactttagtctctgtatttagacactaatttagagtattaaatatagactacttacaaaactaattacataaatgaaagctaatttgtgagacaaattttttaagcctaattaatctataattagagaatgtttattgtagcatcacgtagactaatcatggattaattaggcttaatagattcgtctcgcgaattagtctaagattatggatggattgtctaaacatccgatgtgatagggaaagttttagtcccatctaaacagggtcttaatcggtcttgattagtacaatagtacgaactaacagttatttagaggggccagtgctagaagaaaacacacttggaccagttggtcggccattcaaccatgacatgtctgtctgatagcactgcttcaaaattctaaaacaaattcgaaagcagacttcaaaggaatcataggatggtgctactaacttcggttttgaaaatacatcgttttgagcatgtttcaggttaaacttaaaaaaactctaaacatctagtacatcttatactgaaagtatgaaaattataagtacagacgtattttgattattataatttcaacatgctagtatataaacatactgtaaaattagcagtcaaggttgcattttgaaggccatatggatgttcaaaataatgttttcaaaactggaagaagtactgtcaagtaggcttttttttagctattttttaatcacacaaaatgcagaatgatgacaggatggatacctgatttactgaaaaccgtgtacaaaatgttgaagctcttatctggtgtacaaaaagttgaagaaaattaacatttggcaaggaagatgcacctgcccaaaggaatgagtcaagatgcaatggaatggaaagaataaacaagaagaagggaagtgtacgaaacaaagaaagagctaatggatccaatgaaacctttggacattatctaaaaaaaaaaacctttggattcctactgttgtctgtgtcgtcctaaccttatacagcaacaatttcccgtgaactcatgttcagagaaaagaaaaaaaaatcgtttgtacccattgtctgaagaaatattccaaatccgagattccagtaaagtatagctgaaatatgaagaaaactagcagtgactaaaagaaatttgttctccgcataaaagactcttttcgagaggacataatattgataatatacaggaccaagagaagcagtttattggaaatgcaattacaaaataaaagagcatagagcatagggaaagcatatgaataactttatagatagattatagaaaaaatacatgaatttatggagaaatagagactcagagaaaaatatttcacaaggtcagctccattatttgctattcagcttatccgtcgtaaccaaaatttaaattttagagttaattttatttttaccgtactttattttttaatattgtcttttaaattgctaataacacatatataaaagtttacccatactgttttttatcgtaaatacgcattacggtttataatcggcttccttaaggcattccaacgaaactttataggattataaaatttgatatagacaaaaataacttacatagcaaatgctaaaaatttcatacacaaaacctactcgatttgaatctttttaggacaacgcttttcacttcatattataaaagctttgacttttttttgtcaaattttttaagtttgattaaatctataaaaaaagtatagcaatatctctaacaaaaataaataggatgggcgaacgacgggaattgaacccgcgcatggtggattcacaatccactgccttgatcaacttggctacatccgtcccttatccagctaaaggattttctcatatcatcaaaatatattcaatgttatatttaataaaactaacttgatattataaatattgtcaattttttaaataaacttagttaaacctaaataagcttgactagaaaaaaaattcaaaatgactcgtaatatttacaaacggagtgagtagaaaataggttgacacaaagaaaaatgtaaggaacagcaaaaaaaaaaaaaaaaaacaaacaagaaagaaaatagaaattcgaagagaaggttccaaccaagcataccatcttctccttctccttcctcctgccttcgttcttgtcttgtcacacccatggaggaggagaaaaaggcatagatacgacctggctgccctcacaaaaatacttcaccaaaccaccctcctcctcctccccctttaccatttccaagttccaacccccaaaaaaaatccaaccaaaaagcggagattttccaactcttatcatctcctcctcctcctcctcgtcatcgtcatcaccagcacacacccgagagaaaaaaatcctataaagaaatggattgagccatcacccaacgccgccaagatcctgtcctcttgtgtgcgcaacctgtagctccacctccacgcaggatcaacacccaaatccccccatcttcttttctttttcgtttcgtttctgcaagatttgcatcttcttcttcttcctccgaggagtgagtgacacctgagatagcgagagcgagattttcttcggtttttttgttcctctttttggccataaacctcccataaagctcggtttcttggttcgttttttctttctttcttcctctccttcgagaatcgcccgagtgtgaaatccaagatcccgaattccgtgtcttcttcttcttccgtagaaatcccggggtgggcaaagcggtgggatttctggagaggggtaaatgagcttccgtttctcgattggttcttgatcgcgtctcctctctctctcgaattcattagcttctcttcgattctttgatttcagggagagcgctacaaggcaagaagcttgggtgtccgtagtccgtacggttcttgatctggggtcgccgccaatgcagccggacccgagcgggagcggcggcgacggcaacgccaatgcgaaggcgaagctggcgccgccgccggtgacggcggcgggaggtcggccggtgtcggtgctgccgcacaagacggcgaacgtgcgcgaccactaccgcatcgggaagaagctcgggcaggggcagttcgggacgacgtacctgtgcgtggacaaggcgagcggcggcgagttcgcgtgcaagtccatccccaagcggaagctgctgtgccgggaggactacgaggacgtgtggcgcgagatccagatcatgcaccacctctccgagcaccccaacgtcgtccgcatccgcggcgcctacgaggacgcgctgttcgtccacatcgtcatggagctctgcgccggcggcgagctcttcgaccgcatcgtcgccaagggccactacaccgagcgcgccgccgcgcagctcatccgcaccatcgtcgccgtcgtcgagggatgccactcgctcggcgtcatgcaccgggacctcaagcccgagaacttcctcttcgccagcgccgccgaggacgcccccctcaaggccactgatttcggcctctccatgttctacaagcctggtatgtgtggtttcttagtttcacatttgctcattttggtaagcaattcgttgttgttattgttcatgtgtttgcattaaaattgtgtactgcttatgttgcattcaaatgactaagtcggagctttgtttatagcttgccttggttgaatcaattaagcttagtaatagttctttcatacattgttcatttggctgtcttcagattaattgaactcagcaatagttcttgcatacattgttcattttgctggaagacagcttacttgtctgctagattcttacttacttgtggcccatctgtccttctgttacaccctggtctgcactcatacattgggttttgggtttgaataaatgaggctgagatatgtgtgtggtatgacattgatatgataatgggagagggaattgaaacgttcttgggttctagctggaaactcaatctgtgcaagttagtccatttttgagaaaaggaataccacaaacagttcctacatcctagtactagtaactttgatgtaaatggcaatagtactgcttttgtggtttatctcatttgaactttttaatgcatgtcaaatattttttatgatattgtgatagttgccagctggtaattttcgcaaggaaccattaagtatttaagtgctcttatgattacgttatgtaaccttaaaatgggtagggaagaggtatctttgtctccatgtagtcactattcagctaagtctagttcaatggtagtgttatgtattgttggacatgagattggttgcaaattgcctaatttaggaagatgatgtgaaatgcagtgtcatacctactgctaccaccatcgccattgttgttgttccttatttgtttgtatctgtactgtgtattttgacttggatcttgtcaggaatgctgtatgagtcatgttaagtttatgaaactctgattttcatttcctcaggtgataagttctctgatgttgttgggagcccctattatgttgcacctgaggtacttcagaaatgctatggtccagaatctgatgtctggagtgctggggtaattctttacattttgctatgtggtgttccaccattttgggcaggtaaattatttgccactaaacaactaaattagtaggtccctccaaattctcacgtttccattgtcatattgtctcttgccttgcagaaactgaagctggaattttcaggcagattctacgaggcaaacttgattttgaatctgaaccctggcctagcatctctgacagtgctaaagatctagtccgtaatatgctttgccgggatcctacaaagagacttacagcccatgaggttctctgtaagtcaaccctgtttcctactcttactcgccataggtctgctttgcttaaatatgacataggtaggatgtcttcttttttctccttgtgatggcattgcctattccaggtcatccatggattgttgatgatgctgtggcacctgacaagcctattgattctgctgttttgtcaagactgaagcacttttcggcaatgaacaagctcaagaagatggcattgagggtacggagatttgtctataagtttgtgattcaattatttgcttatttcaattactctcaggttgaccttgtttgcctcatatatgaaaggcacctgacaagtctcattttctcccctgatttgtttgtaggaaatgaatctcactgttaacttcatttacttataaaagtcttgcatctgtggaattcaaaaaataattaagtgttgatatattctacaaccatgtgcatttttagtagagagagctatctgatctcttgaatcatgatgcctcttttcatccattgacaccacctttgtttgaacccaggttcatttggaatatatccagtaactattctgttcaggtcaatgttaactaagatgatgtagcaaactgattctttctgacatttgtttggggctacacgaaacctgtttccttggcagcccagacacttaatgcattataggcatcgtagtttttcttttcttttgaaatgctcgatctagcttgtgaaacatgcaatgatcatcttgagctctttacatattgttaagtatctttcattttgcaggttattgctgaaagcctgtctgaggaagagattggaggactaaaggagctattcaaaatgattgatactgacgatagtggaactataacttttgatgagctgaaagagggcttgaaaagggtgggttcagaattaacagaacatgaaatccaggctttaatggaagcggtaagtgcttctttgttagttgatccttcagggaaatgtaacttgcaggggccttctgatcctcagcattttgtatttcttgcatgctgtaatttttatgtctcgtaatttacatctcggcatctctcttgcctttgctaaaatggaaaagaaaaatccttcactaggaaagaaaggtgttttgtattaagatttaagatagcatgtcttgctgcttttgctaaattgtaatatgttcatttgtttcaggctgatatcgacaacagtggaaccatcgactatggtgaattcattgctgctactctccacatgaataagctagagagggaggaaaacttagtatcagcattctcatttttcgacaaagatggaagtggtttcataactattgatgagctgtcacaagcatgccgcgaatttggccttgatgatcttcaccttgaggatatgattaaagatgttgatcaaaacaatgtgagttgttcttatactctgcattctgtagtttgtccaatttttgacttgtttgttcaccaattgatttcttcacccgttttcaggacggacaaattgactacagcgagttcacggcgatgatgagaaagggcaatgctggtggagctggaaggagaaccatgaggaacagcttgcagttgaatcttggtgagatcttgaaccccagcaacagctaaactcctacaggaaggccatggctgttacatgccatcattgtctgaatctctgcacgcctcatcagctggactaatctctaagagggcaaagccgttgagtgaattgtgctttggcgttacatgagacgctgaagaattttcgtagcagtaatagctacagctactagagtgtaagagaaattggcgttatgtgatcgtaatatcctatcagtgtaactgatcttagatgatgctggagatgatagtacaatgaacagcttatatgtattcctgtccttgtagactgaacattgttgatagttggggaatgctcttggcatcaattctgtctcttctatctattattctatcgttagtacaggttgttgatgttaaatgtcactccaagttctaaacataattttcaggctctgctattgagcaatcttaaacttatgcttaaaatatgagccagtattcttaaacagttttataaaaattatagtaaatgtcagaaaacaatgtttaaatagctttcaaatgctgtgttctaaattgggtttaggctaggttaatcactcgtttaacgtaagcacgcttttcaaactgctaaacgatatgtttcgtgctaaaacctcatatagagaagtttcttaaaaatcaattgaagtttacaatatataatactttattaattatatattaatggtttaactagcttaatcctaaccgctatatagaaggcccctcttattgattctgaaacgggcctgtattttactccaaaatcacggcccatcaacgaaaatgggccgcgcattgtggggcccaaatctggataagaaggtgaggagagggaatccatccaaaatcctctcccttcccaaatgccgccgccgccgccgccgccgcggcttctcgccggcggcgaccaccacccgtcacccacctccgcgtcctcgccggagcacccgttcctctccgcccacctcctcctcccttccccctccccctccgacctcccctcccttcacctccctctcgccctcgccttctccttcctcgccgacccttcccccctcccccgccgcctcctcgtcgtgctccacgccgccggcggccgctaccccgccttctaccacgccttcgcctccgcgcttctctccctccccttcccgctcctcctcccccacccgcgcaaccggctcctcctcgccgcctccgagctcgcccgcgcggcggcgccggggttcgcgccattgctcgtctcgctcctccgccgcctccccttccccggcgacgcccgcctgctcgatatcttccacgagcacgcctccttcctcgccgacgaagagccccagctcctcgcctccgccgtcttcgccttcctccgcctcctcgccaagaaccgcctcgatccggccccgcagtgtctcgagtgcagcgactgtggcgagtgcaagaacgcgaagaatcttgcaggatgcagggagaatctggtgtcgttttgcgcctccgtgttgcgggatcacacccaagtgtgtgagctgatcgggagggacctcgtgaggtgtctccatgaactggtgctcgtgcaggagttccatgaactgtggaaggactcgatgctgggccgtgcggcggagatctgccgcattggcatgccgggttggtgcaccgcgatggccgtctcaccggagatggagacgcagctgctgttcatgatgaacaatgtgaggtgggggaatcagaagaggtaccagctgtggtttgcgaggaagcatttgatggtgcctggaggggaggagaggatacccgacattgtccggttcatctgttgcgggtatcacccaacaaataaggttatgcagtctggtgtcattgcccgatgggcggtcataggttggctgctgacaagctgcaataagagctatgtgcaggcgaatgcaaaggttgcgctgttctatgactggttgtttttcgacgagggtaagggcaatctcatgaatattgagcctgcaatgctcctgatggtaaactcagtgtctcagtatactgatatcacaaacatgctacttgagttcttgtttcttcttgtcgagaactatgacgtgcggaggaaggaggcgattgctgagtgtgtaaggaacgcatttgcggtactggtgaagaaaggagtggtcccttccttggatatattgacatgctgtgagaagctttcaccgatgctgaggcagaaacttgtggcatttttatcttctgctagtcctgaagaaaccgaaaaaacttgtgggcaacccattgatgaggcttctaaagcaatggatttgaacaacagagtttgctcaaactagacccttttactgttcaacagagtagcatgttaggaatgaactcaacaccacttgcccgcaatttctccttttgggatcttcaggaagacctggaaagaggacttgaagattgtatggcatcacgtgtagaggtgaacgcatgctttgaaggtggaagaatacggattgtagaatgtggcttaccaacagctggtcatatgagcagagctacgcatactaaatctctgctgacatgttacatcgcatcacagacacatttgtttacagagttacagtctaacccatccagtgaactacacaaccttgttagcatactcatattcatggttatggagataatgaactggccttggcattggtttctcacctgaaggatggaaatggaatacatttaactggacacaatatgtgcttcatgccatgtatttacctttgttttaaatataacaaattcatgtacagcagaaaactaggtcttcatacaaatttacaatctgcctgaactgattgaagaaacctcaatatgagcttttggatgctacaagcctaagacaaaaatatacagatcttatgttcaaatgtgctgcagagacaacatgcactgcatccttgtgatgctgaacgtttttgtgtgggcgtgatatattttcttcagaaacatagccacaggtgtatgtgtggatgaatttctcctgagttataggagttcatccgatttaagtaggccacaattatgcacttgtaaatattttgtaactatcccagcttttgttattcaatagtaaaatctctttcatggtactttgtctctttccttttcattgagaccaataggtgccatctaccaacttggatctctgatatcaatgtttttggtgggtagtagaataatatgtcatttatgtttgttttttggccttcaattttctcaatcatctttcactctgattatgtgcatgatttctcccatccttgtattacattcagtagcttcagacatattagtggagctagggaaaggcatatctatcctaattgtgattatcatatcaagtgctaccacagatgatctgcaagactactacatggctggaattgtttgaaggcactcttggcatagacttgtcaaattagtggtgaatatgtcttctgcagccatctgtctcctgatctactagaacaatgtgtgccacagaagggacccagcatacaacaaacaactcactgctggagttgttatcacccaaacaccaacaggaaattcttgtgaatttcaatggtcaggacaggttcatggatgtcatatatcaggacatctccaccgtcgaaactcgaaagacgcctatgggcaacagttcctggtgaaatgcacccacagaaagccagaattcttcatcatccagccagggatgatccttatttatggaccgcgtatcgcgaagaagaaaaaactctgtttttacatggtacacaaaaaaaagggaaaggaaaatcatggggaggaaatcatgttgccagggtcaggacaaaggaggtggtggcaagaggattggagcaaccaaagcagagccattcatatccaggaggccaacctccacctcacaactcatatcccttttgcccttaaatctgagaagttgctgcacttctcaccccccctctaaggaaagactgcaaagaaaaggcctgtgtcaaggagagggtagtagcaccttgctctcctttgccttcagagaaaccggaagcaatggcgtctgctactctcctcaagtcatctttccttcccaagaagtctgaatggggtgccacccgccaggctgccgcccccaagccggtgactgtctccatggttgtccgcgctggtgcctacgacgatgagcttgtcaagaccgcggtatgctttctgaatatcatccgtactgttctatggtttttggcatgcatttgtttcctctttatatcaatgacaagtgaaggaactttatgtagttttatgatagatataagcactttatcgtcaggaaatcaaataggatgtgcagtcaagctaagttatatatagcagaattcagtgaacataaaacacttgttttgatataacatgattcaaatatactggcatctctagttcaaatctactcttcaaagttatataatgcatttgaaggaaaatttctatcttcaacttcacagaaagcaaaatagatatgatttgtgtataccaaatgaacttagagactcaaaatatactagtaatacatttgtaaactcgacatctgcatcaagacatgacatgggttaaccactagcagttgtaaggataaagcatgaagcattcatgtgtcctgcttatgttctatgaaccatctgcaggtcataattcagaagaaaagtttggaacttctaatcctacaacataacaagcatacttttatcaactttggataataaattcttaagatgagtttttcattcaattatggttcagaactagaagattaaaaactttatccttcttgctgtagaaaaccattgcatcaccaggaaggggtatccttgccatggatgagtcgaacgcgacctgcggtaagaggcttgcgtcaattggccttgagaacaccgaggccaaccgccaggcttaccggaccctccttgtcaccgcaccgggcttgggacagtacatctccggtgctatcctcttcgaggagactctgtaccagtcaactgtagatggcaagaagattgtcgacatcctcactgagcagaaaatcgttccaggtatcaaggtcgacaaggtatgaatttcactccaaactgacccctgatccttgttgctcattcaaagtagtatcaaatttattaaagctgttaaagaactgaatgtgttagagttgttattactagagaaaatcattgttctagattgaaggaactacaacattaattcttctgaatttgtgctcgatgtcagggtcttgtgccccttgctggctccaacaacgagtcatggtgccaaggtctcgacggccttgcctcgcgcgaggcggcatactaccagcagggcgctcgcttcgccaagtggtgagacaaatttttcacctacaaatataatggccagttacctttcacatactatcatttgtggatatcattccagtgtctgacatgaagttcttcatcttcaggcgcactgttgtcagcatccccaacggcccatctgaactcgccgtgaaggaggctgcctggggccttgcccgctacgccgccatttctcaggtacatatcaaacttgattacagaacaaaaactgcaagaacataataaatctctttcctgatgatgctgcaagcatgaacaattttcttgaataatactaggacaacgggctggtgccgattgtcgagcctgagatcctcctcgacggtgagcatggcatcgacaggaccttcgaggtggcgcagaaggtgtgggcggagaccttcttctacatggccgagaacaatgtgatgttcgagggcatcctcctcaagccaagcatggtgacacccggtgccgagtgcaaggacagggccacccctgagcaagtatctgactacaccctcaagctcctccacagaaggatcccccctgccgtccccggcatcatggtcagcattctaccactgataaagaaactgaaactaaagcttaggaagctactaatattgctttacttcttgcaaaatggcttaacctgacttggaatgttgatcaagaaactgccgctgcaaatgttaaaagcttaacctgattcttcttgcaaaatggcttaacctgactggaaatgttgatcaagaaactgccactgcaaatgttgatctgctaattctgacatgattcttcttgcacaacgatactactaactgtctctgcagatgtagatgatcaagaataaacctgaaagtagagctgatcgataatattgattgattgttgtttggtgcagttcttgtcgggtgggcagtcggaggtggaggcgacgcagaacctgaacgcgatgaaccaggggcccaacccgtggcacgtgtcgttctcgtacgcgagggcgctgcagaacacgtgcctcaagacgtggggcgggcagccggagaacgtgaaggcggcgcaggacgcgctgctcctccgcgccaaggccaactcgctggcgcagctcggcaagtacaccagcgacggcgaggccgccgaggccaaggagggcatgttcgtcaagaactacgtctactaatccgatccaatccaatcaagacagtgaacctgctgctgctgctgctacgtactacagctactgctatactgctagtacctcgagggcactgtagccagtgtgtcgtcacagttacaggttgagatcgatggacaaagttaaaactatactgcattaattaattttaccttgagaacatacgtggttcatcatgtatttcatcacatgaatcttttctagagcgtttgatatacatacctcgtgttttgcctctgcaataaccttgtgtgtagacgaatctgtatactacctgtatgtgtggcctgtgaatcgatttggttactgcaaagttttgcgtatatatacatgcttgtgattctggaattattctggttacccccttagccttgcttcacaatctgttccctgctctggcaccacataaattgaagcaaaaattgtactcacttcgctgactcatgcccttcactatgatttattctgtgttaactctgaatacgatgcgtatatatgttgctttctttgtgttcctctagtccaaatttctattttggcatgaaaagatttataaaaagcgtgaaaactgaagatcatgaccaaatgctgattttttttttgtttgataacttccattaaaaatgcataaatgtgttattctttttaagtttctcgtgaacatgcttaaatagaactcgtgtggtcatgtccataagttgcatatttgatcccaaagtggttatcatttcggcccataagtggcacaatttcagtgcataagtgcatgcaattttggcctataagcacgttaattttgggtgcgggatgggaaaacatccattcagatatattggtatcctgatgcatcacaacttcacaagagactatcaaacaaggatttggtaggcgatcaaggacatattccaaaagaaactgagtagttggaaaggaaattttttgtctattggaggaaggttgattttgatcaattaagcttcggaatcgctatatttgtggcaacagttttcttccctcattacagtcaaatttctaatcgttcgattggttttgcgatttgtgctgacatagacccaggaacccatatcatcatgtccatatccagttccttgtcacgttggcaggcccattaaaatggcgaggccaaaaatgtttgaataatagcatttctcaacttaaaatgacagtacgtgaagctaaaattacatatataatttagaaacttacaaatgtaactttggaacttacattgcaatacactaaaattacatatgtaatttagggacttacaatgtataaatacatgctaactatttttcataagaaatatggcactatttttcataagaaatatggcgacataaatataggtagtcccattaagttttaagtagcctagctatatttatgatctcctttaattgaggcacctaaaggtacactcaagaatctaggtaattactggtctagattcttttgcagtgtgatgagcataaaaagaaatatagggcctgtttgggggagctttagattctgagaagtagttgtttggtagccagcttctgagaatctggaaaagctctgaaacccaacttctgacttcttagttcatttttcagaatctgtaactacagattctcagaagttgtggactgtttggggcagtttctagcagacaagctcccccaaacagggccatagacttgctaaatggagtgtcttatgcagacctaaagaatgtggggggtctcagaatattaacctcgaggtacagaagaaatatttgctaagcaaagttaattaatgaagaggggctgtggcatgatcttcttagaagaaagtatgtgtccaaaaagaatatcactgaagtagaaaagcgacgagtgggctctcattttgggcaaggttcatggaggctaagaaatcctttctgccattgggatcctaggagattaggaagggttctcaagtgagattttgggaggattactggtgtggtgataggccattcaacttactatattcttccttgtattctttggcaaggaaaaggaacacaatagtggcagaggcttagtacaacacctctaaaggattggtataaactggtctcaagagtttgtgcatttaatctatctgaacaagatgatctttttaaatggaaagttcaaaagaatggaatcttcacggttaactccatgtataaggtgctcatgtatcgagatatcatacaattctattatctggaagcctagatttccgttaaatataaagacatttctatggtatatgggagaagatgtcatgttgacaaaagacattctagttaaaaggaaatgaaaagggatcactgatattgtttatgtaatgctaatgagactatacagcatctcttttttgaatgtcaagtagccaaaaacatgtggagtgccgtatcttttttgggccaattccctatatgcccatgtaatttcacccaatcccttctacgcccctgaaatttgtttgatctcttatatacccctgagtttttatttggatcccttacatacccattccgttagttgaccattagtttgaccgttagttattgtagaaattactttattgtccttgttatattgttaaaagctagaaatgttttatgtgtaaattatttgagttgtgaaaaccaataaggaataaattactaaatatttgtgatgaatttttgaaaataaaacattatttcattaaaataaaaaaagatttattgtaaaaaaaagttctgcataagatttgaaaattacttttcaacaaatatttagtgaaaaaagattcgttgtgaaaaaacaaaggggatataattagtttatcacaaattagaaaacaaatttaaaatttttaaataaatttcagatcaaatttgatgaatttcgtatatcttcccaaaaatttaaacctaaataacatttagtttttgctcttaattttctggtgaaactaatgtatggatttaatcataatttttaaaaaataaaaaataataagttttattttttaagttgggcattaaatgattatattgcttgtattttgtataagtttatttttcatatgaaaatttattgggtaggtaccacacatatgtataggatgggtaatatagtcattttaaaatatttaacggtcaactaatggtcaactaacggagatgggtatagaggagatcaaaatgaaaactcaggggtatataagggataatgtcaaattcaggggtattgaagggattgagtaaattttcaggggtatatagggaattttctcttttttttatatttgatgaagagaggctgcaagatgttggaggccagagtgtgatgagcttcttctctaggcaaggatggaacttcaggggaagattacaagcttaatctttgtttctcttcttttgtaagggttggaactgtttaagtggtggtcatttcggtactgcccattatatctaaaaaaaaaagaagctaagctacctcagtttgtgtagtatttatagagtggtagtggcccaatggggaatgacaaagatatgtcataatttgctcttaaacccaagtttattagcttgcaatatatgcttaaaagtacaatctgcctatgatatgatgatacaagctactccctctgtttcaggttataaaactttctagcattgctcacattcatatagatgttaataaatctatatacgatgcttcagcataattaggagttggtgaggtcagccgggtcgagcatttgatcgccatggctggtctcaccaaggaagccggcgtgcgaaaggagcacccacaggtgcgtggtgagctccccgctcccgcgcaggtgcacctgatgcttcgccgccctcgtcgatgccgacaggtgcagcaggaaacccgcccagaacttgcccagcctcttccatagctcgacctcggcgccgccaccgaacgccgccacgagctcctccgatagcagcgcgccaatgtcaatgatgccctctcaccgtcgtccccattgcaccgcggcctgttggagtttaggatgagctgatgcggaagcccttgcatcgcgttgcacccgcgcatggattgtgcggcctccctcctcacttcatggaggaccttgtaggcgacgaggccattgtccggcaccagtgcctgcctgaccaggtacgcacggtagttggacagggtgacggcggtgacataatgcggccacacatctgcgagttcaccatcaccaccgccctcgggcagagtgaggttatacaggtcgtctcgccagcgaccggtggcttgttgttccagtagtttgatctggcagaggctggtggcgatgtgccaggctagaatcttgtgggtctcgccctcgcccttgatctctctttggatatgctcgatctgactgacaaggtgttcgatgtcggcgaaggcattcccaaggtaagaccgcaatagctcgttctttttctgcgccaactcctctggtgaactcctcgtccttccagccgccactgacgctgccgcctcttgagaattcaggagggccttgattgacgaaaacagttccatcttcacctccctccgcagctaccttgttctgtatgccaaggtgaaaaattgatttgaattatatataatatataggagaactacaaattggtcatccgttgataatcatgatcaaaatagcatggtgattgatgactaataaaggggtcatctattcatcaattaactgatttttaaaagttcgacacactcttttcaataagccacttttcaatacaatggtgcaaacctccgaccctctccctctcccttgcctacatgacccaacccgcttatactgctccccaacccaacgcaccaccatcctttcccttgtcagcatcgttgaggcccacaacccaacacaccaccattctcaccgtctccctccctcatgctcaattcaggtagaagacggttgctatgccgtggatcttgatcaacattatattcattggtcaactaagattttaggggaactcttctcagtgcactgatgaataacgaaaatggattcaatttatttagaagagatcgataaattgtttacctaaagataactcttgtaacgcgggctatgcttccagtccgagccgacatcactaggttgcactggcgaatattgcggtcccgtcggcttcgtcccctcccgatgagccagaacatgatcctcgccaccttctccatcatccaaagccgcagcccctggatccagcagccttgacgtcctcgcaacctgatgtagctgcagatgatcaagacattggtccactgcgagaagacgtgcacgataatctcccagagctctctaatgacaagtatggcgatgatgcagtgggtgacgaacactccatggctgatcctagcgaggcggcccttggcagtgaggcctgtgctaacactaggcatatcatgcactgcgtaggccaggtatgaggcagctgctgtcatcagaagcgatagcagcaacctcacgcaagggaagccactggcgaagacatcagcgtgcttgctgtagaagaagtcctggaggaaggacagctctacctccgtcacacggaacgccctctcgtagcccttcttgtcatctaggatggcgtccacaacgagctgccgggtgcctgcatggctggcctcatgtatggggaagttgaagaaccgacggcgcagcagcttgtacagggcgaaggagaggcacacgtccttgaaccggttgctgctgtcgccggcctcaccgagcagggcatcgctgctcccttggctccagaccttctccacagtgatgacctcctcctgcgcaagttgcgtctgtgtgaagctgggtggttcgacctttatctgctgcttcagcttctcctccccgagaacgatgtacttgtaccccgccatggtggccgggttggcatcgttggacgtgtgctgcgtcggcatcgccatgtagtcactgacaagcttcatgtcatcatctctagctctggcagccgcgctggaggtgatgtagtaccagacgatgcgcgaggcgtggatggaccacatgagccagagaggcaccctgaggtgtatcgccgtcttcgcccgaagctggttggccgaccacagcgaggtgagcatgtcgacgagggtcatctccttgggctggtacggccggccgatgcggatgctgtcctgcatggtgacgatgaggacggcccacaccttgaagaaggcgttcgccacggtaccttgatgggaggacgacggcggcatgagccccagggtgtagctcacagcataatggttcagtatccgcaggagctggacagcagggttgatgtacttctgggaggagaagcgggggccgatggaatcgacggcgaacttgatcagcagcagcgttgtcgccgccgccacccagaactcgacactggctgcaccagtggtgctgtcatgacggaacaaccctcctacagttgtggagatcaagtggaggatcgtcagaacaatattagccatcttgcatttgcacactactgccgtctgacgaagcctacttagcaagctaaacacacattagcaacttaactagcaagctagccaaacacattaacactgcttgaactgaaaactttggtatagcaacttagctagttaattagctcatcccaaaatgataagctcaactcactggttttgacgtcaagtcaagatgcttactttaaaaaaagacataacgctagtatatggttgtcgcgttcccatagaattttaatgactttataaagaaaagttgctgccatgacttattgcgtcaatgaaaaatgttatctatcacatggttatcgcaatatagcattttcaaatgggaaactgttttaagtcctgagcactggatgccctcattcctttaaatgatactccctccatccctaaatgtttgacgccgttgacttttttaaacatgtttgaccgttcgttttattcaaaaaatttaagcaattattaattcttttcctaccatttaatttattgttaaatatacttttatgtatacatatagttttacatatttcacaaaagtttttaaataagacgaacggtcaaacatattttaaaaagtcaatggcgtcaaacatttaggaaaggagggagtatcatacaatgagtccaatcatacaaagttgggcagacaatagtagcctatgaaaattactaaattagagaacatatactattgtcttagatattcctctataaatattcaaaattaaatccgctgcacacatctaactgtgagtgagattacaccttttatcgagaaataaaaattgtaaatccaaccataaatgagattgcactattctattttgttatttttacttctctctacatagattcactctagattaaatattatggagggtgtatgagacaatagtctatgttgtcatatttttaagaaaactttataactattaaggctatattgaaatactacaattatttgcagtcttactcccacaagtaggtgtggaaatggtcgagaattccacactgactaaggctcatttctgatttctaccaatatagcgctagtcaaaaacagtggtgggaacagtttcagtctttcaccatccctttcctcggtctgtattgtattcatccagaaattattgaatatctagacgccttaatggcacatacaaaatgaggttacaaaacttggggaggcaacatatgcgtgaaggttgtcctaacccaccccctttggtttgtaggaaaaatggagaaaaaaacatagtaacaagaattctatagaaatagaaaaaattcctgcacgtttcatccatttggtttgtacgaatggagcaaaggagaaacatagaaaaaattcctttggatatgtttccaaaggaaattcataggaaaacatagagctcttttttctattcatgcacataggattgaggcaaagcactcactgttctatgtacttggcctcaagatgcatggattaaaacattcaagtctgatttacatttacttactacagggtattcctgcattttcctcaccaattatgtgaacgtatgatcattcctaaatttatcacgtttttaatcctctgttttacatatgcatttttcccatgttttttgcattcctgggttctaaggagacctttgcataaattagagctaggacgcacgcgcaactagattcccgacatcctttttttccagaaaaaaaggccttctacaatatgaccgcactcacaaaaagttgcaaaaaagtagctgcaactatttagctcttgatataatcaaggtctagggctttggccagtattatttatttgcagtgtgtccaccagataacaaattaagagaagacacgcacaagatgcattaggcatacatgatgatgcgatgacgaagactagaatcttttgcatctaactaaaagccaaaagggagaagcacatacttgtttaagaatggtaaggttggttaggccatcaccaacccccaccacataatttatttaagaatggtaaggtgggttagaccatcatcaaccccaccagaattctggaatgatcatgcattatccttaaacgttaaactaaacaacacatcatcatatggccatccgacaacgccgccacaagccttcgagctttatgagccaaatacaaactttccttcgagctttatgagccaaatacaaactttcatgatgatttctctaacttcaatataaaccatcttagacttgtgtacaaattttaagaaaataacttgattgactttctttttggcttcatttattgacgtttcaaatatatggatttcctaatttatttgaggaatatcgttatttcctaagagcacatatgggagaaaagtggaaaaagttattcaaagtttcgaaatgaatcaaatttaggaaaaagttgagaatactaaataagttacatttggtatcgaagggaagtattacacagcggtttttgacagtctactgatgttgaagtaaggccatagctgtttgatagcttaatcataaatatatttagatgacattggctagtaaatacaagatatctatgataagattataagaaaatccaagaaacaccattgacaagcacccaattacaagaaataccatcgacaagtgcaagttccacaaaatatcatcgtacaagcgactttgtcccaaaaatatcatcgtcgttatggttccgtccatcccacgccattaaatgcaatgttcatcctatagcacctaacggagggctgctaacaggacctaacggcgatgatatttctagaacaaagtcacttgtacgatggcatttcatgaaactcgcgcttgtcgatgtcatttcttggaattgggcgcttgttaatggcatatctgggattttccctaggactattagcaaccaattataattcattagtccgcattgcatgggcatttttatctactttactcctaattttttttaaaattactaaggacaaaatgatatcaaacttaataatgattgcaaaatcatatgtagagtccatcctaatattcagttactttcatttttaatttaatatttaaaaaatccaaaagtaaataagtatttagttgcatttgtgctagagtcacaatttagtatgctttataacttaatgtttgcatttgtgttggagtttcacttggcttcaagtctcaattatagagtggttttttcatgatttaataggttcttgattccaaattaataaacatctagttgtgctatgttaggagtctcagttatagttttcacttgatttaataattaaaaattttggaattaatagctggtaggttgtactccctgcgtcccaaaatacaagggattttatatggatgggacacatcctataactacaaatctggacatatacaaatctagatagacttcttccctatctagattcgtattactagggtgtgttcaatccatccaaaatccaacagagatttcattactcatttttttcctggttctctaggggtaagacagtggttgcgtgttccctgtgatgggaggagaaggcggacagacgactcattgtaagatgtgggatgcttgtttcaatctaactatgtaagctttcaaaaaaaatgtcaagtacagaaactaaagtgtagagtatatttctaaattctaatggcaagttagacaataggacactcaaatagcaggaccagcacaagagtcccaaggcaggttagccacctgagggccgacttttagaatactggtgctaagctttactcctgtgaagggtgaatgcaaactgacagttctaagctttattccaatgacatgtggatgcatgattaattggcactacttagtgcaaaaggtagttgtggaatataattagtagaagaccactgaccatgactctgtgaagcaagttgactgctgcctgcagctaatgcatctttccagccggcgcaactacctgaagggtgcaatgataaaaggaaaaaggaaataagaaaagagacaataaaggaaatgacctcctttggtcaaggaaaaatactttattagtcctcattaatctttccgattgggatatatgagtaccgatttactaaagcttaagctttccttctgccagtgataccttggtagtgagcgggcagcagcggcagcttctgaatccagttaccctcaggtacgcatgcacctgcagctagcacagtcagtaatgtctgggaatacactcatgccctgcagcatgtagacatggaaagttcttacatatgtatggctgctcattgcatttttctttgattcttgattcactgtgcgtacgaaaattaatcccatttctcaaaaaaaaaaccatgggcttccttagttctttataaagctagctgggttcattcatcgaaagatctattgtctaaaaaaacaaacctagaaagcccaactcttacaacctaaaacaaaactagcacaaaaacaagtctctacagatcccttgacaaatgcagtagtagttagatagatgttatttctgcacttcaaattattatgtatcttgttgcaaaagaataagagcagcatatatcatgtacacactatgtgctaccagcgagatgaaaattgtccaaaatgtaaactcatatactgtttgcttgatgcattctccgtatcatgagttgttgcttgccaaaatgaaaaaaaaaagttaataataaaatggtccctagtgtaggagtaataactgtaaatttcctgtttatcttttacttgctcatcatcaataaattaacaaacagggccatcgaacaagcttaaaaattgaaaatggtggacgtccgtgctgtgattgaatcattttttgtcatgctgaaagagaacatctatgtcttgatccgcattgagtccttggtggcactggtgacattgatattccttgcaatgttcatcatagacttctaccgctgccgaactcgtagctcaatcttgaccaccattcttgaaagcatcgacgaattatctgatcagatagtagtgtacctcattggagccatgcaatccgcgaggtttgagaatgagctgttcccggtctgggccatcgtgctggtgagtctccgtaccagcctcggctatctctctgggtatggcatctcagaccgtgatcgacaattcatggagctggcaaatgtgatcaagttcataggggcaggggtcttggctggcactcgtggcttgaagtatgcaaggccactctggtcattttgggccatcctgcaactgaagagcatgtaccggttcttcgcacatggcatggcaaacgaatccttgtggcatggccggagctcagagtttattcctgagtacatgcgcaccttcattcctgaggaccaggagacaggcgtcaatcatgatgatagaaacacatcaactatgatgccaggcaaaaaatatctgatctgcggagagtccaacaaagacatcaccttaaagaagcctcaatacactataaatatcagcaacagcagcgctcagtcactggtcacactgggcaagattcaggagtacaattggaaggggatgaacaacagagatggagacagtaagtttaaagacttgagcatggccttctcactgtcaaggctgcttcggtgcaggcttgaagatgtgacactgaacaaagatagcattaacgacatgcagcatctaatcatctcggagttcattcctgacagccgaggacaacggcaggaggagaaggtggacgggcaccaggctgtcgaggctgagcggacattcaggatccttgagttggagcttgcatttgtcagagactacttctacaccctctacccattggtcttctgggaagggcttggttctctctgtttgagtctgctcctgtccgctgcaactttcgccattgccttctggctggccgtaggaatccgcaaggtctatcaacccccagagggcaatcttgtgctctgggtggatggatgtaattttgacatcatcatgacatgggtgttcatgttctgtgtgatgttcaaggagatctgggaaatagtcacatacctggtatcaaactggacaagattacttgtcctgtgcaagtatgtgcaggaccaggcttggtttgtgagtgaacgactcacgaagcatctagtaaggtcatttttcgagtcaaaaattggcgaaccatggcatggacgtatcgatcagtatgacttcttgcagcaaattacttacaagccaacattatggaaactggcaaatgtcatcaccctgggaaagattaaaggcaaattggatgggaaaaaaactggtgaagccatcaagatccctcaatgtgtaaagctagcaatcctacaggcaatccgccgcatcggcctcaccagtagaccgttaccgagagaaatcccatcactgagaagctacgtacatgctctcaagtcattctagtgtggcacatcgcaaccagcctctgcgagatcaagcttgcgcatgacaagaaaattgacttaaccaaacctgggttcttgtgttctgcctggtcgtacatgaaaaaaaagctctgctgcttctcttcctacccataccttataggcgagaacagtggcctgtctgctgggctcaaaacaaactaccatatcgcgatcagcttgtcacggtattgcgcttatctacaggtttttcgttctgaactgttaccagatagttttcttgtccctgaagtgctatttgtggaaaccttaaagcatgcccgcgaacaactcaaggattgtaacctgaaatggtgtagatataacaaactcatgggaattgcactgcaagcaacaccaagcagtgtagatgagaaattgaaaatgaacatactgcagcaaggtgttactctagccaaggacctgatcggaatgaaggatgatgaagcctgttggaagatcctagctgaggtttgggctgatttacttgtgcacatcgccccaagctggaatgcatcagatcataagaataatctcgagtctggaggcgagttcattactctaatctgggcattgctttggcactgtggcatcgaaaagagcagcctgtggcacaaggatgaagcatttgaaaacaattctcaagtacctcaagaaagcagtactgaaaccagaaatgttatacctatggatgagccagctaatgaggatggaatcgagagttcagaagagctcaagacaagaagctttaggaggggaaaggagagcagaaatggtccaaaagatacagcaaagcaatcacatggtgagaatgaagaaaagaatggcatatcttccagcagcttcaggagttaatgtgccacaaatactatggtgagcgtgtaaaaccaagtgtggttttggtttatttgtgatggaaaattggcaacgaaatatataaccatgagttggttttgagtgagaaatttgctttggattgttggcgattttaggcatcagtgcttatgactaatgtgggtcaggttgcgatatctgtgcccagaatcggatgtttggtttacgtgtgtgcaggtgatcgaagtcaacctcggtcaatggcgaggaccgggactatgctcagggaggagcataggtccggcacggtcaagaggccatgtgacaaggtgggactgacgtcatgatccctgatggtcaacctaggtcgacggcggatcgggactagactgagggggagttgaggtccagaatgatcgacgaagctgtgtgacaaggttaagatcaaggtgacacatggtggacgaacaccgtgtcgggaagactttgcgacgggcttcgcaaggtcaagtgcaagtgccgggattcgcgaagaaagccgacggatgaaaggagcaagcagtgctacagtacacgtggtactgtagcatgcagccaatgagaaaagtgcacgtgcatgcacttggttggaagacttggtcaagcaagctagcatgcaagctgtgcatgtgtgtgcattggtttgagcagtgcatgcatggacaaggtgatgtgcatgtgtgttgtgattggttggtagggaggccaccaatccatcgtgatcatgggctcggccaggatgccacacggctggaccggactggcccagtccaagatggagcagaggccagcatgatccaagcaacgacggcccagctcggcaagcaagggcgtcaaggcaggaggtctcggcgacgacgcgcgcgtgagggacacgcggcaggcgcggactcgactgcgcgctctcgcgcgggagatcgactacatgcgggacccatgccaaattcagatggcgtgcgcgggaggagaaggtgcgcgggagcggctgggcgacgtggcagcatcggtttcgcgcgcgggcgtgggacccaagcgactccgcgcgcgcgcgggagatggcgctctccctcgctgtcaagtgggcccggccgggagcacgagctcgcgtgagggacgcgcgtgcggcacggctggcgacgtggcgtgcatggattggtttggattgggatcacacggatcgggagtgcgaggagtttttggattgactaggtggcagcgatctggagcttcctttgagtagaaggaacaatggatggaacagatctgttctgagttaggttttcgccctaggggtatttgagacaatgtcttaggggtcttaggctataaatagagagatggatgcaagggtggaggttgctcctttcgtaatccttttgagatgctcggtgagagagttatggtgtgagtttggagtgtgtttgcctgagaggcttttgtattaggattagtttggagtgtgtttgtccgagagattttaagtctgtgttaatgttcctctgaaggtgtatgtttgctcctagttgagcgattattttgcatcacctatgaatgaaatgatttgaaggatttcgtttttgtcttgttcatttaaattccgcaatttaaattccacttgcaatttgaactttgcgatgatgagttttgctcactcctcctcacctctcttctagtttcgggaattccttttctcttcctcttctagtgtcgggaattccttctctcttcttttctagatccggcttctctaatagccgcggttccagtaaggattttgagaaatccggcttgataagtattttcgggggcaagatttgaattgctatattcacccccctctatagccgttcttggtctttcagagcgcatgactccatatacttcctttctgtatgtacttttaacatgtacctgaattctaacgctgtggttttttttttcagaatttacaagagcaagctggatctagttcaactactgccttcccgtgcctggaaactggaaagattttttcaaaagaaatacacagaagctatttgaataaagttagtccttttgggggggctctttgaataagtcaagtacacagatgtatccttgaaactttgaaagcctcttggttggtccctacttgccgtttacatgtttgtggtctttttatgttgtcatgattttcacactcaattggagaagtcctctattttcccttcgtttattgtgatgtatttgaatacctatatgtattttgcttgtcctacgtcctgcatgggattgatagcagattggaattaagtcgacccctttctatgaattgctcttctttattatctttgtgttaccgtcaaactcccagcgatattgtacattatatagaagtatataacatagaacatttgtgagtcgacagcttcggaggctcggagctcccactttttttttcgtttattcctaagttaaagtgcagtgaactgaaatgcagtgatgtagctctcacctgaagttactgaaccaatatctccattaactgaaggtgatgcaggcttttgcattcgcaagaattgcaacagaatttctgctccctttccattttccgaaaagataataattcaggtggaatttcatatctgttagcacttctccggtgccaatttgtggcactaccagtggtttactagactcgaatcgaatccaccacccctccccctctccgatccttaacccgatatcattagctggttgtttcaactttcaaccctacaaaaatttttgacaaattttctactaaaaattttaacagatgtaataatgcacacatcaaaacccaagaacacgaaacgtcgcacaaattgtagtgtgtacttggggataactaatactccacattatataagctacagatttaaggtcatatatcatagaactacatatttacaacaaatttatcacaaaactacatatttaagactaaatatcacaaaactacatatctaataataaaattatcactaaactacatattttgggggttaaattctttgcactaatgttatgtttgagttgtaaatgtctaagttttatgattaaattgatattaaacctgaagtttttttataattttgttactggacctatagttttacgatattttaccttaaatctgtagttttgtgataaaattagtgctaaatctgtagttttatgatatattacgttaaatctgtagttttatgataatttgaccaaagtacttgtagttttgtgaaatttactcttaaggagtgcagattaagactcggtcgcagtattgccgtgtgttctatggcagggcctagagtcccggttgaatactaccatgtaatatataaggtgggcagggagcctcgaagggcataacaactatcagatcgtcaaatcaatgcaacatctggtgaatacaatcccaaacagtagtagggtattacctcttatcaagagggactgaacctacctaaacccttatgtttcacattcatctacttttaagtttcatgtgctaccttttttttgtcattgccaattttcagaatcgacatggtgtgaaaagtaactgaaattccttaccacaattatgaaaaattcagtgacctgaaatctatgacactctcattgccaaatatagttgaatggcccatatatatacctgtatctcatttaggtgtccaggaactagtcactatgatcttaaaattaattatcaaggaaagaggtcaaaagcattaaatggcgagagctatacgtgtttgtcacccttttctgccaaataacaatttacatatatctatatatatcatcaacaaaatcattttcttgtttaccatgtgtatatgcccattgcgataccattaacaaatgcttactcttatttcagtatttgaactctttgcctatttaaattattgatatttttggcatgattttttatgcgtgcttgtacagtgtgctgtcatcattagagataagggtttacagactgttgtttctttaatcgtggacgtctttgcttttctgttttgtcatcttttggatgttcagatgcccatcaccgtcaggagcgaatatggattgctgtgtcaactagcaattgttctcgtaagtggacaatacggatcaggatcgtatattcgtatatagcacgcactgcagagaagtcctgtttatgtgagagaaacagcggattaatgccatataaacagtgtcatttcgctgtagctatagtgaactaatgccatgaacagtgaattaatgctgtgatagaggcctcctcgtaaatcttatctctttcctacggacaaatgccagcaagttgcatagttgaagggataggcaagtgcgtatataaacaatatcgccaaagtacatatatgaattaatgtggtacccatctttaatgctggttcgtaacttcctgtagtcccagttatatgaatctaggtttattttagttccgattaaaataactaggattaaattttttagtctcggttggtaagatggagccaggccaggtccggttggtagttttttttctttttttcattgtttttaactttgaatgttaatttcactacatccccaaatcaatcatcacaaaacaaaaggaatcatttccaaatctccaaatcaatcatctccaaatacatcacaaattctaaaaaaacattacaaatacatcacatattcacatctcacacaaatcaaatacatcacatattctcaaaaacaaattcatcacaaatcttttaaaaataaatcctgctccggtccagctgcagttgtacagccgcgtccgcctcccctgcctccggatatagggtaggggagggaagacaaactgcctctccagcccagccgctcctatccacaaacggcgacggcaaccgcttctcccaccgccgaccccgcccgaccgcctgccctcccggatccggcgcgcgcagaccgctgtcgcccgacacgcagaccgccgcggccctctgtcggcctcgctcgctcctgctcctcgctcctcaatctgcagcgaaaggaagaaggagaggataagaagaagagaagagagagattaaagaaaaggataagagagagatcaagaatagaaagatgaggaatttgggaggataagtccaaaggattatatatggtgcatcggtttttagtcctggttggtgttaccaaccaggactaaagatcgccagccccctgatagcctctgacagtaaatgaaccgggattaaagattatccaagggcgataggcgatagagttttaaaccgggacaaaaaaaccatattaagtcctggtttctatttaaaatgggattattgtggtttttggccaacccagtaaagatggtttcttcagttgtgtcatttgtttcgtaatatcttcattatctaaaagttactcatttaaaattttaatacgacccagtaatgatgtcagggttatggataaggtataccctctatcgttggagtcatgtgatatacgggcctgtttggcacagctccagccaaacagtttcagctccaccaaaactaggagtggagttgggtggagctctctcacaaaatatactagagttgtggagctgggtttaggcagctccacaactccactctagacccaacttctagagctaaatttaggagttagagctgtagcaaacagaccctacgaatacaatatatctatgagtatatggaaagagtttgctagattaagaaaatagtgttcatgaaaggggaaataatagagttctactcgaaaaagattaggaaactatattaccgtgcggggtccgttgtctccgagttatatttgcagactaaggcgatttgcagtataaatataggctacctaggaggtacaggtcatcgaatccgaatcctaagtgtaagacacccgccacgacaaaagcaatccggaggatttgaagcctattcgccgatagatctcgtcgagtctctctcgacaaggatcttttcggtaatttcggagtttagttgttctcttttgtactctgtgattttctctataatatcatataaacaggattagggctattatcttacgaggaatctaaaccagtataatccttgtctttttatatgcttaatatcgtatcgtgtagatccttataccaacataccccaataacctcataatatggtccacgggtatcccccgtcgacatatgagtcaacaatatcatctcttaaaaaccaaaatgggtactgaatgatcaaagtttgctatggatgcaaaagggcatgtagcctagtggttacaagagtctcagtagcaccttagatcctggattcgactccccatgggagcaaattttccatgagagaatttttcaggatttcaatcataggagtgagtgtgcgtctgttgtgagtgtctgcgctatactgtgtaaacgttttctttgactgttatctcgatctcaataattgactcatactgtctagtttcttggtatctagtatatgaacggcaataattgtttggcaatgtatagatattcatatgtgtggtctatggagtcgcatgcatgtttcttgatgttgcgtgagacgctagcaaattttctctgttgaacgaatccagatccggtgcagtcatagaagagactgcaggtttagcagttggaaccatttttcatcattggatcaaggcaatcaacggctgaaacaaatgctacggttgttttaaacaataattgctacagcacctgctacaggaacgaactttgtacggtcatttgtgaacagtatcaaggaaagatctagaacgttaatttataatccaatggtgtccttaggactgcataagttgctatagccactgcatgtgatcccaatccttgttgaacgcttgtctgagaaggtcacatatatatgtattgtccgaattcagtgctatcttccactacgcaacttgctgccatttggctataaataccaactttgcacggttggcatatgcatccttcgtagtgcaattcacttatacacggagtttaattagtttattgccttctacaatggataggatcttcgcccgtttcttttgcttcctactggtttgttttccatcagttcttaccatataatagacatatatatatatatatatatatatatatatatagacacacacatatctcatatagcattatattactgtttcaaccaacattttcttttattttcttcttctttcgatataatttatgttacatatgttgagaacagatcatgtcagagggggcaagctagtattgcaagtttcattttcagaaagcaaataatttcaaattcgatcagataaatttattaatagatttaattaaatacaatgacaatcacgcacattctaacttaactgatccattgttcctgtaattatttaaattgcatgttactccaagtttatatgatatttatatgaaattttttatggtgctccaagtttgtttaatttagaccgtctatatattaggatatatgttcaactgaatcaaattaagaggaggctattagtcatacgaactagctaggtaaatttgctgttatgggatctcaatccaagaatttgctgctatggaagagagaatagaggagagggaaacatcgatcttatcttaacattcgcttgagattggctcttaccttctatgaaaagattttttttattgcatgaagttaggaggaaaaaaggaaagaaaagtaataatgtccctaaaaatattttgaagggtttatatttagagtctttactatctttaactgttgctagatgattatctctaaatgacatgtattacctagctaagagaatttatcccactttaacttatggcatatgcgctcaaagtagagtccgatatatattctcttttttaatagtggattattccttttcttttgcaaagattaaagaagtaaaaaaatatacaggtgatcgtacaaaaggtgacaggagaaagaataaatacaaaatttattaggtaagaattaaattagtacaaaagtggtaggcagaggattaaatcatacaaaagtaaatagttaggagataaaggattgtctcgggatcacaaaatggcctgtcaaaaacttatctacaaacgtatatatctacagagatatatatctgctcgtatataaatacaaacgaattttacctattatttgtacctatgatcatcgatctgaataaaaatataaaatattgaaatatacatattcataaataattcgtgtatttaaatgcttatagcaatttgaatagtttgaaatctgaatcatattttttgaccaaacaatctgaaacacattttagttttattctcttatttactagaacttgtaattttaaaacactacagtaatgttttgtaaaatgtgagacatcttgttttgtaaagtataagaattgaataacgcaattttgacatgtacaattatcgtgggaattagtacttttcttgtgttgctatgatttactacatcagttttttaatggatgacgtggttgacttttaaataatatttaactatttttcctattcaaaagaaatttatataaataatacttattttgttgtgacatgttttatcattaaaaaaactttaagtacgacttatgctttagcatatttacgctatttttttaatacgacgagtagtgaaacgtcatgtaaaaaattagcgtgtcatgtattaaaaaaattgaagggagtagtaataaaagtttcaaatatattggttaataaataaataaaaccaaaattaatggttaagatttactgtaagctcttataccaccctagctaggtggagcatcttaattaaaaaggtcttgcataattttgaaagcatcttaattaaaaaggtcttgcataattttgaagttttatgtgtgtagattgcggcagtaagccatgcagctgatctgtcccccgagcaatactggcgatccatcctccctaacaccccaatgccaagctccatctcccaacttcttaactacccttacttgcctgctgttagattacctcgccgtacggatgctggtcagcgcaactacaaatcatcagtttcacatgtggctgaacgatctcaccgtgtagatgatggccaacgcaactacaagttatcagctttacctgccactaatgaactacctcaccgtacggatgctggtcaacgcaactacaagtcatcagtttcacctgtggctgaactacctcaccgtgtagatgatggccaacgcaactacaagttatcagctttacctgccactaatgaactacctcaccgtacggatgctggtcaacgcaactacaagtcatcagtttcacctatggctgaactatctcaccgtgtagatgatggtcaacgcaactacaagttatcagctttacctgccactaatgaactacctcaccatacggatgctggtcaacgcaactacaagtcatcagtttcacctgtggctgaactacctcaccgtgtagatgatggccaacgcaactacaagttatcagctttacctgccactaatgaactacctcaccgtatagatgctggtcaacgcaactacaagtcatcagtttcacctatggctgaactacctcaccgtgcagatgatggtcaacgcaactacaagttatcagtttcacctgctgctgaactacctcaccgtgtagatgatggtcaacgcaattacaagttatcagttttacctgccactgaactagttcactatacagatggtcaacgcaattacaagtcatcagttttggagacgccagaacttctcaaagaccccgacatggcgctcttcttccttgagaagaatcttcaacaaggtaaaaaaattaataacgccctccacttcgccaacttgttggccactacgaactccaagttcctgccacgaggcaaggcggactccatcccgttctcctctaaagaactacccgagatcctggaccggttcggggtgcggccgggctccgacgacgcggctgagatgagtgctacgctgcaggactgcgagctgccggcgaataagggagagaagaaggcctgcgccacgtcgctggagtctatagtcgacttcgtcacatccagctttggggccagtgacgtcgacgccgcctccaccgttgtgctcagtaaggcggtggagtcttcttcgctggcgcaggactacacggtgagcggcgtgaggcgaatggccggaaccggccagctcatcgcttgccatccggagtcgtacccgtacgctgtgttcatgtgccacctcacagaggcgacgacgagggcgtacaaggcctcattggtcggcaaagatggtactgcggtggaggcggtcgccgtgtgccacaccgacacgtcggactggaacccagagcacgctgccttccatgtgctcggcgtcaagcctgggactgtgcctgtctgccacttcatgcagcctgacgctgtcgtctggacccgcaggggctgatgtatgtatgtatgccatatagtacctacttcatcgtactgtactgcgtacgcatgctgccagctgctttgcataccttgctgctggagatatataattaatatccagcacttatatactcgtcacttctatcgtgtgtcgaaggttatatacttgtagcatttggggatgcagtacgtacgtgtgtctgtaataagtttcgtgatatgttgcttcatccatatggaccatatgtaccaccaatcccagtgatatataataatataatatcgttgtctagtactacttgcttatctacctacactagtcagcttgcacatgcaagtcacgtcgatatatattgaattgagtaaattgaaaaatatatatacatccatcttaaatcagtttagttaaagtttctgttataatatatccatacgaggagagaggcaccagtgacagggactgattttcatgctatgtttaggctacattcataatttggattattaagagactataaaaaatgcccgtgcgttgtaatgggcaaaaacatttttgaatcgcatacatcatacactttgttttaggccaaaagctcatttcttcatttcttttcagtttcagtgtagcccgctacctctctgcttagcctgcctcttttttacctagtccacaagtggtcaagtggagctgtagacccgggtatcgctaatacacgacctctactgtatgtacgtatgtatatggtacgtataaactttttatacacgtacacaaagtttatacatacgtatatacaaatatatcttttttatatgtatatttttttaatgtataaaaatatatcatacacaaagtttgtatacgtacacatacaaagtttgtacccatacatatacaaactttgtatatatatgtgtatatacaaaatataccaactttgtatacgtatatatacaaagtcttcttgcatagccgactgccatctttaaactccggccggaagagtgtccgtatgatgctcgaacggatcgaatctttctcgatcttccaaaattggttgaggttgtttgatacacttgatcaactcttttcgtttttatcaaaatgagtaaatccataaaactcggaataaaaacggtcacttttaaatgaagattaaatctggtaaattgtaacatcctgaaaattaactatttttctagtcttgcatcatgcatattcttatgttcttaatatccttctaaacctaggaaaatatgattagagagacctcctaaaactaacttatataaaatttctctttggtatttaatttcttttatgattttcatttaagatttatcttgaggtatttcttgatttggttttaatctaaaaaccttctttcgtctaaaactttctttatttaaatttagtttgaaaacccttcttacctattatgaattatggtccaagaaaccttcctatattgtgctagaacctaaaccaaagcaattccaattttattggaattaattgttaacctatcctttgatcttagacctatccttagttcttgatccaaatatctgaattcctccttttgatctagccgctcatttatttcctgtggcttgatttccttttcagcacaagaataatattattacaaatattgtgaataattgctcttgtgctaagaaaatagattatatccttgtcatccaaatttcttattagcctcaaacaattctttgaaacccatgccatatatttcggggctaaaaatcttgtttatcttcctccatttatttccctcccacattcccaacaatatataggttcaattttaggaatcatagtactcatgcaataatatatatatctctctcccatttgagtgcatcaatagattccaccatattccacttctaagaatattgcactcaaactagaaaatatctcttttagaaattatattcaaatataatttcctttctgtcacgcccagaaatttacgaaccagaatttctaagctggatgtgcattaaacccctgtccaggaccagccagggtacacaaacgacaattgttgacatacagtccacgtcttacaaaaaagtaaaagattacaaatgcagcggaaaagataaaacgagctaaacttggaaacttgacttctgcagcggggcgactccactccacaggcatccttgacggtagcgacgaaaccaacctttttgagacagctccaactgggaagaacttccgctctggtgtggggggaaagagagcaagactgagtactacccactgtactcagcaagtcataccggaagaggaggtatgatgcaggatataaccaaaggaggctaaaggttcatttgcataaagcaggcatttaaaaatagtagttgaaaacaataaaacaattgcagtagattaagcaatattaaccaatcactgtccaacgctacaccacgttgcaacaggcccaaccaaccacctgaactacaccagttcattaagctaaactaggggtgagactaatcacggtgaatctggttgatcgcccataaccgtgggcacggctattcgaatagttttactctggccagaggtgcacaactgtacccacaagacacgattccacacatgtcgccatgccccgaagtaccaccatggcactgcaaagggggaattcgtgacaagacccttcgcataacccgcccctaaccatccacaccacgctaaggtttcaccctcacccctcaaaaagcagtgggcagtcccctcgtgcgccgtggtgaatccggcagctggacaaccggacaccccggctgacccaactccatcacgcccacgctcgccaccggtgcctaggaaagggtcgagctatacttcagatcaagtagttacccactcccgcttgtggtaagcacggtaagtctcccagggtttcccgtgaaccggtccttaattgcaatgggtgcgaccatcaaaaccatgcacccacagcccaccattcagtatattttaatcaaggggcaattgtgttcttacccttgctttacagttcaattgtgattttacccctactttttagggtttgtgattttgcccctgctttttttaaatgaagcagccgcttgcccctactctgttacctcattataatggtgttaaatatgtggtgaatggacaaatatacccctactataattttggcatgaacattggacatgtttcaagttaaattcgtgcgtatttttcatatgggacctaaatgttgataaattttgtacaagttgacagaacacaatatttaggatagttttgacagaattttagcaataattttgacataatttaaaaaagatgacagaacacattatttgggacaatatgtacaccctctccgtcatatgattagaacacattatttgggacaataaactcctccgccgtcgccctgccgatgccgctggcgccgccggtgatgacgacgaccttcccggctagcctacaaacccgcaaatcacattcacatccatccccgattcgcaatcaagaagatgaaatcagcgtccccaaccaatggctcaatgcaactccaagctgaatcgatcaaatcacctctgcgaatcggaggcggtagcgaaggcactgacagaggaagacgaagctgcaggtgtcctcctccccctgaattacaaaagtcttgatccctgcgcgtgcgcccgccgcgctgcgccctcctgcgcgctggcccatggcagttggaccaccgggccgccacgtctccctgccgcgcgctggcccgcggggccgccgcgcctccctgccgcgcccgtcgccgccgccgccgccgcttgtcgctaggttttcgatttggggaaatcgttccagcaagagaagtggttaatggtaagcccttttagtaaaccaagggtagaatggtcattcacaaattataatatcattttctttcttcgctttattgggaaatttcgggcccatcaaactaccgtcaaaaaaaaggggcaaacgggtgcttcatttcaaaaaagtaggggcaaaatcacaaaccctaaaaacaggggtaaaatcacaattgaactgcaaagtaggggcaagaacacaattgcccctttaattaactaacacccttgcggtggcaccaatccgaagctatgctaatagtcaaagtctatgtaataatgtgatccctatttatgtactagttgaactaagcatggctaagtatttcctaaaccaacatctaatcattttgatgcccaagttatcaatggcataaggtaaacaatatatggctgagtagtaggacccatcccacatgacattgtaaaagaatacaaaatttaatagaaatgcgggatatttgtaaattgggtacaatatgattaattgtaatgcatgacttgccttgctctcgcactgatgagaccacagcaacgtcttcgagaaaccgcagatcgacaaaactgccgaaatctacgcgacaaacaaagcacacaagcaaaacatgctataagactactgaaacagaatacaaaaccatttttaatggattctttgcatttttcttgatctactgagacttgaatggacttaagtggagctcggatgaagtgagatataaattttagaagataatatgtgtttttactaataaaaaaatccttattcgatttattgcgcaataatacccagggctgacattatccaaggggcgggggcgccgacaggtgggccccacgggtcaaaggcacaaagggcgccggtccaccgtggaccgggaccacacgggtggtccacccccggtccacgggaccgacggtccagatcagccccgaggccgataggacggtgcggcggcggcgaggcacggcacggctcggcacaaagcctgctggccggccatggcaagcggcggcggtgcatggccgccgacggcggcgaccggcggagcgaggcggcggcagacagcgcgaaaggcggcggcggacggccggagtggcggcacagccaagggcggcggcgcacgcgggaaggggagaaaagggagggggagggagtcctcaccggagggggtggcggcgaccggtgcagaaaacgagggtggcggcgacgaccggcgatgccgaggcgcggacgggcagtggcgacacctagagaaggggaggagaggagttagggatggagaggacgaccgcgacgaccaaagtggccggccggagatggatgaaaatggagagctcaccggtgagcgagggaaacagggcttcgggggtgattggtggcaaccaagcggcggccgaggagcgggcggcacccgcgagcgcgatgacgacgacttcacggtgcggcggcagctctagcggcggtggcgctcgttcggagtgcggtggcagggggcggagctcggtgtgacggcgcgccggcggtagaaagcacgggagggcgcggcgaatgtggaaaacgggagaggaggctcgggggaaggattttatgggcatggaaggggagaacgtggctgggagggtggttgatttggctggccacgtgggggagtggagggagagagagaggggggaggggattcgaaacgaatcccgcccattctcgggcgtgcgcgagggcgggaaacgacgggacatggtcggcaacgtggggaggtgcgtgggtgtgggaaagggcgaggaaagcggcggcatgggcggccacgtgcgcgggcggcggttgccggcttgaggagcggcggctggaggtaagggaaagggctgacaggtgggccctacctgtcagcgcccgagagagagggagaccgggtgaacttcggagggggagggaggagcaggccggcgcgagaagaggtgggccggcggcccaagaaaaaggaaaatagggaaaataaagaggaaaaagaagaaaggattttccccaaggattaaatattgcactttgatgtttttaattggttaaaattatttctaaggctctg

SEQ ID NO: 66996 - DNA, 1654 bp, Oryza sativa
cggatgaattcccagaaattcggacaataacacaccattgtcccctgcaaacttctaagcaaagctctatgacttgacagttcgtgaaactcgtcctaaaatccaaaaccggccggaaattccaaagggggatttgacaggagtgataggcctacatgagcccaaatgcaaaaaggccccacaaataaattcagcctaagcccactaaaattctgtggataaaatcgcatctccgccgtgtgacactgacaccctgacccaccagtggggcccactagccagcggcaacgacctcctcccccctcttcggcttcaccgaccaaaccaacacaatcgcgcggatcaacagactcgagtaggggagagagagagagagagagagagagagagagagagagagagagagaaggcgacgcggcaatcgatctgcccgcctcacctccggccaccgaccaccgccgcctccgcgtccctttgcctcacctcgacgccggctagcatcgccggcgatgggttgctcctcctccgtgccaggttctctctctcacacgtttccatcccccttttttagattagatttcctcgttggctatgtttcggctgcggatattgttggtaccgagtgttaggtaagcaggtgttgccgtgggggttttcaaattgggttcgattcgtggcttgctgctttggaaaatgggagggagggaccagcttttttatgctgaaagctgattggggataaatgttttcggtcacagcgttgatcggggcgaaaattcgcgcaatctggacggttttgaactgtgatttagtgaatttaagtcaatttgtgggttaattggaggttagagcagggtgtctgcacgatctctatgaatgggaggatcgtgtgtggatgtatgtgagtgggggctggggaaagtttgtagctggagtagaagaattagccattttccgccatttgttaacacatagcactgttttgtcatccagctcgaagcactggagggttgaacaatattagcaacgataactccgctactgattcaaaggacttgcgtgctaaggtttactgcacattttgccctttattactacaataatgcctctatatcatgttactagcagctttctttaacgtgtccatccttttgatgttgtagttggtattgcttggtgactctggtgtagggaaaagttgcattgttcttcgctttgttcgtggtcagtttgatcccacttccaaggtgattactgttttgagtctcttagtttcagttgataatgttattcttcaccttagatgcatgattcttactttcagaagttcgattgttttaaacttatttcctcaaataatttcaggtaactgtcggtgcatcatttttatcacaaacattggctttggaggactcaacaatagtgaaatttgaaatatgggataccgctggacaagagaggtacacatacagcactatggttttagcttcttccaatcttgggataatggcatgctgttggtgcattagaagcattggttttgtgagaaagttctagtagtatgtgatactgatttttacaattgatacatcttacgtgacacacatgcatatggtttttctcaatcaagaactcattggtccacccaatttta

SEQ ID NO: 66997 - DNA, 2917 bp, Oryza sativa
ttctgcccatcagcaaggagcccataacggttcatgcggcgaagcagtgcctcaccctcaaagatgcggcgtggattcttctcatcaagtgtgagcagatgccttgcattgttacggatacggctcaaagcatactgaacacgccacagctcacgcttgcacctcagtccatactcacccactagcttcagctctgcatcaagacgctccttctcgtaagggcgacgtggcttcttgaatgtcttaccatctgcaatgaagtaataaatttgttcacaacacatgacagagaaagaaaccactgcagatagcatagttgttcatgaggaaccaaacaataacatagaaagaagccctacagtcccaaattccttatatcctgaccccaaaaatatacaaagcaagaaagaaactgcacacacaacccggaaagacaatgcaacaatacaaataaagaaaactacagtagttgttgagattacgcccaataatagtatggatattcaagacaaatagtagtagggatcttgtgtacagtaaatactaagagcttcagatatacaaccatgtttgacaaggatttaaaaaacaattcataacattgtgtctgattaacccaagaatagcttacatgccagatttagttttgctgtgttatccctggttgcccatatcatacatacctaaattatttgtcctgctgtaaaatggaattcatgacctaaagcgacaatacttgaaagatcttatcagggactatcatataatatatttaagaaaatatacatatagaatgcaattagtatactacaacttacacagaaattttaaaaaaaattaacaaatatagttctcgatggatcactctatggacaaacatacagttagtgcattacaagtatatagtcctctatattaagcgccattattcattttcataaaaaaattcacaagcttatgcataactccattccaccaaaatgagtgatcaaacagagtatttgagaacaaaaaactctagttaatgaatatcatatttccagtccttaaaaccggtaaattatcaaattttgtaccataacagaaataaacattttcgagctacataataccaaatgccagagtaaaacatgtcctcattcctcagtactatacaacacatattagcattctagttagaacccccaaataatctactacatatctcgaaattaaatccggaccacacacaagtttcaactacagaatgcgcagtcagtcgaaatcagcacgaactaatcggcatagatacggatccaacgcagtggaaacgagaaaatgaacaaagctacgggaacagaacgcatcgaggcaaatcttgatccagatcatctcgccaaccgaaccagccatcgcctaatcacctaaccgacactcgctaatcaactaagacacataagcaagagaagagggaaaataaaaggagaacattctctcgctgcgtcaaatcgcactagcaccaaccaagacgacgacgaagaacacaacaggtaaggcccgccgttcttggacgagagagagggagaggaggaggaggaggagctacgcacagttgcggtagaagctgacgtgaaccatcgtcgccggaccgcctatcacgggccgccgccgccgccgccgattgctggagctttggtttctcgaggggaggaggagtgaggaggagagcgcgtttatagtgcggcggcgagaggaaaccctagctttagggctaggttaaatgggccgagatttcccggcccattaacggacgggtgggaattaggcccacatatcgaatgggccttcggtgcaggggccatatttacaccgctcgttaaatggtctttttctcgttcttttttccttatttttataacagaaatgctagtcaccggtatactgtttcgagtcggtcccggacaggacaatttcccacggatcaaacacacaccctcacggatcagatacacacactcgagaaacattgagtcactcccaaacagacacctgcagctcccaaatcgtcacgagcatggctgcggcggcggagtcgccggcggcggagccttcttgcggctcctcctcttcagcggcgccgatgcgcacaaggtcagttgtgccagagagggagagtggcgtgagcgtggtggtggcggctgtggcggcggtgtctgcggcggagccggtggcatctgcggcagagccggtgcgcacgatacccctttctctcattcctcttttttcatcgatttcctgattttgatttaacatctcttcatttttgcattttctagggtttgttgaatcactaatctttggatggggctcatcatatcacatccaaattgaaatcaaagtaagctaatactctctctcttttttctgtgtgtttttgttcattcactgggggtgtttgtagcagaggtgagggatgtgtgtatgtgctgaatcatatgatacttgatatgatatttgcagcaaaatgttcgaattggaatagatcgcttgaaatgcttctagctgtaacaagtattgcttggagcaagcaattttgccgttaacaagtacacactgtcttaaaacagagaaatctccattcaactagtaggattttttttgggtgaactgaagtgtaaacaaaatcagagaaatccgcatcactcggttgctagcttctagttccgggcacgctttgcttgtcaattgttatcctctttgtcataaagggcagtgcgtggtgacaaagttggcagatgcagctgagtcatagatgcagatgatttggattttttttttctgttgatgtttgcatatcttagtggctacatgggtgttttctgttttaaaatgatttgatacttttgttcaatcgaggatgaatcaccattgaaatgat

SEQ ID NO: 66998 - DNA, 7820 bp, Oryza sativa
caaaatgttcgaattggaatagatcgcttgaaatgcttctagctgtaacaagtattgcttggagcaagcaattttgccgttaacaagtacacactgtcttaaaacagagaaatctccattcaactagtaggattttttttgggtgaactgaagtgtaaacaaaatcagagaaatccgcatcactcggttgctagcttctagttccgggcacgctttgcttgtcaattgctatcctctttgtcatagagggcagtgcgtggtgacaaagttggcagatgcagctgagtcatagatgcagatgatttggattttttttttctgttgatgtttgcatatcttagtggctacatgggtgttttctgttttaaaatgatttgatacttttgttcaatcgaggatgaatcaccattgaaatgatattttctttgtcctttcacacatgtgcacagagttgaaatggcattgccacctgctccaagcgaatccgatttcatgcatgtttcaaagaagacaaggtgctctccaaggttgaacaagggctcagcttcacccccactttgacaaatctaacactgctcattcttgtcatctatgcaggactacatgaaagaatatcgtagtaagctatgcaaaaggttactgtaccatcgcttcaacgacttacatccaaaacgtcgtttctaagcttcagaaccaatatgcttattcggttcaagcagtgtcggatgtgtgcttaggccatttttgtagccccctccctccctctcccccaaccaacatatgtaacaagtcaagtttcagaattgtgtatgtagctactatttttgtcttgaactggaaggttgcgaggggcacaacaatcaaagacatgaactctgtatgtggctactgttttcatgtacagatatgttggtaaagaagtggattatattgggtagaccttttctgtggactatatatagtttgagtacgttgtacacaatgaaatcgagttcagtatcatatgaaacctgaggaaatgatactgaggaggatcatgatacctcccagagttcacatgatcctactcaagtatcatatgtgaaaccagtagggaaccactttacaagacatcgatattggataggatcatgtgatacttcacatgtatcaatcataatgaaactcatgtatcacatgatcctacctacccatgtatcatgatagatgattttcctgggtaggatcatgtatgatacttcacaggtatcacaccatcctactaaagtatcatatctgaaacctcacagggatcatgttaccagagatgatacccaagtagaatcatgtgtggtacatgtaaagtatcacaccatcctactaagtatcatctgtgaaacccatagagatcatgttagaggacatgatacctaagtaggatcatgttagaagacatgatacctaagtaggatcatgtgtgatacctcacatgtatcacacttaatgatacttttttgagtaggatcatgtgtgataagtatcacgccattaagtagcatttgtgaaacctattgggatcatgttagaatacatgatacctaagtaggatacatgatacccaagtaggattatgttaaaagacaagatccctaagtaggatcatctgtgatacctcacatgtatcacacttaatgataatatttttagtaggatcatgtgtgatacttgtaaagtatcacaccattaagtaccatctgtgaaacccatagggatcatgttagaagacatgatacctaagtaagatcatgtgtaatatctcacatgtatcaaacttaatgatacttttttgaggagaaccatgtgatgctatagaggtatcacatgatcctacaagataacaagagtaccatgtgatcctacaagagtaccatgtgatcctcaagagtatcacatgatcctaatagagtatcatctttgaaaaccacaagaatcatgtgctacttgtgtgaaaaatttcagcaatcacataagacgccggattgcagaggaaattggctgacgacgtgtgcgccgatggaatcagccgagaaaacaagcatggaggcgcgcgattccgcggatgaatcttcgggatgcggaggagctcgcgccggcgaggaatcacgcacggaggcgcttgattcctaggaggattcatcgggttgtggaggagctcgcgccgacgaggaatcgcgcacggaggtgcgcgattctgaggaggattcgttgggttgcggaggagctcgcgccggcgaggacgcgcgattccgaggctgattcgtcgggatgcggaggagctcacgccggtgaggaatcgcgcttcgtcgggttgcggaggagctcgcgccggcgaggaattgcacacgggcgcgcgattccggaggaggattcgtcgggatgattcaggcggggcggtgagcactggtacgatacgtttctgttcctgtttttgttgacgcgctcgcgcgatactgtgttggtttcagaattatcctgtttttcatcgggataccggtatatagcagccctcttttataaacaacaaaatccgggcattcatcaacagaaggaaacgattccagataatcaaccagagagggttaggatgcaatgctgattgatatggtctcaattctaccaactagacaaggtttacagcttcagggaaaaaaaaagcatcatcatttcatcaccaaccaaacatggcagatttctacattactcatctactggtgtatattggagaaatatgttacatgatgacatgtcataacaattgacataggacaaacttgtgacaaggaggtgagttccattttccttgctttcttgatgaaatggctcctggagactgctacctaatcaaagaggctctctacaccgggctgaatttttcttctttggcccgtaaaagaaatgcaatgatcaagtaagttgacatgatcaagactgcaacgaaaaatatatttgttgagttcaggggttacatgtctagagacctctagttgcagtaactattcatcctcaaagatcatgaggcagcaaagaggctccatgagttgtgtttcggatatgtgctctgataagcagaggttggatagcagtcacacttcaattccttctccggctcaaatgccacactcttgttgctcttttgttcaagttcatctgaatcctttagtgaaccttgttcttctgagcctttcttgcgcttttcagtatcttcgagtctttcggtaccttattttgttcttctgaatccttcgccgccttcatatcttctttcgagttcgatggcttttgactctttcaaaatttttggtggcttcggttgttttgaatcttttgacggctttgattccctggattcctttgatgacttcgaataccgggattcctttcatgactttgaatctttcgatgatttgccagactgtttagattaggcatcacagataacagtgagcaccatgacttcaggatcatagctaattatatacaacatgaaagagcacatagactagtgcatgaagttcaaagtagagcctttttcaattttcacaattgtatagtgcatgaaatggggaaatatgtaactaaattttgactcaggtaccttctttgtcagtttattgagatcttcaggtccattttcttcaataaacttatcaagtgccgtgaggaagtcatcaaatttaccggaaagaccctttttctctgagggatataccaaatatttactatctggttctttataaacacagatatcacataattttggtacacataggctgcaccgctgaaatatggcaagacaggccagcaaataaagatcaatttcatggatggccaaaaaggaagcctgcaaaaatataagatggagagaccaaggaatttaatcagtcaatgtatcatgctaaccaatcataaatttgtgcaagccaaagggagggagagatattagagcaagcatgaactaacagatctttcttccttaccattatgttgtaatcaccatccaaaccaaaatatgcaatgctaaaaatcacaattgcattattaaaaatcctacaaaccttttatcacacagcaatggcatgaattgaaccatataattgcagaacacttgtaaacttgtattgatatctctttacatttttgaaaaagggaggagggtgcacctgacagaggaaaggtgtatgtttccgtactatatctaaacaatgcatgacaagaactaaataatgcttgcagttgcagggtgaccaagtgaactcgtaatttccctgcattagaataggcaacatgtattcccccaaaaatgccaaaatggtcgaagcctgtttgttacttttttgcaactgtttttttcatgtaggcatgttagaacattgtatggtcatagctactactgtttctatgctaatgataagcatctagcgtacctggatttcacgtggtcgtgtagtcctttagtactgagagtgccaatgtggtgcctattttcagatctaaaaaatgtctattcacagctcacaaagaaaatctggcgggagattgaagaactgggtggtgagatcagggttgcagtatagtgcaacggtgagaagaaactcaccgctcacaaaaagctgggacttgggccgtgcagagctagcacggcacggcccagtgtgcttcgtgccaaattgggccgtgtcggcccagcacgccccactcgtcgtgccgtgccgtgccagcacggcctcttcaggacgcggcccaagcacagcccaatggcccgacgggcctattcgtgccgggccggcacaagcacggcccaaaagatgggagcaggccggctgcgctgagaagaaactctggcggcgacgcggcagcggtggcttgcggcttcgtcgtcccgtcgcggcgacgcggcagtgacagccacacccatcctgctcctcctcgtcggctcgtcgcggcgacgtagcccaccggcgcggcggcgtgagtcagccaacaatcttgccaaatgctagtgctggcctgctgggctgctggccttgctggttgctgctacgtgctaccgatgagccgatgaagaaaacgagctgctacttgctgctacctgctggctgcataggaaatttgaccgtggatgggtgatgactgatgacctcgtgctgcagcagccattcgcgtaccgtgccggcccaagcacggcccagtggtcgtgccgtgccgtgccgcccgtcgtgcccgttgtccaggcccaggcacggctcacgtacgggccgtgccggcccagcccatttacgggccgtgtcggaccgtgctttctatcgtaccgggccatcatgccttgggccggcttgataaagcatggcccaagtcccagctctaagcaaggggtaaactttgccccctcccccccaaaaaaaaaaaaaattggccaaaaacacatttcgcccaaaaagcctacttaaagataaaatactcagagagtttcccctaaaatataaaaactcgaatgaagttctcctctttatagaaaagttcttttaggacatgtttttacccaaaggaaacagcgttatgaggaaaagtacattcgagttaatgtcaagtagacagatgtattcgagccaacttcatccacctgacattatttttcctaatagttgtatccgagcaggttcctatggagtgacaaggcgccaagataatgggaaagtatattcgagttctctggtgcggccaagacagctgaaataacaagaaaagaaggaaaagtcttatcgagcagttgactcattcgaggaaaataatcgtggggaccacttcgactactctaaccagctggcaccagatgtcgcctagggaccactagcaaagtactattatacccctagggcctatggatcactaggggtaatacggtaactttatgtaagcccatgatgacaaagatgtaaatatttgtggtcatggtcaaacactataaaaggccgaccagagtcctgtagcaagaacacaatgaaatagagaaaaagtaccttatatacatcctgacatctacttttgggctcactctcagggtaaacgggaatctacactttcccgtttacccccaactctgttcgtgccctaaggtcgtgacagtggcgccgtccgtggggacgtaaagtctccattggagtgggcccaagtggtaaatgcgacgttctcagagaccgaaaactgtgccaattcgttacactgacacttttgcaagtgggacaatagcacttgagaaggaacttgagaaggagtttgaaagagcatttgagcaaagtgatattgcgaacgtaacaaaaacgcttgaagagaagtgggcggaacaagtcaggaaaaggaaactgcgaatccctcaaaggaggaagcggggaaaacaaccacaagtgaagtggaacttgccgaaatggcacaagcacaaggggctgttatgataagcaaagaacaatacgaaggactatagagagagctacaaagactccaggctttgcacagtcaagcaattggagcaagtggatctggtgatcaactggagacataagaggctgatggaaaacaaccaaacttggcagaaaacactcatcaaggagatactttagctggagatcctcaagtcgtgaagttagcagaagagattcctcaagcccaaattatcaaaatacaagttcccacccaacaaatccttcaaatgcaaaaccccacccaacaaatccctcaaatgcaaaaccccacccaaatccaaaatactcaaacataactttccacccaagctcaaatttctcaaaaccgaattcctatccaacatcccaaccaaattcacttttcaactcaaattcatccttctcagattccataccagatataccaaaaccaaacacaaaatcctcaaaaccacacaactcacgctcagatttcccaagcatacacccatataccccagatacaaaacactcaaacacaaataccacaagtacaaatcccacaaatccatatacctcaaatccaaacatctcaagtgaactttccacatacacatgccatacaaaatcaagcaacacaaaactccagtcaacatattcaaaccttttctccttttcttacccaataagatgcgacaaatgaacaagtctacattccacaaatgcccaaccacatgcaatacacaggacaattaccaaaccaaacattcccattccaaacaactcaatcctattttcaaccaatcaaagcggtggacaccaaaagccctctgatccaaaatctgcaaatggcgccttggccattaagttttaagttgtcaaatatcaccaaatacaagggtgatacagatcccaatgaatatttgagggtatatgaaacagcagttgaagcagcagggggagatgataccacaaaagcaaaaatacttcaaaccatgttagaaggagtagcattgtcatggtatacaacaatactaccaatgtcaatatattcttgggaacatatgagagacactttttgagctggatttataggagcctatgaggaacctaaagaagcagatgatttgtatgctatgcggcaaacgcaaggagaaaccatcagaagtttcattttgaaattttcaagagtaagatgtcaaatccgacaagtggatgatgagatgctcatagcggcagccaaaagagctctgttgcctggacctcttaggtttgatttagcgagaaatagaccaaaaactgcaaaagatttgtttgagagaatggaaagttttgcgagaggagaag

SEQ ID NO: 66999 - DNA, 18845 bp, Oryza sativa
catctttaggagtcgaatcaaaaagacagagaaaagcttatgtgagacaaataaatcatgtgggcacaagttatcagtcaattccaccagcttactcaaacacagttatctcgtttggcccggaggatgctgaaggcatacttttcccccatcaagacccgttagtaatatcagtggaaataacacagtgcgaagtgcaaagggtgttggtcgatggaggaagttcggcagatgtacttttctacgatgcatttaagaaaatgcaaattccagaagacagactaactcatgcaggaattcctttacaaggatttggtggtcagcaggtacatgcaatcggaaagatatcattacaagtggtgtttggaggaggagaaaataagagaagagaagaagtcgtgtttgatgtggtagacatgccatatcaatacaacgccattttgggaagatcaacaatcaacatttttgaagcaatcatacaccacaattacatctgtatgaagcttccggggccgaaaggggtcatctccgttcgaggtggtcaattagcagcaagaaaatttgagcttcaaggaactccaaatatgaaaggtgtacatattgttgaacaaaaacaaggagagtacaacaagaaccaaaagccagtaccagaagggaaaacaaagaaagtagtgttggacaaaaatgaacttgaaaaatacatcttgataggagaaaatttggagaaagaagttgaagaagaaatcttaaaagtggtaaaagccaacacggatgttttcgcatggtcaccggaagaacttgaaggagttgagagaagtctaattgaacacaatttagcaatcaagccagaacacaagcctaagaagcagaagttaagaaggatatcgatagataggcagcaagcagcaaaggcagaactagagaaattgttgaaggctaaagtcattcgagaggttatgcacctcgagtggctagcaaacccagttttggtgaaaaaaaagcaaatgggaagtggagaatgtgtattgacttcacagatctaaacaaggcatgtccaaaggacgattttccactcccaagaatagatcagttagtggatgccaccgctggttgtaagctaatgagttttcttgatgcttactctgggtatcaccaggtattcatggtaaaagaagatgaagaaaaaacatcattcataacaccttttggaacatactgctacataagaatgccatttggtctgaaaaatgcgggtgccacatttgcaagattgatatgcaaggttctggcaaatcaacttggccgaaacgtagaagcatatgttgatgacattgtggtgaaaagtaagaaagcttttacacatggaaaagacttacaagaaacgtttgagaacttgaggaagttttcagtgaagttgaatcctgaaaagtgcgtgtttggtgtcagagctggaaagttacttgggtttttagtatccaaaagaggaattgtgcaaaataggaatggagccacccaaaaatacaagagaaatgcaaagattaacagggagaatggcctcgcttagtagatttctttccaaatcagcagaaagaggtttaccctttttcaagacattaagaggggtaaacaactttgaatggaacgaagaatgccaaaaagattttgacgatctcaaagattaccttcataacatgccaactttgtcaagtccacaaaaaggagaacctttgttgctatatgtagctgccacactggtgacagtaagcgcagtcttagtacaagaacagggtaacaagcaaatgccagtttattttatgtccgaagcattgcaaggaccaaaaacaaggtatacagaagtggaaaagatgatatattctattgtgatggcatcaagaaaattgagacattatttcttatctcacgacataacagtaccatcaacttatccaataggagaggtgttgtcgaacaaggaaatagcaggaagaattgccaaatgggctatggaacttttgccttttgacttgaaatacacatcaagaacagcgataaagtcacaagtgttggcaaaatttgtggcagaatggaccccagcagagttagagaaaaagaaagaagaagaaaagccgtccaagctgagataagatcattgtgctccaaaaattccttttcaagctccggagtgatgaggctaggagcaatttcatttccaagctgatgaagagacgagcgatacttaaggtcatcaagacacaacttagaacctcgactgctagtctccccatccgcgcaaaaatcaggcaaacccatcaaccaagtgccatttttcgaacatcgctcgctgaaaccaccaagtatatcttttatcaactcgggagaaggggtcattctgtggcttgatcttcaactatgttttttctggattggaaattcagattaacaacttcaggaacgttctctgtttgaacaggattgacagggttcatgtccacatcaatagcatcaatgcaaataggttcctcaacctctttggcagcagaagtaagaacgttcaagggagcagagaggtaatcagctgcagctgaaagagaattaacgttcgaaacattcccaatctcaactgaacttatctcactgatagcaggtagctcataagacagaatgttttcatcctcatcatcactatccagagcaattcgaacttttttcaagttcgagtcaacaggagaacttgaaggcatctttttacgcttcaaagcaggactcgagttttcttgcacaaaaggagcagtgtgagtatgttcgctcgactcagaggagccgctgtcatcagacgattcatcacttgaatcagactccccatccaagctattctcctcattatcagaagatgaagatgcagcatcttttggattgatattcgagtttttcttctttttcttcttcaaatcaggatgaactcgaaccatcatatcttggccgagggcacttagaatcctgttttgttttctaccttgctgaaccgcaagatatgtgccatgctctttcttggtataagggccaatatatttcttgcttggcccatccacgtccttcacaatttttgctgcaaaaaaaagaaaaaaagagaagaaaaaaagaagaaaaaaatgaattacatatatatatatatatataatgcttgaaataaaaaatacatatacaaggtaaacacttactattcgcagatatctcgaaaggaggaagcaaagaactagaaccctcaggaatttcaccaagagataaagtccagttggcagaaagaggtcgaataccaagataaatgaactcctcgaccaagtctcgaacactaaatttagagacaagttcttcaattcgagggcgaatgtcagcaaagtcttttgacaaagtaacagctggatctgagatgacactcaaagatttacaagaaaacacaaaagggcatttttccatggttttcagatctgctggaatcttatgatagaaccattttgactgccaatgagttccccatttggtccacataacagagacaactggccaaggacaaccgcgatttaagcgtggcataaagttaacacacccaaattgggagttttgccttgtatagcgccgaatggtgtgaaaataagcaaaatcgcatccatgcggagtaccaccgcaactccgaataatccattcaaaaattccaagcttaacaagggtgtttggtgtaagctgagaaaactcaagtccatatagcctaaggacctcaacaagaaatgcactgcaaggaaacctgaagccagcttcaaaaaaatcatcaaacaccaaggtgtagccggcccgaggtgaaggactcaactgtcacgcccataaatttagcccaaatttccagactattttgtgtattaaatccctgtccaggaccagccagggtacacaaaacgacaagtaataaacagttccaaacgtaaataaagcgaaaattacttacagaagaggcacttagtcctcacaccgaaacaaaaacagcagcagcgaaaaaggcaatcctagcggggcttcagctttactccaaaggcaaaactcaactggggtctgagccttggtcttctaatttcatcttcagctcagaagcactacacttctgaaaagggggaataatagcaaggctgagtacaaccaccgtactcagcaagccacaccaacgatgcagatgtgcaaggggaacacaaggactgtttatggctatttgcataaaggcggttgtaaagcattttattgaacaaaacagtaaaacagttgagtaattaaagtaacattaaatctccactgatcaacgctacaccacgttgaacaggcccaaccaacccacctgaactacagtgcattgggtcgatttattaagtgtgagactaatcacggtgaatttggtcaaccgcccataaccacggtcacggctattcgaatagttttactctgatcagaggtgtacaactgtacccacaagacacagccccacgacacgtttccgtgcgccgacatgccaccacgacataccagaaagaggccgtgacaggacccttcgcataaccccctctagccaagcacaccacacctcaggtttcacccccgtccccagcaggcaacgggcagtcccctctcgtgcctaggtgaatccggaagcgacagaggccgtcgcagggcccgccctgctccatcacgcccacccttgcctggatgcgtcaactagaagaaagctacactacaggcctagccgttgcccacgctagcttatggtaagtacgagaaattcttccaggatttcccgcgaaccggtccttaattgccatgggtacgactagcaaaaccatgcacccatagcccaccattcagttacattttagttggataattacgaccactgaaacatggccaggtgtctcgagcatgcaactcgttctgttgctaaaaaggtctaatactgcaattatcccatcaactgagcaagtggtaattaagcatggctaagcatatagttctagctaggtcacataagtaacataagctagtcgatttattatccaatattgacaaaggacagatataaagtaaacatggcacaagcaaacagataggtaaaaccctgatcccatgtaattagcaaaacatgcatgtttatttgcaaacggtaaaaaatttataaattgggatcaacatgctcaaggggaatgtgtgacttgccttgcttcttcacaacaatcttctgaactctgatccttgcgactgcgaacttccgaaacaacagaatctactcgctggcacacaaaacgagaaaaaaaactaataaacaccaagaaaacagtatataaaaagtaaacaaacatgtagagctcaattttagatgaattttgcaagttgaatggctcaattcggagttcgaatgaattagatatgaattttagaagttttgagccattttaatgaatttctataattaataccaatttatcgagcaattattaaatatttttccaaaggaaatgataagcgctgacggcagcaaggggaagggtgccgacaagcgggccccacacgtcagcgagactaggggagggcgcacggtggacacggtccaccgcggcaggggcggcaccgtggaccgagaccacgggtgtggtccacgagcgcgaccctcatcgacaaaaggggaggctggctcgccggccaacccaacaaggcggcggcggcacacgctggacgaccggcgacggcggcacgacgcgggcaaggggacggcggaggagggggaaaaggaggggaaacagagggagagctcaccgagcgccatggcggcgaggggcaacgggcggcggcgatgccttctcgagaagacggcgggggcggcctcgggcaacgaccagtggtgcggaaaggatggccgaggcgcgggacgacctagggagggtggtagagaggttaggatggggacaagtggcccgagacggtgtgaatcgccggccggaggaggaggtgagaggtggagcttaccggcgcgcgaggaggacggagctccggtgggttcccgacgacgagaagcgaacgccggacctcccctcgtcgctgcgaagctgatggaggaaggtgcgacggccggggatgtctcggagtggcggcaagcggcagctggaggtggcaaatggcagtggcgtctcgggttcacggtgggagcagtgcttcgggggtgaaggagggagatggagtggatgccgagctgcgcacgatggctgcggtgctggggaaggcgacggcgcagcgcgaggtggaccagagaggcgatgcggcgcggctggaggcggcaatggtgacggagagagatggtgaacgtggcggcggcgtttcgtaggcggataggggaaaaagagtaggggccggggtagagctcggcacagcgatgccgatgacggtggtggcgcggcgcggcggcccctagggcggcagtagcgggcggctggaggcggtgagtggcggtagtggcttggcctcgcggtgggaaggtggttccggcggtggaggaggaaaatgaagtggatgccgaggtgcggcatagcgcggcgaagccggtgggaccaacggcggcgtgcggccgtggctttagcggcggtggagggcgactggagggtcgccggcgagcggcggcgcgcgggagcgacgcggggagagcgagggaggcgatgggaagctcgggggaggagggaaaacgaacgaggggagcacggggagggtttatataggctcgggagggtgagatggagccggggtgagttggatttgggcggcaatggccgatggatggaggtggcggcgacgtggggaagtggcggccggattttgcgggagaggtgggggaatgaggaggacgtggggcggcagagtcccacggccgggtgcgggcgtgcggagtggaggaggtgggcggattcggcggcaatcgtgggcggcaacggcagccatggcggttggccggaggtaggaggaagagctgacaggtggggtctcgggtcccacctgtcggccagagggagagagaggaggtcggttgggggacgcaaaaaaaacttcgagagggaggcgatctgggccggaggcccgaggggagaagggacggggcggccggccttagagagagggagggcgcccaggccgcggggaggcaaagcagacttgggccgaaaccggcccaagggaaagaaggggaatttaaattggttttctttttattttaattgattaaatgaactttgtattgataatgttacttgggctccgaaaattcgcgggaaatttcagagagtattttagggcacaagaatattacaaaatattcccggccaatgatttttaaggggaaattttaattctcccattattttacttgattaaattgatttaacttatatttaatttctaaaaaatacattatttaataatttttaatcccgatcgaaaatcagggcgttacatcaactcaccagcaggacgaatgactagattgagactagcaatggcaccttttgaaacaagtttattgagccgcttttcagagataatcgatggaccaagaccggaagatgttttcttcgctttctgttttgaggccggttttttggatttccccatggtcgctgagaagactcgaatcagaaactctcgaagcagaaaactcgaaaggcgtgtctatacggaagtgtttgagagaggagagtattcgagacaaacgagacaaagacgggcgcaacaatgggccaggaaagcgacccccgggcgcttatatagctgttttgcgtgtgcgtgttttcgtggggcccacctatcaataattaggcatgaaaaccgaagtggccccatcccctactcgcgtagtatgtccggataagcaccgccgacgacgcacgattttccttcgtgcttatcggtgcccttgtctgagtcgtctcgtccatgaacgtaagcatttgacacgtggtttactagtaaaaaaattaattaaaaattaattacaaaaaattaataaataaaaaataataataaataattaagaaagaagataatacaaaaactcacatgtgctttcgcccaaaacagggggacgacagtttatcccttacatatttctgaccacggtttcggccgaaaacatcccgcccttatccgtgaggggcttgttgtagcaagtggtaaactttgccccccccccaaaaaaaaaggcaaaaacacatttcgcccaaaaagtctacttaaagataaaatactcagagagtttcccctaaaatataaaaactcgaatgaagttctcctctttatagaaaagttcttttaggacatgttttacccaaaggaaacagcgttacgaggaaaagtacattcgagttaatgtcaagtagacagatgtattcgagccaacatcatccacctgacattatttttcctaatagttgtatccgagcaggtttctagggagtgacaaggcgccaagataatgggaaagtatattcgagttttctggtgcggccaagacagctgaaataacaagaaaagaaggaaaagtcttatcgagtagttgactcattcgaggaaaataaccgtggggaccacttcgactactctaaccagctggcaccagatgtcgcctagggaccaccagcaaagtactattatacccctagggcctatggatcactaagagtaatacggtaactttatgtaagcccatgatggcaaagatgtaaatatttgtggtgatggtcgaacactatgaaaggccgaccagagtcctacagcaagaatacaatgaaatagagaaaaagtaccttatatgcatcctgacatctactcttaggctcactctcaagggtaaacaggaatctacactttctcgtttacacccaactctgttggtgccatgaggtcgtgacaatctcggatgcgagtaagccttgtacatctctggaaaggactccgacatggacctgaagtgattccacagttgcttttcactcatctgcttcttgtcccgtgactcaaccctgatgcagttcagaacatggcataggtagaagacctcctcagggctaagttggaaccagtgcttctgtgccgcagcaatttcgacggcgtggccaaaggcagcacggtttaggatcacggcttgttttggctcaactccaagaatggcaccgccacctggacctgacaaaattgccacaggctttgagcttatgaatgaggcattgagctcagcaacaatgactgacatgggattagctgctgctagtgctaagaagtccttgccatctttgcccttcttccatcttggacctgacaaatccatatgctgaacacactcgcagaggatggactaaaattgatgcgtggtcaaatgctgtagtgaatagcaacgacaataaagcaataagtaaacaaagttgtccaaacaaatacctcaacaaatggagattcactacatacatcactaatttatcgaacatgttaatttgtaaagcatagatacataaataatctgccaaaatacccctgatacggccctacctctcatactctctccactctctcctactcttccccgtacataagactttgccttgagcatctgccgagtgtgtgatactagtacgttgtacggtggactttaagctcgccccctcgtgcttggttaacaacatcacaagattgctccatgtgctaattaaagacggttcccgctcaccgctgatttctttcttctcttcttgggttcttgatttctcgtgaacagaatcatagctttccgcaatcgtaatcagccatggcgatcatagtttttgccagcaatcctgacaagaacttctccctgaggaacttgatcaccgggttggtgctctgctggatgaagccgacgacgtaggccgccgtgatcagccggatgccgcgccaccgcctctcctcggcgtacttctccagcgccgccttgacggcctcgtaccccgggtcgtgctcggcgccgtcggcgaggaaggcctcgctgaggcaccgggcgaggacgacgccgtcctcgagcgccgcgcagccgccctggccgagctcgggggtcgtcgggtggaaggcgtcgccggcgacgcagacgttgcccctgctgatgctgccgcggacgagcgcgagcggcgaccggaacctcagcggcgacgacaccacgtcgctcatctcgctccgctcgatcacgtccagcgcctccgccgggatcctcgccgccctcagcttcgccaccacgtagctccgcatcttggccacgctctcctccgcgtcgccgtctgcacaccacacgtgacagattgatcagcgaattaatccgccattgttgctgctcgtcaaggggaagtaactagcaatggtccgcaccatccggggaggggtaccaggtgtagttccagtagacggaggtgtcggaacaggggagcacgccggagcggaagccctggccgatgaactgcaggatctccgggccgaatccgtggccggccgggtactcagcgaggcccctggtggccgagcgccctgagaggatcggctttggcaggccaagccacttcgccaccaccgagttcacgccgtcgcagcctatcagcaccttcagaaaaagcacagtaatgcatcaggccatggctgctcttagtgagaagaagagaggtacaagtgatgatgaacaatcaaggttgcatctagccattgttgatctcacacacctttgctcttatcgttgagccatcggacaaatgtaggagcttgacattgccgtcttcctcaatcgagacgatcttggaagagaacctgatggtgccttccggcagttcgttctccagagtctccagtaggaagttgcgcttcacgcaccgaatctcatgcggtccactgacgaagtaacgacacaacgacgatttcagttttcaggtgtttactcgtataagtatgattttgttacaaaattttaacattcaggtctcagctagcggtagttgcagacactgtaccttttcccttgcatctttagactcaacttcgcggcaggctctcccgtggatgcagagaaggccaacagcctgccaacaagcacgacaagtcacaacttcagtcgatcacaaactctttagtcttaagagttacagattactcctgcaacttcagtaggttaatcgaagggtaaactcaaaagatgggctggaaggagcaagagacagtgtaagcacacaagttcagagctcagacacggagtgggattgtggaaaaagcccaaaacttataaggtctagtacatcagaccaggcactggcagactgacccagcatatggacctaaaatcaggttcatcagtacggcccaggatggcctatcaaacgagctgggctgtaaatttgatttcgcttaaacgagaattattatactcgcgttaggatttgttgtgatttcgtgacggtcaacggactccactgttcgtctgttccactgtctctgtctggctattatctggatctacaactagaagggaagggattggtaaagcaagtggctgctcacctctcgtagagcagatgatgctccctgatcttgtcgccgacaccaagggcgtcgagcgcgcggaaggcgttcgtccatgtcgtgaacgcgaacccggacgcccgcagcgtcgccgacgactccagcaccaggctcctcacccctttcctgcacacgggacgcaccgccggcccagctcgatcatcagctccagatcgatccgcgcgcgcgcgcgcaaacgcggagcagatcaaggcgaaacggtcggcacagaggcttacctgtgtaacccgagcgccgtcgcgagccccgcgaggccggcgccggcgatgacgatgccctcgacgcccgagccctccattgttcgcgaacccccacccgcggttggtgtcgctcgcaagtggaaacagagtgaggatggtcgaaggctgtactgctgctgaaccagttcagggttttctatgatgcgccttcattttgtagcaaaacggtcgaggggtggttggattggacggagaagaccggattccaacgaggcggcgcgtccatccgtcatgccagcggtgaaacaaactggaacatggcggctttcacgaattcttgtatgactagtacacatcgaaatattggtcaattggtccatgttagtcctctcgatcgatttggtaacgttgcgcgcaagtctgattacagaggatccagcattcccgggttcaatgattggcacaaaggaactgtcagggctgtttcgtactagaatcgtagtacgagtacagccacgagggcggcttgtgaataaacccaaaaagaattgttgaggcagcaggtatgctcgcaagcagtgcccattcccctccgggttgacacgggaattttcgatatccgaccaaaaacccaaatgcactcgactttatttttctgcacacaaaaaggagcgtttcacaggtttgggatcattgacacgtgacggaacagtaaaacagacggagcacatacagacaaacatcacaaacagcacgacgatatgattacaggttgcagacttgcagctgggcggcggccaaaacccaaatcacgtcaacaagcaccggaactcgagagcgtgccgcaatcgtagtcgggcatcatgagcagcgtcttggcgagcaccccggacaacagcttgtcacgcaggaagcccacggcggggtggtcgctctgctgcacgaaccccaccgcgtacgacgcaccggtcagctgcgcactcctccaccgccgggcgtccgcgtaccggcgcagcgcggcctcgacgacccggtgactctcctcggcggcgcagtcgccggtacggagcagcagcgcctcgccgaggcacctcgccaggacgacggcgtcctccagcgccgtgcacgcgccctgcgccaggtccggcgtcgtcgggtggagcgcgtcgccggcgacgcacacgttccccttgctgatgctcgcgaacgggagcgacagcggcgatcggaaccgcagcggcgccgcgagcacgtcgttcatctcgctccgctcgaccgcctcgagcacctgtggtggcacgttcgtgctccggagctttgtcagcacgaactgcttcgtcgcggctgaactcttgtcgacatccttatctgtcaaaagacacggcattaatcagtaatacgattcagtgttcatgtcctccttgcagccgatcgagtgttcgacacttggatcttggcagctcaggtgactgaccatctggggaaggagaccacgtgaagaaccagtagacgtcggtgtcgttgcagggcaccatgcctgcacggaatccctggccgaccaactgcagaaacctgggctcgaagccatggccgtccgggtacttggcgcgtccgcgcgtggccgtgtgccccgagtccgacggcttcgcgagccccagccatctcgccaccaccgagttgatcccgtcgcacccgatcagcacctgcatccatcgccaccatctcctcctcagcaaccgatcgatcgacagagacagcacgcacgccatgtgtttttacctttgctctgagagtcgatccgtcagacagatggaggatcttggcgttgccgtcttcctcgatcgagacgatcttggaggagtagcggatggtgcctcttgggagctcttcctccaacgccagtagcagcgcggtgcggctcacgcagcgtgcctcatgggttcccctgcgtcacaggtgttttcaggtgtgcgcatcacacgacaggggggaaggggagtagacagatatatcttctcagttctcaccgtttgccttgcgccctcagatcaatttcttgcactatttctccagtagctgaagacatgacattcaacctaagaacaaacatggagagaaaaaatcaggcttatccgtactgtacaccgtatgatacagacatacagtaacagttacagttagtgtgtgtttagttcacgctaaaattagaaatttggttgaaattgaaacgatgtgacggaaaagttggaagtttgtgtgtatgaaaattttgatgtgatggaaaaattagaagttcgaagaaaacgtttgtaactaaacgaggccttaggagttaggacttctactttaggacctcggtcaccctgctgagtcaacccaaggcctcagggcaagtactatgagccccttatcactaatttcaagaagtcatgtagacttatatgatgatgtggagagaagagaagagagaggggagcagccacctctcatgcaaggggcaacctccacaccaatttcaagaaatgagagaaaaagagataagttgattggttgggtgtagtgtaagtagatgcaatctattgtatgtattacatctaaattaatgtgtagatgatttagacaaaattagatgtgaccactatctctatcataaaacttgccctcacacattcagataatgataaagtggcaggagaaaaaagttagtactactgtactctgacctggaggtcaagatctcagtgactcagagtctcctactgcctctgaatctgttacatacctctggatctgctggtgctggctcctcatcttgtcgcctaccccaagggcatcaagcgcgcggaaggcgttcgtccatgtgatgaacgccaacccggacgtccgcagcgtcggcgacgactccagcaccacgctcctcagtcctttcctgcacgcagtgccgcacttcgatcggctcccatggagttggaacacgtcgctaggcactcagaagcaaaaaaggttgtgtacctgtgcagtccgagggccactgcgagcccggcgaggccggcgccggcgatgacgatctcccggccgtctgcctgttcttgctgcatgcttgcaactggctttgtgcgaatgcaaactgacttggctgcaggaaagagatgagaataaatgctgtgagcaaatcgagtgagcgccaggagtttaaatatgattgctgcgacggcgagggtgagtgagcagcaggccagcagtgaaggcactttgacgtcatcgctgatgatgatgcgccactacggtccggtgagagtggacagacgtcgaacgggacgtgccttctcattgttttacaatatcttggacacattttttgcggcaagatagcagcctccagggaaaaagtaaatgggaatataaaacgttatggcattggttaaagtcaaactatttaagtttaattaagtttaaagataaatatggtaaaattttcaaccaaagataataaattatgaaaatatatttaattattgattcaatgaaactaatctaatattataaatattactatatttgcctataaatttagttaagcttaaaatagtttgactttgaccaaagtcaaaacgtcttataactataggaggagtagtaaccactgccgccacggatgcaccttcatcaaggttttacttgacaaaatgacaatggtctcatccagcacagacccagggtatggtgatcatttttatgtcctcaaacttgctgatagtgaaagttttagagcctcatgggtaagccatatgtttaggctgatcaaccaaagcctttttccaattcaagcaaatcaatttcattggttaacttatttagttgaatggcttaatgagtgatcctatgtggttggtggttgtagccagtggtggatccagaaaaaaatagcagtggggtctgagcaaactagataagttacagtcccccctcccatctacatatggtaaaaaaaatgtagtgggtctttgtggggtctttcatagtctttacgtcagtagtggaggctcgagaccccgccgctctcatgctggatccgcccctggttgtagctacagttgtagcattggcactagagagttcataggattagctaccaccaacgatcctactctcctgttggccccgctatatttggcaaataaacctcatcccaatcatcaagtcgtatgggcttcgggattgagatcacatgcagccatagctaggactgcaagttagtgactccatggtatctcatccattctttttcagatcaaaagtgcaaatcaagtgctacagcccgttactatagcggttgcattgcaccgttacgatgggatttggttcatgtgcaatccctgtgactacaacttaagcagtcatactattgttcctactatggtcaactgagactttttaattcttccatttttgcgctcaacaccttatccctactagtgtcctagaaatatagattcccatccttatccacaaaatttagacctaaacccatacatgttttgaggcagcttttatcacaaaatccaattccatcatttgttcagacacatgggtacaaaatccatttcgtaatcttattaacttgggtacaaaactgagttcccacgttttagagcttgccacagtcatagtccgccattttcagaagccttccggcgagcactccggccaaccacttgtcccgcagaaagctgatgaccgcattgttactctgctgcacgatgccgacgacgtaggctgtcccgacgagctcgacgctcctccaccgccggattctagcgtactcacgtagactcgcctcgatcctctcgctctcggcggcgccgccgccgccgagaagggcgtcgccgaggcatctcgccagcacgacgccgtcctcgagcgccgcgcagccgccctggccaaggtcaggcgtcatcgggtgcagcgcgtcaccggcgacgcacgcgttccccttgctgatgctcgcgagcaggagcgacagcgggggccggaaacgcagcggcgacgcgaccacgtcgtttatgttgctcctctcgacgacctcgagcacctcggttgggatcttggagctcctcagcttggtcagcacgaactgcttcatcttttccgcgctctcctcgacgccattactttctggaacggcaactaaacaccgatcaatcactgatcacctgtcagatcaccattgttgacatagttgacacttgatagtgacgagactgaccgtgttcggaaggagaccaggtgaagaaccagtaggcatcagtctcgttgcaggggatcacgccagcacggaagccatggccgacgaacatcttgaaccttgggtccaatccatggccatcagggtaatgcgcgaggcctctcgtcgccaagcgccccgaggacgacggctttgtgagccccagccattttgccacaacggaattcaccccgtcgcagccgatcagcacctgcacccccgtcattaatttcagtggcatttgctctatgaatgaaacacagtttctagggaattactctgttttttttcctacctttgctctgagaattgcggcgtcggcaaggtgtatgatcttggcgttgccatcctcttcgattgcaacgatcttggaggagtaacggatggtgccttttggtagctcttcctctagtgctcggagcagccagtcccgcctgacgcagcgcagttcattgggtcctctgcatccaagcgaaggatccaaaatttcggtacggttcaatacaagaacgtgtggcccgtggaagcaaaacgacatgcaagtatggcctagagtgtaaggtgaatagtcatcagtagagatcagtgggagagaacatgacatcttaccgtttcccctgcaccgtgagatccgctcttcgtgttatctctcccgtagacgaagagaagacatgcaacctgtgaacaattcagaccaagaatcagtcactattttacattttcaccacacctacaagtgttcctctctttttctacatactcctgaagatgcagatgaagcttcctgatcttgtcgcccaccccaaggttgtcaagcgcttgccacgcgttcgtccacgtcgcgaaggcgaaccccgacgcccggagctccggcgacgactccagcaccgagcacttcacccctttcctgcacgcggagcagatcatcatctcgagttaacctgcggcagccaacacacagagcaatacgcatcaccggctcaccggtggctcctctcacctgtgcagcccgagagccacggcgaggccggcgatcccggcgcccacgacgacgacggcttcctcgccggcttccttttgttgcatgcttgatcgatgctagattctcagtagtcagtactccccctgagtactcttaatcaattgggaggccagtgtttaattaagaccaaacactaactgagtaaagcttctttgctcactgaaatctagtgctgctcgtggccgcatatatagataggctagcaagtgtttgggacctgggagactgggagtgatcggcactggacttactgaagcagatgcgacgaaaaagaagtcaggttggtggattcgaccttgtacacgaacatgcggaaattggattagcgagggcagtcagagtcgtgacggaaatgggaattttgtacggcccaaactgttggctagtgtgtttggatgtggaccatatttccttcctttttttttaatggaataagatcactttgactccctcaactgacctggatttttcacattttggtccttttgaaaaacttatttcataaatagacccctgaaaaaacttatcccagaaatagtcctttttggggcgccagagtggctggcgccgtcgttcaacaggacggcgccagcctggcgccgtccccctgccgacgtggcggggcgatgctgaggtggctaggggg

SEQ ID NO: 67000 - DNA, 124122 bp, Oryza sativa
tccccctagccacttcagcatcgccccgccacgtcggcaggggaacggcgccaggctggcgccgtcctgttgaacgacggcgccagccactctggcgccccaaaaaggactattttttgggataagtttttttaggggtctatttacgaaataagtttttcaaaaggaccaaaatgtgaaaaatccagctcaactgaccaccgaatctaaatcgtatccctcaaccgcaacaccagaaatctcgaccccctgaacttataaaaccggtacaatttgctcccttggtggttttggagggcggtttcactgacgtagcgcacacgtggcagtgtttacctgttctttgttccacgtggcattgacgtgacgcttacgtggcattaaaattaaaaaatatatgcgggcccatttgtcattcacacaaaaaagtttttgtcggactcactgacatatgggtcccacatgtcatcctctcttatcccttcttcctcctctctctctccacctttctctatctctccctctttttcttcgtgcgtggggagcggcgtccggatttgcgccgcctctgccgccaccgcagcagtagggattcgggtttggtggtggcggcgctggagaggcatcggtggtgcgttcgccgcgggggatgatggcggctgggctagggccgcgcctcgccatgcagcagcagtcgacagtcttcgtgccgcctccaccgtcgcagcagggttcggcttcaacgggtccgggaatgaagcggcgctggcgccacgggagatggggatggtggcgaggccgcgtcagccgtgcagtagcagccaactctcgcgccgacgccggcaccgccgttgctgcagcaaaatctggagtggcgacggtgtccccttcgccacgggggatgacgatggtggtggcgccgtcgaaggcgtcgcgcggccaagcaagaggagctcaggagggcatggcggctagagatccagagctccgaatcggccatgacgggcggctagaggacgagttgcggcagcagggcggcaacggcagcctgatgtggtcgcagcagcagagacggtaatggctcggtggaaggcgttgccggagaccactcgtcacttcgtgccgccgcctcgaggccaagacgagcccaccgccaccgcaaaaaacgaaggcgacgcgcaaccttgagttgctcccgcgcccgtcacccgaggtccaccgcccaccgccgccaccaccacctgctcgccgccgctgccaccgagcccccgcctgccgccggctcatgtcaaggggggagagagagagagagagagagagagaaataagggagagaggaggaagaagaagggtagcgagagagaagatgacatgtgggacccacatgtcagtgggtcctataatttttttgtgtgaatgacaaatggccccgcatatatattttttattttagtgccacataagcgccacgtcaatgccacgtggaataaagatcaggtcaacactgccacgtgcgcgccacgtcagcaaaaccgccctcgaaaaccactcaaggagtcaaattgcaccggttttgcaagttcggggtgaagatttatggtattacgattgagagatacgatttagattcggtggtcaattgacggagtcaaagtgatcttattccttttttttattggagtaggccagcacaggcccattcgtagacagcctgggccgaagtttttggggccgataggaggagccgcgggtcccacaagtcagtgtcctgttctcggtagaatacaggagcaccgggagcgtcgcggctgtgaccgcgaaaaggaccgtgagtacgtgtctccatgaaccgtaaatcgctctcgctcggaagaaaacacggaggaaagcggcaccggcaacgcgtccgggacaaagggccggcttcggcacccggcactgcagattttgatctattataagtaggtaagcgggtttatcacttttgcctctatcactagttcgctctcatgaataggacgagaaagagatgatagggaaaaaaaacgagaggagaaaaattaacgtgactgtgagaaggagggggagagatggagaagtatacggcgttgaggagtcggaccaggtccgtccaactgtccaagcgagtgcgaccacgattgagactaccggtcgtgactgaccgtggagtcaggttttctcacctgtattgatgaccttctttcatttttcatgtttttccctcaacactcaaaattttctctaatgagttaagttctactagcttcgtactccctataacaaaaaaaataatggtcaaagtacagctttaaaaatcataaaagttaatacgattcatattttatatttttgacacggaataaatatttttatgtcctattgataaaattgaataaccgtgtcttttatatttaaagcccttaacctttaatttctttctattattttatttgttatacatatcatacaattaataataccccgtatctagaatagtgtaccatgtaccatattcgtgtctgtatccgtatgggagtgtccgtataacatagctaaccctcatttgtgttttgtgccaactgtatcacaaaaatcagttccatcatttgttcatgcaacccacatgtaagtacaaacaacgatgtatttggatcgtgggattggattctaaactcttgatgagatataaattaaattatagctagttaatgtatatctataatcaaatttacttttttcgttgtaacttgtagaagttaaatttgatcttgcatgtttatggatttgtttatcacattttaatctatcatgttgatttttttttattttattttataactatttagatgacatgcaaacaacaagatgatatccctcaagagtttagaatagtttctagtttggaccgtccatattttttatggataattgctcatttggctctgttttgaagcataactaccaatcagactctacttattctaatttgctcatttgacccctttttcaaaatcaaagttaccatctaaccctactttctctatgatgttagggcttcattcaagaaaagggaaaaaaaatccatttactagtcaacctgatcaaaatacccttgatgacattcaaccatatccattcattagctcccaaccctatctctctatgttaggtgaggcagtgacgacgcacacgtagagggatggcacagtggtgccagcgtcgccggtgtggagagggagggagcggtggttgcgcatgaagaaagggagcgacgacgaaagctgcacacgaacggagcagcgataacggcgtgccaagagagggagcggtagcgcacgcctcgacaatgatgatgaggagcgatggcagctgggcccgggcgtcagagctaggactagggcgggaggattcagtaggggatgggtggcgaagctcaggctgaggcgggtggatgcgacggggaaggagtgtggagctcgggctgaggcgggtggatccagcggagaaggggcaacgatggctcgatgatgatgaggaagagcaccaaaggcaaggctcaggcggcagagttcgggctgtagcgatgggtaggcgatcaatccggtggcggctgagtatctagctacagatccggcggcaccgagacgtgcggactgcggatatggtggcggcatcgtggcagtggtggaattcagtgggtgtgggttagttgtcggcaacaacgacgatgacgccatggcaaagaggatggtggttgcattgacacgaaccttcttcctctctcccatccacaagctgtatgtattttgggtggatgttatccaaaattttgttaaattttattcatatttttctcaatctaaattaaatatgtcaaacatctatcaaatttaaagtccattttatcaaactaaagtcaaatttaacaaaaacaatttttgacaaaaatatgccaaatttgatgaaaatctgacaaatctaagtcaaacttatcacaaatcagtgaaacctacgctaagtgcattcattcatttgtatcaggggtcaccgatatggccgaaattatttgaatttttgaacaaaattttatcaaatttgaataaatagtaccaaatgagaaccaaaatttctgaaattttgttatggaattttgaaccctgccctcaaccactgatagcaaaatatttttttattagaagcagaattcataaatcaatagttggtcacttgtactaatgataatacaataatagtgtattacgagtagagagtctagagagtagagaccactgtaaaaggatcccggtacagaaggccaataaccattcacattttagagcttgccacagtcatagtccgccattttcagaagctttctcaccagcgctccggccaaccaattgtcacgcagaaagctgatgaccgcattgctgctctcctgcatgaagccgaccgcgtaggctgtcccgatgagctcggcgctcctccaccgccggatcctcgcgtactcacgcagacccgcctcgatcctctcgctctccgcaccgccgccgccgccgccgaggatggcgtcgccgaggcatctcgccagcacgacgccgtcctccagcgccgcgcagccgccctgccccaggtcgggcgtcatcgggtgcagcgcgtcgccggcgacgcacacgttccccttgctgatgctcgccagcagcagcgagagcggcggccggaaacgcagcggcgcggtgagcacgtccttcgcctcgctcctctcgatgatctcgagcacctcggctgggatctccgcgctattcagcttggtcagaacgaacttcttattcttggcgagagcatcatcatctggagcagcaaccaaacatgcgtgcaccggttaattcctggtcaccaatcgattcaccattcgtgacagtgtgtcaatgacagagactaaccgtgctcagaaggagaccaggtgaagaaccagtagacatcagtatcgttgcaggggatcacgccgagacgaaagccatggccgaagaacatcttgaacttgggatcgaagccgtggccgccagggtaacacgcgaggcctctcgtagccaagcgccccgagtaggacggctttgcgagccccagccattttgccaccacggaattgaccccgtcgcaaccgatcactacctgcatccgcgccattaacaattcaagaattctcagttcgcaatctttgggattcactgtgttttttcttcttctacctttgctcggagaattgcgccgtcggctaggtgtaggatcttggcgtcgccgtcctcttcgatttcaacgatcttggaggagtagcggatggtgccttctggtagctcttcctccagtgctcgcagtagccagtcccgcctgacgcagagcatttcgttgggtcctctgcatctaagccaacaatcatgtaagcgttgtctagaatgaacggtgtatataatcagtagagatcagtccgagcatgccatctcaccgtttcccctgctcattgagagacgttgcatgtgccatctctccggtgaacgaagagaagacatgcaacctgtgatgtgaaaaattaaggtctaagatatggagatggaaatttgcctccagagaatacaacctcctttcttgcatttcacgtaacaatttaatatgatatattaatatgtgatatgtcattgtataaacatgcaggttagaattcgatctctaaaaatatttataaataaataaaaatataacttgtacgtgtaaattcacggtcatatttgtctttttacaatatgtaggagctaaatttaaacatacatatttgtgaaatagaaaataaggaatactcaaagaagtttgagaccatctagcagaacacaacacgagattaatttaaaataaaatataataattttaaattagaaaaatataaatatgtgagttcaagtatcaatacaattttgaaataactgtaatccggaataataagaaatagtgaaaacagatcaatattgaacactatacaagactaactaaaatcggaaaaaaaatgaaaacaaaattagaaatttaaaaaaaagttcaactaggaacacgatttataaataacaaaaatttggagtaaaaaataaataatattgaaaaaacattctatctataacacaacagtgacaatgatgataaaagagaacaacatgcgagccgtaaagaggaagagtggtgacggttaatgggaaattaaaaaacaatatctaactaatgattaggttcagtaggggagaggcgacgggaaggtcgtataagagtagtgttgtgctggttgacgggactattagaaagtaaaaaaagaaacctaataataataatcatgtttaatttctaaaatctcaatgacaagaacatcgggcatgccgtgaaggagtctagtgacggcatttgaggggacttccaaaaaaatatgggcttgttcagattgtagccaaaataaaccttaccaagttttggcaatgtcaaaattttggtaaagtggtaatattgctaaaattttatagcaggatttcttatgtattgatcaaatttggcaacaaactaaatataaccattttttttggcaactttaccgaaaaatggtatggttgaaaatagcatcaatagatagacaaagaagtgaaagtcggtggtgggtgtgacttttaaaacatataaaaataaaaaaacaatgatgataagatttattttaaaaatcttaaaacaacgagattattatttagcaaattttaaataaattagataattttaaatgagtgctagccgtgtgtttacgcagactaccagctagttctaatgatatgtaataattttctcgtcaaagatatatcttcatgcagtgttttaaaccaggtgcgttgtacttactcctgaagatgcagatgacacttcctgatcttgtcgcctaccccaagggcgtcaagcgcttgcaacgcattcctccacgtcgcgatggcgaaccccgacgccctgagctccggcgacgactctagcaccgtgcacttcacccctttcctgcatgcggatcaatcaagcaagcaagcagatgatatcagctcagctcaagttaacatgcagctgccaacacggcgacacatacagaaagccaacacattctcagggggctcagggggtgtttgggagagaggggctaaactctcaaaaacataagtccctctggttttgtgagaggggctaaaatataacaccccctcagtttcccacctgtgcagcccgagagccacggcgagtccggcgattccggctcccacgatgacaacggcatcctctccggctctctttcgttgcaatatagttgatgccattctactagctagtagatggtgcaggctaactgggggtcactgttttataaacaaaccaagttcacataggccgtgtctagatgttttggcaaaaaaaaaaaagtttgacgtatacggacacacatttaaagcattaaacgtaaactaataataaaacaaattacagattccgcatataaactgcgagacgaatctattaagcctaactaatccatcattagtaaatatttactgtaacaccacattgtcaaatcatagcgtaattaagcttaaaatattcgtctcatgatttacatgtaaattgtgcaattggtttttttattcatatttaatgctccatacatgtgtccaaacatttgatgtaaaaaaaattaaaagtttgaaggtaaataaagacagtcgtactagtcagcttctgtaggctagctgtagccacaagcttcttacacctcacgtttttttagccgcacctcacgtttttctagccacaaaagtccttattgatccacgtggctacagcctacgggctgcatcaatcaagttcgtactcctcctagtattccctcgaaaataaaccaaactcttacaacaatataacacattctaggacgattagtttattttagaatagacggactctctctccatcccataaaaaaccaatataatactgaatgtaacatatattagtattacgaatttggacatatctctgtttaaatttgttgtactgaatatgtcacatttaattttagactcggtttttatgggatagaggaagtaggtgcttaggccctcgagtctgtgattaatgggcaaatcatactcactccatccaaaaaaaaggcaaaccgtggattcccgtgctaacgtttgactgtctgtcttatatgaaatttttttataattagtattttcattgttgttagatgataaaatatgattaatactttatgcgtgacttatctttttaatttttttcataattttttcaaataagatgaacggtcaaatattggacacggaaacaagggtttgtctttttttaaggcggagggagtatgccatacctagcttgacaattgatacccctgacactgattgaagcattgtgtggctgctgtactctagaaaattgatattttgccattatcgaaacggttcgctggagtgccacttacaaaagtggtctcgttaaaatgccacctttgaacagggataacatgttgcaatgccatttcatccatttcttcttagtttaatgatttttgtaatattttttcttgctgagatgaccaaaataccttgatcctatctcatgtctcctccatctcttcctactctccgttgcagatggtgggcggcttggtggtgcggctggggatggggacggcggccccccccctggggactgggacggggacgaccccgacgtgggtgtggaaggctgcttggctcggcggcgctgctggggacggcgtacctacgccgcgcgggcgcggctgccgcccatggaccccgcgctcaacaccgacactaactgcatccggggatgcgtctcccaggtctgggtccacgccgcgccgaaggagggcgcgccggacagggtcagcttccaggccgactctgacgcgcagctcaccaagggcctcgccgcgctgttcgtgctcggcctcttcgacgcgccggcgcgggatgtcgccatggtgcccgtcgagttcatcgagttgcttgggatcaggcagagcctctcgccgtctaggaacagcggcctgctcaacatgattagcctcatgaagcacaaggtgctggagatcaccatcggtgaggtaaccactgaggaaattggtcgccaagatgtggtccaagaggttgccgaaccgcctgctgctgtcaccgtccccatgcccagccgagccgccgccgccatccccgtccccagccgcgccggcgccacccaccattggcaatggagaggagtaagagatatatagggagagatgagataggatccaatgctattttggtcactcagcaataaaaaaacattaaaaaatcattaatttgagaagaaatggatgaaatgacattgtaatatgttgctcctgtttgagggtggttttttaacgaaaccacttttgaaagtggcattccagcgaaatccagtttttgaccatggtaaaatatcaattttctcgctgtactcgctgtcccctgctgtaaggtctcaaatgacgcttcctagaatttcccatgttctctccgtctcaacgtgtggaattgaagtactagtataacggaattgagatattacggctgcctcgaaccacaaagcatctaggagtatatgttaagacagagagaacacatgaatatattttagacggagataacgcatgataaagtagaggagagaacacgataaagatatgacaaagatgtcctttatcttcttatttatttgttctcgtaattaatgaactttctgagtctcttttagatgcaggcaatcaggttatattaaagggataacgacgacaggaggtacaattcttcattctctgatgtatgcaaataacctaatcactgtgggtcaggcaaatgatggagaagctactagaatttttcaaactgttcaaacttgttgtgctcaatctgttcaaactcctaactgggggaattttctattttctttagctcaagcactcctaatcaacaaaaacatcaaattctcaatatttttcatgtccctctgatagaaaattccactaaacatcttggtcaccctttgattattaacacaagaactagagcttctgcttataagtttattatttccaaattcaaagctcgtcttacctctcttaaagctaacatgctctctcatgctagccacttgtctttaattaaatatgttttcgcttcaatccctatttactgtatgtccacgattttacattctaagagcttattgaacaagttgacagctattattagcgcggttttggtggacaagagtgcataatgaaggctctaagaaaggtatttcctggcggtcttggaatgatttttgcaaatgcatctcctaatactatttctcagctttgggatgacaggacatgttgggaactgagcaaactcaatcaaatatttgatcagccaatggtacaacatataatgaaagttcagatcgttcctcgggacaatgaagacaaaatttgctggattcataattcttcaggtgaatgtacttcaaagagtgcatacaagcaggtatataatctatcacattcagttttcacaattgttacttctttgcagcttaatattcttttgaaaatctgttccactaagtgcattcctcctaaatttaaaacttttatttggagacttaatagaaaggctcttccaactgttgccaatcttcacttaaaattctgtgacattcctgatatttgctcttgtttcaattcttcagaaaatgaggttcatcttttttttcactgttcttttgctagagtcacttggcatatttcagaaatcacttttgttaatcgcatcactgatttaatgtataatgtctctgatattttagcttacttgcttgtcacaaacaaatctgagaacatcctacaaaaaacttgtgtcatgcttaggtttatttggatagctaggaatgactttttttttttgccgggacggcaagaacaccggccgtagtatattaagaaagaatgaccagtattttaagaataaaaaaaagaccgcaaaaaaaagagttttatttgtatcctcaagattcagaacagtagttacttgacataacacttaggccttagctacattacagacctgcaaaggctcccattccttttggaactcttccaattaaagatgatattgctgctgcctctatcaaattgttgccaggaactagatgttatgtagatgcttcttggaaagataatctgtttgggtttggtatctttattcatgactctctaaatcatcaagctatttttgttcaagcaaaatcagatctttatgtgtcccttattcgggcagaactagcagctttttaagttagctattttcatttgtgttaaacttcacattgcaaatccagtttttctttcagataatcaacagttggtgtttcttctccagcaatcaaattacataaatcaaaatcatcattggagccttttaccgctgcttgcaataaagctgcgttaattttcaggtggtgcttcaatcaatactacatggattccaagagaaatgaacaaaatgattgattacttatctaggaaaaggccagagaatcaagggttgttttgcctatagcaagctgtcaaaaatattaatcatgtttgtaatagcaaatactagttccaccaaacaaatcctgctttttgcctcttgagcagctgaaaatgttgttagagtgcgcagcccggcccaccaaccgtgggccacccaggtcacattgggtctgctccaccacagacccaaccgaagccataactttaggtcctaggattacacaacccaaaagactagtctgatggggtgaggaccgccccaccttttaagtgggactaaacccagcaatctccctcgtcacacatcgggcccaacaatctccccgtcacattaacccatgtgacctcgaagacttgttacctggcctcaggcccaacaatctccctcgtcacattaaccccatgtgaccccgaaaacttgttacccgggctctccaccatgtgacccatggaaattgttccgggttccaaaccggagctagtcttttgggttgtgtaggctcaggacctaaagttgtggctccggttgggcctgtattggagcaggcccaatgtgatctgggtggcacatggtcggtggcccaggctgcgtactctaacaaatgtatcccttgtgcacgtgttgtgcttttaatgtttgatgtaacaagttctaaaagaaagaacatgataaagtacagggagaaggaatgagagataataaattattccttacacttcctccgtcccaaaatataatagattttatatggatgagacatatcttagtactataatttaaacaagtccagattcatagtactagaatgtgtttcctcatttcaaaatcccttatacgttgggacaaagggagtataagaggcactaggttcggcaatagcaaaaaaaagagaaaagttttctgttttttcgtgcgcacttttccaaactactaaataatgcattttttaaaaaatctagatgcgtgacccacacaattgtgtggctagcatctatacaaaattatctatttttaaaataattttacataaagtttattaattagatatctcgttgtcttaagattttgagaaaccaaaccttatctccccgaattaaatttgaaaatgtactattcatttgttttttctctcagaaatattcgggatgcaatttttttacacaaatatactatcgatctcgcagaaccattaagtgaaaaatgacgtgggtgtgacgacacagatagtgtcgtgcggtgacattgcgagaccgagctgtctcgcatatggaaatagcgagaccgacgtccatgtcgaacggctccaatttaatttgtgattaattacccaattaatgactaactaataataattagtgattaattattttaattagcaattaattaataaattgctaatcaggataattaattaatttgaagcggccaacctgttcggtctcgctcgctggtaatgcgagatcgagcggtcttgcaccgtcactgcgtgacacagcgcgatctcgcgccgtccgtgccgtcatgcccatattattttcaaccaacggttatacgagataacggtatatttctatcaaataaattgcataaggaatatttttgagggaaaaaaaaggttaatgaatagtatattttcaaagttagttcttaaccttcctgtgtttctaattttatagtttttaaaaatcgtacctattgctacccttactcctatcgctcccttcgttatttgctcgatctaccattgtttttatttatttttatggaacctttaaaaattaaatcttatagtttttaaggtttattatctcattagtttttatttttataatttttataagtcccgtcaaacaacgatacctttgtatactcctctaatgataatacaataatagtgtattgcgagtagagagtatagagaccactgtaaaaggttcccagtgcataaggccaataaccattcacattttagagcttgccacagtaatagtccgccattttcagaagctttctcaccagcgctctggccaaccaattgtcacgcagaaagctgatgaccgcattgctgctctcctgcatgaagccaaccacgtaggctgtcccgatgagctcggcgctcctccaccgccggatcctcgcgtactcacgcagacccgcctcgatcctctcgctctccgcaccgccgccgccgccgccgaggatggcgtcgccgaggcatctcgccagcacgacgccgtcctccagcgccgcgcagccgccctgccccaggtcgggcgtcatcgggtgcagcgcgtcgccggcgacgcacacgttccccttgcggatgctcgccagcagcagcgagagcggcggccggaaacgcagcggcgcggtgagcacgtgcttcgcgtcgctcctctcgatgacctccatcacctcggctgggatctcggcgctcctcagcttggtcagcacgaactgcttcttcttggctagagcatcgtcatctagagcagcaacgcaccgatcaattgctgatcactaatcgattcactgttcgtgacactgtgtcaatgacagagactaaccgtgctcagaaggagaccaggtgaagaaccagtagacatcagtatcgttgcaggggatcacgccgatgttgattaatttcagctgtggcccaatgcaagccgattctctcggagctgaacgggaggatgaattagtctagcaggagtttgttagagatgcaaataagtcgcaaatcagttaatcgtgaccgagtctagcgctggcagtggcgcgggtgtgtgcatggagttcagagaaaagcggatcgtgggatggcgcgattttgcctcggattcctattttttttgcgttgagtataagtagttctcttagctctttattctttttgtaaggtttacattcagttgaatgagaaaaacccagaaaaaaattgccccatacattctcgcaagaattctttctctgaaacttctcctctgctctgtttgctgctctgttcgttgttgccgctgcagttcttgccgtgccgggcgtgaacagtctgccagcaaggtgtttgatcggagtttttttgctattgccaacaagtggtatcagagcactcaggttgagggctgatctgacaccatggcgttggttccggcgggagcgggagcggatccggcgagggggagctcggggagtgctttctcctacccacaactcacggcaacgaactacaccagctggtgcattcgggttcaggcgatgatggaggaccagggtgtctgggacgccatcgagccggcggccggggtggccgtcgacccaagaagggacaagaaggcgaggtcccatctgttgcagtcccagccggaggacttgctgatgcaggtggcgaagaagagatcggcgaaggaagtgtgggattgcttgaagacaaggttcgtgggcgcggaccgcgttcgcgaagcgcgcttgcagacgttgaagggtgaatttggtgccatggtgatggagccaggggaaactctggatcagtacgcgggccgcatcaccgcgatgagcgtgcgtcactcggcgttgggctcgacgctgggtgattccgcgatggtgaagaagctgttcgacacggtgccggaaaaattcgtcagcctcgtcgcaggtattgagcaattttatgacattgatactatgccatttgaggaggcagtgggtcgactgaaggcctacgaggagcgcatgcggaagaagaaggctgccgccggcggggtcaccaccgacgggcaggtgctcctcactcaagcggagtgggaagctcacttcaagaagaacggcggggaatcctcgccaccacagaagaacaaaccttcaggtgaaggtgctgggcgcggccagggcggtcgcggtcgcggcagaggccgtggcgcaggcggacgcggcgggacgccgcggggcgactcaggtgcaggctctggcggcggtggccgtgacaagagtcacatcaagtgcttcaattgcgaggagtacgggcactactctaaccaatgcccacatccgaagaagaagaagggagaagcacatcttgcacagacggaggacgccgggcctgccctgttgcttgcggtgacggaggatgtgccagagcgcgcgtcgtgcggcttggtcgtacgcgagcagcgcgtgtggcccaagctgctgctggcagacgctggtggacatgctggcgatgtctggttcctggacaacggggccagcaaccacatgaccggcgatcgaagcaaattccgggagctggacgagtcgatcaccggacgggtgaagttcggcgacgcttccacagtgcagatcaaggggaaggggtcgattcttttttcatgcaagaacgatgatcaatggctgctacaggacgtctactacatccccagtctgcaatgtaacatggtgagtttgggccaactaacagagaccgggcatcgcgtggtcatggatgaggatgtactcgaagtgttcgacaaaagtccatggcggctggtgatgaaggtgaggcgcactgtaaatcgtctttaccgaattgagttgaagctggcgcatcccgtgtccctgctgtccagcctcgacgacccggcttggctgtggcatgcgcggctgggacacgtaaattttcaagcaatgaaactgctggtggacaaggagatggcgggggtgttccggcaatcgtccacccgaatcagctgtgccaatcttgcctggtggcgaaacaggccagggcgccgttcccggcggcggcgcacttcagggcggaggagccgctcgagctgctgcacatagatctgtgcggcccgattacaccgaatacgatgtctggtaatcgctatttttttcttatagttgatgattattcccggtggatatgggtgttcgtactcaagacgaaggatcaatcgctcgatgctttcgtaaagttcaagccactggccgagaacacggctgggcggcgcgtgaagacgttgcggtcagaccggggtggtgaattcctgtcaggcgagtttgcacaggtgtgcgaggaggcggggattcaacgtcacctgacagcgccgtactcgccccagcaaaacggggtggtggagaggcgcaaccgcacggtgatggccatggcacgctcactactgaaggggatgcgcgtaccgggcaggttttggggggaggcggtgcgtcacgcggtgcatctccttaaccggctcccgacgaaggcaatgggtgatcgtactccgttcgaggcatggacggggaggaagccacagctgggacatctcaaggtgttcggctgcacggcacacgcgaaaaacacgcagccgcacctcaagaagctggacgacaggagtgcaccgtacgtgtatctcggtgtggaggaagggagcaaggctcatcgtctgttcgatccgcgtcgtgggcgcatacatgtaagtcgtgacgttgtatttgaggaaaatgtaccttgggagtggacatcagctgcaggacaggagccaacggatttcgcgatggaggaggagcctggtgagcagctgccgagcccggcaacagcggccggcgtggtaccgccgtaccaggcaccgtctcctggcaggcgcgccgggaaggaagcagtggtggcggcagaagaagtaccgtcaccggcaagcccggtggcagcatcaccgactctgcctggaacgcccacgcccggttctccatcgacaaactctgccggggtggtgccgtcaccgggcacagatgacaacatcgatacagatgatgggcctaggcggtatagatcgctggcagatgtcctgcgtgaggccccgcgtgtggatttggtggaggacgaatgtgatggagaggcgctcctagctgagtcagaagagccatcaagctatcgagaagctgccggccaacctgcgtgggaagaagcaatgcagagggagatggaggcaatcgagaagaacaaaacgtgggagttggccatgttgccagccgggcaccgagcgattgggctgaaatgggtgtataagctcaagaagaacacggcaggggagataatcaagcacaaggcacggttggttgcaaaaggatatgtgcagaaacaaggggtcgattttgaagaggtgtttgctccggtagcgaggcttgataccgttcgtgttgtgcttgcagtggcggctgatcgccgctggcaggttcatcatcttgatgtcaaatcggcattccttaatggtgaacttgaagaagaggtgtatgttgcacaaccggaagggtttgctagatcaggaaaagagcatcttgtgctcaagctgcataaggcattgtatggactccggcaggcaccgcgagcctggaatatacgcctggacagaagcttgagggagctcggctttgatcggtgtacgcaggagcaggcagtatacacccgaggcagaggaagtgatggcataattgtcggcgtttacgttgatgatctcattgtcaccggagaaaatccctctgaattgaaggttttcaaggaacaaatgatgggggagtttgagatgagtgatctcggtttgctcacatattatctcgggatagaggttgatcaggatgagagtgctaccacattgaaacagactgcatatgccaagaaattactgtctcagtttgggatgatggagtgcaactcagtttcaattccaatcgatccgagatcgcagctgagcaaggatccagaaggtcacccggtggatgcaactgagtatcggcggatcatcggtagtcttcggtatttgcttcacacgaggccggatctgtcatatgctgtcggggtggcaagcaggttcatggagaggccaaccgtgatgcatttcaaggctgtgaagcaaattctcagatacatcaagggaacgatggattatggtctcgtgtatgctgcaggcactggggcactgaagattacagggtatactgacagtgacctcgccggggacttggatgatcggcgcagcactggtggaatggcgttctacatcaatcagagtctggtggcgtggagctcgcaaaagcagaaaactgtggcactatcgtcgtgtgaagccgagttcatggcagccacgacggcggcctgtcaagcgctctggttaagattgttgctagcagaagtggcgggagtggaggagaaagcagtgaagctcttcgtcgacaataggtcagcaattgcattgatgaagaacccggtgtttcatgggagaagtaagcatattgacacccgttatcacttcatacgggagtgtgtggatggcgggcaaattgttgtggagttcgtccggactgaggagcagcgagcggatgcactgacgaaaggattgccggcggcgaagctggtgacggcgagacaccttcttggtgttcgttcactagggtcacggcagaattaagggggagattgttgattaatttcagctgtggcccaatgcaagccgattctctcggagctgaacgggaggatgaattagtctagcaggagtttgttagagatgcaaataagtcgcgaatcagttaatcgtgaccgagtctagcgctggcagtggcgcgggtgtgtgcatggagttcagagaaaagcggatcgtgggatggcgcgattttgcctcggattcctatttttttttgcgttgagtataagtagttctcttagctctttattctttttgtaaggtttacattcagttgaatgagaaaaacccagaaaaaattgccccataaattctcgcaagaattctttctctgaaacttctcctctgctctgtttgctgctctgttcgttgttgccgctgcagttcttgccgtgccgggcgtgaacagtctgccagcaaggtgtttgatcggaatttttttgctattgccaacagccgagacgaaagccatggccgaagaacatcttgaacttgggatcgaagccgtggccgccagggtaacacgcgaggcctctcgtagccaagcgccccgagtaggacggctttgggagccccagccatttcgccaccacggaattcaccccgtcgcagccgatcagcacctgcatgcgtccccgccattaacaattcaagcatcccgggtaatacttttaatctccaagatagatatatataagctgtaacaaaaataacaaatcaaactctcattagtatacatatattcacagttaaatttgttgtttttgttacttccttcgtttcacaatgtaagtcattctagcattttccacattcatattaatgttaatgaatctagacagatatatatgtctagattcattgacatcaatatgaatgtgagaaatgctagaatgacttacattatgaaacggagggagtagaacttataaaagttgaattttaacttgcatttttgtggatatatcatctatcttgtaaattttttttaatttttttcatgatcattcagttgacatgcactaaacgagtggacatccgctcgagtgattagaatccatcttatcccccgttcatataatcttttggattcactgtgaaacacttttagcaacttaggtagatatccatccatttattgcatgtcaactaaatagttataaataataattaaaacaacttgataatattaaaatatatcactctactaacagacaagttcaaaatcaacttttacaagttataacaaaaataacaaatgaaactctacatagtgtacgtatatttcacagtaaaattgctacatcttataaaagttgaatttaaaattaaatatgtttatgaactgatatattacatatcaatctatttatcagtttttctaaaaaaaattataattattttgttgatatgcaataaacgagtagacattcaccgagtgattagaatccatctaccgatgtacggattcactctgttctttttctacctttgctctgagaattgcgccgtcggctaggtgtaggatcttggcgtcgccgtcctcttcgatttcaacgattttggaggagtagcgtattgtgccattgggtagctcttcctcaagtgctcgcagtagccagtcccgcctgacgcagagcatttcgttgggtcctctgcatccaagccaaatcggcgtgtaagcacggcctggagtgtgtagtagagatcagtctgagcatgccatctcaccgtttcccctgcacattgagagacgttgtatgtgacatctctcccgtggacgaagagaagacctgcaacctgtgtgatgtgaacgattcagatcaaaacatagagatggaattttgctctaggaaatgtccacttgtttcttgcatttatatttttttcaaaaaataattaatatacagtatatcactcaaaaagtacaaaattaaattaactactacaatttctcaattaagaattaactactaacaaattaaaatgtacataatattcatatattcacgtacggccgtatattcttttttttttgcaacttgtagagctcgaattagacatacatggtaataaagtatacacatgaatttattttgtttcatctaaaaataaattatgcatgtttgagtgacatgcaaaaacgaaataacaaaggtgtatctcctgcagtgtttaggtctttgttaagtcttgtgcgacttcgtccactcattaaggcgcgcacgttttttaatatttaactctttaaatgcgcacgttttttaatatttaactctttaaatatttgaccaataaactataaattaaattttattcgatgaaaataatattattggattgttatttaaatttactttcatataattataattttattgcgacaaacattataatatatgagaaatttaaagttacaaattagttttaaaaattgcgccaagtttaaccgcactttagtgagtggacgaagaaagtacactagtacttactcctgaagatgaagatgacacttcctgatcttgtcacccaccccaagggcgtcaagcgcttgcaacgcattcctccacgtcgcgatggcgaaccccgacgcccggagctccggcgacgactccagcacccggcacttcacccctttcctgcatgcggattaatcaagcaagcaagcagatgataccatctcagctcaagttaacctgcagctgtgccaacacagagagcagtctatatccagttatccggcaaacgcatcgctcgccgcgccgcgcgctaatagctaagctcccacctgtgcagcccgagagccacggcgagcccggcgattccggctcccacgacgacgacgacgacgtcctcctcgccagcttccttttgttgcaacacggttggtgccatccttgtgtttggatttaagccaatatcatgcagtagtcagcttctttagccacaggccctcttattacttattaggagacacctcacgttttttttcagctttcttagccacaaaattctctattgatcctcgtggctgcaggctgcatcatgaatagcctatctcgcacgtgtttggatcctggagtcctgctgtctgcgagagtgatggcctctagccgtagcttgtgtggctgctgtactccggtgagtgttgacatgtttcccttaccacctataactgcacggttaccgcggggtatggtaaggttatcaatagtagggtttttgagcaaattcaaaaattctaaaaaaatagaaaaaaatcatggatgtagttcttgatttttaatggtagatggtgaagaattttttttttgaaaaagagtaagataaaatcaaatttgagggcaaaaccaataattgtttaggaaatggaaaaaagaaaaaacatgtattggccttaatttttgcattttacatccaagctaggttttcaggtatcctatatattattataattatccttaatttctacacacatttaagtgtttttaaatttttttagcatttttttcataattttatgttttctacaaatatcgcggttaccgctcaaaccacgcagtaaccgcgaaactgctaattttttaatttaaattttttgaagacgaaattcagacagttttcaacggttacagcgcggttatcatgataaccgtcttaccggggtgggggcggtaacctctccccttaattttatgttttcataatttttttcataataaatgataagtgcaaataatcacacgatgaagtagagaagataaatgggagagagaatatgctgtatctcatgtaagaggtaatctataggagcaaccttttccaagagccatgacccactaataggcatatatagcgtgccttgacgactgaaattattgctaatgaaaaaaaattgaaaatattgttcaccatttttttctcgaaaatataacactgttgaatttttcacaagattagatcgtcgtagcaagaacggcatgcaaacacgtaacgagtttgtctacccaccatcagatttggagcacaatgcgcgtggatccagctcctctgaccttggatggaaaaggcagagaataagggcccgtttagttcataattttttttttccaaaaacatcacatcaaatctttggacacatacatgaagcattaaatatagataaaaagaaaaactaattgcatagttatggggaaaatcgcgatatgaatgttttaagcctaattagtccgtgattagccataagtgatacagtaatctacatgtgctaatgacgacttaattagtctcaaaagattcgtctcgcggtttccaggcgagttctgaaattagttttttcattcgtgtctgaaaaccctttccgatatccggtcaaacgtccgatgtgacacccaaaaatttccttttccctaactaaacacaccctaacagtaaaatgtgtctgtgctacatcagaaacagtaatacgtagtgtttcactgtagcaacagcactctagctctctaactttacccatgtaaagtcagaggatccaaatccaatgcgcgtgtgggcgggaagctaagtaagtttattgggccacgatatctcatgtaccttcagcgcgaactcggccgtgtgagaccacaagcatgcatcatgcctgcacgaactcagggcctcattggatggatgtttgggctgaggcttttcagccaaaacccattgaattgcttattgggctgatgagtaccagccacagaaaatcttcatcaagttaaataagccaatcaaaccaatcaatggtttttctttagcttaaaggaaaaaagccaactttggcagtcaaagctatttgcttaccgatgagggcttcgtacagtgagtacaaccccatgaaggtgaggacgacgtcaacttcacgagttcacatttgctttgatcactttgttattaaggccgtgtttagttctatttttttttaaacttccaacttttccatcacatcaaaacttttctacacaaaaactttcaacttttctgtcacatcgtttcaattttaactaaacttttaattttagtgtgaactaaacacagtctaagagagaatggtggtattttaacttgtaagaaagtttcacttatgttcataaaattacaaagtgtgtattgaggttcgtaaacttgttttatcgtattattctagtccaaaacaacttggtttatcgtatcattcttgtccaaaaccttgtttgacctacttagcatgctacgtggataatgacatggcacttttttttttccctttttttctcccctctccctcagggaattttttttatttatacttttttttattaaaatatttacaaaaataatttgttgtttcgaaaatttacaaatctaatcgcctgccgccctttgagagggcgatttttaaaaatcgcccttccacagggcggcaagggacctaaatgtaaattttccagcataacttgttagctctataattttacaatttaaaattatattatataaagtcagatgaaataaaactttatatcaaaattgtagagctcaaggagatctacaactttgtagttaataactttttcatttaagatgttttagatatccaaatattcgttacaaaatataaaacacattttaaaaaatctcagatctacatttcaaacgacattagatggagataaactttatataaagttgtagatcttgatgagatctataactttgtagtttatcacttttccatttaaaatcatttggagtatcgaataagcattattagtttttaagcaattaaaaccggtgggaagggtttgaacacaaataaaaattttgtatttaggtcccttgccgccctttgagagggcgatttttaaatatcgcccttcttaagggcggcataagggcggcatgcaattagatttgtaaattttcgaaacaaaaaattatttttgtaaatattttaataaaaaaatgtataaataaaaaaaattcctccctcaggagtccggaccggtttgctgcccgccgccggcatgtgggccatatttccttttccatggtagtaggccagtacaggcccattcctaggcagtcccggcccgcaaatttatcggcccaatatgaggggtgtcgggtcctacaagtcagtctccttgctcgttctagcgtgttcggtgttcctcgatagaaaagaggactgggggtttagctgcgcgctctctccctcccccaattttctctttcctcatctagggtttccgcgtcgccgcggccgcgagtcgccatggatttcgacgagtacgactacttggagaagacggtggagggctccggggcgccgtccaacggcgccgccgcgcccagatccgaggagaaggagcgaagctctcgccgccggagcggcggcggcggcggcggcgacgaagagcgcgacgatggcgagcgcagatccaagcgctctcgctcggaggagaaccgcgaccgcgacaaggacaaggaccgggaccggcaccgcgaccgcgacaaggaccgggaccggcaccgcagcagccgggagcgtcgcgaccgcgaccgcgaccgagaccgggacgagaaggatagggagaaggagagggacaaggacaaggagaggagaagccgggaccgcgagaaggagaaggagaaggagaaggagagggagagggagagggagaaggatagagagcggaggagccggagccggtccgagcgccgccgcgacgacgaagaacgtgaccgcgaacgctaccgcgagcgagactaccgtgaccgcgatgtcaggtgccgattcatgaccttacccacctgtattggtgccgctgtgttatgaactgagtggtcttaacggacttgccgattgcttgattccaaaaagctgccatccataatctcgttttcaccacgtttgatgcgcttaggcatcgttgtctccaacaaaatcaattttatttttctacacttggtcatgatatattgtaatattcgcggaggattgcatgggatggggatagcaacatagtttgagtgtaatgagtatattattatggggtgcattgggacttttcttcttatttgtacaaatgcagcatcaatttgtaaattgcgtgtaatagttctgctttcatcgtttagcataatttatagcagatgatttgataactcttctatcagagtattcctattgcttcctataattctactgctattaacagttttttgtattatatacctcgacttcttgtaaattcctacaatttgaacattagtatgggtacctgcagattcaatttgctagagccatcttctgtggtcttgatgttgagcctgacctaggatatcaggtgatttttttttaatactactattattagataggagttagtgttctatgttagggttactatgatagggaaattcaagatggatgatacaatttatgcttttgagtggtggtctgagagcaatgatggtgccatccacgcataaagttttgttgcatccagaacatggagctgaactgtacttcttgtgttgcagaaatgctggtgagcggtgttttgggcttcttcactgaagcattgtgtcttattgttaaggggactcagtattcggcccgctgcacaaacaacccttattgctttttacccttttcaggagatgtcaactttgagttgtcagagttaagagttgtgcgaaacctggttagatgatggttcagagcccactcaccgttctaaaccgcatgcatccatgcagaaggggggggggggggagcagctgcatgcatgcatgtgcaacactgggtcaaatggtttagtaaaaccgtttttgttcacccccaatcatggtgatgcatgtctatgccttacaacaaagggctttttacactacattttttgcttatctccaaggcatgtcttgttacgatgtgacttgatagaatgttgatgggccacatattctaatgaaatgtctaactcgattagtcagttatgatctataatgatggctgaactatgctcagtgaacgttgaaagttattcttcctggacccctagatctgacacattcatttcttcaattattattattggataacttgttgggtagttaagcgttgtgatcttaacaaatcttgttatttaggtgagaccgttagaggtagggagagaggattgagtggtgatataaatttatattagtatggatggacactaacatgtagggaatgattgatattgagaaactgaggtagtattctttttatgaggaactccattactgttggagctgatgattaatgtgggcttgtattatatatatatttttctatattttcgtatcaatgcttatgacagttttgcttattgtctgtgcagacgtaggaaagaagaggctggagagcctgaagcagatccagaacgagatcaaaggacagtatttgcctaccaggtgcattttagtgtaacatttgaatttcactttgtgaccaggaaaatgctgaagccttttctatttgaaactaatgtttgtgagcataatcacagttatctctgaaggcggatgaaagagacgtgtacgaattcttttcaagggctgggaaggtgatcctcactttgaatttgcttgtatcctctttagtagtaaaatattttatgattagcagatgaacatttacggcctataattgtggtttggtgggaaaaaaagttcttctgatggttgctgcgcatttgttcagtctcttgtcattgcatcaaatcaataactgtgctgacattgattactttttgtaggtccgggatgttcgcctcatcatggaccgaaactcgcgccgttctaaaggagttgggtgagtttttatagtgaattctgtgcaacatatcagatcgttgttttatttgttacctgttttttttccttgagttgctaaaagaggggttttattttcttagtggcttggaatatctagcagtttgcttataatagccaaatatatctattgtttacacatttgatgggagggaggcagggtgttacttgtgtttcctgttttagaatctccaaaagatctgattagactttggtgttctactgattgttaccttggtcgtttggtgcctcccatggattcataacctgagatctagagagggagggtggggcttgattttaggttttacagtatcggaatgaactcgttagtttgtgctcataatgcttctggttttgtgtccaagtggcaatattgacttactgagaatgagggagatggacccactgttttggggttttagtctgtgttgctaagccatttgtttgtagcaagcaaatagcaaatgcctcctagctttctgtaaagctgctccagttttgtgctcatgtggcaaatattgtgatttaggttgttggattcaatgttaggcatgtttgcacgtgagtgtaggtgtgctgtaaggtccattgttggtgggcaacaagggaaggagatgaactgaatcagaaggtatgaaccagagtggagtagatgtctcacaagaggctgcaaagagatcaaatgtgtgagaattgttttttgggtggggggtgattggtagggtatttcaaatgttaatgaataccgaccatatttgtcaatatttttctggttgctgttatgattacacaagcatttttaaactgtagctacatctacgatttattatgggggaatatattcaccgatttttcatactcggcaggaatgtttataatttggtgtatctactgggataatcagctacttatgactaagatggaatacaagatctttttgggggaagtaagcagcgtggaacatcaaacatagcaattccacattattggatgccatttctgcgcattttcatatgattttggttggaggaatgtgcaattagtttgtgctgggaaaaattaattctaaacctgtttgaaaatgtttgatatgcaagattttatgtgaataactgaatatcttttcaaaagattgaacgaatgcggcctaattctatcggcgacatgatatcctgatatttattatgcttttgcgtttccaggtacatcgaattctatgatgttatgtctgtaccaatggcaatagctctttctggccagctgcttcttggtcaacaggtgatggttaagccatcagaggctgaaaagaatttagttcagtcaaatgcttcttcaagtggagcagcttcaggtggggcaagaaagttgtatgttggaaatcttcactcaaatattactgaagatcaattgagacaggtgatgccgacaaattgttttttagatgagttggctgtgcttttggaagaaaatttcccttggagttcataatggaaaacatattacttttatggggtagaagaattactatggcatccttgttatgcatatatagagtttaatgaattctctttaccaggtcttcgaaccgtttggtcaggtggagcttgtccaattgccactagatccacttactgggttatgtaaaggttttggttttgttcaggcaagtgtttgcttattaagcaattcttttgtttttgtggagagttctgtgtggctgacttctgtttcatcatgtagtttgcacgccttgaagatgcaaaggctgctcagagtttaaatgggcaacttgatatagctggacgtgtgattaaggcaagtgttttcttcagatttactagaatacatgttgttttcaagctatacatctcaaatataagggttctgcctgacactatgctaaactgctgtaaccaggtttctgctgtgacagaccaagcaggagttcaagtcagtggagtaactactggagatttggatgatgatgaaggtggaggtttggtgggtgccatttctggagacacatcgagaactggaaattcacttatcatatttgatatatatatcctcattttcttttaagtacaattacttgggacatagcatgcttttgcttgcacctcgcctcaatctttttagagaagattttactccctccatcccaaattgatcaccatatatgcatatgcaccaaaaccaatgataatttaattcacatcaatcaagacatcatgcacacattctcccacagcgcatgcattgattaaaacaccatgccaattacacccttagcatgcacacattctcccttgctgcattaattgtattccgatgaaatccatgttcatgtggttatatgatgatcaatttgggaaattttgaatttcattatatgatgatcaatttgggaaggagggagtaatgtgcaagaactttaccatatgatggtttagtatacactgagcactctgcatacctagcatatctactatagcaagcctttattgcatggtcatttgttcattcttagttggttaatgtttgaggctgtttttaaatgccacatacttatgcatattgcaacagtatctcaattgtgtctgtgatgactttgctgaatgctgatgtatgcaggcactgaatgctagttcaagagctcttttgatgcagaaattagaccgtagcggcgttaccaccaggtatatatatgtgagcttaatgggttaaactatctttttggtgccctcgtggccatgtcaatctaactacatcagtcatattcaatcttacatataacctttgtcccataaatactccctctgttttttaatagatgacaccgttgacttttggcatgatgtttggccatgttgaaaaaaattatataaaaatgtcatttattttgttgtgacatgttttatcattaaagaaatctttaagtatgacttataggcatatttacactaattataccaaaagtcaacagggtcatctattaaaacagaggtagtataaataggaagaaaaaaaagaccatgatacccctctttaaatgtggtatggacgggaggttggttaggggttagctcgtttgatggcacaagtagtactatagaatcccttatattttgggatggaggtagtagcttgtttaatagtgtgttgctcagtcaaccaggtaatttctgtaatttgttgatggtactgcagagccttaagttcatatttagaatactgggatgtcaaatgtccagaacgtcaattatcttgcttgttagagttgctgtcatttgtatcaaaatcattcgttattgacctttactatattatcgtcaggattcatccaccactacatcaacactgtttccatatgtatatagcttgtcaaggtcattctccaaggacctcttccaattctttggtgtacatcgctattgttaatattttgtttactccatttctaacatcaaatgtcaatcgcattgactactacaaatttcaagagagtgaaccatgattgagaaatgccgagaacatgccacagtaccttattattcttatggtatcatcaagttatcgtgacaagacatgttagccataaccttttaatttttcactgcatttccaattcaaaaaatgtgcgtggcatatattaactacaaatagttggtactggtttgaacacttggccttcctctgaattttttaccttccttttgtctgtctgcagtttgactgctgggatagccggtactggtttgaacacttctgttggattaccacctgcatcagttcttggtgctcctccagtcgctgcatctgtactgcctacagtgcctggtcttggttcagttcctggggtgtctcttccaattactacccaagccattgagacagccccacccagtgaatgcctattgcttaaaaatatgtttgatccatccgtggaggtttgttcttactactgcattctttttttttttgggttcaccaacagtccataccttttttaaaaaaaatctttactggtctgtatcctttctgtttggttgattaaaaactaattgaaacttactttattgcagacggaccctgattttgatttggatatcaaagatgatgtccaagaagaatgctccaagtttggccaagtaaaacacatttttgtggacaagtaagtttgttcaacactaattaccagtcaacaaatctgtaacagcttgcatacggcattattgtaaccatctacagcttcccagtacataagtcccaacacaatctagtaatctagtaaaatatagtattcaatagttaccagcatgtacttgtagagtgttaggggaataattctctattctctgctaacatatccaaaggctctgtttactgtgcttttatctttcaattttcttgtgtactgcaacttcagaaaggtgcagtgtacttttgctcctcgtactgcagtgcaattattgccgtgtgcaaacctgatttaccttgaaaagcctgccaattttacaaggatagcctaaggccatgtacaacgtgtgaccctggcctgtggtctcaaacctccacatcggacgggcgcatccatgtcagtggggaccgtggctctgcaggccgattccgcgcttgcagaggaaccggtcgaagcgccgtgcctgggctcgggagccgcgaagccacagcccaaggccacgcgttggcggagccggagccccgtgcttcgcctcgtccggtcggtcgccgtggtagtcgtcgctgctcaccgccgccaccgctgctccccgccgccgccagatgcgaagaggagcgccgccgatgacaccactgttccccgccgccgccagatgcaaagaggagcgctgctccccgtcgccgcaggatccggcgagcccgcgcccggatccggtgagcccgtgcccggatctggcgaccttgtgcgcagggtggcggcgaaggaagtaggatgcagcggaggagggcgtgtgcgtggcagaggaggaggagaggatggcctgggggaagaacgcggcggttgagaggaggaggcggcgctgcggcggcgcaagagaagaggagcggcgctgtggcggcgcacgagaggagaagtggaggcaacaagaggaggcgttggagaggaagagggtaaggcagagccggttggtaggaggagaaaataaagggaagaggattggagaggctgacagtgggtccatatatagattaggggtatctatttctttttgttgttagaaggactaaaatagttaattttataataacaaatatcatagggactaacacaaataggtaggggctgaaacacaaaatatactctgcagtggtctccattgtagatatcgtggtttttgtgtggccttatcctatgtggcaacctgagaccatagttgcttgtggcttgcattgtacatgccctaattatttggtattgttgcaactattttgcaggaatacttctggctttgtgtaccttcgatttgacagtataacagctgccatgagtgcacagaaagcacttcatgggaggtggtttgcgggaaagatgattacggcaacatttatggtatggaatacaacatttaattgaggtcaatcttccctttctaaattttgggtttgctgattgctcttttgctgtgtcagtctccgcagcagtactcaacgaagttcccgagctagcggacagcaactttcggttgatcgctgaagattcttgctctattgctgtgtaacggtctcctgtaacattatgtcatgcagccttttgtactttatagcatgggttattcaacactaagttcgcatacatcactcgtttttgcttaagacattatctataagctctcgaagtgtacggcgggcaaatattttaactcttggtgtttcaattgatcgtgccgtgatggcaaatattaaagaaatgttgtcgaattttggggcaatcgtaattgcccaggaaaatgatctcattacttgatttatacccctatcatccgtttgaaaagcagaaattcttgttttagaaagcacagttccctcgagatttcctaataagaaggggctatacatggttccattacatgtaaagtaaatcattggatctccttgaaaaaagctggatttgaatttaatgcctttttggccaagttacgcgtatcatccctggatgattcccttgatatgcgaaggagctccttgatccctccggttagaataatgtcacgggcgttatcttctgcgaatatgcgcatgtgataggaacatcagtgatgagggtcaaatactcaaaatgcgtgagcttgattgtacacagggagggatcgaaggtgacggcagctagtcagtttacgtaccattttgagctaaatggcaaaatgcaagctcaatatgtcttcgagttgaagcagaaaacgcggatgaattggccaccatccaattaagaacaccttcttcgatgaggagggatctccctttcctgtgacctattttgggtagaatggcaaaaaagttggattttccctctcaagtttgcatagttatcttcaggagaaaagagctgaggacagtagtgttccatagtgttcaaggtaaaaaaatatgtaacatgtgacaatgcaatccatgttaaggcatatttagcatatatgattgtgtaagcctaccaggatattattaattgattagtggtgtaatatcggttcgtgttcttgtgaacatgtgcgttatatgcatagatctactatagtaattttcaagaagtatgtacgcaatttcagcaggctctagccctgttggcatgttgtatcatatcagtgtatcacacttcagattgtcctctgccgcattttacctcttttcaactacacccagatcgtcataactatccaaataaattcaggactgttctgcagttgatattcatgcaaccatgtggagtttgatattcaaaccataagctcatagaaaacaacaaacaattacagaataatatgaacgaatatatccatcacaaatgagtaatagagaatgtactaaccttgacttattactcgggattcacattttgcaaaattagccattccccgtgctatctgagctatgacttcgttgtgtccagttcggaacattccgagaagtgcttttattccgccatcttgtttcaacataacatgcagcttttctgcaaaaaaaaaaagaaaaggagtacatggtattggtcactcattatcaatcaatgttctacatacacgagctctcttgtttccattccaaaggaatgctagctcgatagttgcatgtcattgctgttcaagaagccacaagtggtgcaccctcacaagtcacaagaggacaattgcccaactaaaattacattattctaaaacaaaataaattaaagaaatgtacttatcagctcttgacaaatatccggtgcaccaattaacaagtttgatccgtaaaatcatgactttatcttgtttacattctgcatcgctatccacctttttatcttcatttcagaactactagcaatcagcgttaaaaaaggccctgataagctgtcctgatgcgccggaggattagtggctactggctagaaggatatgaattcaaactaaacactcaaattgtaaatttagatttttttttttcagcaggtaactgcacagttaccctccggtactggtaaaaaaaattcaaattttggatttgaattttatctagtaaaatctggtaatcggtggaaccaggcctggtaagttagggaatactggtatttggaacgctgctagcaacattgtcaaacaaaaatagttaactcattaaaattgaaattgaaatttgaataaaaatatgacacccactgccgttcaagaaaattgaaattccatattaaaaggaatattttgctataatggatacaataaagacaggttgtaccgtttccacataggttggcaagggcaccagcaaccatccgcagagtttggggatcattagttttcgacgcaatatttgctaataatcgagctcctcctttgttcattattagtccctggtttgatcctgcacttacaaggatctaacttaatactcaagttattgcctgttcattttataaatatcgcaatataaatttgactaataatatagatatagttcaaatatgtaaaaagaatatctcatgctggaaacctattggggaattttccttcagtcaatgactgggccatttggcatgtgcggaagacatttagtgaaagactatagaacacaccggttaacaactacttccatgctgcaatattatcagcagtgagccaactatacaatgaaataatagccccttttgaccaaatgtggaaaataaatctcatgagaggttggaataggcattaccattcattgccaaattagcaatagcaccagctgtgactcgatgaattgtggtattttctgatgtttctagaagtgacagaagagcatccagtcctccttcttcaacgattttttcctgattaacgtctgcaatcccagatggattggtgataacaattaactatggttataacagttgccttctaaaggagaaaacatagcatagacagcagataactgaaacaaatcactggcttcaatattatgaccaagtgcaaattacaattcgtatggaacagttgaatatgttcgtcaacagaatttgaacaatatgccactttcacatttttcacatattataaccaaaagagatccacatatttttagggaaaaaaaatcctcttttcaggaatattttccatgcaaatgtacaaggaaaggcagtgaatgaaaaatattcagagttttacataaagtcccgtaccttcagcagcaagattagctactactttgacagcatggatctgcacctctagttcatcagacttcaacagagccaggacatttggaagaccgactgaatgccagttggaccaaaaataatgtcaagatggctacccacaaaaaacagctacactgatattgtaccacaaataaaagtaccttcttcaaatatctttgatatgttacttctctggctagatagcaactctctggattttcctgacttagacataaaaggcacactacctaatccagatcctgatctaaccataccacataatgctttagactgtcaaaaagagagattgacataagatatgattggaaaatgagcatcagaatgtcaagattataatgcaagtgtggtacctcttcagagcaattatcagccaaagattgtttcaaccttagaatttcatcttcaaggccctgtctatgtctcatctcctgttgcatcttttcttgagtagatttcagctcttcatacaccaactcctagaagaataattaaataaaaaggtacattaaaattgtttcagatttgagaaaacctaaacatctccatatgtttagatgtgctgtcccgtgtttgccataccttctctgatatgagatcagcaattctttcttcgagtgagcttatttgactggcaaattcttcagtggttctggagagctgcttctccaattcacaggctatatttttctgcaaccgggatatcctcatattaaccttttcaaaattcctgaaggatgcaaacaagtcctccaacaaaccttaaattattgcagggacatgcgcaatgacattctgccaaaaggccaatagtgaagaaaaaaaaggaaaaactatagagaacccaaggcatgtctagtctaaaatgtttttccatttcaagtatggagagtagtcctggttgaggaatgaggatattatatccaaacaagatgcaaccacaaacaaaaaatgtatacctgaattatctgactgttatattgtattagactattagttactatgaattatctgactgcattatagctacagttgtaaattctgaaagtatacctgaaaataattctgagcatcactcagttgctgttgtagtacatttaaatggtcgttcatgctagcagaacgtgatctttcatcttcaagttgcttcagcaattctcttattttcttctcatgagatttagttgtatcggcaagaatatttgtgtttgagatgttctcaagctgtttttgctactaacaacaaaacttgtgttagaactgtgaaattattgaaataggacatctcagtgtcagcagaactacatcaaatactaagtacaaaatcaagataaacattacatatgagagaaatatataatatggcaaagaaaatctaccttattctcatccaatgatgtttctaagtgaataatttgctcagataaaatattatttttgcctttctctttctcaaggtccagcatcaatctcttgattgtagattccaattgacgcttttccatcgccatattctgcgaaaataaatcacttgttacattatatctataatgccctgaagcaagttttatgtactgaaagtgatttttcctgaatgctcacaattaataattatatggaaagcacaaacaaaaatacaaccaatttacttgtcagaaattacaatagatatttacttcaattcatgtacccaataggaaggacaaaggtaagtaagaaggttctgtaataaacaaaaggcacccaaactggtagatttttgtggagtgacaaaaatgaatcaaaattaatatacaatgcaaacttcatagtctatgctttttggacaattagtctatgaaagttatacctcaatttgcatgttagaggtcacttttaaatcattcaaggatgcttctgattctttcagttttttctccaactgcattttctcactgtttttaagcttttgctgcctctccatctctgacgtaagatgatcaacttcatgttctaccttcttatataggctttcataatcaacttcctcctttatccttatcgtgttcactattttcattgcctgaaatcacataatgaacgacttaatgtggtgttataacttataacaaaaaaggaacaagaagaaggaaacgatataaaacaactagacaacatgagtttctttctttgagtaaatgcagagttgcaattttaaacaacgagagccattgaattcatttcaagaggaaccagtaacaagtagtttagttcatgcatgaattaagtctctgatgtaatgcaacatgcacagtttgcactgtgtgcaaattaatgctgctcagttcactctagtaatttatccagttagaagcagttgaaatgatgtttccaactccatgaaactaggtgcattatgttggtataagacaggtgcatggcataatttaatggcctgggatggagtagagttcagatattaactaaccatcatatatctagtgggattaactaaaaatatatctagtgggaaaagctctgaataccatttacaagaataggttccatacagtagaggccaattttgcacaaattggaatagggaaagtgagcaaaaattcatcaacgtagacagatcttagtatcttacagatggacctattgtgcagagagagagagagagagagagagagagagagagagagagcaatgaaatattgaccaatctacacttactcgctgcccaaacataattgtgcttgaagtttctgagaaatgccttgaagatggacctattgtcacaatgagtgaagtccttgcagtccctgcatttggagatttgagcaaatcaattacagtgttacacatgtagtgatgtggagaaaaagtaaccatgatgtttgaacaaatgtgataaattcaaacaatctaataggcacctatactttggacaaacacaagaaattcaatcataccaaaaggaaatcatacctccaaatgaatcacgcagtattcttgtaagttttgaatctcttgttggtatatgaggactattttctgctaacgcgttaatgcatttgcctagagatgttaatgacagattgatgaacttggcttcttcaatcatgtgaccttcacttcctgggagacaaaagattaatattacaaacaaacaatacaacatacgaaatgaaaaggtttgtttcaattatatggtaagacctaccagatttatcgatacgttctgatccagcaaggtcgacaatcaagagcttgctcttgagaacaagcggtaaattatcaggaaaaaggttgtcagtaccattaggaagagaggtattacttccatcttctattcttgaactcctctgtatatgaatctgaaaagaatatcaaattcgcatgggcatgtaatttactttggaacttaaaacagaatacccacagcaaggaagaaggagcatacaatgagaatagcatgactacgagatgattctgtgttcatcttagtattagcagcatgacgattcatctcaccaatttggagaagttgaaaaacatgttcaagatctctgatttcaacttttgcagcaccaggcaaagaaacttcaccagtttttggatcctcaacaatcggaatattagtcttctctggagcaagtaaatcttgcacagattctaagtaaagctataaaccaaataaacatgtatacattagtatggaaaaacatactacaacaataagggaccactaatgaatattcaaataattttatataattgagaaaaaaaatatggacatagaagcttaagcattaaatgaaccatggtgcactttggttcaatttgcagtacaccatgaactataacacttcatcccatttgtgcagttttttatgcaatttatctagcacgatagaaaaatgcctttatctttgtcgtccacgtttaacatggcaaactacctggaactatggatggataatattaaagtgagtgaaagtgttcaaacacatattgttatacatgacctatttgatgtcatgtattaaatacaaaaactggtgctatgtcttacataatctgttcaaaaatgattgtgacaatgtggcacgataatcatataagccttagcatataaatatgactgttcctggcttcctgcattaatcgagacagtttgaagaatcctagctaataagaaagttaaaacaattccaccattccatgccaaaaaagaataatgtcgatcaataagaaataatgatacatgtacaaaacaaataacttcagttgttgagaatagaacctggagaaatgatattgccacactatctgtctccaaagacatgacagaaaggatatgttccaatgctctgaccattattccaccttcagaagggtcgtcatttccaagccgaccaactgtgtatgtcttgccagtacctgtttgaccgtaagccatcacggtcccattatatccttctaacacgctctgcgagatttatcagaatagtttctacattctctcaggccaatataacaaaatatcatatgcaaatgggtcataagctagtaacaggctaaagggaaattccaattgtatacacataaaagtttgttcctactagcaatacagaaaagcgttcttaaggcatagttgcaggcctgttgtacactatttggcacctaagagaatcacttcctgataataatcaagttctaccaactgaagttaatgtaactacatagaaaacagacaaacataagcatttgcaatgaaaatatgttgctcatagttagtagtacgttacatgtgtaaataaaagggtgatgacatgtacgacttgcctcgactacaggttttgcaacgacctcatatacacgtttttgtgaagcattttcactgaaaacctcatcaaacctatatgattcacagctccagttgtttttctttagcttcagcttcttacactgcacacaataaaaaacaagcagaataagtaattaagttgttaattacttataatgaggtacaaagcgcagagagtaaaataggatgctcacctcaggctgcaactcaacacaactatcgaagtccgcgccatgagctaagtcctcagaattcttcggccggagccttacagcaactcttactctgcacgaatctgtgaaaaacaccctttatcaattctgaaaacataccatattgacatcaactccataaacgactgtaaagcatattaagctacattcaccgcatcagaatgtgagaaaacagcatcgattacagatatctagcagaatgtactgtgctagaaggctagcagcaccagggaaatggcgtaaattcagagcgaatatataactgatagcgaacatatatgacttgtatacatgtgtgtgcgaacatatatgacttgtattcatgtgtgtgcgatttaatgagtacaatatataactgatagcgaatttccaatgctgaaatgcataaatggtcatctctccagcgacaatgatattcccgtcgccgttgcaagtatccgtaacgtttggagtttcccgataaaccgacgaagagcgaaaaacccgagacgcgcttccacggctcctcgaacagaggaaatgcatcattcaccggacggcctccgacgaaaagcaccaacagcgaaaaacccccaatacaccgatgatgaagtgcaatctccgatgattcacgggtgcgcggagcagcagaggagcgcgtacctgaacccccgtcgttgtcggcggcggcggggcgcgcgcgggagggggacggggagggcctgcgcgacggaggggcgaccgacctggagcgcccggcggggcggggcggcgcgccgtgcctctccacgggccgcaccgacgcccgcccattcgccgccatctccgcccgccccacaaccccacccgcgccgcggatccctctcggctcgtcgccggcggcgcgtgctggatcgggtggaggaggaggacgcggcgagatggagagagagaggcgttgggttggggtttttgagttgaggcgcgcacgacggcgggcgggcgggcggagacggaaacggagtggcttgcaggagaaggaggcggcggctcttttcctaaacgctccacctcctcggtttgaattatttaatgcaggggggtgtgtgctttgcgtttggggttgagagggtgggatggttgatgttgattgaggtgatggatccaacggcggagaatggatgttggagtttgctggatgtctctcacgactgacactactccccgtgacgaccaccagccaagcgatcttttgttgcatttgcttctttttcatactgctgtgcatgtttggctgtttgcccgtgagagagtcataactaatgaacagtaattattactacttcatttctgtaaatgttttctagctgttttatgttaaactaaatgaatgcaggagctttactacgaataaaacaaaatatacgcgagttacacatcttttttatgaggaatgttcacctttagttcgattttatacgtggcagcatattttaaatgagctcttaatattaagaggttcaaggttaatttgtaactttacggatttattgccaccaccattatcctattttaaagaagtgtaaaaattttgttatgtactgttcttttctttaaaataatgttgtttatgtactatctttgttttcttttttttccgagctgtctgttttctaatagaggtatcattgattttgtcacaacactttaatatttgtcttattcggaaataaaattagtgcacatatggaaaaatataagtaatacttaaaggtcctttaatgttaaactaagtcgcatcaaaataaaaaatatttagttaatttttttaataaaataaaatggtcaaacaaaatgttaaaaaaatatcggcatcatccattaaaataacaaaacggaagcaatacttcaataagatatgctctctccatcccataaaaagccaatctagtaacggatgtgacacatccttatattacgaaaataaacatacatctataaacatatatctatttagatttgttgtattacgaatctaaatatacatctataaacatatatctatttagatttattgtaccactataatgtattacattcaattgtttttctttctggatggagggagtatatacttagtaagtggcactgaattatctatggaggatctcagttaaggtaacgaaaacaatgctcacaaaatctgcaatgcgctagtatagcaattcagtatgaaccacgagcaaagatgatacatctgcgaatttctccttcctcgctacaccatatgcatgatacatctgcctgtcgattgtcgaacaaaagatgggcactgtccaggtttacacggaacaaaaatgaacaccacaaaaatggaatctgaactatgcaacacaaacattacagattttcgatgagcctgtatagacaacactagcagctcagcaacccccgtgtatgaatggatttggaaacccaatttatagtctatagacagatcattgtgcccatttctccactgtaggcagcaaaatccttcccacgtacaaatagcgttatttggcttcgagatcgtgctgtaggagcttctacgtcaaaaatcggatacaaatgagcaacaatacacttgatccagtgacctcacactctgcgcagaggttgagaccccagaccccaattcaccaagacagtaattgcaccatttgacactctgatattgactctatgaacttcccgttgaattggcagctgacgcatatatctccaaggagtgctctggtatgtatgtaagacctgtagtagaaagatatcaaacaaaacaagcaggaaacatggaataaattccactatagtctacatacttctttctttttttacaatcaattccaacaggaaataattatatgtcaacatcctaaggaatctaggatattcacattgtgacagattgttaaaaaaaaaagtgttcctccaatgccactaatttgtttttctttctctgtgtttttactatgcttgcaagaaaaagtatacctttctcccttatcgttatttgaagtgtatccagtgtaatgatcccatccgttaatggaagtagctcaagcttgacggtggtgcttgaacgtgcaggaatacacctaccacaatggtgacaacaaatgttattctttagtgtatagaaatactccctacgtcccaaaataaactaaccccatacgggatgtgacatcctagtacaatgaatctggacatatcgtactaggatgtggcacatccagtacgagattggtttattttgggacggagggaatacaaggtacatgggatgtgtcactcaaagaaagaaaagcaggtgaggatcaataccctaaaggaaccgcactctgcaaccacagatgagtacagcctccagaagtgctaattctatttcctccattgtcactttcttttggtgagccagcaaggactgaattcattcttcgaaaaccagctcgatgtttacccaagccagatcttctcacagactcattaagattgtcatacgaactatttggtgtggttggagctgagttcaaggatacaactgaagaagaaccagacgcttctggagcaagaaccgttacggtaaggttttctgatgtcatattagtagcctcaagggttaagacctggaaggtaacagtggattgcactatcaaaatgaaacatggataatctgcataatatacctaaaaaagcataggaattacctgcactgggagttgaggaactcgagcactcgaaataggatttcgcaaagacagttctgatgatacagagatcataaggtcactagcaacacagggtcgccagctggtggcctgcttgaagaaaagttttgattctacacaggaaagaaggctggaagtcagaaataacaattcaacgcttcttccaagtcacttacccccatctgttaagtagtttacctgtgtaattgcagcgatatgatacaagtacagcatactgatccataagagagccaatggtctcgccaaccttagccaaagaaacatttgtggcagttccattcatcttagggagtgacaaagtcagaggtgcatcattgttggtcctccggtccctaaacgacatagttgctggcttgagaataaaagagtgctcctcgcctctcctggaaaggaaaaggtaacatttaagaaagatggaatattctagaatctgacataaacttcaatgtttagagtaagaaatactcaacatacaaccatgtttactactactagcatatacttgaatctggtgaaagtaaaagggaaatgtggaattaatccagtcctgctttgactaacccagtactctagggctctaggccatacaagaccaacttgtttgaggccaaactcaaactcctggatttgatggaccccgagggggaattgaaccaatcaatttctttgcataaagctgaaatggtggatagagagtgaaatcaatgagaaattgcatatacctgagtgcaagatttggtaagctatgcccgtgcccaacctcaatactggcaattgggagtgacaaaggagcacctcctttggatgcctcctcaaagacaattgtaattgcatctaccaatacaactatatctttcacatgctgtggagaaatattctgaaatttgaagatagaagcattaggtttgaaagcttctctaagtaggagatattaatggttagggatgttcgcgtaaccttgattagaacacacagaagattttccgaagtacattttgcggcaaaagagtgaacctcaattggttgaatgatctcaacttttctccgccatcttttccctggtagatatacaccttctagaccacaacgtacggaataccgttcaggctccaatggaactcctctaaaggaaagttgtccatcatttataatatcaggtgttttcgcaggcttttcaggcacaaattcttgactttcagaaattggtggtggcctaatgttgggtggttgagtggaggaggctgaaggcatggaatagcttctgaagtgacttaatgaaaaaatttgagaaccagaagcagaataagattgcttgtgtgatgcactaggattgagagtaggaggtgataaggatcgcggaggaagtgtgcgatccaaagggagcagccagcttagcagctcctgacatggatcctcatcaccactagaaagtccattgaccagattcttggttatataattgcttgatgaagatttctcaaattgaagaacttctagcactggagcttccattttgttaacaccaacattcacttgcaaaacaacctgcatccttccaacaaagaacatgagtgattaatcagcatatgtataacatctaaaattaatcaacagatacacgtgtgcttcctttctttctgaaaaaggggatttcaccgaaggtaattctatatgacttctaaagatctcagaacattgctcaatgccgtgatttataaagttgcagaaaatgaagagagtactaaaaggcatgggcatgaggtattagccagttatgtcaatctgctaagattgacgcaaataggtagcacatgagaacagtctaccatgtttatgcctggtgaagttattatgattaaagcatccaacttgcaattatttatgcagtgctcataagtaaacttccaatgtgcatacattatacaaaagttctagttatagtatcacccagtaactaaacagaaggatcattcataccacgatgtctccattttgcagagcatagcaccttgctgtaccacgagcgattcctccagatgtgctaccatcaaaaactcctttatcagaaatggtattataagcattactccttgaacccttattgttttcctggttgtctgaatatgattgctcttttggcacctttgatacagctagttttttattggaccagagaggttcatctgactctgcaattcggacaaaaaaattggacattttgaatctttgaagcatactttcaatttgttgcttgtgatcttccaatcgaaggagagattcggtctccaaaatatcttgttttgaaggagagatttcgttgttgagttcaacattttgcatgtcatcttgttttgaaggagacatttcgttgtcgagctcaacattttgcatgtcatcttgtgtcataggagacatttcgctgttgagttcaacactttgcatgtcatcctcaacaacctgggaaccattctctccattctttacattactatcaccattttctgtggcatgactagatttatttgtggagtattgcaaagaatttccattcttagacatcacggcagcaattctaaagggagatatgacctgtgtttcttgcttcgaagcggacatgcacgccaatatatgaacctgctcacctgataactgaactagttcagattctagaaaacaggcagaatcatgatgcacttgtgccagaccccctagactaagtcataggaaaaatgcatttaccaggaaaaaggaaggggcggtccaaaggctgtaactgcaacatgtctgaaaggtcattccagttatcaggaagctcctctgtggaagtaaattgaagatgttactgaccgtagatgtaagaggattaattgttacaagcttatggcacttctaaaagcatgacctatgttccatggcacttcaaaaggaaaattttcagaaaaatatggatttccttagaacatttagcagatcttgtagagatattcctaacaaatggattcttattaaccagtaatgactttaaatgaaaataaagacgggcaagtcaaagggcacatactgttcggaattgtgatccatccttcgtcatccaaaacatcggtatgctttccagtaggaactgaattttttgaatctgcatctgcagagtccccaccgatatctacatctccattatcagtatcttcatcttcaggggaggggtgatatggatcatcggcaataaggccctccagagttgtaactggcttttgtaggctatccctttgctgatcttgctctggaatccgcggaagctcgggtgcaacaggctgcgaagtccggtagaggaaattcatctctacccgtcctgccaagcaaagcaagagggtgaaaaaggagataatgatacgcagatgattaaacaaacaaaatcacaccaccgggagctccagttcgacagagagaaacaggatcaacgagaggaaacagagattcatcgatccggcagctcattgaagacaaaaacaacgggacatcagatcaggcaaccacccgcggcaaagcgagccattcgaggcagcaattagccatggcggcgcctgatctagcggctacacggcacagggggcgccgcatttccgccgatgcgggagcctgcctagcaatcttagcaaccactgacgactctcactgaagaagtaggagaagaggaaggcttagatcacacttacagcgggggcttcctatgggcatcaaacgatacacgcacagctgggctcggagaaccgcgccccgccggcgcggggagggagagagaagaagcgagcgagcgagcgcggcggcggcggcggcggcggcggcgacggggagcgatcgcgtgagggggagcggctgcgtcgtgcgcaagagaggagagaggggagcggggcggcggcctggcgctccgggggacggacggatctgagccggagaagatggtccatggcgatgcgtgggtcggattaaactaatcttcctcgttgccaacaactaacccaaggcccagctgaggcccatgcgagcccaactatctcacgtttcttttgtaagtttttggaatatcaatttttttttactaaatttcagcaaaccccatgtttttggttgaagttgtataaaaccccagttattgcacataacctcgtaattcttaagtttcacaaaacaccacacatatacatatttggcaaatatttacttaaaattttaaaacatagaatatatacaaaacttttagtcgttgatttcttgattaaggttatcagtttaactcttcgctactttaagaaatattgtttctgatatcctgaaatcaattgaaatttgtatcagagtgaggttttatgaaacatttaggccataaaacatgtgattatatgtcgcaagtcatcacacgtgtgattgtctacaactttgatcataaaaacgtgaggtgttatgaaatttactccattttttagcaactttcaaatacccacttatacaatgtctttttttgggtagcattgctaccattggcaaaatgttcaagaataaaaaggaacatgcttttgtcaatcacaataatattccagctgtagcagaaccataacatggttaattcctgctcaaaatacagattacgagagaatttggttcgtatacctcctggattgctacttgttgataagtgttgaatcgtgtagcaaaatggttcgtatacctcctgtacctcacgtaagagcatctatattgataaagtgtagcctctatcactaaccctcaacctgacaatatcccatctccaccaccatatatattgataaagtgtagcctctatcactaaccctcaacctgacaatatcccatctccaccaccaaacactgctgccttgttgggcactggaaaatgttcttccaagcagcttgtgtgttcttcaagccaaaagtatgtctttgtctatcttcaccatccgcaccaacttaacgtacaggcattggtgtggagtagctttcaccttgacgtgagaaggagcaattgctattcttcgatggagttgtgcggatccacattaccgtcgaaattagcacccgtggacccaggttttcactctacttcttgccttccagtgacttgagatcagtttgtttaagttcaacaaacttcccaattctgaacatgtaacatccaacaagggttaatattcagtgttatttttcctcccagtctgtaagaataaatggaaaacaaaaaggtccaggataccaaattaatttatcattttgtgcatggaatcatgcctctaaaatgatggcataccagttatctttgaatcagccaactatactggacaggtcttagcatgcctgctggcagatgctatcaagtatacagcaccatgttacctcacaatatttgacaggtcttatgatatagttattgttcatatcatttacagcaagaaagtgccatgctctttcttgcgatgtttcatagacatgatctttttcttacagtatatagtgttcagtgttcatatcttttacatgaaaagaacatgtcatgtcgagtaggtgctaagatgctaaaaagacagtgtaaatgtataatggtccatttcaaacatatacagatgtggtaaactgcattacctgagatctggtggaagcctgaacctgcctatccgaacacgtttcaaggcataaacctatcaagaacaaggataaaatatcagctacttcccagaggggggaaaacattccaaggtatacaattccagcaaaaaacgcacttactggtacacaaggatatatgcctacctcacccataagaatataagataagtgcacttcttagacttcactgttgtttttagaaacacctaagactaggaagaaatcccaagctgatgtgaacaaaatctttcagacaagtgatgttccgttgtacaggtattacagttagtacaatttatcttatgcactgtagtgcttgtagaagcacaagaattgagatctgcaaagtgctttgagataatatcaactaataaacatgctaggcatctcaaaagctactgttctaagaactatatagtagaatgtagtatatcatcataagcaggtttgagaagaaaaactctgaagcgcaatgtgctaggtgtatgacatttttttagtaagtacactatgtctttagcacactgctaatctctgtcgttgtaatattcgatcatcataataatatttctgttgaaaagaagactctgaagcacataagatgcatttcaatcctcttctaaaacatactgttaatttgtcaatagtgctactgatcattaatcgtcctcatttctaacaattcaatcagataagggattaacaaacaacatttgctcttgattctagaaccaaattacttgagttaccaaatttgatattgcacaatgggaaatgttaagatatgatcaataaaacataaagggaaaacttgagaaaaaaaatattgagcatacaaacaaacctctaggcctgcattctgcacgagttcacgaacttcatgatttcttccttcatgaacctgccagacattaaaaaaaatagcataccaatgagtagatgaccaaatgctatgcctttgcaagtttacatctctatagaattgctttagttaagaatacatgcaagaattttgagcaataagtccataacatattgatgtcattgaaaatactgtatgttgcccagagtagtgacttttccttctacactggtttttactcacagggctgaaatattatcaagaaatggttccaaattagctggtaacatgttaaaattatttagctagttttgaacaatgcgaaacatattattgcttaagctttgcagaattaccagtttcttatggtttccacggtttcaatcatttgaaaaagtaagcaggtgaggcaaattatcgatccaaccaactgcctgttagacatttaaagtgaactttacataatcactaaccactttagcttgtcatgacatttaaaaataaatcttgaccgcaagatactatctaaagagacctttcgtgtgtcatgtatcatgttgtatatcccataaaggaatgataggatagattcattgctagggtatatttttcactgaacagaaagagccaagttgcctatcttctacattatcctatgaagaatttggaattcatgaaacagacagtaaagtcaatccggaatctaataaaatgaggtataatagaaaatataagtaccgctattctaatccgggtcctttttgtattggattgtacatccaatggttccactagatcaggtatacatttgacgccatcaatttttgtgccttcactgatagctataaggtgatttctgtgcactggtccatctatagttaccacatatctgcaagatcaaacaactcaaagtcaatgttggtttcatttgaaatttgataaaaatgatatttcagatatttcttttcgcaattaccagtgcatattgataatgaataaatgagagtaaaaaaatgtgaatattagggaatggcctaatatcaaataaatagaaaaggtgaggcttcgaacccaggccggctagcccaccaccttgtggagctagccggaagacccctaggcgtttctccaaataaatgagagtgataccaacagactgttaaattttcttctacaaaagatctggatagtgtctacagtgttcctagtacgtgattttgtattactgtacttcgaaggacacaagaagttgagcttactccttcattatatttgacgaagggtgtgagagtttctgggcaaactcacctgaaagagaaacaaactaactttaggtattggatggtcaaaatattgattcccaagtatttattatgaaatacaatgaaattaccgtcatttgtaattattatcaaaccacttgtagcaacatcaagacgacccacagtaaacaagcgcggttttggtactcctggttgaatcttgttctgcaaatgttaattgaaaatggaaaattgtaagtcctagctataaagcataagaggtgaaagatttcacaaatattaggaagtaccatcactataaaaaaaaaagaacatacccaacccttcaaatagtcatcaaataaggagataatggactttggttcaccacaggaacaaatatacctgcagtacattggaaataacatttagatatgttgctcatatggactgctgcctccatatatatttcaaaaatgctttgatggaacaagatagcggaatggaatataagagctgacccttttggcttgttaacagcaaaatataacttcggaggaagcttcttggaaatgcggtttccattaacatagatagaatcctttgagatgtcaactttggtctacataaaaaagaatgtataagaatcatatgtaacaaataataaacttgtctatgaatacatttgaagcacatggatcaaaattcatagtaaaatgacctagctaaattaaaacaatttatattttaccgcaatagtacgatagctggtctcagaccagcaccaaataaatgaggataagagctaaaacattacttagacatgcaacaaacttagagaagtagcatttcatcattcataaagctaaaaaaaaaaacatacctggggtgcagtgcagacagaaccattgacggtcaccttcccttggaagatgagctcctcgcatgtccttcgtgaggccactggaaggagcaatcaggccagcattcagacaactgatgtgttgctgtaactaagtaatataactttgattgaattgattctgtccaattcaagcacttcagtaaaatcatgcgtgataggaagactacctcctgccgcggcaaggaccttggcgagccgctgcggttcgtgctccttgatattctcattgtagaatctcctcgcggccttggagaacttgggcggcgccgtcgcgggggcggccttcctctccctcaccttggcattggcgacgggggtggcaagggcggcggcgcccttgtggctcctgcgggggtccttcttggccttcttggcctccgcctccgccagcgcaatggcctggaggacgtccggcggcggcgcggtgcgcatggacggcttgccgtcctccccacgcacgatccacggcaccacctgctccgcggacggggcgggggatgagggtttgggtttcgagggggcgggggcggtgggctccgcgaaggtgatgttgaagtccggggcgctggaggtggaggaggaggcggcgcggaggaggaggggagggaggcggcggtggcggccgcagcggaggagcacgcaggcggcgggacgggagagcaagggcgggaaggagacggccgctgccgcggcggcggcggcggcggcgagggccatggctcgagagtggagagtgtgggagggggtttatcggttatcggatatgcccgcgacggcgcctgtttggttgcttggtacgcctggcttgagacgtgccggaggggagaccagcccgaacaacgttgccacactgacgtcagttccttttttttttaagaaagaaaacgtcaaatggggtcgggattaaaactccgaccccccctccttcgtttcgagaaaattaaaagtcggcgatttagattttttttttaaaaaaaaatacacgacagagattatagatgcataagtgcacatatgcaatatcacgctcacctccacaaatacattctctataatgtacttataactctaaaaaaaataaccttgtttagaaatatgaaaaatgtatgttaatatagtcatataaaatagcactatgctgaaataggctaaactgttccgatataatacatcaaatcacaaactcgactacttgggcaaataatgcccccccccccccccccaaaccttgtttggacaattggataattggattatcccttaaaagatgtagactaaacttgcaatattccataaatatgtgcactttaggatcagagactaaaattttgatcccttcctcatttcgtttagattaacaaaataccaccttatagtatattcatcactatttaatggcattgtgatatcttttattggatacaaactagagagtaacaccagtcatatagtacaactatttctaactagtccacatttcactttatgttttgtatgaaatactccctagaatttagtttgatggtttcactgtagcttagttacatgttttatgtttgatggattcaccgtacaagcagttgtccatgttcatctctataattttttttttctgcacaaaaagtgataaagaggagattcattaataacgccatactttatatgttttgccattaaaggaagccaaatcctctctcgtagggaacaagggagaactaaatactaaacctgattgaaaaacggttaggaaagctatattgttttatagtgtgacaatgattggtttaactttgggttaacaactgttatttttttcttaaaaaaaaagggaagcaagaccgctgaaaccgtccttgttgtcaccgcagaccaccttacacaccggataaaacaccccaaccgggtacgggctaatctgaccccttcattctttcttaaagctaccaaccaacggcccagatccaacatcctcctcctgtggccaagaacaaaaaccgaccaagagaccaagcgccggccaccacaagaaaaaaagagcgcgcacgcatcgcctccccaaaaaatccacccatttttccgcgatcccgtgcgcatctcatcgcccccacctcgtccgccatggccgattccgccgcagccgcatcctcctccctcccccgctcgctggcgtccaggaggccgctgccctcctcccctctccgcggcgggaggccccggtctccccgccgctgccgcttcgggtcccgctcgctccaccggctgcgagctcgagctgggaaggacgatcccgaggatctgtatgggccctacccatgggatcagtccttggatctcaccactggcctcggtaagttcatgcccccacactctccctgatcgttctggttggtatccgaattcgaatggttcttcgattcgacggcgagcaatgagctgggggctacttgcgctagtcttgcggtgggggtgatggttgatttcccagctgttactagtctgtgatatgatgatgaactcattcattgttctgcagattttgcttatttcactttgtgagaggctttatacttgcgtttatggcgtggctttatttggggttcaatctctgtttcttaacagatattcagtgggtgccagaagatagagtcacactgttcacttctgatgggcttgttcaaatagggggttccctggttcctcgtcgaattactccatcagaggtgccgaatcattcaacttgggctcgtttcattaatcgttcatttttcagtaataaactatgtggtatattagaatatcttgacattcaagtaggaaaacaaagtctcttgcatcatagacagtagtaaatttattcttgtcagtaaaactagggtgcatcttcagttcaggagtgagatatgttatagatattgcagacactattgttcaatgatcaggaatgttctgttccagggagacatagtttcacattaaatcagtttcaatctcttttgcatagtgcatcacagcctaacttcatataattcaatcatagacttggatagatgattagactattaaaaatgtttgacttgtcactatgctaaaagtgcttatattttgggacagagggagtatcaaacaacaaaaactttttcagcatcctgaccagcatcaaatgttccactatgaaatataagctctttcacacctctgttcatgaaacatttggatatatgcagcagtacttatggaaacgtgtcatgtcagcaagaaattgaaggggaatgaatccttgaaaagcagtatcacatacattatagcaccaattttgtatctcccatggtggcaccaagctaacaccatagagtagtgtacgtctgtcatgtaatgttggagtatcttattgcataaacaaagcatgccatatttatggatagccgtatctttttagtatttgtgctcgcattcagttcagttgacctgaaattatatccaactgaaacaaattccaagtcgattacaagtaatccagtatgaaatctagcacagtgtgaatcatctcaagaacacgatgtatctcaagctgacaggttataattatgatctgtgcccaatgtgctagtttagaccgaatcatagtaatgtactgaattacttaaattgtgctagttatgaaatgataattacttaaaagatgttgattttagatagaactgcaagttttattatgtattcaccattatttcccatattatctgtactcacttcttttgttatattttgaccagaagaggcaacgaaaagtaaaaggtatacaaaatatccaacggtttcaggagagctcgtacatggacccaaatcaaagtctttgccttggagcactatttaacatagcagcaacaaatgtaattatttcctcctgcctatttgcctatcatgctgttgctttcttttcttgatgtcatttctcatttcagggtctagatatgggaagaagactatgcatctttggcttttgtcgctctattgaaatgctaagtgatgtagtggaagatacagtattggagcatggtggtgaggtatgtgcaacagtcttacatggaaaaaaaaatcttttggtactttgctccttacagttttatatcttcattctgactaccgcatagactatctttccatatttgaaataagccatgtaaagggtaccaacagattaccttctttctgagaaaaaaaaagatttaaaaatggcgcacatggacaatgatgtggcgttttatactgaagtagattgcgaagcaaacataacggtgcccaaggaaacatgccaggtgtagctaagttttttctaaaaaaaaacttaataaaaggttgagtagaaatgctaaattgtcaatgtttttaaaggaggaaacatctatctagtcagctcttgttacatttggattttttttagaactttacatttggatactaaactgtgaattgagtaaagggcgccaatctgcaggttgtcacggcagagaaggcaagcaaagatggcctccaggagaagttgaccatgtctgttgcagtgccattgttgtggggtgttcctccagcatcagagaccctccatgtcgcggtgcggagcggtggaggcattgtggagaagatctactggcaatgggacttattttaaaagtcccaagccgtccagtcattaacaaatgatccatgccacggtgtaaatactcattcagtctaattcgctgctcgcattgtgtcagcaattgtaaattgtgcatatatgtaaacagaaaactttggaatctctatacatgtacagacatggtcacacccctgcatataagaaactgtgagttaacagctcaacttctacttttatccttgttttaatatttaccagtgaactgtcgtcaccgtttgagtattggaatattggagatttggagtaactaaacaatgcgaaccagtcattagttgactccgggaatcgggagtaactaatccctggcctatgtcattgtagacacgtttatgagttttggagtagtaactaatgggttgtttggttgatgcctaagcttgccataactaagcttaggtaagttgtagcatgtggcaaaagtatggccaagaaatagttagccacaagtgtggcaatgttagctctagttatctgagtatgacatgtgggaccatctaaatatgacatgtgggacctaagggtagaaaagtgtggcatgacacaactgtggcattgaaacaaacacacgcctaaaaactgtggcatgactgaaatgtggcgtggcaaaatgaagcaatcaaccaaacaccccctaaaacaatgtgttgacttcgggatttgggacaagattactctgtgttttatattgtcgctgggccttgatcatgatgagttgatgatactccaggtgtgatgcttcctgcactaacccgtgctagttgtcgcgccggtggtgtcatgcatttagacgaatcgaaaagacattttcaggggcgttagggttgcgagttgtgggtcgtttggactgtggagatcaggccaggaaccaggacgacgatttttaagacctttgcaggcagtgcaaggctgcaaattatggcattttcgcttgcgtttatacttataagctaaactttaaatttgattttttcgtcctagtttatttttagtatttacttttgaatcgctaagaatatatataaaagttttactcgcagataatttttatttgctaataagtgatttcgaatcaacgtatgaataagcgaaacaatggaatggcctagtaagagatttgttcaaacatccctttcatcctccaacatgaggtcgccacaatgccacttgccatttttctggaccgtaagatagttgtccaaataccaaattagccaaacagtagttgcgtatcgggatttataatgacgaactgttcaaagctttattggacttcacctagatcaatccggttgaggttgacactcactctctccctcgtgcattcagatttgtgacaagcaagaggggatctccatcgcgtgctgcattctccgtatggaccgtatattcagatttgtgacgagcaagaggggatctccatcgcgtgctgcattctccgtatggaccgtatatagccatggtcgtcgcctctcgccgaactgaaattactccctctgtcctaaaatatcttatctccgttatatttaaatatagtaacctagtagtacaatgtttattcttatactatttgctatattttgatattgagagagtaacaaagagtgtgtttagttcacgtaaaaactggaaatttggttgaaattggaatgatgtgacggaaaagttgaaagcttgtgtgtagaaaagttttgatgtgatggaaaagttgaaagtttaaagagaaattttggaactaaactcggcctcagcatcaaacatgatatatattactacaaatcagaacagtaccacattgatagaaatcagaacagtaccacattgatagtagtaggatatgttgtatccaatcgtaattgctacttctttgtttcacaatataagtcattctaacatttttcatatttatattgatattaatgaatctagatgttaatcacatcaatatgaacgtgagaaatgctaaaatgacttatattgtgaaacggatggagtatattttaaaattaaaaagtaggagtataaatctatgtgcgaaagttgaatctcgtgcatacatattgaatatgacctttgatctagacggtcgttcctatccactgtaccctaggtatctccatgatgcagacttcgacttcgttttcattccacttccatttgttcgatcatgaatgtgttggtttaactattatgggagtgttcggatgtcccttttcctaactcacatctctcgttttctgcacgcacgctttttaaactactgaacagtgtgattttttaaaaagtttatatacaaaagattaatcacgcgctaatgaatcgctccgttttccgtacgtgggtgatgggttcccaacacccaccatcgaagacaacctatatgctctattgctcattcatgctccacatctactaccccagtttttcaaaaggttctcgaattggattgacataaatccaattgatatgacggcgttatggttgattgttatatgttcggaaggaggtgaacttcttcccactacacaaaatatgatgatttattggggaagtattaaagatgtggtagtgaagttgtgggtatgtgactccatttatcagggttcaaaacttcaaatcatgttgtcacgtatgcaggtggactttcaacaagattttcagggatatgccgttggttttcgtctcttatgatgcaattgtggttgattgttatgggttcagaaggaagtgaatttctccccactaagcaaaacatgatgattcattgggaaagcactagtagtgtggtggtggagtcgtgggtgtatgattccatccactaggatttaaaatcatgttgcacataaatattagaaatacgcacatgcaggtgagattttaacatgattttagtgagattaggtatatgccgttagttttcgtctcttagagtatgtgttaggggacgttcgtagggggtgtgagtgtagtgttgcatgtgtagtggtgtaatatataatgactcattagtgtacaattaattacttcatccgtcctaaaataagtacaattctctaaatttgaattagaggcgtgcacttatttcgaaacgaatgaagtaaatattagttcaaaatattttaaaatatatattaatatgttttttacactaatttatatgtaaaaagtttatataaaaatatattattattcgataatttgaaaaatatgcccatgaaaagtttggaaaagtgaagttagtaaaagagaagttgggaaaggagcagtactacaattctacaaatgtacaattcaacagaatttttttgagaattaatattatttttatggaaaatcgcaaaagtagtggtcaaccggagaaaatcgcgaaagtaggtccctgtcgaacgggtgcagttcgatagggcgcctatcgaacggccagagcgcgactggcgaggagatcggaaggctgccgttcgacaggacctgtcgaacagcccccgttcgacaggcagggctgtcgaactgcccctgttcgacaggagggctgtcgaactgcccctgttcgacaggatatccgtcgaactggcgcagttcgacagggtcgcgttctccatttatttgtaataagttattttttttaataatatgtaatttattttagtgtgtaagaaaggaaaatatttttgtaatgttatatgtatatgatttagggttttgataatgtttggtcagaaattgtagtatttatttgttggttaaaatatttgaattatttagtttcattattttttgtatatttgaatgataatttgtcatgattcattcgaagggtatgctactgagtaattatccgaagaagtttatgaaatagtactgatagtactaagttaatcgtaaagtgtttctcaaatagtacagacagaacataaatgactaaaagtttaatacaaatagataagtcaaggacgatcagtgcccttcgcacgcttgctaggtcctcccttctttctacgcctaatctgctcagtgggatatgtcaaattatcaggggggtgcctatctctagctgcctactgtggtgtcacgtctggcccctgaccggcctccgtctcctgcgtcggctgtgtgacctgaggtgctgcgtgccagtaatccatccctacttccccctggggaggatcagtggaaaagaagtcctcaatgaatgctgtgcgaggggagtaagcaggcattccgtgatgcgtcgacgccgaaccgtactcatcgtctgtttacacaagaggaagaaaccaaaaaatatggcgtagttagtaacgatacatataattagaaactaaagcgtgttattgtttaaaatgacttacatgtgtgctgtgtgtggccctgctctggcgcacgcggagtgatatgaagtccccatgctggtgtgttcaacacgttgtcccccgttggcatgtaagggaagtgtgccgacccagatgctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgtcggcccgacgtctgcaccacatctgccgcgctccgacaggagacacgacgtagtagtgcggcagcacgtgcaaggaagttgtgaaggatgctcgccacgtcgtcaggcctgacgactggaggtctcgcctctagtctttgcagcagggtgtcggactccacgtgaacgtgctcaacaaattccgcatgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactagttgaaccaattgcacatttattagacatactgaactacttgctaactttttaaaaatattgaactagttgctcaaattccacaaataaacacgtaccattgagttgtaagctgatctaggctgaggggcaaacgtgtcagtaatcgctgcctggtgggggacggtgctatctccttgtggaggaaaacacctccatcgtgtaacactgcggtaccaacgaaggtaagctccataataactcccatcgtctggaggtgtctgaagtgccaagttatcagctgcgtgctcccactcttgtatcgtcggctgaaccgtggtcacaataactagctcgtaggaaagcccgagcccctttctggagtacctgcacaacaacaaattcacacattagaaaaaatgttgtgcagtgatttattttaaaaaatgtaggattaaacaactgtgatgtgaactaacctatgaagactatcagccaaaggacgaccatctctcggagggaagtcctgatacatgcccaactgtttgagaaccctgtggacattgtgtggctcgacgtgcacgtccaccacgaggtgacaagtcgtcatccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgatgtagatacagatattacagtaccagcacacatagatacagataagaacagttcagtacatttcaatttaaaattacaagcccacgacacatatattatgatattacaagtgcagtgcagttcgaaatttaaattacaattccaatacaaatacatgacgatattaaaagtgcagtgcagttcaaaatgaaaattacaaggccattacaaatagattcgggtaataaaagtgcaagaaagttcaaattaaaattatagacgcaataaacgtaaattgaacgataacgatcttcaaagtagggagtccaccaaggataatagcgaactaaggattatttttcttcttcgacttcccctttggaacgcgacgaacatcagcgcctgtggcatcttgccctacattgtacatgctgcaatctttacgggaatggttctccccgcaaagaatgcaagctttcttacgacgagaacgatctttcactccagcttcatccataaggttcttgatcctgcgcgactggcgatgacccttagtatcaactaataaatttgagtcaggaacccaattggtttgccctggaggaggacgagtgaaatcgcacacggcacgccaaccacgcaattcaccacgccaagttgcctcccacgattcctttctaaagtagggagaaacaaaaatgtttccatcaacacccccttttgcggaagcagcaagaacatgggaacatggccgatgtaacaggtaaggcttgttgcaattgcatttgcaagcgtgatactctggccacaacgtgcattccaatgtgatgtcagtagtcccaatgccgacaccactcttgtcacgaagtcgtatctcaaataacaactctgtattcccagcaggccacactctgtggattcctcccttcttacttttctcatccatgtactgtgtaatagcggggctatacttaacactgggtttgctgaggttcagactagccatggaataccttttacagagatacttctgtgtacccctcgtgatgccctccaggatagcaacaagtggtagaggtcgtgtattcttcataacccagttatacacttcagcaagatttgttgtcatcacaccatacctcgatccatctgtatcgtacaacaacgaccatttctcccttggctcaaattctacccactccgtgaagcacttcgtgacccttccacgcttcctgcgccgagtaatacttggtgcttcattaggaatgggttcaagtccctccggctcctcctgtctggcaactataggttttttcctaacctcttccatgtgtgtagtggtcaaacgatccagttgatcccatatggcatcaaactttctttgttgattctgcttgcataacttcttgaacaggtccatcaatctcttactcctgaattgtctataaaaattagccccaaaatgtcgcatgcatcatctgctatgtaaatctggccatggcacggactgtgtgacatcttcttgaagcttctgtatcgctgatagcaaaccggcgtgtcggtcatgcagaacacacacatttggtctgttttcaacaacacacattttaatgtgccgcaaaaaccatagccagcttgatgtgttctcgctttcaacaaatgcaaaagcaataggaacgacatggctatccgcgtcgactccgatcgcggttagaattgttcctctgtacttgcttgtcatgaaagtgccatcaacacagagcaaaggaatgcaatttctaaaggcctctatcatgcacccaaatgaccagaaagcccgacgaagaacattctccccatattcattcacctcatcgagaatagccatgtgtgtgcccggatttcttgcctgcatcacctccaatagtgggggaagattgtgataagaatcctcataagttccaaacctcatctccaatgctttctgttttgccctccaagccttgtcgtacgatatctcatatccgtactctttctcaacgtcatgcattatggtgaaaggggacaaagatgtttttctaaccacctttgaatataccatttgtgccacaaatgccgctgtcaggtttctgtgcaccagacgggtattctccaacaaacacgtatgttgctcaaccctcgaagctacccataaagtgtcatgttgtggcttgtaaccatgcactctccaaggacatccaccctgtatgcacttcacgtcatacgtcgtcctatttgaaaccttcaccctgaactcacgcttctggacaaatgcccacctcttcaccgcatcttgtaagtgacctttgtcatgaaacatctgtccaactttcacctgcttactatcataacaccagtgggcatctaaaccatcgtttaccttcatacgactcattgatatggtcgtccaatcatcgggtatgttggtttcgttgtcccacagtgttgtatcttctccttccactacaagcgcaaggtattcctcgttttccacttccatctgatccactaccgcctcattctccttcgctgcatcaacacgcataggcgaatcaggttcttcatcgtccaagtcgttggcctcacgattagtaccacgaacaatgacctctccttgtgtattaccctctactacttcttcccctcgaccttgcttagtctgccaaacattttcagcttgtccaccttccaacggagtttcttccaccacggcatgacttgactcccccgatcgatcaacacatgttgtcttctgcaccactattgccaggctatagcctttctcccttactttactaacaaacttcctccaactcccagttgacgcaacctccactactctccactgccatccatgttgacccctcactggccacacggcacttatgacaaatttatcgtgcactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactatattgccgtgtactaatttacaactattagtaacaaacaactagtttaataatccaaataaaatataacacctttgtacctattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaatttttttattaaactttcatatgcattgtacttagggattactaatgtataccttaacttcactgctggagggcgtcgccaaccctttcctcccggccggtgcctcctcggcctcctctccggcctgctatcccctcccctcgctccctccggcgctcacggcgacgatgtggcgactcttggcggcagctggcgatgtggtcacaaatcgaactcgcggcctgggtggacggggctttaaaccggcctgtcgaacgcccattgttcgacagggtcggtggagggccctgtcgaacgcccccggttcaacaggcctcgcggcgccgggtggtgggccctgtcgaactccctccgttcgacaggtgagcgtgtcgaacgccagccgttcgacagagctttgtcgactgcccgtcgttcgataggtgccctatcgaattgcacccgttcgacagggacctattttcacgattttccccggttggccactacttttacgattttccataaaaataatattaatttttttctcaaaaaaattccaattcaacgcaccctcgagtcagcactcaccacaacaaagccctcctattctcccgcaccaaccaaacccaagaggcgggggaagccatggcgagcgcgtcggtgccggccgccggctacggcgcggacggcgtgtaccgctcgctgcgcccgcccgcgcccgtcgcgtccgacccgggcctctccctcaccgacctcctcctccgccgcgccgacgcctgcccctccgcggtcgcgctcgccgacgcggccgccggcggccgcgccctcaccttcgcggagctgaggtcggccgtcctctccaccgccgtcgcgctctcctcccgcgcgggcgtgcgacccggcgacgccgtgctcctcctcgcgcccaactgcgtgctctacccggtctgcttcttcgccgtcaccggcctcggcgccgtcggcaccaccgtcaacccggactacaccccgcgggagatcgccaagcaggtctccgacgcgcgcgccaagctcgtcatcaccatctccgccctggtgcccaagattgcggggctccgcctccccgtcatcctcctcgacgacgacgcgaacgccgcggccgcctccttgcctccggacgccaccgtcacgctctacaccaacctcgtcgccggcgtgaaggaggcggattaccgccgcccaccaatcaagcagagcgacacggcggctctcctctactcgtcgggcacgacgggggatagcaagggcgtcatcctgacgcaccgcaacttcatcgccgcggcgaggatggtgacctccgaccaagacgagcgccgggaggggcccaacgtgttcctctgcttcctccccatgttccacatcttcggcctgtccgtcatcacgtacgcgcagctgcatcgcgggaacgccatcatcgccatgtcgcggttcgacatcaactccctgatggaggccgtgcagaggcaccgcgtcacgcacctgttctgcgtgccgccggtcattatcgcgctcgccaagcacgggaaggccggtaagtacgatctcagctctctcaagttcatcggctccggcgccgcgccgctcggcaaggatgtgatggaggtcgtggccaagaaattcccggacagtgagattgttcaggtactaattgaactgaacatttgatatttttcactgtttactttcataatatatgctgatgaattgttgaaattagcttatggttggttgctttgaggtgtcaatccatacaggataggttgatccatcatggcatcatcccgtgattacgatgggattagtcaagtcattgattgaccaacccattgcattcctcaaacctaacacgaaataatggttcagagttacgtttgggcagtgaattcataacaacatttgttctgaccgtacgttttataaggacatacctggtttgatttggaatgactacgaaattaagtctttctttggctgtgcctttgtggggtctgatcttggttgtgccttccagggcgtaatatagtgttcatatgtgaaagggcatgtagcctagtgattgcagtgacctgagtagcaccccaaggtcctgagttcaaatctgcataggagtgaatttcagattgtgttatttgagggctaagttccttgtttgataggctaagttcctaatttaaaaaggttgcatatatccggttggatgtagaggccgggtaaaaaatctctaaaaaaatattgattcgatagaagctggaaaatgacatttaagtgcgggagactgacaattttgtcctataaatataacctcattgaggcaaaggacatttaatttctttttgtttctatatttatacttaaatccttaaagtgtgttcgcgtgtgtgttggtgataggaaattaagaatgtcaacttgcaatatctgaataataatggatattttgcctaatgcagtgggcattgaactggttcattcgtaaactagtcctatcagatctgtttggatcaatttggtatattgtatgtgctaatttcagtctgatgtggtccacaggccaacaccaagacaactcgtcaagatgtaaaaacttgctctaaaagatgtgatttctggtctgtagccaactgttctagactcaagaggtgtgcaggcatttctagtgtgtcttcaaactgcaacttatgacagctaaggcctttttgttgacatagctgtaataaacattgtccggatacatctttgatgcagaggctggatttatttccgtaatccagttttggtcaaaaaaaaaaaaagacatacaccgtcatggtctagcacctaagcaaccactgcaataagatcacagaactatcttaaagtggtttggtagtttgttgcaccacactccttgtgggaacatgattagtgtggtggcattcttttcttccatgatgctacagtgtatctgtaaaatcaactagtaaggttaagaattttatatctcaagttgtatggcatgttatgctcctctttcagggttatggtatgactgagacttgtggaatcatatcgctcgagtacccagaaaaaggacaggctcgtgaatttgggtcaactggcacgcttgtctcaggagttgaggcaaagattgtcgacataaagacattaaaacatctaccgcccaatcaagtaggagaaatttgtgttcgagggccaaatgtaatgcaaggtaaaatttgaattatacatttgatcaattattatacactggttctcaaaataactatttcaaataccagtatcagtctaatactataatcatattacaatggaactgtagctatttatttgtattctttgttttcaattgtacattgagtcattgacaatgcacaatttaacaaagactagtgatgtcgagcatacaaaaaatatttgaaaatattccacctactagacctcactatttttcactgacaatagatcccaatatatcttatgcattctgtcctgcaataataatagaacaaaacaattgcttacctatctgaatgttgcgtttgtagggtatttcaacaatgtgcaagctactgaatttacaatcaagcaagggtggttgcacactggtgatcttggatacttcgacggaggaggccagctttttgttgttgatagacttaaagaactgattaagtacaaaggtttccaggtaaagaaattgattctttttccctaaatacttttttttgtccaaaaaaaatttctggtcagcccctctacttatgttagtcacatcagggcccttgctaatactatgtaaattatgtcattgaatctcgtgctgatgagttttataagcagacttgaaagatcatatacatataggatcaattcagagtttgccgcaaggatagattgatatagcacaccaaaccttctgaaattgtcgtggcttactagaataatttcgtgcatatattatttatttattaaaaaaatgcttagcaggagctctttccattcactaaagaaagaatcatatagaatagagctggttacaatcagaacaccaaagagagaataatataggattatttctgggctccgttcgtcatgtatcttaacatttttgtcttgagcataccataacctcaccttttcttttttatggaatttcctgtcttttttgtttactctactgatagattgcatctactgagattacaatacactgaaaagccttttctctattaccatttaccaaagcacatatttatagatgggagttgtctgaataagatccttcttgttttagtatccactataacaatcataacaggaatccaacctaatgcttgtgttttgtcttgcttgagcacgcgtcatattttgtccaatatatggaaatagctaatcatctcctttattttacttctttagattgcacctgccgagcttgaagggttacttctatctcatccagagattctagatgctgttgttatcccgtaagttgaaccacctaaaaatttaagtgtttcttgctccttatgatataaactgttcgcttgttacaacattgttgttttggatcgttctctctctgttgtgccttgtttcttaacggagctctacttgtttccaaggtttcctgatgctaaagctggggaggttcccattgcctatgttgttcggtcacctgacagttcattgacagaagttgatgtccaaaaatttattgaaaaacaggtgaggctgatttggaagttggaaccttgtttaattgggattgtagactagtggaactttttagcagcatgagacaatttgggtaaagctcgtccagatactaatgttaatgaaacatggagcatcaattagtacatcgagtttcattcatatttttcttagagttctacccactttgactatacatgtacctggtaaaaatccaagatctaaatagcaagaatagtttgctgtgctggccaaacactggtattagcatccaacatttgcaatccatgaatgaacaagtattttgtgttttccatcgactgcatactaccctaggtgctaatatacttttttttgacacaaaggtgctaatatatttcactaatgaactgcattatcaggtggcgtactacaaaagattgaagagagttacctttgtgggcagcgtgcccaaatcagcttcaggaaagattctgagaaggcagcttatcgcccaagtgagatcatccaagttgtagcaaattaatctgcttctctttgggaatcaatcgtgcttatgttttgccttgattcagccattttcaaaacttgtccgcgaaggtttatgtagcattgtgaagaccacgtgaatgtatgatgtatcagaatggaacccccatactgtgcattataataatggaacataaatgccaatttcaagataacatactctggaaaggatatagtactaaagaaaaaaaaagctctgacttaggctgcgtttgttagttaggccttgtttagatctaaaaacattttagccaaaaacatcacatcaaatgtttggacaatgcatagagtattaaatgtagaaaaaaaaccaattgcatagttccgtgtaaattgcgacacgaatcttttgagcctaattacgccatgatttgacaatgaggtgctacaataaacatttgctaatgacggattaattaggtttaataaattcgtttcgtaatttacaggcataatcttgtttagttattagtctacgtttaatacttcaaatgtgtgtacgtatacttcaaaaattttacacccaagaagtaaacacggccttagggttcccaacccaatccctttcgcgcgcacgcttttccaactgctaaacggtgtgtttttttgtaaaaaaaaaatctatacgaaagttacttaattaatcacgcgctaatggattgctccgttttccgtacgtagggcactagttcctaattgggggaaacgaacacagccactatcctctagcattgagcctacaagtaccaacttattccgttccaaaaatccaatctagttagggataggacattacctctccaatgaatgtctcatccctgcaaggtcaatagtgcagcaagcggtaagctccaaaattttatcatgttaagatagagctaacttaagaagccaactcatacaacaggctaactacaaattatctataagctgccttggttagagcaagtttaatagtatagcccactactagctccaattcatctatagccaattcatacaatagtttcttactatactattaatatatggtctcacatatcatacacacattgtgtcttggagtccgtgctacagctgactacatatctatagcctgctgctcttctctccaattatttatctccataaaatatgtttatagctagttaatagcctgctattgtacctgctcttaaagcatacatacattaaatataacaagtttttttttgtgtgggacctacataacaaattttttctcatctcccgtgaccgatacagcgtggggcgctgtgcaagcgccggcgctaaaacaagcatccgcttgtttctcttccagcgatttctttctctaatctggtattaggctgattaataagttttggagccttcttaacggcgctattgtacctgctctaagtaggttaggtttatgggatagagggagtacgagactcgcgcatcaatcatttcattccatgccaaacacatgatgcatgtgattgacaattgtttggaggcaaaaggtaggggtagcgatgtgtgctacgctggcagccttgctgcacgtgtcatcgtggaggacgtacgtgtaggcaggcgtcttgatcgacgagctcctcggctcttctacgggtccggtgcttgtgacttgggagagatccgagagggtaaaccggccggcgagaaacgggaggaggcagcttgcgagcagcaggggtgcatgcctcttgcgggacacgagcgaaaatgccgtgcgcgtggcgcggaccgaatagttgatgggccgaataccggcacgagagggccgtggtttagcgggcccctcatggaccgtagtttggccttttaggccttaatttccatgggcttctagtcacgtgtgtgcgctcctaggctattgacggcatagatgtctatcaaaaccggtgcaattttactccgcttaaaaataagttcactttgctatatagcactctatccaaaggaaagatttgaacttagactagctgcgtaggtactctattttaggttgatatctactccgtcttgatcagaatcccacagtgagatgagatgttccaattccaattgtgctagtccctgtttgtaatgtgtaaatatttttcataaataaattagtcaatgtccatctgaatctagagtaaacacttgtaacccgcttgccattgtttttttttcattaaaagaaagaagaaaagttgcatctcatttagaattttaagattaatcattttcgttaaccagccttgttttcatgtctaagaagacgactttaaaaacggcctaaaataatctttaaaatcatatttcacaatctgactttttaggaactaatgaggtggaagaaacggtggccaagcttacatggtagtagcacgtatatcgtttcacatgcattggttgatctaaaaaaacaattacaattgtgtacctgtctctctatataaaaaggggaaatttaatacacttttatttgccagccagattgagttggcaacgaattcttaacaagaatgacaaaaaaaaaaagggaaaatgaaaagagaaaatatcatcgagcttttggtcgctgttaaaaaaaactcgacacgacattacttgcaaaattaagcctagtaattagcggtagtagtatgctcgtcccttctacaaacaggcgagagagagagtgagaaaatcaaaaacgataaatggcaatgcgcgctcgatcaggccgccgtgcgaacggctcagctagcagcgcggcatcttcttcttcttcttcttcttcttcttcttcttcgtctactgttgcggctggcccgccatgctgaaggattggctcttcatcgccgtcgacttcttcgccggctcgccgccggcgccggcgccggccatgctgaacgattgtccgcccatcgccctcggcttctttgccgccggcgccgcctcgtcggcaggtacttctgcggtcacccgctcggccttcttcttgttggacttggtcccctcctcctccgccgccgcctcatcgccggcggcgccaccagctgccgcttggttttcatcctcggaggccgcagcagccgtcttcgcctcaccggccgccaacctttccgccatggcgccgcctgaagcatccgtcttcgcctcaccggccgccatcctttcctccatggcgccgcctggtgccaccttcctggactccgaggcggcggagggggacttcccggtggccggcgcaaaggagcccatcatctcctcggggttcagcgagctgatccggatgacggacgggccgtcgtcggtgttcaccgggttgttgaactcggagcacgatttcctgatctcgccgtccttgccggtgatgaccttcatgccgctgagcttcgtcatggccttgccgaaggtggcgtcgaactggtcggtctttttacccatggactccacgatgggcttcgttcttgcgtccatccccatgaggcggtcgatggtgagcggcatcttcttgtccatgacgagttcgaagtagttggggtcgacgacgtcgggggtgatgggatcaagggggacggctcccttgtcgccgtccttgccgtcgcagaaggcggtgatgttggagcggtaggtcgggtcgatgggcgccgcgtcgacctcgatgaagaagcacttggccttgccgatggagtggccgccggcgaggaggacgaccatctcgtcggcgctgaaccccttctcggagaactgcgccatgagcttcgggacggcgatgtccgggccggggagcgagtcgccttcctcgcggttggagacgagcgagtcgcggcggccggtgggcacgtcgtagttggggcccccggcgaggcgcacgctgtcgcgcgtgctgagcgccacgatgtccgcgcacgacaccacctgcgggcactccttctccagctccgtcttgatctcgtcgatgatgtcgtagcccttcaccgagatgttcggccccgcctccttctccgcgctctggttcgacagcgggtcgatcaagatcgacgcgtcgcatccctacaccacccacacacgcacacgcacgcacgcatccaacatcacatgcaagtcagcatccgccattgccggcggcgggcaaggtcgtagaacgtgaacgtacattggcgaagcagtcgtggaagaggaggcggaggaggagggcggaggtggtagggtcctccttgaacttgcgctcgatgacggtggagacgaccttctcgacgttggggcaggtggaggagtagaagtcggcggagagctgggcggtggcgagcagtggcgccgcggcggcgacgacgccggcgaggaggaggaggagggggaggcgggtgtccatcacgaggggtccagtatcgtgcaatggtggggctcgttgcgggccgtgcttatacagagcgcatgcagaggtggtcagcgcgggagaggagtgagcggtcgaggcgcgcgcgtgcgctggacggttcatggctatcgcgcctttcgacttctgggggtgtaataatagcaggggatgcttcttcctgcttccctcagctcttctcggcatgcatagccacgttaccttgttcaaaaaaaaatgttttctggtcgttttctggtgtatcgacgggacgatcgatcggctggaggaacggaggatgcataattaatctaagagaaaatccaaataaatataattgacaagcacacaatttcaaataagtccaagtttcatgaaatgtcattgcatcagcgatttaatttgtctcaaaaatatcatcgtcgttaatgttccgttagtacttagcatctctccattaagtgctataggataaataatacatttatcgtggcgggatgatcgaaattctaacggcaatttcatcaacggtgcagatccagatccggatctaggtgctatggtggtccctatatggtggcgtttggtggtagcgatggttcagctccacgactcggtgaagctcagcggcccggctaggtggaggagcgggtcatcaacagcgctgtccagtcgtggtgcgggttgttgtggtgtgtaggtggtgtacatagtgcaagtagtttcgatgtgcaggtggcatatggttggataggactccaaggtgaaagtcttgcttggcttgacggtgctagcggcggcgacatcctctgacgctgttcactttcttgaaggcgttgctatggagtcctcattcaactccacatcaaaagatttcttcgggtgaaaaccttatattcgtttggattgggcgatgtcgtcgttctgttagcgtgtccttaaagctttgtttaggagttttttccttattggatggttgttctttagttcagtaagtcaacggcaggatttttgccggttttatataaattaaccgtgccgttgtgagatttttagatctgttttttttatagactctcttttttctcttctatagtgaaatgtgggagcacctcggaaaataacatccatcagcaatgtctcttaaaaaataccatcacctctcaaaaatcacaagaggaaatagatacacaagagaagacgaacaaaactaggaatttcgaggaggtagaggtgaatgtatagatggccaaaaggcccgaggcccgatggcccggcccatggcatggcattttggcccggcccaagcacagcaccgggctgtgcctgggccactccaccggcacgttgggccagcccgacacaaccggcccggcacggcacgatgggccggcagccaagcccgatacacaaaaaaaaataggggagtaaaaatagacatattatatgccttggacgaaagaaaaggatgtaaaatagacttattttatctatacatatgtcagcccaaagaggagggatggaaaatatacttattttagctatatatatgtcagaccaaagaggagggacaaaaaaaatagacttattttaactatacatatgtagaagcccaaagaggagggacggaaaatagacttattttaaaaaaacccgatgggccacccgtgccttcgggccgccacggtacggctcaacagttggtgggccatgcctgggcgggaggtgcagcccatgggctggcacggcccggcacgaagtgccgatcgggccgtgccggtccaatagctggtgggtcgtgcctagccgtgcctgagctgggccgtgccgggcgggccttttggccatctataggtgaatgcaatgcagcaatcagaaaaaaggagcacaactcttaccccttcgaaattccttcacgccttccaacaaattcaatcaaccactcccatttacgaagatgcaacttttctacataggcctggtttagttcttatttttttcttcaaactttcaacttttttatcacatgaaaactttcctacacacaaacttttaacttttctgtcaaatcgttctaattttaaacttctaattttagcgtgaactaaggcacccataatagaaggccaaatcgtcgtcgataagctgcagtcttcagtggggaagaagccatagttggctgccagtatcgccgctcccagagacaatccagagcaccacacaggcactatcgaggcggcttgtgcccagcggccgcgcgttttccgcgagcgacgccacccagagcccccgtccctcgaacccaacccgcccgccgaaggaagacacacaggcggataggggcacagccccgcggcggcgacgctggggcatcgggagttcagtagatcaactgcctggatcaacgacggcagcctgggtgaaggtcttgccgaaggttcacgttgacaaaaaaaaaaaacaaaaggaaaaggttaacggaaggcaactcacgttgattgaacggcgatggtaaaaataacaaaaggagaaaatagcttataccatggtattttgtagagcttacatctctatctatattatcataaaatttattagtggtaatggttttgtcacttccacctatcttatgtgctactatttgcttcctgaacagtataatacattgtttatcgtatcatctttaaccagagttttaaagtgataatttattattatatcaccgttaatcagagctggagaatgatgattaattttagttagctgataacccatttaatataattagagcccgttgtaacatatggatattttgctagtatcaatggtatttcttagaatcgatggtttgtcgataaacaatcttagaaatttcccctttttccataagagcaggtacaatagcaggctataaatcagctgcaaatatattttaagtagataaatgaggagagagaaaggtagcgggctacagatttgtagccagctgtagcacggactccaagacgcagtgtgtgtttgacagatgggaccagatattaatagtgtagtatgtaagtattgtatgaatgagctattagattgattataaatgaattggaactagtagttggctatactattaaacttgctctaatggcaatggaaaattggtggactcttcaaaatacattggctgattggcggacgaaaggcctagagaaccaccactccaaaagctttaatgaagtgtgaacgtgtgattgttcaaccgagatgcatttgcagtttttttctggtcacctgaagttgaggataatcacaccagcgtgtaaagatgttcacaaagaagttgttcgtgtatcccatattcccttgtttccttcatagccaaaaccaaaaggcaataagggaatcagatcgatatagaagtatggaaaattttgctaagacaagtagtagtatatcatataactaaggcaaatatccaatacaaatgtatatgcctacaataagcatgcaaaaggctgaaatttcactcagatcaaatgctaactacttcaaaatgctttaaacaattacatgacgttaaaagacgtcttttctcaaccatggcggaacagattaaaagccggttagaagttactcggggagtgatacaggtctggtcagggcacccgccactctaccaatcagactgcagcgttaaatcggaataaactacttttccaatgcccactaatttacaggccatttacacaaaaaaataaaaaataataaaccaaacacgccagacaacaatcaacaaacacactacactaatgctcgtgcttcactcgccctttcagtattcctggaatagggggtgagcttggcaatctagctgtaccattagttgatcttgcaggttgctgcacttgctgcctataaatatttggcatgcttgagctctcacctccatttgaaattagatcatgaataccgtcgatttgttcttctccacaagaactcattgctttcagtacaaatgagtcatcatgcaactcaaatggtgtgctgcagtttcagaaatgtaaatatcaagaacttacgctgatctaagggaaatctaagaggctgcaccgatatcaaattatttctttcaacaaaaataaaaggcatattttgatatgtttcattcatttgatagttccttttagaaagagtaaattgcactcatggtgcaagaacttgtcaggtgggcgtgttttagtactagaacttgaaatttgagcatattagtccattaacttggctatatggtgcatatttgttcaaagtgaaggccacattacatatttttgccacatcagcaagggacgctgtcgattgcacatcaggcacacaaatcgcttatctcccatcccaacaattttgaaacaaactcccgactatttttcatgttctaattgttccagatgatatataatgtctgcttctttccatttattatgaattcacgactcccaggttgatccattacttttggtgaactatgaatcttgtgaagctagatcatctacggcaagatgtggcaatgcatatcattcctgttcacatgatcaaactttggaaatatataggcaaaaatcgaacaggctagctaactcaaagatgttactgtgtgcttcgtcagtggtggtggcgggtgatggtgatgctagtcttctcgaagcaagcgttggccttttagatcaagctaaatttctactgtctagtttcattgttcaattgacagtataactatgaattgattcatgcatcaatcaagagattacagtgccctctatcaaagctaaatctagacctatagagcttttgatttgatattgttaccattgaactggggatatttgctaaaatgaaccttcagtctatctgtcgtttgaaggaagaagcaaaaacatgttacatgaatgacatgtcttgctaacgtggccgaaaattccgtgtggtattcaccttgaccaaaagcgcaccgtctagtcaagttggtgagccagtttgttcagttttcaagttcttacaatagaatgcacccacctaacaaattcttgtaccgtgaatgcaatttactcttttagaaaagtaaaatgaatttcacacttgggctctcatcttcccaatttaggatgccaatgtctccctattattcaagaattagtgatatggcaaatgtcactaggataatgaggacctgcgacctgtaattggactaaaactagatgacttagctcaaccaataaaagctaacaacacttttcaaaagtcacattatttacacttccgcttgtaccgtcccatcactagaggtttggagacaaaaatctctaccatccaaatttgatatagcagctgagattttagttcttttttacagagtgaattatattatattttaagggttaaaagaccactgccagaatttaaatgagataagaggatgcccttccagtgaggaccttctgcaatcatatcatgaaagaatagaaaaatggaaacagaaagagaaaggtgtggcttgctagataaattgtaaaggtgtgaccagatgggagagaataacaggattcttgttttacctattaaagtcaaaatgtacaagttgcatatcttctgatatttcaacttccacagttgcatgaggccgtgtctgcatgattcattcttgtcatttagcctgaagtcatgtgcaggaaacagtgccatgaaacaagagaatagaagacaaagaatttatgaactattcacctgaacaaggataaatggtaatgcaactccacccgagggaatgtttcctgaaccatatagctgttcatttctttgtatcaacttttgcatacctacaaacttaacatgccaaaaacaatgttaccgagtaagggcattatgtgtatcacagtatctaccactaaagccacacaatttgaagactatggtacactgctagctcagtagaacagttcattttatatattgcattggacatgactaaagaaaagcaggttgagctatatcattacttggtcttgcagctcctgcaaatatgtatttttcttctcaatcctacttttcagtcctacaagttccgtctgtaaaagagcataaataaattaataaatatgactaccaaaagtacatcaaatgtcgataaccagtgggaaaagaagacgaaaaacctgcaaatcttcaatatcatttatactggttcgaggcaaccccttccactgaatttcctttttatctttagatataatctccatagccatcagaacattcagagcatcataaacccttctccgtatatttttctcgtcatattgttgctgcatttaacacaaagtgagcatacaactgacttaagaaataattggtgatgcaggcaagtcatttctcaactgcattgggattatccggatctggtggcaaaatgctgttattgggatctgcaaattcggcaacaagttcatctgccacctgataaagataagtcagaaggactatgagacttggacttcaccaataagggtaaacattgaaaactatcaacaaatgcatagccaaaattattacaactttttgccagagagacaaaatatgatagtttttagcaattttgaggaactccaaacatgaacatgaatagatgcaaagacagattgttagtttaaatataacagtagaagagggtgatatgtatagcggatttacaatgatcaatatggtggatgtcacatattacaacacatcaccatagtaagatctgagcaagctgatcaaacagcagtgttacataagacatgtgagtgagttaccaattttatagccccaaatcatgatgcggaacatggcagttttatagataatgaattgtttgacaataccaccaggtggacggacaatatgaacatgttggcttattggagcaatagctagtcctgccctgtgcatatattgctattaggttttacattgcatacatagcctaagtcctcttgaaataactgattgaatcttcaaggatagagttaacaagaagacaactatgcaaagaaacagggagctgacacatgcaacatttgtgatctcaatttgctgcttcaatccatgtgatgtgaccacgtacatgatgccatcagatgctcagaacaagatacatgaactcggtagaaagaggaaagcactaacctcgttgtatgttgttctccctttactttcaactttctcacaaactgcaaaagaacaaacagtgtcatcatgagtttttatagcacatacttgtggtgcttataaataaactcaaatggtgtactaatagggaacaaatgggatttaacacacctttcatactaaactggcgcagccccctgccacctttgtcaggaccaactgctcgtgctcctctcttcttcttcttgctgaataattttattcatagcaaaaacccttattgcaaatgcacaaaactagataacaatgaagggatttattttttgaaaaggagccttaagaggtagagaacttctgccaagtcgtacttccaaattcataatgcagaaaaacatgcactggcatccaaacagcagtgttctacagtctggaatctatgtagcaaaagaggtcacatgactgatgttttactgatcatcgtgagtacagtatacacgtgtaatagactacagatgagaactactccgtatatatatagaattaacactttcagcaaggtaaacctacagagcataatcgtataagcatccccagaaaatcttacttgcaaccacacatcaaagtgatggcaggatacacttccctaagcattttgcagcccaaacacagctaattacaacactacggacaattttaaccacccggtgcatctccggagcattttaagtagcgtacagctacagagaaaaacaaaaaccaaccaaattctcaaaatcttaaaatcttgtaataacattgggaaaaaaacgcaaccccgcggcgaaaactggcaaaccaaacgctgacctcgttggagcctgtgaggaaggcgcatcgtcgccgtggatgtcaaggtcgttgaggcggaggaaggtattctcactaatcggagtagaggccgccgccgcccccgccgccatgcctgcggctgcggggacatgctgctcgctgcggctggacggggagcccgcgctcccgccgctcgtcgaagcggattgcgctccgcccgagggcggcggcgtggccagggacggccgcgcgccggccggctgcggcgggcgctggaacgtcgaggcggcgcgcccgccgtcgtcgtccgggcggtgggcgacgccggagaccatgggtggccgagatcgcgcgaatcggggaccagaattggggaggagttggagcgcggaaaccctaaaacgacaaagagggggcaaattggagggagagaaagaaatgagaaatcgacgagagggcgggcagagacgcggagacgagcttcttttctcctctttgcgtttttgtttctttctttttatttttatttttttttcttatgaaatttggcggtttcggctccgtgacgcgccggctgccggcgcctgaaatgagcccaaagcctagtgcggtgccaggtggcctcatcgtctgaacccaaagcctagtaggaatgagaacttgggaagcgcgagcatttccgacgaaatcagcctctccaaccattcacatagctaattcctctcctgatttggctatttggtaagccagactcgcagttttttcatctacacttttcatttgggtctataacagtgagacctatgtatcaatccatcacttttttttttcggaaatccatcactttatttctctccttctccttcctcccacgtcccaaccactactccgtacctccatcctcaatgcaatatcctcccaagtgccaaccactaatctattcctccatcctcaatcctccaccctcggtagtagtggtgggagggcgaggacgacggcaacattaagcaagccgctacacttgcgtagagtgggtaggcgatggaggaagctagagttgaggatgaagatgtgtaagagggcagggagatgtatagataaatggccaataaattcaaaatcaatatttgtttagtagtaaaaagtaggccacaatggtgataaagctattagcgcatgattttatccattaaagctcaaatcctactgctgatttgcatgtattcctagagaagttgtaaagcctatatacttccattatcttaaaaataataataataataataataataataataataataataataataataataataaacaacgttattaataagtcatactacacgttgaattcaggcccaaagttccagttgaacccaatacaggcccagtacacatggataacaccacgtgcgtttaggtcttttaaaatacaccgaattgccgaataaaaaaagcgttttttcggcccaagtggcacagcgttaggcacgtcagcccaaaactgacctcaccgccgcacgcggcagcccaccaacttaggtcgttcttatccaacccaccagctcatcgcaagccagtactagtagttctagaacgttcgagaaactgaaccatcgcgcgtcgctgcagcggctcgccggtttccgagacgtgggcccacacccacttgggcccttgatgggccctacttggtccaaagcgagcgcggcttccgccactggattccagcgaaggacacgtacaccgcctcccgcacgtagggcccatttttgttcgagaaaagtgaagaaaaaagaagggaagggccagggcccacgaccatctcggcacacgtcgccttccaccttatcgtcacagcgatcgtcacacggcacacgataattttcgtcgcacaaatcgtcgcctcgtacgtgtggttcccttaaaaagggaaaacgtcgtacgcgaggactgaagaaaaggggaaccaaagccgttgcaattaccatcctcctctgactggaaatatcaacgacccctttctaaaaaaaaaaaacaactaatgccaacatttacttgattgatcaccgtgttttaccatagtttttgctctgaagctacgtggcaagaaaggacagtactgtatctctgtcacgtatgagccgtggccgcatagaaactcgaacattgtgacaaggtagtactgtacaaacttgagttgtggagtaccaaacagtatctggtcggtgacatccaaccaaacagctgttgatcctatctaaggcaagtagtactgtactagtactaaagtccagtacactggctacgtaggagtacacagcagcaaaggcaccagcaaaatctacgcgatgacgccacgtgacatgacatcgcaggtgaccgtagccaaagccaaagcaccagccgcggcaggcaggctggctttgctggtgggaaattaccggccactgaaaggaaacttgcgcccgacgcgtacacggatccgcacggcgggcgggcgagcggactgacagggtggccccacccaccccaccgcggcgtctacggtttctttctctttctctctctttttttttcttcttcgtctccgtcgcctagtcggcttcgcctccgcttcctcgtctcgtctccctccccctatttatccccgcccacccagcgccgccattttattcgcttcgtcagaactcaaaatctcaaattccagacttccagaggcgagcacaggaggaggttggaaaaatccatccatgggggatgagaaggctgctccgaaggcgggcgccaccgccgacccggtggtgctgaggatggagttgcattgcgccggctgcgcgcagaaggtcaagaagtccatcaagcacttggccggtacgcatctcggtctcgattattcgccgctgccgcctctcgtttctttctcttttttctttttgagccttttttggggggttcgatttggtgtctgggtgtctgaatttttgggttgtctctgggatcgcaggggtggagtcggtggcggcggacgtggcgacgaacacggtcgtcgtggcggggacggccgaagcggccgcgctcaaggcgaggatcgaggcgaagaccaagaagcccgtcgaggttgtctccgccggcggcggtggcgccgccgccaagaaacccgccgccgagcccaaggccgtcaaggacgatggcggcgagaagaaggacgcccaggcgaaagaggagaaggggaagaagcaaccgccagaggagaagaaacccaaagaggtcggtacacaagaggcaaccctaccaacgccatacgcatacgcttctctgctcctcccaactactcgtttgacctgagaactcaaaatgtctctctgctttgttgttacaggaaacggtgctgctcaggattcgcctccactgcgatggctgcgccgaccgcatcaggcgacgcatctacaagatcaaaggtgaggattttatttttttaattaatctttcctctgtcagtttttgtactactctcgttctgctgtttgttttgttgctttggctccaaaactgacgccttctggcttttgctatgtgtcaggggtgaaggaagtggtaatggacggcaatgccaaggatgaggtgaaggtgtcgggcacaatggacgtgccggccatgctgacctatctcaccgagaagctcaaccgcgccgtggaggccgtggcgcccggcagcaagaaagacgagaagaagaaggacaagggcggtgacgccgacggcggcgagaagaagaaagacgccgccggcggcgacaagaaggacaaaggcaagagcatcgaggtcgccggcccgtccaccgccgccgccgcggcgtccatggcgccggcgccggccgaggcgagcacgtaccacgtctcgccgtacggccacggctacttcgcgtacccgcagcagcagggacctccccccagctactaccagtactacggcggcggcaatggcgacggcgtgggctacgccaaccccaatgccggcggcgccggcggctactaccacccccaccccaacgacgtccctacctaccagccgccgccgtcgtacccgccgtacccctaccagctcgacatgtcgccggcgccgcagctgttcagcgacgagaaccccaacgcctgctcggtgatgtgatcgccatgtctccggcgacagagctcagaggccaatctgacgacatgtacataccgaggactttagacttagaagatcagaggcatccaccaaacgtgttgttatgctttcgatcaatttttgtccaaacttaccccttctgttgtagcgtcattttttttagatcaattcttgactggttaagcgaaatttgattttaactagagtattagcggatgaaatggactgatggagtgatgatcttttggtcgcaaaatgcgtgcctagtcagagatgttggttgaatcgtggactagttctgtcttggtcgcgttgcttttcatcaaagacgtggtgtttaaccaggcgattgtaaattaaaatatatgattaaatcttcgttggtcttgtgctgttcgtgaggggcaaagaaaagtttcctcaaacgcggagtagtttaattttctttcaaacgattcgtggcggcaaaattgatctcgttcttccccgtccgacgtggcgccgacgaggacggatagctacgtcggtgattcggattcggatattctcccagctctgtgtgtaagaagtcttctccgcgatattatttgatgttctctgtgtgctacctggttgcattgccgttgcgattaatcttcaaatttcagattattgcggcgattaatagttttataattgaagacacacatctttttcgatgtgaagctttggccatgcgtgtgcaggccgtcgttaccatcattcatatcccttttgacatttgagacagtaataaagggtcggtaaatccaaaaaccttttcgtctttactacgttaactctgattcgtagaccatttcagaacaactgcattttctgatctacctgcaacttgtgaaatccagaactatcacctcggcaatatttgtatacagcaattctagctctgtgatctacacatgttctgtgcaattttcacatgggaataagaaaaaaaataacaaaaatttcagcgttccagacagggagtcaacaatgttcatcaaggtcttcgttatccggaatgaaatgcccacgtccttttcgcccacattttgcaggtttggcgtgccacacggtcacctaccattgaagcaatccaaatcactaacacgcccatgtttgaagaacgcggcaattgataagagaataaagaaagcgattagactgcactagctttggaatatgaccgtattaagcatatttagactacgaacaattagtcccgggattggactacagggtcagaggggtatggtctctctccatggggacacgtgtcctgttcatgattgaaaccttcctggtgaattatccttaaatatcattttcttccactgtctaatctcacatggaaatcctaataatcattttgttcttatatatccgaaggttatccattccgatggcctctgctcttaattaatttgtgcagttcttttaatccctgatgctgttgcatcgttgatccgttgccaaatggaggaaacaaaacacacagcaaaactattttttttcatgctctgtttttgtcttcatacgtgtgcctgactaagaatattctcccaaatggcaattaaatatggcgttgattaactcaggcaacatgtcagaaaaacacggacttctgaaagctgaaacttggaaaatgttggactgcaattcaatttctggaagtagtggataacctaatcctgtacgaacaactgctggatatgaatctcttgtcggtgtgctgattttccattagttaattgaataattgagtcggtgttttctttaattatggtttggggcatgccgcattgccgccctgattacgcaaattgtttttatattttttgtctcgtgggtttacgaatcggaagaattgggttgtgtttagatctaaagtttgaatccaaacttcagtccttttccatcacatcaacctgtcacacacacacaacttttcagtgacatcatctctaatttcaaccaaaatataaactttggatccaactaaacacagccttggtctgaccggattgcaatgccggtcgttgtgcactagacttatttttttttaattttatctacattcatgttacattattcgataatatcataatatggcagcaatatggtgcttttatattttagggaaatgttaaaaataatatactccctcatttcctaaatatttgacgccgttgacttttttaaacatgtttgaccgttcgttttatcaaaaaacttttgtaaaatgtgtaaaactatatgtatacataaaagtatatttaacaataaattaaatgataggaaaagaattaataattacttaaattttttaaataagacgaacggtcagatatttttaaaaaagtcaacggcgtcaaacattttgggatggagggagtatgtatcactggctgtgaggataacatcgccatgtcattgggtcgttctgttctctgttccagcctcattggatgagaaacacattaatattcaaacaatatcatgaatactgttggtttggtcagcttgtcctagtcggatctttggacaaattgacctgaatcgagctggcaaccgtgctaattttcaaggaaatcaaaattttgaaagaaacaaccaaccgaccggtcaccggtgatcttatattcttatttgaatagtacttgcagaccgtcataaatcacaacactttggttgtgtttagttcgtgtgccaaatttttttagtatacggatatacatttaaagtattaaatgtagactaataacaaaacaaattacaacttttgcctgtaaactgcgagacgaatttattaagtctaattaatctgttattagtaaatgtttactgtagcatcacattgtcaaatcatggtgtaattagtctcaaaagatttgtctcgcaatttacagtcggactgtgcaattgttcttttttcgtccatatttgatgctctgtatatgtgtcaaaacatttgaagtttgaaaaaaaaaagttggaatctaaaagacggccaatgtcttgtaaatttaactgtctgctacgtttgcgcaatgcagtgaagttaagtatagttcaatgctcccatgttttttttttttttttttttttgagaaactttcatggaaatgtcactgcaactgaattcaggttctgtctgaattggattgcaactagacatgatccatgtaaactcccgcctaaattgaaaggcaatctttgcactgccctttaaaacctttttcttctttagctcaaatttccttttgactttcttctttcttctttatgtttccattttttatttacccgcaataaaaagaacaggggatcacttttcactagggaatctatcaaaaaacaagaaggaaagaaacaaagacagtttcagactttggtaagggcagtgggccttgctcatttcaccctttaatcacatgtttgggccttctttaatcccagatttggcactccaaacttgtccactttctgacagccatttccctgatggcaggtagcttctgtgtgtgccacatacctgcatatgctggatgagtggctgccaaccatgatcctggaccatttcttccattctttcactcatcctggcagcttcaggtctggtgagaccgtgagagtggccagatcacaaacttttggctcaagtgaccaactgaatctgaatgtgggtggcctgcaggtaagtgtcagtactaacttgcaaggccaacaatcaactggttactgatctgatctagtattgcagcacattattttcctgctaccaactgcaagatcgtcatcattcttaggcctgtttagattccaacatttttcttcaaactttcaacttttccgtcgtatcgaactttgttacacacacaaactttcaatttttccgtcacatcattccaatttctttaaatttccaattttagcgtggaactaaacacagacttatgccagctgtatggcttcgtttgttaattgttattattgttaactttgctgattacaaaagagtcaattcatgcagttctttctttgttttatgggggctacttgtatgaaattattgaaatctgtaatcaaattgcacacagtcagaaaccggtggttagaggccttggtcctgaagtctcaactgtacttccttgaattcgctagataaatcacagaagatgattcgacgcattaactaacaccattgagttcagcatcatgcatcacaacgaagagatcaaagtttcaattagtaccacacaatgatcttgactaacaataagctccaaaccagcgtacagagttacagacagttttatttggcgtgatctagactttgcaagcaacaatttgggcgatagagataagaagggaaaaaaacagaggcacccgtactaacacaaaatgtcagctgatcatgacgtactgtttaccttcctatgatctgaagaaacctcacaatagtgttaactgtttactgcgatacctcaaccatgcaatatataatttttcttttctagatttccactatgcttgtattccaattaaaaatactactatcttctaagattgaccttagttttggattcagaaccaccaaaatccaggattgaataaaataccacaaataaaatatatccctagcttgaccttacttttttattgtcccttcttctaccatgatgaaagggttgaaagccaaacaaaaaagaagtcctttaagctaaagttaaagaacaaagtggatcgcattgcatggccccccttgacacatcactttcgttcctctatttcttcagacatatcatcacttgtatcaggtttgctgcatacatgcaggagaggatttggtggagaaagtgaaagtggaagaaaaacattcttgcacgagcagagcacactactgcctgatgagtgttctttgcgatccaactttgtagaattgtaggtcaccacagacgctttacgcacatgtgttgttgcacgcgatgtcgcatgctttgatccagacatgaggagacgaaatgcgtccatccaaatttctggcaaaagtgtcgagggaagcatcgaagtttcaccatagtttacttgaagtttcgcaaattaactagctagaccttgcactttacagtgctgaaaaagttgtaaaactcgcagcggcttcacaattcagttaggaaaaatgaaaccggatatataggggctgttcagattgatactattttcaaacattctatttttttttgttaaagttgcaaaaaaatgtctacatctagtttgttttcaaatttgataaatacatatgaattccagccaaaattttgacaatattgacatattcggtattgccaaaaattagtaagatttatttggctacaatctaaacagatcttattttttggcccatgttatcaaaccggcccattccatttccgaagtagtatcacgtcatttctctcttaatatacaacaattgtgctttttctgcagctccgtcacctccctgtcactgaagttccaaagtaggaggctaggtgcagataacttgtgtcttgcaagtgtcatagatattgtcatatattcaaacaaaataattttcagttcacattttctcagtgctgcaaaaaatgtaaaactcgcagcggcttcacaattcagttaggaaaaatgaaacagaatatatagaggctgttcagattgatgccattttcaaacataccatttttttaaaagttgtaaaaaaatatctacatctaatttgttgccaaatttaataaatacatatgaattccagtcaaaattttgataatatcgacatcttcggtattgccaaaatttggtaaggtttatttgctacgatctgaacagaccttattttttggcctatgttatcaaaccggcccattccatttccgaaatagtatcacgtcatttctctcttaatatacaacaattgtgctttgtctgcagctccgtcactgaagttccaaagtaggagcagagaacttgtgtcttgcaagtgtcatagatattgtcatatactcgaacaaaataattttcagttcacatttttttgtggctgaaatctcaacggatgaattcccagaaattcggacaataacacaccattgtcccctgcaaacttctaagcaaagctctatgacttgacagttcgtgaaactcgtcctaaaatccaaaaccggccggaaattccaaagggggatttgacaggagtgataggcctacatgagcccaaatgcaaaaaggccccacaaataaattcagcctaagcccactaaaattctgtggataaaatcgcatctccgccgtgtgacactgacaccctgacccaccagtggggcccactagccagcggcaacgacctcctcccccctcttcggcttcaccgaccaaaccaacacaatcgcgcggatcaacagactcgagtaggggagagagagagagagagagagagagagagagagagaaggcgacgcggcaatcgatctgcccgcctcacctccggccaccgaccaccgccgcctccgcgtccctctgcctcacctcgacgccggctagcatcgccggcgatgggttgctcctcctccgtgccaggttctctctctcacacgtttccatcccccttttttagattagatttcctcgttggctatgtttcggctgcggatattgttggtaccgagtgttaggtaagcaggtgttgccgtgggggttttcaaattgggttcgattcgtggcttgctgctttggaaaatgggagggagggaccagcttttttatgctgaaagctgattggggataaatgttttcggtcacagcgttgatcggggcgaaaattcgcgcaatctggacggttttgaactgtgatttagtgaatttaagtcaatttgtgggttaattggaggttagagcagggtgtctgcacgatctctatgaatgggaggatcgtgtgtggatgtatgtgagtgggggctggggaaagtttgtagctggagtagaagaattagccattttccgccatttgttaacacatagcactgttttgtcatccagctcgaagcactggagggttgaacaatattagcaacgataactccgctactgattcaaaggacttgcgtgctaaggtttactgcacattttgccctttattactacaataatgcctctatatcatgttactagcagctttctttaacgtgtccatccttttgatgttgtagttggtattgcttggtgactctggtgtagggaaaagttgcattgttcttcgctttgttcgtggtcagtttgatcccacttccaaggtgattactgttttgagtctcttagtttcagttgataatgttattcttcaccttagatgcatgattcttactttcagaagttcgattgttttaaacttatttcctcaaataatttcaggtaactgtcggtgcatcatttttatcacaaacattggctttggaggactcaacaatagtgaaatttgaaatatgggataccgctggacaagagaggtacacatacagcactatggttttagcttcttccaatcttgggataatggcatgctgttggtgcattagaagcattggttttgtgagaaagttctagtagtatgtgttactgatttttacaattgatccatcttacgtgccacacatgcatatggtttttctcaatcaagaactcattggtaccagccaattttaggtatgctgccttggcacctctttactacagaggagctgctgctgcagttgttgtctacgacataactagtccagaatcatttagcaaagcacaatactgggtgaaggtatgctatcgccaaattatctgcttttctgatgtctggttgattgattactctttctatcttttactatgagtttgtattttttgcccgaaactgttctagtaaaattttatatcatactgtaagattgctgctaaaatattataaatgtgttgaagcttatgctcaaagattaccctgactagcgtgagaagtgtatataatatgaacacttgcatttaatcttaaaatgcaccttctagatttatttcatcaatatcaattgattcagtgagattgtaccatgtcgactattgtgaagtatgttatgtttccacttcttttttcaggtatgaagcactttcagattgttttttcttatattgcaggaacttcaaaaacatggtagtcctgatattatcatggttttggttggtaataaagctgatctacatgaaaatcgacatgtatcttctcaggtcagatcttgtgtgaagttgtagtaaacatagtatcacaatatgctgcaaaattgttttgacgatatggtgcacattctgaaggaagcacaagagtatgcagagaagaataatatggttttcatcgagacatcagcaaagacagctgataatataaaccaagtatttgaggtatgccccctagcatatgaagctatttgctttcacgatgtccaagaagcaggatagctaacaagagaacatgctattttatttcaaattaatcaagctgaacaaaaacaccaaagcttcaaattcatggaaatcctaactgtttcacccacccccttacgtgtaagcattgaatggacagctactgcgttaggccatcaatggtcatcatcatactaactcgttatggtatgatatttttccattaacaggtcaccgtttttgcattattaattaaaaacagaaagattcctgagttagttagaagaggtttggggtatggaagaacagctctaacctcatattaaactctcactaagtcactagcacatatatgtgtggataaacaatctcagcacaagaatcagtgattttctctgatctcgcctaaggatcaccacagatagggacagcctaatgtgggcattttaacaacaaagttcaactctacacagcctacgccctacggataaacacttcgttgcattttcatcagtcaggttcctggacattgtccacatgcactgtcaccttcatgttcttttcctattgatgtttttatcctcttatgtttaaatcttttgctacactacatagctgggaaaagaaactttgtgaacgtcgtcctcataacttgatcatgttccttgtacaggaaattgcgaagaggttgcccaggccaacggcgtcttgataattagcttcggtgtttgttgaagtggaacacatacaagctggtaatgtgcatgtaacatgtctgtcagggcaaaaactgctgtatggtcgattgtttggaaaacaaaggatactgtacagtttatcccattgtgttcaatcgtatcgtattgtatatgttaatagtgccgtcgtgtaacatcttagtttactaaaacaatctaatatcggtactaaaaaaagttgcttagttgctgtgcctgtgtacacccaccacaccgaagtttcatctaaacaagtactccgtgtacaattgcagatggctaacctcaaacagacagaaacttttgccttttacgctctacaatttgtgcagtataatgaattaatgccacgatcgcatacgaacacgggacactttccttacaatcgaaggcagcaaaagatgcgaaacttctcttccgagccgaacacatgctcctattcctgcacgagcaggcacaagtgaacaacaactacctgatacactgacatgtcgggcccacactctctcaactcggcacggggccccctccatcttccgggacccacctcatccgaactctatgtcgcgtgggccacgggcctcgtgggacccacatgtcatggacctccggggactcccgaaccgagcccaacccgtaggacggtaggaggtcgaatcccaaaccccttcggcaagaaaggagctatttaaggtagactaatcccctcgtcttcccccacaatcacttctccccccggaatatctccgccaagagaagagaagagacacccaacaacccaaaacctagcgcctctgcgctcgaggcccccccgaatccgcgaatccgccgactcccatggcgagccagggagagccctcctcctcctccgatccgtaagtttccccccttcctgatctagccttttcgatctggtagattatcgaatttttgcgatttttttgcgatttttttgggtgattttaatgttcgtggggtggtggtggtgttgtgagcaggaaggggaagaaggatttctcgacggcgatcctcgagaggaagaagtcgccgaaccggctggtggtcgacgaggccaccaacgatgataactccgtcatcgggatgcaccccgacaccatggagaagctccagcttttccgcggcgacactgtgctgctcaaggtttggggatccttgcctctgtaattcttctgttaagcttcaattgcgagggtttgaaggcctaatctgtggtgcttgtcctggatagtaggaactgatggtctgaattgtgaatatgtatgaaaaaagaacttagctttcttgtctctaagcttaggtttgtgtgtctactgttttgtagaggataaattattagtgaggttgaatgtttgctactttctagtttttgcccctgatgttagccttggtgtagattatttattcagattacatatggttagattatatgtattcatgactcatgactctttagcttccttagtactaggttgttacagtaattatgctgtgataagtgatcctctaatttgattgggtacagcttacaatctgtaattatgtcaagattattgcagttaacttctaaactgtgatggctattcactaggtagcttcacaacagtacttatttagttttataatgccatgaggtcgggaacttgggattctgttttgcattgtatgataattcttgtgtcatcaaggcatattttattatttgctgctgacattttggctcactgcatcacagggtaagaagagaaaagacaccatctgcattgttcttgctgatgacacctgcgaggagccgaagatcagaatgaacaaggttgtcaggaagaacctgagagtacgacttggtgatgtcgtgtctgttcatcaatgcccagatgtcaaatacggcaagcgtgtgcacatacttccaattgatgatactgttgagggcatcaccggaaacttgtttgatgccttcctgaaacgtaagatttctttatcactgaagtattttgatttttctcttatagaaggttctagatagagaattttagagctttgctgccatgttctaaaacagtattagccatttcatttgaacttgcttgtttgatacttaattatgtcgaggaaagtttttgtggctcctaatttccatgaactgtagtacctatattacgatgtacattataacattaactacattgttgctaatattatggcaaatattcaaccttgatatgtttaaacgtgctcttgcaacctctagtgtcgccttcttacatcctgctgatactgtttttatttgtaacttttcagcgtacttccttgaagcataccgtcctttgaggaaaggagaccttttccttgttaggggtgggatgagaagtgttgaattcaaagttatagagactgaccctgcagagtactgcattgttgcacctgatacggagatattctgtgatggtgagcctattaagagggaggatgaggaaagacttgatgaagttggttacgatgatgttggtggagttaggaagcagatggcccaaatcagagaacttgttgagctcccattgcgccatccccaacttttcaagtctattggtgtgaagcctccaaagggcatactgctttatggaccccctggctctggaaagaccctcattgctagagctgttgctaatgaaacaggtgctttcttctttctgattaatggcccggagattatgtcaaagctagcaggagaaagtgagagtaatctcaggaaggcatttgaagaagctgagaagaatgcaccatcaatcattttcatcgatgagatagactccatagcaccaaagagagagaagacccatggagaagttgagaggcgcatcgtttcacagctgttgactcttatggatgggctcaaagctcgttcccatgtcattgtcatgggtgctacaaaccggccaaacagtattgatcctgctctcagaaggtttggtaggttcgatcgggagattgacattggtgttcctgatgaagttgggcggcttgaagttcttcggattcacaccaaaaacatgaagctggctgaagatgtgagttatcaccactacagtctagatgcaaaatattctttattggttgcatttttttttaatagttattacattgttgtcgcaggttgacctggaacacattgccaaagacactcatgggtatgtgggtgctgatcttgctgctctttgcactgaggctgctctccaatgcatccgtgagaagatggatattatagatcttgaggatgagaccatagatgctgagatacttaactcgatggctgttacaaatgatcacttcaagactgcactagggacaagcaacccgtctgctctccgtgaaactgtgagtatttttagtatgatctatttgcacattaccaggatctattcccatttgtttccgaggcttacatctagctttccttttaaattcaggttgttgaagttccaaatgtctcttgggaggatattggtggactggagaatgtcaaacgggagctgcaggaggtacttattgctcttttctttcctcacttatgagttcttatttgtggttaacatactttaaaaccttgcagactgtccaatatccagtggagcatcctgagaaatttgagaagtttggcatgtctccgtccaaaggtgttctgttctatggccctcctggctgtggtaagactttgttggccaaggcaattgctaacgagtgccaggctaacttcattagtgtcaagggacctgagctgcttaccatgtggtttggtgagagtgaggccaatgtgcgtgagatttttgacaaggctaggcagtcagctccttgtgtcctcttctttgatgagcttgactcaattgctacccaggttagttatctcttctgaacaaacgatttccatggttttttcatgataatctttatggctgattactttcaaccatatttcagagaggaagcagtgttggtgatgccggaggtgctgctgatagagtgctgaaccagttgttgactgagatggacggcatgaacgcgaagaaaaccgtgttcattattggtgctactaacaggccagatatcattgaccctgccttgctaaggccagggcgtcttgatcagcttatctacattcctctgcctgatgatcaatctaggctgcagatcttcaaagcttgcctccggaagtcacctgtggccaaggatgtagacctgaatgctcttgccaaatacacccaaggtttcagtggtgctgatattacagaaatctgccagcgtgcatgcaaatacgccatcagagagaacattgaaaaggtaacataaatatcttcaatattatttagttattaattccaaacatacttctggcttatgcttgcgtgctaacggagacttgattttgatttcaggacatcgagatggagaagcggaggaaggacaaccctgaagccatggaggaggacgaggttgatgatattgctgagatcaaggcggctcacttcgaggagtcgatgaagtacgcacgccggagtgtgagtgacgccgacatccgcaagtaccaggccttcgcccagactctgcagcagtctcgtgggttcggcaccgagtttaggttcgctgaccagccagcgtctggcgccggcgccgccgctgaccccttcgcatccgctgccgccgcagctgacgatgatgatttatatagttagatcgctgtgctatttatatttaacctccgtgcttttgttcagtatgtctatttcgctttggtaaactttatcatatgtaacatacggggaaacagtgtactatttttaagttaatattttgagaggtactgaaccgaattgcatgtttctgtatggatgtgtcgtggatgagcatggttgcgggttgtattcatcgattggagcatggatagatttgcgttgtatgtttgtgaggtttatagatgctcctgcaaggctggaacttgttgaagtttgtttttatagtgttaatccgaggcttcatttggtcggcgagacaccaaccgacaaaaaaaaacaaaggtcagagggcagacataagttgacataagagattactccgtttcttgataattgataatttcggcgttgacaactaattgcttttgaattgttgagaccaaattgaaaatattttgaacgtaccacacatctataacattaccattttgtactgtttgaaaatattcaacaaatatatgaaacggatacaaatagtccgatcaaaactatttgtaatgcgtagatttgtccctaaaagtacttaaataatatcacagattcattggaattctaaaaattctcaaatcttctctcgcattctctcctctttacctcctacgtaaagaaacatcatttactcccacttcatccatcaatactgtcggaaccagaaaagcatgcataacacggtgatgccatctaattaatactctctccggaccgataatacttgtcattttagataagggtgaggtccaactttaaaatctttgattatgaatcatttttaaaatcattatctttcaaatatggtgattacatgtatagattagtcttaaaaagtattttaataaaatcatatatttgttaacacttttatatatattataatagaaaataatggtcaaagttattttttggagaccgtgttcttgtctaaaacgataaatattattaacccggagggagtacgtaggattgagcaaatgcacattctgctattacatctaaaagatttggcgcaacgcgcgttttgattttacactcgatatgccaaaattctgtcgtgctcatgtagacacaatatgagcacgccgatatatcgtttgtatgctacgacaaaaaaaaaactactttgcctcgcccacaaagctcagctctcaccggatgttcttcgctttttctttttccttttttcagccccatctgacctatccgatcgtcttgattgttcctgcctgatctccatcagcttcgctcttgcatctcggaagggagcatctgatctcatggccaacaattcctagcagaagagggatttcacatcaaagttaagaactagtagcaagagtttttgatggaaaaggagtttttgatggaaaaggcggaatcttacttttatatgatccattgcagcaaggttgaaacctatagcatccttgcattcctaaaggatgaacatcacataaatacattaccaggttgctgcgaaaggtataacgggagataacaaaagtaaccaaaagttacctttactctactgtaaagaatgcctttcagttctgtaagtatcgatcttgcagatggtgtcgtagttaattggctgtggtgtgtttgaagcagcactaggcaaaccctacaaacaagctcaacctgcagcgtacaacagacatcaggatttgtgcagatgagggtatggaacaattaggtcaatataaaatagagtaacacaaacgtgtggaactgaattaatcaacaaaatccatgaagccaccagtgatgacccaatatctctgtaattttttaatgtaaacagtagcttaaacaacttccatgaatcagcgtaaacctagccattatggactacacatttttttacgtcctgggtattcatgcacataaaaaaactcacaattttgaacttgaagagagacagctagactgctagttatgaaatggcttgtgataggaatggtgcgattctagctgagaacaaagaaagtggtttctgacaaacaacactcgaaaactcgcagtaaaatgaactagaatggaatgtctattgcagtcataggattggaaactgagaaagttgacaggtaaattacatttatgacataactagtatagagagcaatgaagtactagcattttaccttcaaaggaaccatagaccactcctttaagtaagacatgatcttaagtgcatctgagaatggcaatgactgttgcagggaaaacataaatatataatcaaatgatgaatgattaatatacaaggatgaatctgtttagtggttttttaaatatgctaacgaacacaatcaatatgcttgacaatatggttatgtactaaaacaacaaggccagattgaacaaaatcaaagaattgtgttctatactaccccagtagggcatgacactttatggttccagaaagcctttcttacgtgtgcagtcttgttgaagttggaattcatcctatcagttgaattttgtttcctttgcaataggggcaatcatgggccactttggattgatgccaaaatgtgccatgccaatttttttggtagtttgaatagtaaatatgatggtttggtttgaagccaaatggatggtaatgcacatgcttaatttggtataattctaggactttcttcaccataacataaaatttggcttctaattggtatcaatccaaacacattacttagaactccaccctaccaaattattggtagtgccatatgcctagattttggcactaccaatgttttggtatggcactaaaccaaacaagccctatatcagtgagtttcatccatatcttccctaaaaaaaatctacaatataccactcacagcaaggttgccagatggccctgggcccacatgtcagtggggcatcggtggaatacgtggacattagatgatactcaatgcataaaatggatcaccacactacaaatattggctagtaatttactataacaacaaataattgatggtggcttttccctgaaagccgttctgtgagaaatacaggacaaaactaaaggaatgatgtcatccattagggaagataagggaaaaacttacaaggagagcctgttccaagtcatttggacgaacatttgaaactacattcaaaacataatccgatggtgactgcccttgcattataacattgggttgaaatgtagttccattcccattattttgtccttcctgaaattataataaatgtatagctgaagtaaatattccacttggtgagtcatcatttaacagcagtaacagaatagcaacaagggttgcacattatgtttttagtttcactttttaatacctggtgctgatcaaggcgttttacttcttcctcggcagtgtcaagtgcatcaataattgcatcagcagcagttactgtctctttggttttcctaccaggaacacctacagaaccctcatcaggagcaccatctttttgcccatacttgtggtccatagcactatctaaatcagcctcgaaagtttcctccaaccttttctcttgctcttcctgcatttatttttgtgggtttcagagctaagaaaaatctaagcaaagatagcaaacattcaataacaggattccattaaaacaatacaatcactgcatacctcaatgaagagttgttcttcagtacgatcccaacgccgaatagagcggtcatgagaacctgttacaataaaatcaccacgactgctgatggcaagacaccaaacttcagcatggtgtccttccagtgttaacaacaactcgaatttatcagcatcccagtactttacagtgcggtctttcccaacactgaacatataatgtgttttagaaacaaacttaacatccatcacactgcaaattgaacacgtgagaaaaaggtgtaaggattgtgccaacagtcaaatcacaaagaaaacaaaagggcaagaaataacctgtccgtgtgggcaaatatagacttatggcagtcaccaaaatccataccccaaattttcaaatttttgtctgcagaaccagtaactattagaactccatcggatgatatatccatgcagagaactggaagtttgtggccataaagggtaagggcaaacttcagtgagtccatagtgaagacctgcaaacacacagcacaagatgttgaggaaattgatgaaatcaaaaacttaattctagattgcatttttatttccatgtttgcaggatgccaactggcacctcaagatataaaaaaagttcagtacaagtgcttactgcgttaccaagtttgcaggatgccaagaaaatattaacaataatagctttgcccatataaactgactggcggaaaatagatatttgcttatgcttgtcctgttctaaattagaaaactaaaaattttatggacaaggaagtaaagaatcatgctctctatctatatacacaatacataatcataaaaataagccccaaatttgtgttcacataaaggtccccactaaaaagaatgtagttcattttctagagaagttcaaaaccatacaaaccttgactgcgccatccaagagagcaacagcaatatgattcccagttggactgatggttactgcaaggacatcgtcattcattttcaaagttttgacatttgttacgctcagctgcttagagtcctggaacaagatgagaaaacactaaagttattctaaaagcctatgcagacgatatttatgatgcttatcagattaacattgaaagttcaactagaacagatagatcgatgatcttgcgcattcattacatcaaaaacagtgcaacacaagaaattctttgacattgaatttttatatttctgtgtaacatcatttagaaatttggcaaaacatgcctcttcatgtggagaactggttagtaaacttgcaggcgcaaaataaaccaaaagaatgtcattaagagatgcatcacaataaattgttgttcttcttggcatataaataatggagacttggttaagaaaaacagacacttctgtagagtcataggagaacagacgatgccaagggattagacagaagactcacattatcagatttctgcatcaattggtattcccagaacttgacatcatgatcagcacttccagtgacaaaaccccatgcaccagcagttccatcctcgtttggaatgagtacaattgatcgtatggaaccagcatgagcttctataacctcaatagagcttccactattaatatctataatctccaaagtaccactctttgtgcctacaagggcataccgatttccaggaacaaatgcactgcacaatccataatcagaatcaattgtccggagacagtcgccagtactaggattccatatcttaacagcattgtgacttgttgacatcaggaggttgtcctctgagttaagtgcaagactcctaatatcagaacggtgtccatgcatctcaatggaatacatattcgacacattctcattatccactgagtatgtctcaagcatgttattattcagagatagagacaaggtggcaaggcaaccttttggtggattgtttggagaaaatgcgacagagcaaattttcttgttaacccgcaaaacatggagaagcttaaatatatcggtgacaacaggagtgggattctgcaagtcttgagccgacaaaggatctataacagtaccattcccttcagcagccatggatttggccaaagccttctccttctttctgtgcatcctcctcttggccttccgtgctgcctctgtttcatcaagaaccctataaatatccaccgtcttcccagccacctggcatgccacaagattaccgttcttattgaacttaacagtcgctaccctttccttgctttgccttggaatctcaccaaatagcttcagcatatcccacttgctccaatcctcaccctcctcagcagatttccggaccgtaaacacccgcagctcttgatcggccgacccagacaccaaaaacctctcgctgggatccacatcaattgaccatatttcactgcggtggccaccaacaatctgaaggcagtgctgcgtgtcaaggtcccaaacccggattaacttatccttggagcagctcactagtttcttccctgaatccagaaacaccaaacccgtgacctacagcgagtaatcgccagattagtatgactgaactttgctacccaatagagacagagaagagaagcacaatgtagtatacctgatcacggtggccacggagtcgataaaggccggcctgtccaactacatcccaaaggataatgtcacagtccttactgccagaggcgatgatggcgccagaggggccgaatacgagggcggaagccgcagagcggtggccatggagggtcgcctcacaggagccggtctccgtgtcccatagcctgatgctcccatcggcgtgcccactcgcaatctgaagcaaaccaacacagcgcacgagatgatgaaaccagctcaaaatgcggagagattaaaccgcaaaaggggaaagggaggaaggttcagcgtgtgataccgaggaggcggaggcggaggcggcggaggggaaggtggcgaggcaggagacggcgagggagggggacggggcggcggtggcgaaggagagggaggggaggccgcgcttgaggtcccaggcggcgaagcggtcgagggcggcggcgaggaggaggcggccggaggggtcgtacgcgacgttggactccggggaggcgaccacgccgaaggagatcgccggctcgtaccggaggtaggccttcaccatggcgcccggccgccggcggcgtggtggaggaggaggtggagtgcgtcgctgcggttagggtttatggcggcgcgtgcgacttcggtcaaggggggtttaaaagccaacacactagacaaaaaaaaaaggaaaatagaaaaatagatataaaagagtaaaattcataaaaatttcgaggcatatctaacataaaacctaaattattataatttttttcagtgaatctcagattttaaggtaaaatatcttaagcttatattattgtttttaatatatttatgtataataattataagataataataatacgagatattgcagagtacatatcatttttttcgattattggtagtatcattagtttttatatatataagcaaccggttatatatttgtattgtgttttttcaattgtataatagtaaaggaaaaaatgaattatgccggagggatgtgtattttgagcttaataatgtaaatatatacttaaaatattataactattaatgaaattatgagcatgtgatataaatatggggattcttcaaaaacattttctcttagtatctggtattttctaaaataaatcataatatatgggattttatattacatagtactccttcgttttatattatcgttagatttttttccttagtcaaagttatatatgtttgactaaatttatagagaaaaatagtaatatctacgacagtaagttagtttcattcattaaatttaacgttgactatattttaatacaatatttgttttgtattataattcttagtattgtattttgatacaaacttaaattatagaaaaatgattaaaaaattcaatcgaggtataatatgaaactgaggaaatgtgctttaaaatctatagtgttttccaaaatttactccagataaaaagtcacacaaggggggggggggggaaatctctccatttgccagtcgccacatctccctatcgtctccgccgcaagcccgcaagcgaagatggcgacgccggcgaacgccaccacattctccggcgaggtgtgggcggagctccgcctggcggactccagcgacgtgccccacatccacgccctcatccaccagatggcggagttcgagctcctcaccgacctcttcgccgccacccacgagctcctcacctccacgctcttcccctcgccgccgcgccctcccttcacctccttcaccgccctcatcctcgacctctccccgtccccgctccccgcctccggcccctccaccatcgcctcccactgcctcgacctctccgcgtccccgctcgccgacccggaggccgccgccttcgcctcccctcgcggcggcgggcgcgtcaccgcgggcttcgtgatctgcttccccaactactccaccttcctctccaagcccgggctgtacgtggaggacatcttcgtgcgcgcgccgtggcgccgccgcgggctcggccggatgatgctgtccgcggtggccggcaaggccgccgagctcgggatggggcgcgtggagtggtgcgtgctggactggaacaagaacgccatcgacttctacgaggggatgggcgccgaggtgctcccgcagtggcgcatctgccgcctcaccggcgctgcactcgacaagtacaaggggaaccaggaggaggggggaggcagcaaggcggcggagtagatcggccatggatggaaacgtcgattcttggctgtccaatctcgagtgagtgattagtgataataaaggtagtggattttggttccacttatctgctccttgtggtgatgtatttcttgatagtgattcagtgcattggatcggttcttcattgctatgaattacagtgatgttttagcttgattatgtcatgaacttgatctgaaacatttcggtatcaaattcttgattgaaccacactgatttcggtatcaaatttctcatagggtgtccaagttgattcatcagagttcagtaacacatggcttcagtgcaatttgcctcccatgtcttattcattatcatctaagctattttcatttgtgtcctgaatccctgatgcttccatcctggcaaggaaacatataaaagaaaaatggaagaagtggagtaaaagctccaatggtatatgaatgtcttagctgggtcatgtattcatgttgtttaaagatgaacgaaaatgtatgtgactgcggcacatatgctactaaaatgttacacatcatctgaccacaacacagatattttgattaagacctgcaactatgtacaacagaagtaggagctgaaacaacgctcctgggatgtgttgaacagttttttacaattactggaatctacattgtttctaggaacatgtaatttcttcccagattgagtttctgaagcaagatctttctgcaaactgtctagtaacagtatcattctagctggattggcttatacattcatctttgttcttgtcgggaccacagccatcaaccactgtttgacgaaactgtattatctaaatgatgattgaatcggatgcatattgcatgaggctttagggcctgtttagtttgctaaaacaaaatttttggacgtcacatcggatgtttaaccgaatgtcggaagggattttcggacataaataaaaaaaactaatttcataactcgcctggaaaccgcgagacaaatcttttgagcctaattaatccgtcattagcacatgtgggttactgtagcacttgtggctaatcatggactaattagactcaaaagattcgtctcgcgatttcccccctaactatgcaattagttttttaatctatatttaatgctccatacatgtgtccaaagatttggtgtaatgtttttgagaaaaaaatttgggaactaaactaggccttaatgcaagctgtattcttgttcggacgtccagttagtcagattggttgcaaacatcgaaatccaattgatgacagtataaggtgcatgtaaaattgatcagcaaagacatttaagccaaaacgttcttgtataatctactacacattttgaccccaacctgtatggcaagttttctatcataaaattgaaatattcaattctatcatcctgaaaactttgcgagtaggcaaaaatcatgagaagaggtcacccgccggtcagcccattggtattttctttctttcatgaaaagaaagtttttcttccgtaatccgaagatgatagtatgattaatgattctactagtaattgtgatcggacggtggctttgcctttgctcgccttctttcttcttccctactccaaggcttattaccgcctctttttcctctccacgccttgctgctcagcttccttctcaagaaaaacactaccctataaaatgtaaacgacgccacctctcccaaatcatcgtagcaacagcgacagccaaaaaacatcatcaaaattcttcggggggagagagtttgatggaggagaagggtgcggaggcgatgacgcagaaggcgccggagaaggaggcggcggcgatggcgtgctaccggaggacggtgggggaggaggcgacgttcaaggagagatccaaggacctgttccggcagttcaaggacgcgccggcgggggatcactgggtctgcctcaagaacaaggtccgcgccgccggcgagtacgccaccctccgtactcgccagggcatcaccatgttcggcgagccaaatgtcggcgacctcttgggaagaaccaaggatgacgactccaagaagacgccttccgcgtaaattatagaccaagattgagtggagaagcagtagcattcttgagggcgaaccatctaagtttgttaataagtgttctctctatggttaaatgattgattagttcgagttttactccgttcgtgttgattagtccaggctttcgaggtgtaatagaatactgcaacaatagaagtgtgtttctttttgttttggttattttcccttcaattcatcaaggacacgctgaatttcgcctcccggcttacacggttacacctataaaaacatctggatgaaagcacagttcatataccatcgcccaacaacaatagttgtcatatcgtaagccatattattattagacagcaatgtgctcactgagaccatgagacattaacacatttttcaaatggtacttggaagttatccaagtgatctgtattcataaactttacggactgaagaaagaatgaatgatcccatgtaaatgggaaagatcagctgcttatgaaaatctacgttgatgcatcagggggtacaatccttaacccccaactatttctctactttctacactaaacacattgctaacgaaggaacaaacactaggcctatcagacgtcaggtggttaaatacgtgatctggtacaacaagcatggcctcaacagctagagcttttgcccccagctgtgatcactcatcagtaacatgaaaagtggcaacctatcaataatgattaaacttctttctatggcgactataatctgagacatatctgaaactctggccacagtcaggagccgagcacttgtacggtcgctcgcctgtatggactctgatatgctcagtttgcgcccacaaccacttgaaagtcattggacaaccatcccaggggcatttgaatggcctctcatctctgtgtacacactgatgacgcttcaggtatttgtgagagctgaagcgcttgccacaagactcgtcggtgcagatattgcgttggtgagcacgaagttcagctttagtctcaaatgtcatgtcacaaaattctatgtcacactgaaatgcttccacctttgccttcttcctcttatttgcagttgaagcttctgcagtttttgtttcgtttgtcatgtcttcaacaatcgcaggtctagtccttggtctcaagctttcacatggagagcggacaaagctccccaagctttggggactattaatattgaactcagatccgctctttcttttgtgtttgcgtctggcataacatatgatatttgttctgtttgaacttccaatgcttctagacactatgtctgatgagcagaagccatgcgacggatcagtgatctctgcaacttcatcctgagttacatcatctgcagattggtcattgccagccagtgtcatcaatgtcaaggaagctttgccaacctcatcctttccagaagagaccttagattcatcggctagaactccaagtaaaatatcaattgaatttgactctgtgtgcatggatgttccattttttctgggaattgcagttgttgaagcagattgcgcaccttctgaaatgatgaaatcactgcttggagattcatgaggtaattgtgtggtatgaatgctattgagcttagcacccttgacatcagtcaaactggccacaacctcagcctttgaattatggactgcctgcaactcactgcccatcaaatcatgagccatagacagcttttcgcttgaaaaggcagcatcagtggagacagggcagtccaaggtcagactgcaacttctgtcactgctagaaatcatctggtcacagctcgactttggtgttacaagaacaacactacgatcacatgtttcaggttgatcatctgtatcaggttcgctgttctttaatacagtgtcagaacagtaagacgtattaccacagctatcctcattttcaagggttgatgatgctgcccccccatgtaattctcctgcaaccaattctgtgttgggattattacaaagtaccatggccaactgatcttgttgaacttgcaattgttcatctttgcacactgaagttgcattgtcagattctaagtgctcatgattacttatgaagttcatgctgcctccctcagcgataagcccattgtccaggaactgttttacagtactcaactcagttgattcagcaccacattgttctctggtaggtttgccagctgacactgcaacagttgtgggtgaatcctgggaatcaaatgaacagatagggtcatcacatgcactcacacttactggacgctcacaaacttgatgcatcataggatattcagcaacagcaattggaatattaataagagaatgtccatcctgatcattcaccttgggacgcttgcacatatcagctacatcattggattcttgcaggacacaatcttgttgcagagtttgttcacttccaatgttttcatgagcatttccagaagtgtctatctgagtttttgtaactgcgggcttaactttgtctggagttgccacaacatcagggctggaagcataaccaatgaccttatatggagtccgtgctttcctgcaaagccatttcaagtttgaaacaactgaaataggtgatggcttggaaaataatccccaaaatgataaaggaggctgttcttgactctctggtgtttctttcctaatcttggaactatgtttgaggtttagacccatccgtgatgtccaatctgttccctcttcctcatatccctcatcatcaattgaaatattaattagatgcaaattagacttggacgcatttgctagtgcaacatctttatagtcaaactgaaactcaatttcctcagctattgatattgcaagtgcttttagtttgacataatctgcagataatggagggaaaaaggttatcactgaattcaggggacaaattaatcaaataatcacagttaaaacaactacattgattttcaatcatgatttaaaaagttcaagatatttggaaggaatcaaaagggcccataatacttaaatcccctcggctaatatctcttattttcagttaacttcagctgacaaaaacatgtcaaataaacaataaataaaattccacatccagtgtgcaggattaatacaatctacgggagttacattgaatgtgacaacagaagtctgcatcaatcgtacctgcatggcatatgatgagggcatgaactccacctttgctcgcaagcaactcctcaatctcaagggcatgttgtaagcaaaagatccgaggccgtgcaaatgcacagcctgtattccagctgatagtttcctcactaccttcgacatctggtacattaacatcacctctgcctgattgtttactcaactctgagccagggcaatcacttggtattttcttctcaggggtttctgtgtcaccgtaaggatgaatggtattttcactgctacaagaacaggaagtgccaatatgtttccctagggttccattaaactcctttcccatcaaagaaatgtcacttctaattggcttcacatcctgatgactgaggttagcattttccacagggctggacgatctattggcgatgagtgggcatcctgatacatgggggagaaacatttgtcaagtttttgtacatgaaaagaaaatagaacaaatcattaaagttgaaacatagaagatgctcaggatgatggatggaaacccatgcacttcagtaatacaaataccaagagctcagctagacaaaagtctggctatctctaacttattgacgaaaaagacagttatattaatcttgtgtagtaatcaagcaacaacgcacactgtacaataaaaattatggtactaaacctagttgcaggcataacataaacatttgagaggattacagatttgagtccaaatgatcataatacccttgtgtgcattattatacgttgctaaggagtcgacattcattatcctccaataaaatatatgttcaagtgtatgacaacagttccctcttgccgaggtttatcataacaaaagaatctgcctcactgtagctcactgaaggccactagaacaacagcaacgtgaagtacacacactgggaacgcaattaatttattggacatagaaaaacaagacacttgaagaatatctaggtcttatgaaaaaaaaagatctacaaccatcatacaaattcactttatttcctacatttataaataaggaactaaaacacaaaatcttcaaagataataaaggcataccggagctaccatcattaggagagcacggaagcacatttgaacaaatctctttttcacaactcagtttatatctttccttatcaacaagggaaatttcttccagtgcttttctggaaggttgcaaaatcgccataaatggatagccaagaatcccacatgcaacacatgtcaatgaaccagaatcaatgctcaaatcaaaaggcaggtcatctccgtcatcggtatcaagcttttctccctcaggagcttgtttgctatccatagacaagcctttagattgtgtcccagtcatacatgcagtaccatcagatgagctgtcatcttttgagctggattgggtagatccaattctgggaccatcttcacccttcttttcaggagcttttgagcaagacgagcaggggtgtagagcggtaagcgatggcagcaagtcaggctcccatagaacaacattatcaaccgatttttttccaagaaatgaacatataagttcattttcactaatcatatcctgcaagaattcctgtttgaccaacagttctcggtcttcttttttacgatctcttagacgagaagttcggattccagacagtagttctctagggttcctgaaaataaaatgaatccagcagactcataagtgtgtgctatgataatgatttagcatacttgttaatataaatgggcacagaaagcattagaggtaatgattaaaatatacaatcaaatgagtgcttcaatattaaacacttcgaataatcaatgaaattccaaaacacaaggcaatcatgtgagcaacaaatgaacaatagaagctttcaaaacaaaatgaacaatggataaaaaaggcaagtaatttgtgtggatgcagacagccaacattctgcttgttagcttctctttggggagtgaatattgatggcttccaacaaacatggaattgttacagtggcagaatccatagggatgtaatcatcagcacttacttccatttcttttgtttcgataaagcatatattttggaccttttggcttcttctgttgtttcaattgtttatcatttcagatttccatgtccgaagatataggctgtgttcggcactgttcccaaaagaacagtgctcacggaaaacggagcgatccattagcgcgtgattaattaagtattagcttttttttcaaaaatggattaatttgattttttttaaagcaactttcatatagaaactttttgcaaaaaacgcaccgtttagcagtttgaaaagcgtgcgcacggaaaacaagggagatgggttgggaagaaggggtgccgaacacagccatagtcagttgtaacttattctggtaacatctagaatggtcagttttaatatatatatcaaagccatcttccctcctaggcagccaccctagaccctcctaggtccaccttagggtaaattaggtgctaagcactgatctgtttcccagctagagcctgaaccttcgcaaacacttgttcacatatatgatacatctaaaaccctttatgagttcttactacattggataactatcccagagagtaaccttcaatcatggtgtcccatctactataatccagagagcactatgctacaaataacgtaaaccattgccagattcaaaatgtaaagcggcaagctagcaaataccaatttatgtaaaacataaacaacttatgcaaaatatatgtatgaaggtaaaaaaacatatacaacttatcatcaaaactgttgtgcacaaaaaatacatatggaaactatgaatgcaaatttcctattccctagggactctagaagccttagcttcccatatagagttgggcaatctagaatccaaggtgacttaagagaggagaggagagagagtacagcttaggggaggggatgagggagagggtggagaaatgggctcatggactgggtagcgggtgggtgtagcggcttgagtgggttttatgcgctacattttccatttgccgtttatatttccatctgatatacttggaatataatgtgatttagttgaagtctagcttacacctagcattgtggtgatcctgtaatgcggcgtctcccaggagcaccatgacaacttcacctttgcggttatgcgtaatccttctgtatggcagacctaacaagcatctaacccctacccactagctgtagcatttggtttgttggaggacaaaggtaatatattttgtttcatcaacctattaatgaggtgcaaaaactaaaaagacactttggacagcacaaaaccaaactccaaaaagaaaaagaaaaaaaaacctggatataaatgaaactgctagcaagtacaatagttgttgatgggagagcattggaagataattcatcacagcccttcgaactgcagcctctttagcaaacttcaaccattggggagtcgcaaaattggcagcttctccacaattgaatcctgtattatattacacgaacattagagttgccgatagcatgcatagcaacaaaataaaataaggaatctactgaacatgacatgctgctgactgcattggatattcagtttctacaacataccacaatctacaaattgtttcttttggttccacaaagtaaatgaatctcatagataggttgactctcagatataaagtgagatccttaagaggatctcaagtgttccataaaactatgaacgcaaataggttaatacgaagaagcttgaattcttcaaaaaattagtatgaagttgaaaaaaatcaaactcaccaaactagttaagacaacggtaaaaggatcaccataatcttgcttcaggaaacaagtatgaaagagtaatttgttttgccattacccattagtatcatctgaataacctagtttattatcttgaattatgattcatgacaagacaaaacagtagcaaatattggttatattataactgagtgtgtattactaccacggctccatcacatcgacaactgcacttcatgcctagatctatgcagccacatgcactgtgtattgtaaaagatttgtgttcattgacaataccataaagaaattaaattaaagcatacaaggttcagatgatttaacaactagcacatactgatgaatcaaataacaagtattgtgagttcaaaatatgtatgatttaacccaccatggctaaacccgacatggtaagcccttgggaatgtcaccacaaactcaccaggatattgcaccaatctgaaatacaatgcatgtcaacacataaattaattaagattggtgtattgattgctgacggtttcagaacttgtacctacagcagggcacaccattgtctataaggacctctggggacattagtgttgttttctcaccaagcactgctagtgacgctgcagaaaccaaccagaactcatatcattcgcaccatcgcgtgagcacaagatctggataaagaaacacaatataagacaaataccgatccgatcagtgttgcctccatagccatgtacacggataacttcctcaagctcaacagccctatcaccaggaaccgcataccacgtcttaggtgcgccagtgtggaggaagttgagactatgcagatcatgatcctccacatgccacgcaaaccagctgaacagcatgccaatgtaaaccattggagaagtcaccccaggaacatcgtcaggcataaaccgtgtgagcgaaccaggagcccgcgcaattgcttgcaggttccatgggctatttgacagcctccagcctgaactcttctcccattcgtccatcggggcagtctctcttttctgcttcttcttgcgttgcaactgcacgggtgcagcaaacccagagccagggacatcattggcgtactcaatatagataggacggtccgccgacgccttccagaagagtgattccaccgcgagcgcagtcggttcgtggagtccagcgaggtgcgtctttgagaaggcgcgggacttggactcaaactggtcgagcgtgtaccgctccccactctgccacacctgcttaagcacctgcggcgtcgggcgtccacgccgcgggttgccgagctcctggtgccgtgtcgtgaacaccgcggcggagaccggcggcggcgaggaggaggatggaggaatggacgagtcggaggcggcggcgggagagggcgcgggggcgtcgcaggaggagacgagggagcggttgaggtgggcgaagacgaagcggcgggaagggcgcgggtggggcgggatgaccttgcagatgccgtaggcggcggcctcgcgctccacgcgggagaggaaggcgatggggtcggcgaactcggactccgtcgggcggtactcgggcgcgcgggggagccccctgagccaagccgggacggcgggatccggggcactggccgacgccgacgccgccggcggaggctggggcggcatcagggggggagcgcgcggcgagagggctagggttttgggaggcggggacggggagcggaggggagcatttgggttgggggggtttgaggagaggaagggaagggaggattgggcagccgaccaaaggagattgcgaagacggtgtgcgggggaatcgcgtcgcgggtgtgggtatgaggggaatggggggggatgcgggcggtgtgtactggagtttgtgggcggtggctgtggttgcgcgcggtcgtcggcccgtgggctcgcgtctcaaggctcagggtgggggccggggggtgagttttgctttctgcgcttgtcgtggatagggactgcggttagtttttgcccgcaaaactaaccgcccttctctcgtatgcctccgcaagaccgcaaataccaccgctgtcttatacaagtaacattcaacaacagaaagaatacggtgtcaataaattagaaaagtgttatgaaacctatttttattataagccgaatta

SEQ ID NO: 67001 - DNA, 3301 bp, Oryza sativa
  unsure (1)..(3301): unsure at all n locations
tgcacttccaagtgcactttgcccgtgaacaggacgggcaacccacgataagccttcttcaggaccatacagtttgatcttctctggatctggagccagcccttcatcagcaagctcatcatcaggtccaattatgtattcctcaatttttgtgtctttcccaacccccagaccttcaacgagaagggccatttctcctgcacagttaattcaacatgagaaactccatcgcatagataatatacctatactgatagcattaaatagtttctccactttctagatcctcacagggaaaaatgctgggtaagacatacaaacctgaaacatcttctcttccacgcaggccttgcaacacacgcttggcctcagccattcttcctttgctcacgagccacctcggcgattcaggtaagtaaaagatggtcaatgcaaagtatataagtgatggtattgatagaacgccaagcatgatcctccaatctggctgtggcatgagggacatgccaaataccatgcagtatgaaaggaacatccctccagacccactgaactgcggcagcgtgtttagcagtcctctgatgtccgtcggggcagtctcagagatgtacaatggtacaagcgtgacagccaaaccgatcccgaacccgtcaatgagcctcgccaagagcaacacatacacatttggcgcccaaagcatcactagcccactaacaaagtagaggacagccgacgcgatcagcatgggccgcctaccaaaagaatcagccactgctccagagaacgtcgtgatgatcgtcgccccaatgagcgacatggccacgatcaggccttcgataaggggctcgctctgcaagttgaattccttcttgatgtacagtaccgcacctgataaagatcatcccaacaagtccacagggtcagcaagaagtcaaaaccatcggtatcaatcaaatttctgaaaccttaccatgcagacagtatcaagtccaataaatacagatcattcatgagatccggacatttgtttaatcctactcataattgactcaaaattctactgaaaaaaaaatatcagttgtttttttttgtgatatcatgaacagagaagaacanctaaaccattttttactgcagatgattccaccaaatccatcatgatctccacaagtatcacaataattgccaccaaacacgggccctagcgtcacataacgacatggcacacaaactatggcagaaaaaaaaagattcgttttttctctaaccacgaacttacctgcaatggttgcattatcccagccctgcagcaagttgccgatggaggccgcgatggcgaccagcacggcgcccgccatggccggcgaatcttaccactgcacaagaaagaaaaagaaaagaaaacaacgaacaccaccatcaacaccacaacaaagaacgccatcagcaacacaaatcttacaacaaaactccccccacccacaaacaaaacttgattcgatctaacaaatcccctcctagaatcaagaacatgcctccccccagagagagaaagaaaccctttctttacccaagtctctcgtccaccgagatttcggatcccctaacaagaagagaggcggctgggaatctggaagggctcgttgggacgccgagatggggcaaatatatggggaattctcgccaaattgggaagcttttaggggagatttggaggagggagtccagggccgagggggggggggtgaggagagtgagtgtgggctgtggactctttggactaccatagattttgctctagagaggcaatgtttttttctcctctaccccttctttgcattgcttaggtgactgacaggtggggccatgcaggttgtgggccaggtggttcagtgagagagggtggtgatctgacaggtgagaagttgaattttggatgtttatttgacaggtgagcattagcagtagagccagccagtgtcagaggagaattattgagctggatgccttcggatccatccttgtgctccatgtaggacaaccaaccattatgtacttgatgctggcaaaaaaattggtattttgatgaattgccatgttcaccacaagaattttgaaagcatactatgtgtggtgtatcagaggaaatcaataccattttagtttttttaaggttgaaatgctagcttgtaatgggatgtgtcatgtgtgctaattttcagatcttaattcttcgattataatacaacccaagttcgagatgcaagacttgattggttcatatggattatagagcaaagggatgcatcatgtgtgccaattttaaaagctattttcctcattttaatctatctccgcgttcaagaaacaagacatgtttggttccaacttttagatagacatgtattcatatgatattttaaaattcctatggaatatctcgttctataggaattttgggagaatagaaacatgtatagtttcttgttgcaccaaattcttattttaccctacaaagtatctaattattagtgttcattattaaaaaaaacattcagttctatatattattccactaaacactccatcggaaacccttctctttgctctataatcaatattaaccaaacaagtcctaatcttaaactcgggatagattataattgaggaatttggatacgaaatttggtacaaatgatgctcccaaaattcctgtagaatgagacattccatagggatttaaaaaaatatgggtgcatcccaaatcatactaatacgggtgcagtcctttgtcctaaagaccacagatatcctataaaattccactaaaatacattaagagttagtttttaaaactatttgcattggttgtggaattacacgagaacttcaaagtgtttttagcatgtttcaagcttatgtttcgttaggcatgagtaagatctaggcttcaagtagtatttcaacaaaaaaaaaaggaaaagggaataaaacctgactgcttttggcgtagcagattggggatctagacgcagccacggggcacatccaacttgatctatggattcactcgtcgactcttccttgaaaatgatatcctcttaggtaccaagttaggattgattgtggtggcaccatcagatctgatttggtggcccatcaatcaccacggcaggcacttcaaacttgctctatggcttcgctcgctgattcttcctttgaaagcggtgtcctcttaggtgtcatattaggattgattgtggcagcgctaacagatctgatctggtggtgcctcagatct

SEQ ID NO: 67002 - DNA, 2469 bp, Oryza sativa
tggagcgtttctaggatgattaatggacttttagtatgtaatagattaattaagtattaactttcttttaacagtttaactatttgaaaacgagaaacgcccagaggtcttccagctagctccataaggtggtgagctagacgatctgggtttgaattctcaccccttctaattatttgatattagatccttccctaatattcgtattttactatttgaaaaacatgcatgtaaaaaaaaagatgagttgggaaacttagctgccaaacagagaattgaattggagagatatttttgtcgagatggaagagagaacttgaggagagagatgtgtgggtgactaagagcaagaataataacgagctataagctaacaataaatttatacgaaactatcgacgtttgatgtcgcgattccggtatttgcatagtatggggatcgttggtactaggatatatgcgagactgaggtaaaagagatggatacatggatttttatacaggttcgggcccctgaatcgtcaggtaataaccctacattctgttggccgaagccggtcgttgctcttattcatcataatcacaccagtacaatatttggggtagcctatctaactgttgtcgacatggcggtctgaagttctgactcgtagtcgataacatggtagtcttcctcctcgaatctgtgcctggcaagatcagagacagcgctatgtctctcctaacagtctccggagacaccgtaggggactggccatgcctatctctaaagtcgatatccggcgtcttgtcttggcgcatgttggcttgtatattgtggcttctgttgttccgtgtcccctctcctcctaggtggccttgtatttatacccataggtgtccccttgtccaagtagaactagggaaaccaatatggatacaatccaaatagtccttgtcgtttccatgtaaaactctattcatcattccttatgcagaactcctcctatatctgaaggttgtttccgtataggacatgatatgtggtgggtcctgccgagatttagtcaactactattaggtatgtggtatccataaccctgacataaacagtgaaacaacaaaaaaataaaagatgttggctctcatgtaaaatctaactaacacgtgcttcaagacaaatactttaaatacataggtgagagagatagtgagaagcagtgaaacaacaaaaaaataaaagatgttggctctcatgcaaaatttagctaacacgtgcttcaagacaaaaactttaaatacataggtgagagagatagtgagaagaaaatatggaaacaatattatagttaatttattatatatatgttggctttaagataggctaatagcggttagtgaactctactactccaacgcactcaacgcagcaatgtgggcccaacgaataggaacaaagggagaaagcataggagagagattaacatgagtaaaataaaatttttgatcgtactattgcagctagctattgtagtagtacctaagagacggtaaattatctctatatgatgcggatgaaaattatagcctgttgcttactctattattaatcttgctctaaccatcattagatcgaataacaaagactcagaacgcacaagagtattgttcatcatattaccgtatgtacgtgttgaatagggatagcagcgccgggggtctccaatctggcagtgggtcccacgtgccaatatctaccttcttcttcccttctctttctccacagtccacatctatcaccttccccatccccacccacccggtggccctcttcccaaccagtggatgaggaggcggcggcttgaggctagggggcgagtggatggggagctggcggcgccaccgccgtttcacgcgatgatggccgacgctagacgactacgagcacatgaggtgatgacgggatcaactcctcgccggcctccctcaccgtcgcgtcctccctcccttgctgtcgatggtgcacaccggctccgtcgccctcgttgtcgagttgcgctgatggccgacgctgaagaaggaaggcaacaacggccggcagaggtggcggcgactggcaggggaggcaacagcctaccggcaaacagcagggagccaccgagccggcggacagcaatgaacgacgacgggtacgagagagagaagcgtgaagaaaagcagaggtaggggcaaaagcacatgggtccattgttttgggaggaggaatgcatgtggggcccaccgttagctagtgactttggcttgccaagtttaggccaggggagaaagtgttttggacagtcagatggcgccatctggttaaaaagactgttggcgatgctctaactcataacttcgggtcctcgtgggtcaactcttatccccgcatgcgcccctgcatttactgtctgcaaattgccaccccttcccgcgtatgacgacggccggatc

SEQ ID NO: 67003 - DNA, 3972 bp, Oryza sativa
gtgtgggtaaagtgtaccccctctgcagaggttaacaaactgttcgaacagccgtgcccacggtcatgggcagatgtgaggtgattcctagcgtagttttgtttgactattgtcttgtgaaattgctgttgtggaaaagggatcgatgtttagaaaatctgcagctgatgagatcagctaggcccgggtggccgtttaaaagttgttggcccgggtggccgtttgaaagttgttggccgggtaccaaccttgaatcaattcaaaagactgatacattgcacatactccgaccggacgagacgcactgtctcatccgtgtcgtttgagaagcactcacttagtggtttttcataaaagagttcaaataaaatcaattgcaaaaataacagtctttccttgaagcctgcattaaacacttatttcccatggcttgctgagtactcccgtactcacccttgctttatataaataatcccccccagttgctgaagaagatgaagcggatcccgctgatgaggagttcttccaggagcaagccggctacgatgagttttagggtttcggcctagttcccaagtcgcgcctgtgaagtttggtccaagtcttggcttccgcttcccttttgtaatgcagttgagagctcgggatctgtccgcagcccacatgactgtactcctactctataataaagagacctctgttgctgtgatattctgtcttcctgtggtaccagcactgtttcctgggactggtatcgattaacaggttaatttggagcgtcacgggctagtctcgctcggggctagttcggggcatgacagcagaggtaggggcaaaagcacgtgggcccattgttttgggaggagaaatgcacgtggggcccaccgttagctagtgactttggcttgacaagtttagaccaaaggaggaagtgttttggacagccagatagcttcaccatatatccagttaaaaaggctgttggagatgctttaactcgtgacttcggggcctcttgggtcaactcttatccccgcatgcgcccccgcatttactgtctgcaaattgccacccctagccagtagccgcgtatgacgacgaccagatcgtgcatgcttacgcatgtgctacctgccgggaaatgcctcgcatatactcctacgtaccgcgccgagtcgtcgccgaccgatacgcgttgtttactgcatgggtatatcatgatagcctgcgtctttttttttgcatcgatcaatcgatcatgtgaaaccgtacgtcatgaacttcctcaccctttcgttggttaaacttcctgcgtaatgtcaacaactgaactttttttttgttttttttagttgaggccggggatcaacaaagtgaacttgactgacaaatagtcatgcttgatctgatctgccagcttgatcaacgagttgaattgagttaacatcgatacagggcgatttttagttatatatacatactccctcagtaaaaaaaaataattatagagatgaatatacaggtatatctagattatattcatccttaaaattaacattttttcttgctgagggagtatattttggcgatgccatatgctatagtactccctttgtccaaattataaggcactatctttttaaaagaaaatcaaacttggtaactcttgattaataatcatactaaccagtattatgcatgttaattatatcactatattcatattttaaaagaattttaatgtcatgctaatttcatatttgttgggagcataacatggaataaattaatgatcaaaatgagttattaaagtctgtttaaaaaaaatatagaccctataatttaggacggaggaagtatagaaatctggtaacatggcattgcaggaaaccgctactgcgcctgtcacacgttgttgacacaattatttgaatagacaaaatggtggttatgagtttttgtttcttaaaatcatgaattgtatgcctaggtttattttttcgcgaacgcgcaaaaggattgcgcgtcaatatattagaagaaaaaatttatagttacatgacgcaatcagtcagaccgacttatgtaaagggaagggggaaaaaagcaaaataagaagctggagcttaaaaaactacggcggctaaatacaaactccaagcagcgggaaggggccgagccacgttacactcctaacaagtccctaaaaacggcaacgccagctaaagactatagatggccctcctgagtggatggactccagaaccactgagaccgaagagaacacaaagtcgaaaaacctagagttcagttccttccacagctgccaagagaccaggagcaccaggaagtcgaagctagcgcggagatgctcaggttagcaggccctgaaggacggccaccagtcctagaaccagctgccacgggggagagagggcatcccagccaggaggcgatagcacacagagccagacctactgagcaaacacatagtcgaggaggatgtggttcgccgtctcaagatcctgagtgcaaaaagggcaggccgagtgactatcgatgccatgcttctggaggagatcagtcgtccaacaacgctgttggaatgcaaaccaaaggaagaacctgcatttagcaggaccctttacgtgccagagaagatcagctcaggcaaatgaatgctggccatggaagaaagcctggtatgccgaacgcgcagagtagcgctggtcatacgtccaacgccaaatgagacgattctcgacacccggtgagagctgtacgtgaagcaccgcatcccaaataaggagaaactgggagatgactgggatagtgagggcaccgcggatgtcagagacataggagttgttcgccagaccagaagcaaccgtgcgtgaacctggaagacgctggggaacaacgaagaggagatctggagccaaggacgccaccgagcggccatcgatccattggtcggaccagaagagcatagactcaccatttcccggcacgaagaaagtggatgccgcgaacatgtcggagacggtctgcttgactggggacttcaggccatcccagcaggtttattttttcgcgaacgcgtaaaaagattgcacatcaatatattagaagaaaagagttatagttacatgacacaatcagccagaccggcttacgtaaagggaaggggaaaaaaagcaaaataagaagctgaagcttaaaaaactacggcggctaaatacaaactccaagcagcgggaaggggccgagccacgctacactcccaactagtcccaaaaacggcaacgccagctatagaccatagatggctcttgactaggtttattaatttttactagagaattaaaggttcaaaatgtaatgttatcctcaccgttgtaggtaactgtatcgatcggtgacgtttgtgtttgaatggaactcctagcagcaacagggccacgtttgctctgcgaacaggtcgtaagtacaacgtacgcactgaatttcttcacctctccagccaatcaacggtgggccacattgctgaacatataaattccacgttgctgaataagcacattgccgtcaatatattaaacttgatccattggagatatagtatatttatatagagaatcaacgactccatgaaggctcaagtgtctcatccatttcacagttatttcgtgctcacttattaacgattatgagttcttatctcatttttcctaattcacatctttcgtttttggtacgcacgcttttcaaattattcaatggtgtgtttttttttaaaaaaatttctatgcgaaagttgttttaaaaaagtattaactatttttatacgaaagttgtttcaatagttaatacttaattaatcgtgcaataatgcatgttccgttttatgtgccgggaggcaacccctcctcccgaacacacccagaagttaacatcaaattattcagtcct

SEQ ID NO: 67004 - DNA, 5409 bp, Oryza sativa
gtcccactcgaagggctgaagccgggcgacgcgatgatcccgctgccgccgagcggcagcaccgtcctgctcgacaccttctcgccgatcagcttcctcgtcgacggcgcttaccaggccgtcaagaagccggtgacggtcgccgtcggcgcaccgccgatggcgacgccggtggagctgttcgacgtctgcttcccgaaatcgggggcgagcggcgcggcgccggacctcgtgttcacgttccggggcggcgccgccatgacggtgccggcgacgaactacctgctcgactacaagaacggcacggtgtgcctcgccatgctgagctcggcgcggctgaactcgacgacggagctgagcttgctgggaagcttgcagcaggagaacatccatttcctcttcgacctcgacaaggagacgctctccttcgagcctgcagactgcactaaactctcctagctaatcaatggctgctgctacttaattactttcttcatatgtatgtgtacttctgaataacgcagccttgcggcatgagctgcagcatgctcatgttggtgaaaataatactccattcttattattattctgtggcgatctggcctacttcgatttcaatctctgttccatgtttaatactttaatggttcatcaaccactgtaggaattaggatgctctcctacagtttttctttcaaaaaaaaatgtggttcatcaaccaagtttcgtcttacagcttcagaaacaaactgcatgcctcttcagttatcttagcaaaacactctgaaattaaatcagaacggtagcttcaagtcgatcaattgttgggaggcattgctaagaaatctaattagtcaatagtcatggattacgagttacgacgactgaactgatataccaaattaatcaccaaatatgacaagtggaactctaaaacagcaacatttatgcttaatccaccttgcatttctggatcacgtgctggagacgactttttccaccagaagccgcttcacacgtactaccacactcgcactaactaaccacgtattcgctccattaaaaataaacaaacttcgctaaaatgtgataaattctgatagtacgaatctagataggttcttaagtactacgaatttaaacatactaaattcataataatgttataatgtatcacatcttgtactatatttattaattttagactgaatggggtagtagatgaagtagactagaccaaacatgaagccagcagatcagggtaaatgtggtaaccgcaagtccaaagaaaataaatcctctaacttactattctatgtatatccacagctcatgtttccatggctgctcttatcctttttagttttttagggggggggggagggggcgttaccgtggtaatcgccgaaaaccgcgtaaaattcacctccaaaaatataacatttttcatttaacctgttccaataatatttataataagcttttgtcaaatctaaaaccttttgaatggaacactctcattttgtctttacaatactaatccaatatgtctaatacaatggcatgacaagaagccgttgctatatctatcacccaccgtagtatggtaaaattaaaaactattgcctagccatggtcaaaggtacggttggcgacatggctgaaaggtttatttaataaaaaaattataaagctatatacagtttttactagagaacggttaaactgaagaaaatattattcattcggatgtaacaacatcagtgatgtctgaatgatacttatgtgcataattgaacctttatagtgtgaatgacaccggtattttttttagagaagaatgacaccgatatggtgcagtcgttgtcaatggtttttgagatagaatgtcctagctacatggttgaggcgcgatctatgcgaacaggtggtcagtactgctaaagaaacttctactatgtagccaaccaaaagttgccacgttacgtgctcaacacatattctataaagatccatgcatgtgacgaaaacacaaattgctaggtttcttttggttaattaaaaagatcaaactgaattttaaattttgagaagatagattgatccaattttatttgtttttatcaatttatcaatggttacagtaaaatccactcatgaacggtttttattctcaccatgaacggtttttattctcaccatgaacggtttttattctcactatcagaactagcatggtggcccgcgcaatttgcgcgggctagcatcattatattttctctcatataatagcatatatgttttctcattatattatttaaatatattacaatgacaacataattttaaattttgcaataactttacgaaactactaatgtgtaatattcatattgtattttatatacgtgttagttattaattatttttaatatcaattttttgttatttataaattatatattttcctatatggactctagtctcctcttctaatagtccttattttttaattccgaattttaactatttctaaattgtatttctatatggactctagtctactcttctaatattccttattttttaattccgaatttcagctatttctaaattgtatttctgtatggactctgctttttctttttctccgattaatgtgagaatttctaggtcatgagagcaaacgtggaggctcctttttattccgaattttagttagttttaaattcatatatagactctatactctacttctaatattccttattttttaattccaaatttctttttttttcttaattataattctatatagactctatactctacttctaatattccttatttttaattctgaatttctattatttcctgattgtatttctatatggactctatactctacttctaatattccttatttttaattacaaatttcagttatttcctaattgtatttccatatggactctagtctcctcttctaatattccttattttttaattccgaatttcaactatttctaaattgtatttctatatggactctgctttctctttttctccgattaatgtgagaatttctagaccatgagaacaaatgtggaggctcatttttctattcctttaataatataatagattgtgaacccaaccctgctccatgaaggctcaagtggttcattcaatttcactgtcatttcgtgcccactaatcctcgacgagtctctctcgcgtaccaattaaacgatgaggcgtacgttgacatctctttattcagttttttttatcggttagatttattcaattactatgcgacattacagtgttagttaaaatcatcttactcctggtttattgcatgcagccaatcatctgcagatataagcttcctatataaaccctacctctggactttgatcatactcattagctcgagacattagtcgatcatcataatgggaaggctaatcgtaacactgctcgtgctgtgcgccgcggcgactacgtgccccgcggcgcttcgcgggcacgacccccggcgagccatgcgcggccgcctcctcgccgacggcggcggcgcggtcgtgccgttccactggtcccccgagctctacaacgtggcgaacttcaccatcggcacgccgccgcaggccgcgtcggcgttcatcgatctcaccggcgagctcgtctggacgcagtgctcgcagtgcatccactgcttcaagcaggacctgcccgtgttcgtcccgaacgcgtcgtccaccttcaagccggagccgtgcggcaccgacgtctgcaagtccatcccgacgcccaagtgcgccagcgacgtgtgcgcctacgacggggtcaccgggctgggcgggccaccgtcggcatcgtcgccactgacacgttcgccatcgggacggcggcgccggcgagcctcggcttcgggtgcgtcgtggcgagcgacatcgacaccatgggcgggccttccgggttcatcgggttagggaggacgccgtggtcgctcgtcgcgcagatgaagctcaccaggttctcctactgcctggcgccacacgacaccgggaagaacagccggctgttcctcggcgcctccgccaaactggccggcggcggcgcctggacgccgttcgtcaagacctctcccaacgatggcatgagccaatattatccgatcgagttggaggagatcaaggccggcgacgcgacgatcacgatgcctcggggccgcaacaccgtcctggtccagaccgccgtcgtgcgggtcagcttgctggtcgacagcgtgtaccaggaattcaagaaggcggtgatggcttccgtcggcgccgcgccgacggcgacgccggtgggggcgcccttcgaggtctgcttcccgaaggcgggggtcagcggcgcgccggacctcgtgttcacgttccaggccggcgccgcgctgacggtgccgccggcgaactacctgttcgacgttgggaacgacacggtttgcttgtcggtgatgagcatcgcgctgctgaacatcacggcgttggacgggctgaacatcctgggaagctttcagcaggagaacgtccatctcctcttcgacctcgacaaggacatgctctccttcgagcctgcagactgcagctcactctcctaactaacattggctgcagcctgtgcagtttgtgcgtcagcttggctgtatatgtttgtgtggttgtcaggtgtgtacaactcgcatgtttatagccataataacgcagctagctaggcagcatgcatgcatgtgtgctgcgacatgctttgctttgctctcccagtgtctacgcattttccttcgtgaacctgcgtgcttgtgtgtggcatcctagtgtgatatgttacttgttagtgcaaataatatattcagtcgtgatctggacttgatttaattccgtcattcacttgatcattcccatatgtaatgttttattctcacggtctccttccccttattaatgatggtaaaattaaaattaattgctctattaacataaggctacaacttatagaaacagattgctcattcagttatcctgctaaaccacagttccaaaattaaatcagtttccccagctcgcagctaagtattagtttctcttgttcctatggagcaatcgtcattacgcaggctgctcatgagatgacaaacctgctccattatagattaaggtatacgttacactttgaatgcaacccattctgctcccgattggaaattgtattttgcaatcttgccttcataaagtccttaattggtgtaaagttctgttatctttagcttatttttactctactgaccccgattccacatgcacaaggattggtgggaaatacctcggagcgaataagatgggattttgatgttcttca

SEQ ID NO: 67005 - DNA, 2580 bp, Oryza sativa
ggagggtataaggtgtgcatatgtgaattcatagggtgggtgtgctcacatttatataagcgcttatgattgcctttacatcgttaataaaaaaataatttcaagaaaattgacggaatggcgtgaaccgatgccacggcagggcgacttcttcggcaacctcaccagcagcgatcactacatatatgcacaatctgaggaaaactttaaggttgcacagacaaaaacctaccaaacacgatggatcatacatatgcgctcttgttatttcttttcctttttgacatctattgtgtatgtacgtacatagagagggattagctgtttttttaaatggggttacttgagtagattgaatagatctaatctaactggtgaaaataatggatttactgtgttagccatgtacatttatggctaaatgttttgctttccccttatattttgttcttagactttctcttatttatagagcaccacatgcattttagaagagtttgtaggattgtaggaacgctattacttatactcgcaatatacttgtagtcaactattgttttttgtggcttagtggcgtcctctacttacctatcatttgctgatggttgctcacttagtatcatcctttatcttcggtgcttgataacaatcttgttgaatgttagtgcacggatgccttgtaagcaatatgacctgacaatttatggatagtagtttgtatataaacttatatacataggggttagcagggatatacgattgatatattatgctatttttgattgacaaagtatattacatattaagcattttagtatataagaaataaatttaaggttatattctaaagtgcttatcggattggctactcccttgtttatcgtgaccacatttactgaatttctaaatggtgcatatttttgcaaaatattttatatataaaaattttctaaaaaaccaagtaaatccattttcatgttttaatattaatacttaatactttttagaaatatattaatacttaattaaactttctctaatgacctgtgtcgtttcacgtgccctggataagctcacccaataagctagatcgaacgaagtcgaggagtgagataaacgacatcgatatggtgtcaagagaatatatttgatctttaatttgctaaaaatatatgaatagagaaaacacataatacaagaagatatatctgtgataatttttatttaacatttatgataaatttagtatgtccttttgacgtatcaatatttttatagtatagagaattggagttgtttttatttttgaaaatgcatgttcaatttaactattacataatctatattttaattaatttattttttatggatgttttaatgacatgcgtctagtttgaatacaactaaaaataacatatatttttgcaatttaaagtatagttaatatgggcttgaattattagtttagtttttctatctaatctaaaggagaaaacagaaaaaaaaaggatgtgggatctatgtatgtacgtaccttttttaatgaatacttacatatgggctaggagccacatcatagcttggtctttttacagataaatttaagagttaatttcacattgcaccatatattttgaccaaattttacaatgggcaagggccaaaccaaccttttcacttaacaccacatatctttgcactagttggcactttggactagggttgagcacattaatgaaagttgtcagagaaaagctagttcaaatcatcatttttagttccatagtattaaaataaatatctttagaaagaaacagcaaatcacaaaacaacttttttcagcaaatcacactaaaataatgatgtgaacatgtttaaaagtggcacaaaatgatctatacataggggcaaatgaataaaaataaaatagaaaatagttaattaccactcacactgaaaagaaggaagaaaacataaatgttttgccttttataattatccctgtgtaatcatatgaaattttctcacattcccttgatttgctcacccctagtccaaactgaaaacttatgtaaagatgtatggtgttaagtgaaaacattgatttaaccctagtccattatgaaatcttggtcaaaatatgtggcccaatgtgaaatttactcaaaatttaatcatgagatagatttaatcgttaaaaaaatagtaatatgggcttgaattattagtttagtttttccatctaatctaaagaaggaaaaagaaaaaaaaaaaggacgtgagatgtatgtacgtacgtattttttttaatgaatactcacatgggccaggagccgcatcataacttggtctttctacagataaatttaatcctaaatatatctaatggttaaaaaaataggaagctttttccctaagagattatgaaagaaaagaggagatgaggggaggacgtacgcaccacagaagagtgggggtacgtattacgtacgcaccaaggtgtagagagggtggattttttttaattaaatctaatggtaaaaaatattggacccaccaatttaaagaaaaatcaatggt

SEQ ID NO: 67006 - DNA, 4150 bp, Oryza sativa
aatataaaaaattttacatagcccccacacataatatgaagtgtgtggattttaatattttcaatatgcatgtattaatttttttgaaaatataatttatgtttcatatgctctagcgtcgagttcgtttatgtaaataatctttcatatgctacataaaattatttttctaatatagctatgttttgtgtgtgtgattcatctttcatataccacataaaaatagtttttcaaaaaatatttttgaaaaaaaaaatcttaaaatatatatagaaactttatatcatataagaaggctacactaaaactttcatattttttttcaaaacttataatgagccaatcaattggcaatccttgtatggcttgaagggaattttaggtattttttgaaaaatatccatcccgatggcatattgtagaaaaaattgacaaagttggcatattatagagaaagacagtcgatggcaaatcattaaactagagtaaactcaggggcatagaatggattatctcatatatataacttagagactggaataaaataaagagtaattaggatgatctaaatctacaagaagactgtaaaaataaacttcggtggaatttgacaaaagaaggaagattcactgtgaagtctttgtataaagctcttaaaatgcaacaagtgaactttcggcagaaaaaaaaatctggaaatttaaaatttctctgaagatcaaagttttcatttggttgtttgttaaaaacaaggcactcacaaaagataacttatacataagaggttgaagaaaaggggatagaaaatgtcaattttgtgaaaagatgaaaatgtacaatgcccatggccagacttctgtggaatatagtaacttgtgcccttagttggaaacctatgctgaataatcaagatctgtttggacattggcttaacaatcttgtaaacacacaaaaaaaccttcttgtgataggaactagttgggcggccagcgcaattgcgcggctagcattaatttaaaattatttatttattatacatgattttatttaaaattatcattcccatgattctaattattttatagtttttaaaatccacgccagtcactacccctcactcctttgacaccttttttatatggttactcgatctaccactacttctattcatcctctttaaaactttaaaaattacgccttatagtttttagagtttattatctcgtattaggttcttatatggacttttatttaaacatttcttattttaattcctaatttcagaaatttttaaattgtattcctaggtggactcttcttgttttttctaatttctggttttattttatttttattccgaattttgttaatctcgtattgggttcttatatggactcttcttttaatattgcttatttttaatttcgaattttagttcttttcaaattgtattcctacgtgaactcttcttttattattttttaatttcagattttattttatttttattctgaattttaattaatctcgtattgtgttcgtacatggactcttctttcaatattccttatttttaattccgaattttagttatttttaaattggattcctacttggactcttcttttttttctaatttcggattttattttatttgtattctgaactttgattaatcttgtattaggttcttatatggactcttatttcaatattgcttatttttaattccgaatttaagttatttttaaattgtatttcttcttggactcttttttttctaatttcagattttattttatttttattctgaattttgattaatctcatattgggtttctatatggattcttttttcaatattgcttatttttaattccgaatttcagctattttgaatttttattaatctcgtattggttttctatatggactcttctttcaatattgcttatttttaattccgaattttagctatttttagattgtatttctatttggactctccttttctttttctctgattaatgtgggaatttctagcccccacagcgaacatggtgtcttctttcaaaactgttttaataatataatagaatataatagatagatagatagatagatagatagatggctgcaattatttggccatttggaaaactagggatagagcttgttttgagaaaaaaaaaacccaaataaccccactgatttggtttttttggcaatgccattgggttgaaccctgggctgttatgcagaagccggaagcaagcccaaagaaatctgcagtttaagattcggatagagggctggcatcaggaggattgaaggctgatggagatactggtcatttggagaagtggggcttcaggggttttcgtgttctcctccgcataaaagtttgttgatgtatgctggcttgatctaatctgtgttgagagtagtttctgttgaagggtcaattctgggcacaggccccgctgttagtaacttcaattcgctttttgtttttgtgttcagttttaaactgctttgtaccagacttctatagcgtgtttgctcatttctagtaagagaaatgggggacttcatgacctagatcaaaaaaaaaaaaagaaaatcagtactctgcacaattttcgtcagtactagtttgcaagcgtttttttacatcatattcagggttgttgaagtagatacggaaacgtgtgaagcgcaaacttggccggggtttctgaatacattatacctggaaaagctctaatcacccaagctggtgggtaaaatgtatctgattctgtcatatagataggtaaaacattcatcgcgatcgattgcctttctggctggaaaaatctctgtttggttcgtgatctaaaacaggagaacttgtgagcatctcaaacctccttgcagttgtatatatcttcagaacttgatgtcttcttatattagcttacctactgtaccaatcatactatcttttctagaacttgatacatgtgtaaccaatctaacctagaaaagttgttttttttaatggaagcaagataactaagacaatgatgatcaaataaagaacaaacaatgctctaatatgaaactgtgaacatccatatatctcttcttttgtacctataaataccctgtacagaaatcattagttcagtacaacaatagcatcgattaacacagtgattaagaaagaaagaaacagctaattaatcagtcactaagccaaaccatgggcaagaacgcgagccgcctcgccgtcgccgccgtcgtcgtgttcgcgctgctgctgtcgctccggcagctggaggcggccgacgacgtctccgtgtcgtgctccgacgtggtcgccgacgtgacgccgtgcctggggttcctgcagggagacgacgaccacccctccggcgagtgctgcgacggcctgtccggcctggtggccgccgcggccaccacggaggaccggcaggcggcgtgcgagtgcctcaagtcggccgtctccggccagttcaccgccgtcgaggccgcgccggcgagggacctgccggcggactgcggcctctccctgccctacaccttctcgccggacgtcgactgctcccagtaagtacactttgcagtagcagtaatccagtgacacgccatgcattgtgctatagatggccatatggcccgaggcccgatggccggtgatttgacccggctcaggcatggcacggcttgactcgggtcatgcctgtgccggcccggcccaacaatcatgctgtgcctgggctgctacctcaacacgctgggccaacacaacccggcccaaagttcagggatgcgaaacatacttattctcaaccatatgtaaggcaggtcacaaagaatagagaggaaaaatagacatattatatggcacgacgtaaaaagtagggatataaaatagacttattttagctattttaaagagggaggggaaatagacttattttaaagaaggcacaatgggccacccgggggaagtatccggtgcaatcatgcaactttcatcttacactgttggatcgagaaatggacgcccgagattcatccatgtcaccatgagttaaaatttaactcacagattccctcatgagttaagggctggtttggt

SEQ ID NO: 67007 - DNA, 8147 bp, Oryza sativa
aattcacaatagggttaatggcctattgggttgggagccaaattttggcatgcctaaaaaaataggccatttcaacagttaatttaggctattttggcttcaatccaaacacaattttacctttgccaaaattagccatgctaaaagttgccaaaatttgacattgataaaatttggtaaggccaatttaggccacaaaccaaaccaaccctaaaatttactgggagttaaattttaactcatgttgacgtggacaaatctcaggtgtctatttctcgatccaacggtgtaagatgagagttgtatggttgcaccgattaggtgattgcactagatacttctccgggctacccgtgccttcgggccagtacagcatgggccgactactggtgagccgtgcctgggcctaaggtgcagcctgtgggccggcacggcatggctcgaagtgccaaccgtgccgtgttagctcgatcgccttgggctgtgcctagccagtgtctgggtcgggtcgtgccgaacgagactcatggccatctatacattgtgcgtagaggtggatctttaacgttaacgagttaaagagctacaattaggctcggcttgtgcgctggctcgttaaattcgttaggcttgtttcatttgtattatattaataatttcaaatttactattttattatatattaacataataaaaaacaatactaactaataaaaaaactcactaaacacgaatgttttaatgtaaattaaaatactaaatattagttaagtagcactaagtatatatagatatggttatatcttatactaacaagctaaacgagtacggagtagataacatgctagcttgttaagctcgcgagctaaagattagcggccccatcatttcgcttatttgtgtaataaaccaaaagacatataaaagtagtttgtgaataaaacttttatatacgtgttcttaacgatctaaatgcaaaggctaaaaaataaacttcaatgaaaaaaacctcaaaatcagctctaaacatatggttgaaaaaaaaacaaattttagctgataagtataaacataagcgaaaagatgaagccctagctcgactcgactcattaaaactacaagttcaagtcaatatgagttacgagtttcgaggttttatccgcccctaaatatatgtgatagtacaatctcggttgagcaatgtggatggttggatctcaatcaaatgacatagttcagccttgatcagttgattgtcaggaaaggccagcctctctacgattttttttaaaataatactatattaatggaaaatattactgtggtgcttccatatgatagagattttagtcatcaacctctatgtttacaatttttcattaaaatattattatattatttcaaaaataatcctcttaatttctccacattccacagcgatctgtctctcttttctctgcgcttatctttgtgccttgaccttgacaaccaccattgccaagcagcagaacaaatctcatactatcatattctccgatgtgtcaacacttcagtagtattaggcccaggggaccttttttaggcccaggggaccttttactatcgggagatgggttagccctccccacggtaaaccctgttactgttactgcggttaaacctggcgaaactgacgagaaaagaatgccaacaacttttaccggaaattttattctttatttttataatttggtcgatataccagggtgttatcaattatcataccccgacgattagctcacaataactaccaatattgtaaaccctaattaggccatgcacgcaacatatcagaaccaacatataagcctgcttgtttgttctttggttctgcacctaaatttaaattatagaacttaattttagattaatttaaagagtatttcatctctttctatttttcagcattagcttttggagtacaaagtgcaaaagcatataattatggttgcttccgtcacttgtcttcagcttacattctctgtttttgaataggatattgcattaaacctataataatcaaatatttgcatttaatattacaatattacattaatatccaataatgaacttgcgcaatctggatgatcatatcgaagataacaatacactgacggacttgcgcaatctgcaggagtcaaggacacaatcatgcattcaagcagccaaataattcgtctactggaccacaattgcctcccagaaattaaaataaattaatcaaacgaggaacatgttcacaaataaaacaggctgtataaagttggattgcacggcgacgaaatattttatatctcgcatgcactaacctttttttttcttctctgctttcatttctatccgcaggattgagtgaagagaacaaattaaaagacagtgtgtactgtgtcttgtgtgcttgaactacgtcgagatgagacataaattctcctttgtgtatttgtgtgtcagcccgtgtgccattatacttttttgtcttctccttttgtgctaatctctgtacttagtgtgtgctattactgtactactgtactccttttagtatttgtgcctgagcttttatgatgatgacatccatttgttagtaactttataatctttgcgcccatcaggtgaaaagaacaggttgaacaaccgcagctcagagaatggcggctaaaaaaaaagaccaggacacaattaactaaagctaccattataatatccagactttcggccaatattaatacagatttcagaacaaatttcacggtaatttatacaaaacatttcatttctaaatgtaattggaaaaagaaaaacctctgctcatagagttccaactaaatgcatgggtggataaggcggatcacaccattttaatggtttcaattttcgacccctctaattgtgcttgctaatgctctgaaaaaaaaaatctagatcggccacttaataaatgtgaaatgtatcctgataattcaaagaacgtactaattaatgactaatgtgaccatctccttgactaaccatcaactataatcaacacgttcaccttgtgtcacgccggcgtcgtgggcgcgggcgccgccgcgatcttgccgtgctcgaggttgtcggcagccgcgtcgtccgcgtgcgcgacgtcgtaggtggcgtgcacgccgaagagcacgtagtagacgagcatggcggccgtgcagatgccgaagcgggcgtacgccgcggtgcccagcgaccccatcaggaagaggttggtggcgatggacatggccggcagccacggcaccagcggcgcgccgtacacccgcggcgcccgctgcttctccgcgcacgccgccagccccgccgcccccgccgcccacccgcagccgaacgccgcgtaccctggccaccgccgcgcgtaccgggagttgtagtaggccgagacgccgatggaggagagcacgacgagcgcgaggaacgcgaggaaggtgcgcagctgccccggcgtcgtcgcccccgcgacgtggtagcggcggacgaggagcgccacggcgacgagcgcgaagatgaagagcgtgctgatggaggagacggaggcgagcacgtcgaggctggagaagagcgcgacgcaggcggcgccgagcgtgacggcgacggtggcgtagatgggcgtgccggtcgtcgggtggacgagcgcgaagtacggcgggatcatgtgcgtccgcgcgatctgcgtcgtgtacctcgcctgccccagcgcgccgacgaggaggccgctcgtcatccccttgagcgcgccgagagccaccacgtagcgcgcccacctcatcccggccgcggcgaacgccaccgagtaggcggcgttggcgtcgatctcggtgtaccgctgcatcccgaccagcgccagcgacatgaggcagtacacgacggtgatggaggacatggacgagatgagccccaggggcacgtcgcggccggggttcttggtctcctccgccatggtggccaccatgtcgaacccggtgtacgaccagtacaccacccccgccgcgcggaacacgcccgcggcgccgaaggggaagaaggacggcgcgaggttgccggcgtcgaagtgggagaaccccgcggccagcacgaacgcgatgatggcgatgccgaccaccgacgccagcgagttgagcgtggacgtgaggcgcgccccggacatggccaccgcggaggtgctgacgagcaccacgacggcgatggggtccaccagattgaacccctcggcgagcgccgggacgtggatgcggagcgagtcggtgtctcggccgaagagcgcggcgaggtacgacttccacgacctcccaagcccggccgccccgacgacggcctccagcagtatgttccccgcggccaggaacgccgcgatgtcgccgagctcgacgcggaggtacgagaacgagccccccgcggaggggatctccgtggcgagctcggcgtagcagaaggacgacagcagcgcggagaaccccgccgcggcgtacgcgagcgggatcgccgggccggcgtcgaagcgcgcctcctggccggtgagcacgaacaccccggagccgacgacggagccgaacccgaggaacgcgaggtccagccacgacaggcaccgccgcagcgggttctcgctcacggcgcgcagcgtgccggcctccgccgcctccgacgagcggctccccacgcggtcaaccagccgcggcacggtggccgcgagcgcgccgccgtaggaccgccagctcgcgaacgacggctccgggaagaagtccgccttactccaccgccagtaccgccgcccactccctccctctcccgccgccgccgccgtcgccatcaccggcaacacacacgctgacacggacgaatggacggaggagaagatgccgcgtgttagctaaccaccaccaaccaccgacaagccatcgccatggaagagctggagatagtgcggcgggcgggtgggttggagagatcgatacgagaaaatcatcacaggataaactcgaatttatctatctacgcgcaaaacagaatcagctcgggattcaggggagaatttctcagcccggcgaaacagaatttcagagaagcgcgcgaactttacgcgccagcgccgcgccgccaacaagcgatgcatgccatcctcaccgtgcaggctactgctactacgaatctagacagcgcgcttatcctgattcatagaatatatctagaatgagtaaattgcgttgatgctaaagacctatctcattttatagaaaaccccctaatatgatttcttaacgtacacatatctcatttcatctttcttgacgtgatcctgatcgagaggtggctgcgttggtggcagttactactagaaaaagcatttttcccgacgtacgggtctcattttcgcaagcggacataacccttagagccaaataaccacctacaaaaatataaatcgaggtgaatgtgtcggtcacctgcgaaaatctatttttgcaggcggtcctttcgctggcgccgcttaagagatccgcctgcgaaaatagacttgactataaatagactttggatagacttaaattttttctaagtctcaaaacgcacccctcccctctcctcccctcggccggactatcccacggcggctacagcgcggggcggcgcgcggcgtccggcggcgcagggcggcagcggagaccacagcgcgagcggcggtggcggtggctcccctccccccctccctcccagatctggccggaggagggaggggggaggccggcggcggcggctacggcgcggggcggtggcggcgacgacggcgcggggctgcggtgacgacgacatgcgcgctggggccgtggcggcggctcccctcacccctccctcccagatctggccggaggagggagtggagaggccggcggcggcaactacggcgcggggcggcggcgacaacaacgcccggcgcggctcccctcccctcccctcttgcccggcgcggcgatgctggaggagggcggcggcgacgactgccgcccgtgatttttttgcccgccgcatgtgatttttttttgtttttttaatgtattttcgcaagcgagctgttaccccgattgcgaaaatggatgattttcacagtcgttgacttacaggcggtccaactctccgcctgcgaaaatcactttttgccgcctggaaaaatactttttctagtagtgggtgacgacgcagtggcggtggcagcggtggcgacgacaacgagggaaaccgtgcaactacatcgcggcggcgatgagggctccgtgtgccacactagttgaagccctaaaccaataaccaaaccaattcaagtccactagttgcaccatgagcgcactcacctagccaagttataaagtcaacgcaatttacttttctagatacatggcatggcattatactatgtccaatctaatttactttttatattttggagcagaggggtaactgcatctgccaaatttcacactcgattttttttaaagacaaaactaactttaattatcattaataatctttttaccctggctgcaaaataaaatctttatcacaaaactgaaattttaaatctaatgctttgaaatcattttttaaaataaacaaatttggaactttcaacttaaaatttaaaaaccttactcaattttcaaaactttcaactccaattttaaacctttccgtttaaaattttcaactataaaattggaactttcaaattatattctaaaaccttcgatcaatcatttatttattgttttatttcaaaagtgattaagcataataagcggtatgcctggagttaattacgttaaaaaaacaaaacattgaaatgagcgtaggtcaattaattaggttgtgtaataaggtctctcggatttaaatatttttttatacgggtactcgtatttatgagtaactattttttttttggtagaccacgtaggctaacccgtggaactcacttgcatactaaaacaagccaggaacccgtcctcatccagcagtccaggtcctcggcattgtgggcttgtagccatccataagattgagatgatgaccggcagtcgcggtgtggagggagccctgcaaggctgcaagctggagcgcaatgcggcagccatgcatgaccttgagctcggaggcctcgttgcgggggtggtgaccgtgaagtggaggcctaccgtgctgatgatgggatctgccccctctcccttcgctgcaactagatccacccccatgagccccaagtttcgcatctgcccgtcactgccgactgcatcgccctgagctccgcttctgtcgatcaacgttggtcccacacctcgagcctctgccaccaccaaaaggctgctaatggaggatatccatatgtggaatgatagggtgacccgttcttggcgacgaagatctagcaatgttgatggttagcccttctttgtgatgaaaggaaggaggaaaaaccgagagggtgtggtgaggaataagataaggaggccaggaggggaaaaaatggtggcggcaatgtacgagatggaaccgaggccaaaatttgtgtggggagcgtaaaggtcggaaacaaaaaaaaaaccgccacggcaggaaatggggggaggggggagggggactcactttttcttaaggtcaagttccaaccctccatctaaaatggtgtttatggtattaactacattgtcatgtaggacttttaacttatgtggcactatattaattaagagagagagtgaagagaggaagaaactagatctcatgcaagagacagcttcaacacgagaacctatacactagacactgtcaagttttacattgggagataatagtgtcttcataatagatgaaaaataaatatgattggtagagaagagagatgatgtatttattaatggcccactttaagaaatcatgggttgtggagtgtagtttctattgtgatgttttattgacatggcaccataaacactgcttatagacactatgggttgggactgccctaatgagccaagacaggcttattagggaataaaattaaatttgtaggtaaaactttgagatatcagttcgta

SEQ ID NO: 67008 - DNA, 1400 bp, Oryza sativa
ataggtcggatatagatacaaatatgtatattttctctcgaatacgagtacgagtatgatatcgaagtttccatcagatatggataataattcggatattcgataaacagtactatttggatatccatagaagccataagacataggagtacctaatttcattataactctatgaccttcaatatacattttttagattttaatagtagttcatctcttaacactagtccacactattaatattatttaaatttttaaaaatatttataaattatactatattttatataaaatgagctaattatatatagatatttgtttctattagaagttgagttagtttttgtgttccgagaaaattttgttgccgtattcatgtccgatcatattcgattcttattcgtattcgagataattcatatttgtttccgtattcaagctatctatattcgtttccatatctggcatataaacgaatatggtatgagtattatccgtctgtttatgttcctaacgacaagtatgctcgcagggcacagacagatttgggggctaatccatgggcacaaccacaatccatggattggccttctttgtcaacctgcatccacttcagcccaaaccgtaattcttcataggccagaccgctccactccaaaatgaaatcttagcccattcaaaaccaaccaatgtgatccaaatgaacatccactacacttaacccaaacaaacccaccctactaagtaggcataactacaacacactgcaattccgctctcgcttcactaaaaagtttgagcttggtgttacaagccatcaggcatccatccttacaaactagtgcttctctagttggctggtgaggtgggaccataacatcagttacgttgtttctgctgccgactgcctgcatgattgctgctgatcggctggatggcccaaggcccgggcctgccgctgcactagtgtcactgcttgcactactgctgccttacgctggcccaaggccaaagcatcccaaccagctcaacaactcttctattaactcttttttcatttttgttcttttcaaatattgtggagcgatacagatacccatactcaaagatttaacgtccccgtcgtctatatccgagagcgatcgatcgctaggggcgattagatttctgatttccttttttggcaccgcattactttcctattttagtaaatttatacacttaaaatttatacacctcaagtttatacatctccacaaatttttttacaaaaacaaaaagttagaaaaatttatgtatagaaatactatatataaaaaatttgaattcaaattcaaatttaaacctgaatcgggtatgtaaacttttaacttataaactttgggtctataaactttagg

SEQ ID NO: 67009 - DNA, 2621 bp, Oryza sativa
atcgggttcatccaacattgtatgcccgcatacaagatacgtatatatgtataaccacaaagtcatctctgataccatttataaagtttccacacttttaccactaatgataaaagtgcaagaccatggattattatttaacaaactatgttttgtcaaataacacctggccattggagatcacaagactacaagagaaatagttagagttatctttaatttgcctccaggagtcttatgaacatctatactctgtcttataactgcaaagaacaaaacttataaaggagttatatagtaaaggtgggcactttcatacttagaaaatcattaatagcaaaatatcaatgcacgaataatagtttatcaatttatattatatactatacctatataacatcatcgccttcatcattcatcaaaactctaagtctattttgtaaaaggattataaaaaagatttaaaaactaaattacactcataacattgactagagttagtaacaactctgtgtagctttcaattcaagagacaggcgtgactcacaattttattgagcactgtgcaggcttataccactttatggatagtactcttatttttaggccttcacattccattcaattgttagacttctcagagtactctcgtttccatttactatactccacaccaccatgtgcattgagaaagtatgtatcatcacttggtggggtttatatcatctcccatcctaactatttgcggatgggatttgtatcatttcccatcctattactccatacccatgtagagtgtaataaagttgataaggtactaggctcattccgtcttgagacggatccataattgatagggtttatttggttctctaatactaataagaggtgattaattcttatatgcatacactctattcagagagagccctaataatcatcacttcccctgagctctccctatccatcatattaatatcctgatataatcatcatcatcgtcatctaccaatcatctcatcatcaacaataatattttagagaataaagttttgatacaatactaagagaaatattttacaaaatacagatttttaattaaaatagtgtcatcaacatctatcaatatgatcaaagagagacttatattatgccctactgccaaattgacttattccaactcttgcctcattcctacatttcgttatatacgttgaggtttaattaaattcctaataggtatagatgggtttgatgggaactttgaatctttaagtgtggtgtttgtaatacccccacaatattatatgggtaccccgcgcgttgctgcgggagaattatgtatagtatagtagatatgagttctaaaattttctttcttacctacgttacgattttttcatgtgtttaaatatttttttacctttatcaattatccaaatgttataaatgatcgggctgtatggtgtgccttttggagggaagagatgcaatttacatccttggtgaatcattcaaaggttaaaaataattgaggtgatgtggctttatgagagaagagagaattagcagtaactatattttgtggggatgaattttatagatatataggatttgaaaaagaaaaggaaaagagataaagacaagaattgttgggctggcttgggatgctttggccttcggccagcgtaaagcagccgtagtgcaagcagtggcagcaccagtagtagtaaggaatttttttcatttttatttttttgttttaatattacagaaatattgtaccagcgaaaatatttatagaaatagactctgtaaccctccccgagggcgagggcgcagggtgacgtgtgtgagcaggcgctggaggcttctgagcgggcatgtgaattttgcatgcggtgaaaattgcatttcacctacctcagcgcaaaatgcgtacatggcgccgtgtgccacgtcaccttgctgctctccacttgggcggcatgatctatttctgtaaatattttcgctggtataatatttctgtgaatattaaaaaaattaaaacgaaaaaaaatacagtagtaagcaggcagtcggcaggcccgggccttggatcatgcagccgatcagaaacaacagttcatacagcgcagcagcaagcaggcagtcggcagcagccacaacagggatgatccttcggcgtaatgccgatgcagtaacagtggctaacacgcgggcatagctgggacttgggccgtgctttgtcgggtcggcccaaggcacgatggcccagcacgaggaaagcacggcccagcacggcatggatttgggctgggccggcacggcccgtagttgggctgtgcctgggccgtaagttgaggcacgctgggcggcacggcacggcacggccactgggccgtgcctgggccagcccagcacgaaaatggcccgaaggcctgaaggtcggcccagcatgaggagcgcaggagtcggcccgtaccgcgagcgcgacgaattttttttatttataattttttttattaaaagtttgacaaaaataattttccattttgaaaattgacggaagtagtcgcctaccaaaaatcgccctctcagagggcggcgaaaatgac

SEQ ID NO: 67010 - DNA, 15110 bp, Oryza sativa
agggggcatggaattttgcaggcggcccccttgccgccctgggggagggcgatttttgcctctccccctataaagcccagcccctcctctgtgaaatttcattatattcactaaaaatacaaaaaaaacgaaagagagagaggggagggcagcagaaggggagcggcgaagccctgctggttcgctcaattcatcacaggtatgctcccatacatcttttgcatttgtactaatatgttatgtttgagtatatatgttacgttttagttttagttccatatattttagcacatctgtagcacacagcacatatgtgtagattcagagcatagaatataatagtatgaattgagacatagacagtagtgttaattgtaagatgtagtttagtttgatctggagaatgtaacgtaattttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtgtcagttgtagtgagtcgtgcaacagaaggttatttttgggaactaatgccgatggacagcactgatgcttggagacggtatgtggaaatggcttttgaacggtcatggcccctcgttatatttgtgtcggtacaagagaaagatataaatgtttcaatgcaaaccgaagatgtagagggtcctatcaatgcaggggatgttgttggaccatcgatgcaaaatgaggaaaatcaaccaagggaggagcaggctatgggcatggcggatgagggggagagagtcggtataattgttgatgaaatggagagggaagattcggataatgaggaagtggacgacgacgcatcatccgatgaggaaggtgatgtaatggccactgattgggcaaatgaggacttctctggacttgttatatcagagggtgatcatgtaccctgggagtataaggagaacgaggtaattgagggtgcaaggtatgctcataaggatgagatgaaggaggcggtgaagcattgggcagtttccttgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaaaatcattgagatgaggtatggcacatttgaagcttcttatgataatttgcctcgtttgttagccaccattgctcagaggaataataatacgtactatgacctacatacatttacatcggttgatgatcgaacaaagagtgtgctgcaaagagcctttttctcattgggtgcttgcatcaatgcttttgtgcattgtcgacctgttctatgcatagatggaacttttatgacaggtaaataccgaggtcagatattgacagcaattgggtgtgatgggaacaaccaggttctacctatggcttttgcatttgtagagagtgagaacactgaaagctggtactggttcctagagagagtgcacattgcagtggtgcgtatgaggcccaacgtttgccttatacatgatcatcatgcgggtatgttgcgggctattgactacttgcagaacggttgggatgagaagggacttccagctaagtggcctgatgttcggagtcggtggtgcatgcgtcacatgggtgcaaatttctacaagcaattcaagaacaagcatcttatggagctctttaagaggctctgtgcacagaaccaaaagaagaaatttaatgagttgtgggacaagttggattagttgacaacgaagcaaacagatgagcaatctcgcagaccactagttgaaggtgacgagcctcccatacctcttggtgcattacatgatgacccaccaacaatgagaaggaggtcagggtcgtccatcagaaatttcactcagtggattgagaatgagcctaaggagaagtggtctctatggttcgacaccgatggatctcggtatggcataatgacaaccaatttggcagaggtgtacaactgggtaatgcgaggagttcgggtacttccattggttgctattgttgaattcatccttcacggcacgcaagcgtactttagggatcgatacaagaaaattggtccgtccatggccgataacaacatagtgtttggcaacgtagtgacaaagtacatggaagataaaatcaaaaaggcacggagacatcgagttgttgctcaaggcacacaagtgcatcggtatgaaataatgtgtgttgataggagcaggcgtggtatctatcgcaagcaagccgtgcaggaatgtgtcttgaaggcggatggtagatgtacctgcagttgtatgaagccgaagcttcatcaccttccttgctcacacgttcttgctgctgccggtgattgtggcatatctcccaatgtgtacgtctcaaattatttcaggaaagaagcaatctttcatacatggagtgaggagatatatgggttcgggatctcaggatcttacacaacgctgagtgcccaagttttttacattccagatccatctaagttaagggtgaaaaagggtcgacgccaaactagacgcatcagaaatgatatggatgagtcagaagcaggtgggaggactttacgctgcagcaagtgtgatctgcgcggccatacttacaagaaatgcccgaagaatgcagaagttccaagcggcgcagatgctagtccatctggacaggcaagtgatggtaggcgaccacctggtgaaggaacaacaagcaggcgcgcaaggccaaggcgtcgtcgcgcagcaggcgattccatggtgtaacaatgctttcgatttaggaaataaaatgctgttgtgatgtaatgagtgttcggactaaatacttctatcgtgtaatttcaattcaatgttgttgtaatgagtacctccgactattgttgtactagtagtattgcgaactattcggtgttgtatcataatgttatcgtgatgagtgttcggactaaacacttttttttgtttgtactcttgtttaatatgtgttagtaattcgcttatgaacatttattacttatgttgaactaattatttatatgtttctgatcaacctatttgatgcaggtatggcgtacgacacaccggcgctgttgaaccgtgggattgacaggaaccaccgctcgttcctgtcagcagtcgagggtgcacagctcggcaccttccgtccacgcacgtcgcgcgagtggttgcgtgtcgacccacgtcacgttccttggtacgcgtatgttcacatttcaactcaactttgctttgtgttgtacttatgtttgaagtttgctctatacaggttgcgtgcggcaggccttctaccactttgtaggcttgttgaggcggcggcggacgaccgtgacccagcgaagcggtgggatgcagaccggtcactccttgccgctcttgtagaccgctggagacctgagacgcacacgttccaccttccctgtggggagatggctccgacactgcaggacgtgtcgtacctgctcgggctaccgctggcgggagcagcagttggtcccgtggacggtttttttgggtggaaggaggatatcactgcgcgcttcgagcaggtgatgcgccttccacacctaggaccgaccaccacccttcctccgtactctacagtcgggcctagcaaggcttggttgctccagttcactgtaagtaaataagttgttattatcatacgtgcttatttgcgaccgaatgagtgttttgtactaacatttcattcttaattgtaggcggaccttctgcaccctgacgctgatgattactcggtccgacgctcccttgaggcgtacctgttgtggttgttcgggtgggtgatgttcactagcacccacgggcacgctgtggacttccggctggtccactacgcacggtccatcgcggatgctcagccacaggacgtgccgcagtggagctggggttctgccgtgctattagccacgtaccgtgccctctgtgaggcgtgcacgaagactgacgcgggagcgatcatcgctggctgccctatgttgcttcagctttgggcagccgagaggtttgccataggtcgaccagtggtggacagcgcaccctacggggttggtcgcagcgcgcagtggccagaggacggtcccacgatggggacttactggtgtcgacgtggggttagtgcaacttcgctgcgttataagtttatcagtcgtcttttttttttcttcacataacatgtctaattccgatcatgtttattgcagcgtcgttacgctcacgtccaggtgagacgtggttacccggacttcgtgttcgagtttgaccgtctccagccgagcgacgtcatctgggagccgtacacagaagaggccgtcgctgcgagagcaccgctaggactttcgtccttgtgcacacgcgaccaggcttactggctcaccatcctgccgatggtgttcgacattttcgttgagcctcaccgcccgcagcgtgtgatgagacagttcggacttaggcaggtgtttccgggcaacgtgcagccgaccgtcctccctgccgaccactcgtgagttcggattgttcatttctaaatttttatgataattacttcatcgagccatataatttacctctcttcacaggttgactcgacggggacagctagcaggcgcactttgggctccacgtgtacagcagtacgttgacgactgggtgttagctacagaggaggtgatcaacgagctcttcccacacacggaggagaactactgtgagtaccttcgctggtaccttcctcgcactcgtgcgcgtgtgaccttcactccagacgccccagagccgcacgttgccgctgtcacggacgcgtatcccacgcaccgtgaccgagactacttcgtggcggtacgtccaatttgtattacttcttacaattatttcatttatcttgcataatataggacaactactgaatttgttatttccatcttgcataggctgatgccgcacgggatatcagtgccgatatcaccgcagtccaagtgaggttgaacagaggtttgcacttgactgacgttgagcagagggcgaccttcgaccggatgcaggagaagatgcgtgcggtcatgcgcgtcttctcctgtcgcagcgccgtggacgtcgtacctccagctggtccggtacaaccacggcctcgcgcgcctaccgtcggagcaggacctcgacctacggcacctattttgcacggtacagttcagcccagatataagttcatttttgtttcagcttttgcacgattatgtcaccatgttttaactgcacgtttcctcatcgcaggacctcgtctgccttcgagcgcgttcgcaggcacgaccggcgcttccacgagctccgcaggggcgttcgccacctcttcgggcgcgttcgccagctcttcctctcacggagcgtcgatccctcgcccacacggtactttactttttattaatactgttaattacctgtacgaaactgatggtccttgtccagcaggatttgcagccgggatcttcggtactggggcctcttcgtctcacgccggtaggactggtcctactagccagttctacgacgacgacttgcacggtgcagaccaccacgacgtactaggctcctctcagcttggaggagctccagaggcgcacactcaggagcagccagaggtcacacctgtacaggcaggacgggttggccgtgccgtacccccggaccgactcacgtactcccacgggcacgttagggcgcagggtaggagggacaggggtaagaggcctcgtcagtagtgttctacctcttcagtccttatgtgaccgtttcttttggcttacaaacttgtaaagcagtactacttttgctattactactgcagtactacttgtgtttgtctcgtctacatagttcttttcattcatatggtgctagaacaacttatgctcacgacaacacactttcggcgctgcacggtagtgtcagatccagtagcgcgcacagtccacaacagcacacatgaaaagcggcagctcgagttatcactatcaactttcggcgctgcctgtttacataaagtgaatcacgcccacgcgtgatcgtcttgtcacatctaatgaataatgtatctcattgagttcacatatattgcagtgaaaacgacgctatataattgacaatctgaaggcaacctcttcatatcttctttcccactatcacacaacacacgaaaatgaaagcctattcattggtaatacgtaatctagatttgagattatgtagaacattcttcactacaattttacattttggcagcaaaccaaatatgatcaaatgcaattttaccttaccaaatatttggtcgtgaagaaaaatttggcactaacaatccaaatatgccctaaaaattaataaaatatttgtacggtaaaaaaatatttgtacggtaacaatccaaatatgccctaaaaaataataaaattgtattttaccagtcttggagattttaatcttgtatagttttcaatataaaatgatttgataactattgatatttatacaaaaatatagagcacaatacaaaatcgccctagcggagggcggcaagggggccgcctgcaaatttccatgcccaccctcgccgcccatttgcaggcggccccccgcacagtacaaaatcgccctcgcggagggcggcaagggggccgcctgcaaatttcgttgacggccgtcgcccgagagcgaacggccgtctgccacgtcattttcgccgccctctgagagggcggtaggcgactacttccgtcaattttcaaaatggaaaattatttttgtaaaacttttaataaaaaaaattaaaaataaaaaaaattcgagcgcgactgtgcgagatgatcaggaggcaggtgcctcgagcgtcgagtgcgtgcgtgcatgccggggagcccagatggtgatttctgttttgttttgaatggaacgtaactcctgtgacgatatctgaacgcgttatctgaatggaattactccttctcaactatcaagggaacagtgccatgcagatgtgcatgcctgcatggtcgcatgttgactattgttgtaccatgcagatgggcgtgggcgcgtggccgcgtggtcagacttcagtgtgcgtgcgtgccgttgccgttcagtgtgcgtgcatgcgtggccgatcgacgtcggcgcagtgcggagcaacaggcggcggcgggcaccggcgcgctgcgaagcaactaggcggcggcggcggcaaggtaacaagtgggtcgtgcttgggccggcacggcccgaacagcgcccgccgtgctttgggccgtgcttgggtcctttcttctccacctcggcctagcacggcccggcacgattagtaggccgtgctgggccggcacggcctgttctagcacgaagcacgatgggccaggccgtgctagcccggcacggcccaagtcccagctcgtgggtccagatccacgtgtcagtatctactactacatcaagataattctcattgtagtaacacatgatttagtcgatcccacctgtctagccatatagagaagcactagtgataaagatggatgccaatggattgtaacaccgagtgcaaacattttacgtgaaatgaggataagagcacaatattaattcaaacaaaaatatgctgtaaaatttatgcgatgcaaagaaacccgaaaagggaccacaatgctagtatacatataggtgtagaatgagggcatgcttgtccttcttttggacaatatgtccaacccaagtgcccaaccataggagaggtcactttttctctctatgtcggtggaggctgagagtctatgcgacggcaaaaaaaaaaagtgtgtctttagctttcctctgttcgcctcccttccccctctgtcttcggtggccactggtcatcgacaaggggaggggagtccagtgggtggtcgggttcatcctgcagttaggtctatcccattatagatcgagtttatctcatgttaagatttcttctttccctttcatgcacagctcaagggagatgacgatgtcttcatcctgcttgctgtcttgcatggctgagaagttatggtccacaggtgcagccgatatgtcctttggtggaaggtcttcttcctccacaacggcaagatagcaccggcctttcagaccaactccggcaagtttattcctaccgatttgatgtccttctttgtcttcaatggtgtgttttcaaggctagactgatttttctcctatttattgaatctgtttcaacctctacttataagagacccccgttggatttgtgtttcgatactatcttttgcggtcaacctcgttctcgccatcgccactatcgactttattgttttggtcatcggatcggaagaagaagcaaagtaagtacttgattgctttttaattttcttttagagtccttctttgcttatttttaggatctctatgtaatttgtttatcttctagaggtctttctgcaaattgtgatgtatgtctgtcttgtcctattgtgggcaaattaatcactatttcttctagagatgttatcatccctcgtgaattcggatcaggtgtagtcacactagtgattgcaagttaacaactgcacgcaactttggccgtctattttttgcgatcaacgggttagatcaaagctacagtagccatgtgaacagtactctgtgctacagtatttattgctacagtgttgtcgacggtacaatgcgcgatctaggctgtccagcttgtatccaacgatgcgtacggctattgtttaagttgcagtcactattgtgaccgcacctgatccaaatccatcactcatgtatgtctagtttatatatatatatatatatatatatatatatatatatatatatgtaatcttctatatattgaataaatgcatgggttcttaaaaaaaaagtgcccaactatctctggcccaataaggattaacgtctgatctacatgctgctaaagttgattgggattttcatttaaaaaacaaaggcatttgccgcaattctgtaaattcgtctacaagacaattgtcgctgtcttgatggagatttttgccacgttcgttcgacctgaaggcaatgtcgaactgctttgttaaatacacgaaatttatgaaatgtaggtctaaacttaatagtagcaaaggtcccaactgtttaattaacacattgaaatatacgtctaaattcaattgtagcaaataaggtcccaactattcaattatcccatgaaaggtacagttgtccaaatcaacgctctactgatcgatagatacattgatccgatcatttagttgtctgaagtggggcagtctatgggatgaaatagtgtagcaaatgtataggactccgatatatcaccaggatttaaaagttaaatgttgtttcatcctccgttcctattttctctacggatctagacatgctttaagaatagctatatatactatttaaaacaacagtagtggtgcatggtgtctattctgccaacaccgccgcatctgccattgacaatatatctgggtccactaaggcagcacgaaaatattgtggcttattaacatataattaattgagtattagctaaaataacttgaaaaatgaattaatatgattttttaaaacatttgtatagaacttttttttaaaaaaaacacatcgtttagtagtttcaaaggcatgcacgcaaaaaataagagagctgagttgggaaagtgaaaaaaaaaacttgagttgggaaagtgaaaaaaaaactcagcttaattagtgaaacagcatgtgccaccagcgttgtggaaaacggttgatacggccgctatgacgcccgttaaaacggtgacggtaagcagtccgtcacattagtcgtccaaaaacgcgtaattcctgttattaccgattaatccagcgtttttccgactaatcggccgtattggcagtatataatcgggcatgatcaaattcactgggcccagctcacgcacgatagcctatcctgttagttgtcttctctcgtactcctgtacagcatgcatgtactactatattaatctctttgaagaccaaatatttttcaaatgcactaatactagtataagatttcaataacgtgtaatgcaaattatcatggtattattatatataatttgttatggcagcaatggcaggcattatgaactgaacctaccactagttaatgcataaatatgcattatgatattttttgcattattaactttagtacgtgtatgttaagttaatgtcatgttatggttgttctatttaaatatatatactaggaaactagaatgtgttcatatggatttaattacctctaaaaggacaaactattattaactatgtacttatatttgcaaaacgttaaatttccgtcatattccgactaatcatccgtattccgattaatcgtttggcagtactctccccgtccgacatccgtatttcgtcttccataacactgtgtgccacttgattcaaacgctcccaatttcacggttgacccccatcccgtcttcgcagtttctcgccgtaggccgcaatgcttcgccgtctctcgaaaagctgcatgctgcatggaatcgtagtgcgacacatgggcaatgccctcgctggctgggaattgtgcgctcttggccaggaatcgtcgccgccactgccagccaccagccatcaacatcgaacctgacacatgggccctatcagtcagtcacccaccctcctagggtctcctcctttgtcaggcccatgaggctactacgcggtgcccctgttccccagcacagagctttgagtggcggcgacaaccaaaaaggactgaacgcgaagaagaatgatgccacacggagcttcccgtcgctatcaccatcgagctccttcgtgtcgtgcctgagggaggtaggcggcaactctttagaggatgagcggcggagacggcatcctgatctgccccagcaccttggcgacgaggagggggacggtggatggcggcacactgaagagtagggaggcggtgtgaacaagaggcggcggttggaagccccgagctctgtcggcctatgccacccaaatccgcaccgcttcgagctccattggccaactccacttcaatgttcaaaatagctggctatggcttttagcggctggtatctgtagaggctaagaaaggctatagcgggctatagcgccgctaatcccatttagcggttttgtaattgcctgacagaaatcagtcaagaattatgcatataaacatggaatcaggaaaaaatcatgaactaacatggtccaagttctaatcttccatctatctaatcctctgtctatcctcattgcctgacatttgaaaggagcaaaaggaacaatactaagtttagaagaagaaaagaagaaaattaaacttgcctgtctgacttgcttgttgctccggctagggcatggcgtcaaaactcaaaactcgaaagaaacttcttcctcagcagccccaagtcgcgagtctacaggtcgaggccgtcgctgcctccgagactctaactccgcagcccagccaccaaagaatcgtgtcgcaggtcgacgtatatcacaggctcatggccgctgccgccgccgccgccgtcgccgctcttttgggggagaggagaggtcaagaggattgaggaatggctagggttgctgccttgctacttgctagcttgctcttatacctcccctttgggccaccagcgagacttggagaaggcccagggcctgctctggattttggcccaagcacaaattgcaaactgaatggcgctaaatgaagtgtaatttagcggatttagccggctaattgctgctattagcggaaaacatcgtttagcgtcaaaagctaactatcctcgctatatcccgctatagcggtggctatagccggctattttgaacattgctccacttaaacccccgtgtgccccgagcttgagagtagagaggttggtacaggatgaggccaccggtggcatcgcatctggcggggtggggggggggagcagctaaacaaacaagagagggaagaggaagataataatggcgaagaggacctagagctcacacatcccgatttgtgccccgccaggagctcgtcggtcacgccctggctcgatccgcgccattgggagctcgccaccttgaccacccgtcaccgtggacctcgattctcctcacctccacgactgtcgccaccccactccatttgaattaaaaccaggtttcctatggaatccaaccaatcctttcattcataattttaaatttgaacattcattcggtaaacggcactaacaactgtttaaccatttttgggtaactgtttgttttaagaaccgttatttttaaccttgtctaatagtagacctaaatggtgcacatgatttaagctgcgtaatttgttgccaagtcgatttactaccctataaactcaaaattttttgctatatgtttaaaaatacccgctgcaaatattttgtatttatgtttaaacttttcttttagtatttttaagatagagggagtatatcagtaaatattagtatgcattcttatagtgtagatgctctaagttatacatcttttataaaaacagtattaattaataaactttagtagagaaccgtaaaaaaaaaatagtagtgcactaaatctatctaatgttactcccaccaaacaaaaacagttactcgaagaaaagattctctagcaaacgcacacaattatcagtggaatcttagtcagtacaggcaagtgtgcctgcccaattcggtgcatcaattgatgcccataatacagaggtatggcgactgtttcctgagctcaaattaagtcttcctggtcccacgaccataatatccttaactgtcctgcaacaagataacactaaacagcagtactgtttttcttctcagcatgcaactgcgatttgcaggtttgctgctagcgaacacttgcagttagcccctcctggaaacgatgttttgcagttggatccttaaaaactataggacatgtacggcgggtgtgtgccagccgtaaaatactaaaatctatccaccccctggtaaaatctatccacgtcaattttcattgacgtgggagagagtttgtgaagagagaaagtagcaatatgttaattgtccaccgtaagagagggaagggaggtgttaaggatgataatctccttgctgtaacctagcattcctatatccctatgtttgttaggcggtgttctaaaggggcttttaactatttaccacttttagatttggcaaataactatttgccacccctatctcaatgacatgtgggtccagtggcaaaaagttaattgccacatctaaatgggcaaatggttaaatatctctgttctaaaggctatgtttccaactttctttcttcgttttcacacacatacttagcaaactactaaacagtatgaaattttaaaaattttctatatgaaagttgctaaaaaaatactccctccattttttaatagatgacgccattgactttttgacacgcttttgaccattgtcttatttaaaaactttgtgcaaaaatataagatataaatcatattcagttgacggagcgtggggctcctcaccgggagaccgcgcaggcccccctttgccggtccggccgggggccctgggtgagattctaagctcctagtctgtggaaagttcgcgagaatggaaaaagcacaagacacgggcgaagtatacaggttcgggccgccgagaagcgtaataccctactcctatgttctggtggatctgtgtatgaagaagctacaaagagctggagagccagagagctcttactctagaaaccctcttctcccttttttcctctcgtgggatctactctccagttcctctctcctttcttcttttcgtccccctctcctaagtgggcaaggtcctccttttatatctcaaggggataccacatgcaccacctctacctatctctctttttggttggggacttatcctatctttactccaacttggcttgccttctctagaaagctaaaaacactgcttgtttttgagtgtggccacgcgtcctcactcgtctgacctcggggatcaccctgtcatctcttcataaatgggcggagacttgcaatggctgctgtccgaatgaccttctgatgggatggcccatacctacctccactccgccggaagcaggtgcaacgtgggaacatggttgtctgccgacgacatgaccagtgtcagaccggtcacaaatcggtcattcttgcccaccacgtgtcagtctagcaatctgcatgctcgcccttcttcatacaatatcttgcttgtaatggttaggatgaagcctggcatatatctgaccgggaccaacgtgccatctccaggagctaacacgccggttccggctagggacgagtgcttggaggctctcatcctgacgggatggggcgaggcgtgcgtcagaccgcctgtcgccacctaacccacgatctgatcggtctgtgaccagtcacagaccggataaacgagcgca

SEQ ID NO: 67011 - DNA, 26254 bp, Oryza sativa
tcggggccgacccccccgagggggtcaggccacgtgggtgattgctcctgcccaaacctctagtcatgatactcccggtcccatgtcaccgacattagtgataaaacaaatcacaataaaatatactataattatgtaaattttttaataaaatgaatgatcaaatgtgtgttcaaaatcaatggcgttatctattaaaacagagataaatctatttttaaacattttttcataataattaattaatcatgcactaatacatatttcgatttttcgcgagggtctgtaaataagatgtgctgagtgcatggtaaaacaaaaggtgaaatctagcacaagtgatattgtatgacactcctcgtgggggaggtctcatgtgcacacaatgtggccctcatcctttggtcaaatgcagataatacgtcatacggtatattagaaagaaagtaatttgcagctaaaaaatttatatatgtgttattagtgactttaaatgacaatgctgaaaaataaaatttgataaaaactttacaatcatctttttaaaatttaaatttaacagcgattgatgttctatagagaacgatagaggcttgctgtgcagacgcccggcacgcgaacgccatcatcgtgctcatgaattaggattctctatcttcaaaatcaaagtcacgtgacatttatcattgacatgtaggctcgacaaaccttaaactgatcacatgttagtggcaatggtatcaggagggtttggttaactaccacacagtttgttgagccttatcacaaatttttggcagattttgcttcatcgatacagttctggtacgccaaaatctttaattcctcatacaaacatgccatgcacctctattactttaattatcacactttagctataactaagtttcgtatggtgtgatattaaatacgagtagatcgaccaaatatgcatcgaagcattttatatttaggaattaacgcctttgtcttctatatcctaaaacactttaatttagtttgaaaactcaaaaacaaggatttatcatttattccctcagtttcatattataagccgttttgattttttttcctaatcaataatttttaagtttatagaaaaaatatagcaacatttttaacccaaaataaacatattatcaaaatatattaaatattaatttcaataaaactaatttggtgttgtagatgttaataactttttttataaacttgatagcctgactagaaaaaagagtcgaaacgacttataatataaaatggaaagagtaattataaagtttagcctacatacttggccttatttgtttcagcttaaaattattataatccagattattgagtcagattactataagatgcattataataagttgagatagaataagctatctttagattattagttgtttgttagctaaaaaaagcacctttaaagtggattgtaataatctattataataaactatttgtttatttcagcttacacctaataatctattttataataatccaagggctgaatcaaacagggcctaaatttcttgggacattgtgcaagttaaaaccattactttgtaagcattcttcgtcatctccagtaagcttgatgtcctcgccaactctaatttcttctccgaagaggatgacagacattcctcggagcacaaaatcaccatgttcttctttaggttagttggatccataccactacaaatatgtcaaattagaaaaatgtcactactattcacgatatcgatttggtgccactgaaattttataaaattgtaaccatgccaccgtccactttcctgtcatcctcgttagatccacattctcttcatctgtggcgtgtgctttgtcaacctcatcggcttcttcaactccggtgtcaacgctggcaagtagcagcagcaccgacacacgggggagaacaaggagagctctgcgtccgcggcctccagcggcggcgtgcggctcggcctcctccctggcacggaagaaataagcggaggtcgtcgaccatgacgacatggtcctcgtcgtcgtcgcgcctggacagcagctcctcgtcgtcgcgcgtcgccactaccatgcccccatgctccagcccatcgatgctccacgagcaaccaccaccctcaccgcctcttcccgcactgacaagcgacgagcgagcggcgggacggatgagccatggcgggacctcggtagctcggtggtggcttctctctcaccagatctaggcagagatcccaacctgtcatcatcacgctcatcgatgagctcgagcggatgcgcgtcctgctcgccgctgccctcgctgaggagctctcctcctgtcccgcccctcccccatctatcgctgtgccctccttctccagcgccgatttgtctgtcgaggatctcctcgcgctcatctcctttggctccctcttcgaccgtccacgaccaccgcgtggagtcgtcgccatccacgaccaccatctagccttcccggagctcgctggctagcctccggcgtaggcttgctgcttgcagacgaagacgacaaggagacgaaggccctgatgtcagaaaatgtgacatggacaacataaattgcgatggagtagcatggttctaattttagaagattggtgtggcatttacctgatatcacgaatagtagtgatatttttctaatttgatatatttgtagtggcatggtgaccatggatttcaaatgcaaatatcacaaatgtagatgccttttatggaagatttccccccttctcctcttcgctttcgctgtcacagatagaactaaaacacctaattcccccaaacaattccaattccaattccagctcaatgctgcacggaatctcctcttcccatcccccaaaactctcccaaaaccgcgtataaaaagcgagctcccctatcaccttctccatcgcatcatccctcccccaaattccccaactccgggcctccggcaagccaagaaacccccaacccaactccggcgatggcgtcgcagctggtggaggagcaccggtcgggcgcggaggtccacacggggcacgagctctgcgagcggaaggcccgggagctgctggtggagctcggcctccccgacgggctcctcccgctgccgtccctggaggaggtcgggtacaaccgcgccgccgggttcgtgtggctccggcagacccaggcgggcggcgccacccacacgttcgacaccatcgggaagcaggtgtggtacgcgggcgaggtgacggcgttcgtggagcaggggcggatgcacggcgtcgccggggtgaagagcaaggagctcctcatctgggtctccatctccgagatcgtcctcagcccctccggcaccaagctcgtcttccgcaccccggccggcctcggccgcgccctccccgtcaccgccttccagctcaacccggcgcccccggagccggagaagaaggacgccgccgccgccgacgaggccgacgccgccgccaccaactgatccaagaagacatgggcgttgcgttttagcagcggtaagtaagtagtgagatccgggccgtcgtggtgaaaaagattgtagttgttgttatatgcttggaattcgtgagcctacgagctcgatctgatctcccatctctctccagtctccagtgtgtctgtccatggatgatgctgaaataaatatatgttcttgtggattcctaattgcagtttacatttttgactgctatgctattgctctgccagcttgatcgatggcttggtgatctagcaatccatgcgaatttctcgccgttctttttgtggattgttatagatttgataatttggcatatattgtcataggattcacaaaaaaaaaaaaaacaaactgtgttttttttttgttttattatttatagaagtggcagagagtaccaaccaacagccttgaattgaaccataatccagcaattaaaaggcaggcaagagaggcatggggtctcccctctccccatgtgttgtacaggtagaaggtagaagttgttcatctaatccaacggctgtgcgtttcttgaaaaatcaacggccgattgttctttactcaccgtcaccttttttttttttttttttttttttttttttgctatttcacggtcatccttgcttggcttgtaatgtaagtcaggccctgtttagatcggactaaaacttttaattccctatcacatcggatgcttggatactaattataaatattaaacgtagactattaataaaacccatctataatcttggactaattcgcgagatgaatctattgagcctaattaatccatgattagtctatgtgatgctacagtaaacattctctaattatggattaattaggattaaaaaatttgtctcgcgaattagcttttatttattaaattagttttgtaagtagtctatatttaatactctaaattagtgtctaaatacagagactaaagttaagtccctggatccaaacaccacctcacggtcatatattccctcccacatactccctccgtttcacagtatgaatgtggaaaatgttagaatgacttatagtcagatttgtaactcagattagagtcgaccaatgctggttagatttgcaagttagggtgtgtttgaggagaaggagattgagaagattgggaagatacgcaaaacgaggtgagctattagctcatgattaattgagtattaactattttaaattttaaaaatggattaatatgattttttaaagcaacttttctatagaaaatttttacaaaaaacgcatcgtttagtagtttgggaaacgtgcgcgcggaaaacgaaacagacaagctcactctcccaccctctcgagcgctgccttaatggctttgtgttggcagcatgatgcatgcactgtttgatatgatagccaacagttgcttagttgctgtagtgaaagaactagttacaggctattgcgcagcgccgtaaagagctgcccaacaggccgagaattttcagaatatgtcactcaatttgtaacactctcagatcatgccaccaaggacgcgaattgtttcattccgtgtcactctgtccctctgaagcggagcgccgtcgcccgcccgtgtcacaacgtccgtctgagtcgggcaccaccgaagagttcctcccccacgccagggagttcttccttccatgccggcagagctctccccaccaaggcgagctgttcctcccgcgccggcgtagctcctcctccccaggttgccaagcttctcccccgcagatgctagagagcttttcctccctgcaccagaatggcgagctctttctccccaacaccggccaagctcctaattccctcacgctggcggcagcaacatgacgcaatggacggcacggtacggatgggcgacgggcgtaacttcggagagacggagtgtcatggaatgaaacaattcgcgtgctcggtggcttgttttgaaagtggtacgaattaagtggcaaatcctgaaggtggtgcaaattgagtggcatactttgaaaattctccaacaggcataatgcatggatttagaattgtaactttcccctgttctttttttaataaaagagaaaatataacttgctattcgtaaaaactggtagggttgcccgcttaccaaatagcacagtttcaagcgaaagatcgctaatgcatcatttgagagttaaaacacaactaccaaagaaggtattctcttgttcgtcgatagttatttcattagatgtgggacgagcctacgtgtcgggcgcccgattgatttagggaaaaatcgggcgttgacgtcagcataacgtcaacgccacgcatacgtacaaaactactctaaactaatttttctcttaaattatttatccaaatcatgatccgattgcaccattaaattcgttgcaattaaatctttaaaacaaaaccacacatggatatattccgatgaattttttttagcttattattgaattatcattgtgtttagttccaaagttattcttcaaacttccaacttttccatcacatcaaaactttcctacacacacaaacttccaacttttccgtcacatcgttccaatttcaaccaaacttccaattctggtgtgaactaaacaaccatacatagtgaaacattgtgggtacactaggtgaaacatttttcgtggaacaaaaaatgaaacgaattcccttaatagagggttttcaaaatatgtgggtaatttgttgcaatgaagtatatggtggagataagtggcaggcgagggaagagacgtggtggggcccaggggcaggcaatgcgcgtgatggggagggagcgcctgatattcctccctcccccgagcgactgatccggggcattctccttagatgtgtacatctggagttgaaaaaatgggttagaaattcaagtataaatttagggcctattttgtatagtttcacttcgagggatatcgtctatggttaggaagtgcttcaaagctcaaatcagataaaacacatttgatgtgttagaggcaacgggttcaaatcgtgataccctgaatcatgcatgcgcacatatactttctactgaaagtatatgatgttcgtatgttatggctttttatattgagcagcgaagccagggccgggcaacctagagccagtgcccaggcccatcgcaccgagaggccggtaacgctctctcatcttagagtgtatgagattttttttaataatggattaaaaacacagctaatttatggaaaaggatgtatacaaccataaatgtccatacaagaatacttatactctccccattacatgtgaaacattgacgacataacaagtttaaccaccacaagaaagaagaaccaaaactaagcttcaattcttcttgtgaagttccaaccataggtagattagacttccagaagtttcatctccaaggttttgcatagaaccttcactatattgccatcatcctcattaagaacagcgaccaaagtcttgccaaatgcgtgcccctgaaaatcacctacgcaaaagagttagcgatgtaaccattaaataccacattattcctacttatccaaactgcccaacacattgcagctatgcatacaaaaattagcttcttaagtgccaacttccaaagatatgtgatgcactacgaggcttggcagtgaagaggtcctgatgtcgtgcacagggagcatggagccatggagggaagggaggggggaggggggctaccgaatatccgtcggaatatccatttgcaagtatggagattccggttgaggatttctgcttggaccgaactattcaacaggatattggtatttgttactagagattccagtatagttggagcttctccaacaaagtgaacaaggaataatatcgaaaggaatatttagggaaaagagagaagtgattccaaacacaaaaagggaacaaaaacacacagacaaaaggatttttttttttcatgaagttctgatccaaagatcctactcttcattgaggtgcttcttagagctggtacaataaagtgatgtaagatggttgtacaagttaccacatcagatttgtgcttacgtggaggaaagagaagaaaagtggactacagattcttagctagcttcagcacgagctcaaataaactatgtgagagatggctgaattaggttttaatgatgtgatatatatctatagctaactattgtatgagtgagctattaggttggctatagatgatggttcaatttttggagctaatagttgactatattattaaacttgttcttaagagacgactctcttttgatcccaagcctcaccaagttaataaccaagagaaggctttaatctccaacttcacaccaaggaataggggtttactcctaaccaccaaggttcaaggatccaacaccaaggctttagtcgcaagagcatgaacaatccaatccatcaactaacctatctagctctcacctcatgacgttaccatctcatctctttgtattctctcaatactcaactctgtctatgtctcacgtcgctgtcaccacccacacctgcagcaaagaccaacaccatgcactccattgggtctgacaattttaatttgtttcttgaaccgaggtgcaccatcatcttcgagatatgaaacaattcaatctatatccgcacccgcttagaaaatgtagtgtaggatatgatatgactagaggtgaaaacagagtggattcagacgaatagtgatgagaccatatcctacaccacatattttaagggattctgagcgggtgtgatggtgtgcatatgtggtgcgggtagttttggataatggaaatggtgcggactctattcggaaatagatatgtgtatgtaatacatataacatcaatgcaacgtacaaaagtacataacaacataacatctgatttctaaacatgactcccactctcaaggacaacaaccagtcagctgttaggaggtaagagccggaaagacgtctctcaagaccgtcggttatcatgtggtagaccgtcaccttcgcctcatcaaagattaggaggttagaggggaaggattggagtggtatcactcactgctcgctatgtcattgtgtgttgtttctatgagtggtggtggctacacaagcatgagatgagacggtgagagtctacaattaaggagtttatgttatctgatgaattgggctgttggataatccaatgggaactttggataatcctcatccgctggattttagcgataccacaatcgttggatttatataaacccctaccatattctcatttcaaacagattcagaacggatcggatcggatattatccgattcattttcaccctaggtatgactgctattgcccaaatcctctctgttttcacccctattatattaaattcgcccgattgttacactcaaggtttacaacatcatgaattcaacactgggtatccatgctccacaaatgcattgtactataattgtgctaagtcatgagctaccctattacaccatcttccaatatgcctaacctcaacttccgggagcaatctcattatacttttcacttcattgatagttgactctctctcaaaagtagctgttggagcacgaaaaaaccaaaaacaaatgtgaaaaaaaatcttgtgctatcttgcatgatccaaccatgatgaagttgcatcggcaccgtcgcaagaggaagggaactccacctatcttattctaaataatgtatattaccttacaagcatttaattattgtttttttttcaaacacactatcactgggaagatggtgaaccactattgacaaatcaaatttggtttgttgtcaaaaaagttatattcgtttcttgaaacttttctttttatgattgcatcgttgttttatcttgagtatatttgcaacaatattttaattgtgcatgtagtattcttgaaattgcctcattattgcaagccaatgaaaatgacttactcttatgagggcaagtcctttgctatgaaaatgaaaatttttaaatattggaaagatattcccattttgtatgcatttgcatttattcatgacttgtgaggattcctcaatgttttgccacttcttggcaaattgtttgaggtatttcggaagtatgaaaataaattgcaggtaagaagaaattaggaaaacatcctcttcagatccctcgtctttgcatcgagtttaaattccggtattggtttagggatataatttaaacgacggaacgctgaggaatataaagtagactttctctaagaaattacaattgaaaaaggagttctgctgttgggccgtaatgctaggcccagccacgcagagcctacgaagcggccttctgggctccggcccggggcctatcatttcgcaacaaaattcccaagtctccccaaagaaagaaaaaccccatctcccgtctccccgcgagttcgcccgccgccagcgccggcgccgatctccatcccgcgaccgcgagcagcggcgacgtgcttccgccgcaccctcgctcgccggtgagaatccgccctcttctctgtcatcacaccattctcagatttgcttaaaccctagtttcacttctagatctggaagcttcctatctttgccttaaccttagtactaataacagttactagttcgtttgttcctcaaaatgtttggggggttcaatctgtcggacgaattgattagcctattttctttcagccctgagttccaacatttgtaatcgtgtgcaatctgttggatcatatagcgactagagtgtgttgtgttgtagtgtgttgtttgggaggaagcatacgtgaagcttcagaaacatctgtagtgtgttgtgtaggttgctgccatttttactcctaagataagagtgttacttgagaggtgaatccattcttgggtttgctagttatcaaaatttccggcttatattcaaatgaacttaatcctaataatggagatcaggaatcaatgctaataatatatttgttagtggtgaaatcacaaagtatttgatgggctagtcatggatacacactttacgccactgaccttccacgatcacatggaagtatggaactctgggcatcacgcgcctcttggaaactgcttgttgagccggttactctctgctgtaactccctgcttcctttaacctgaccgatttaacccctctcatcacttattccctgttctgaaatcactgtgctctgcaccttttttttttttttactgaggaaatgtaaggttcagatggtctgccgcagccttctgttgcttactcaacagaagctaatttgttcctgggtaccacacagcatgtggtaacctttttgcttgctaggtgctacctaagtctcaggttttcaggaatgtatctcaatttgctctgaattggtagtatgtaaatttttgagatttatggtggcgtgaattttctagctttcttggctgctgttcatgttgcaattcttactgcggtcaaagctgctggccttaaatttgatgatgttaaccttctaaaaaggttgaatgctgagactatagtgtttattcaattcttatactagtcacaacaaaccagttctagttgtcagaagattatcttctctgctgtcactatgccttggggctaagttacaggggttgtagccgggtgaaacaagaggttggggtcctggaccaaggcagcgggcaggcattgaaagaggagtgtgttgctctagcttatcagtgattacctctagatcagtggagagatgcacgctgttgagtattgacttcttcatctacaagtttacatgcatacggggatcatcatctgtgtatcttgaacattggaatttgaaattattttttgaaccgtcatgttcttattgcctttcgcagttttcacaacaaaaataatatgtaatgggtcttataagtgcttatgtctgtttcatttcctgctgctcttataccattttagattcatatgtatgctggaacatcacagatttatcactcatgtgaacactacacagtaatggcatctgcctaaatttgttctgagtttttagtgcttattaaatttatttaaattttgttttcattgctgtcgaaagctctaaattgcttcgtggttcatgacaaagctaacttttaccttctccaggtgtccgggtatttgcattcagtgacaaaagttcttcagctgcggagtcatggctgcccagatacgcataataatgaaatcttttatgagccaagctaacaaggttcaaggggttattccatacgctcagaagattggattgcctgaatcacgatccttgtatactgtgttacgatcacctcatattgacaagaagtccagggagcaattctcgatgcatgtcaagaagcaatttctggtacagaaagcggaaacgcacgagctgcaaaagaagctgttctggttgaagcgcctgcgcctacttggagctcaatacgaaatccaaatcagtttcaagactcgtttggataagagtaagctccaagctgctttgtagttggttcgttcacccttgaacaagactgcttctctctcttggttttgagattgtcaaacagaacctttgcatccattagcatttcatatgaagaactgcatcatttggaagagttcacaggaatgttgtactagtaattcattccaaactcagcaccatttggaatagtttacaggaatgtagcagtagcaattcatccaactatcatatgctatgaattatgatgacgcagcatgatctgtaataaaacagatgtgcctgcattcctggatttgttggttttgtttctagtacagtctaacaactcatgacattccaatcctatataccttttattcgtttgttcttggtactactaattcacatgagtcatgacaaaactcaggggctcagtggtggagatgagctgttgaattagagtttagtgttggtggctagtgagcctggttctgaatcaagcagccttagcacactgtctgttggtcacaaggtctgcataaatcttgccccttttcgtggaaggacaacaaaacagagtgcaagcacatcaacctcttgtaaaatctgcatttccggcgatccattcgaagtgttcattttttttttggcaaaatacttaacataaaaaaaaaatagtcgaatcatgctgaactgtattgtacagtgttggatcatgtggacactgtttatactccatgccttcatggcactgatctgcaatgtgagtatggattcctctattcatactctcttcgtctcgaaataaatcaaactttaactagaattaaatcaaactttaactagaataggatacatcctaatacaacgaatttgacagatttattgtactaaaatgtgttatatcaagattcgttgtactaggatgtcctagtacgagattaatttattttgggcaaaagggggccttaatcaggctggccgacatactccaattattcatctctgtttgtcaagctgatgtgcgcgccttctgaactccattcattaattgaaagcgtcttcttggcttgttgtcacctattaatcgatctgatatgaattcaatacccaaagatacaactcagttgtaatggataattaatgtgtctatgtcaattctttctctgaaggaacccaaatatctcgccttgataaatcctatagctaggggtacgcctaatggacgatcgatcgccctggggatagggtagcgatcagattcgctccccacctctcccctccaccctcccttcctccacctggtttcctttttggctccgtattactttcctattttagtaaatttatgcacctaaagtttatacacctcaagtttacacatctctaaagtttagagaccaaaagtttataagtcaaaagtttatatatccgattcaaatttgaatttgaattcaaatattttttatatatagtatttctatacatctaaagtttatacacctacagtttatagacctaaagtttatatatccgattcaaatttgaatttgaattatatctgattcaaatttgaattatatctgattcaaatttgaatttgaattgaaatattttctatatatagtatttctatacatctaaagtttatacacctaaagtttatatacccgtttcaaatttgaatttgaattatatccgattcaaatttgaatttgaattcaaatattttctatatatagtatttctatacatctaaagtttatacacctaaagtttatagacccaaagtttataagttaaaagtttacatatccgattcaaatttgaatttgaattcaaattttttatatatagtatttctatacataaatttttctaaattttttttaaaaaaaattgtggagatgtgtaaacttgaggtgtacaaactttaggtgcataaatttattaaaataggaaagtaatgtggtgccaaaaaagaaaacgagagagaatcagatctgattgcccctagcgatccctagcgatcgatcgctaggtagcattacgctatagctagtgtatgattgttctcttgtattctattactagtactcttatatgctaacaggtttgatgttgcctagaaaaataaataactatgtgggctcatttgagactgggaatgtggtgaggacatccctatcattgatacaaccatacctagtatacagcaaggaccaattattcgagctcaagcacaacaactcaattatcaggaacattgaacacaaacaaggtgggaggaggagcagccatgagaatgaacaagtgaaagccagcatgagcaagggaaagttcagacagcatgtccggttctacaggcaatggcaacttcaattggtcataactctttacttcaaagagtgttggaagctcatgagcacttgttggaaagggttttgatgtctactttcatatggatccagaaacaccatcaaattccatcgaagctgtccagaaactgcagaagagacgttcggacctcgaacttgctagttgggccttgtatccagtatagcccattaagggagcatttcagctcagttcaaaaaaaaagggagcatttcagctaaggtctccgtaacctcctgctgtcctccaccatataataaggcagcagcagccaccaagaacactcgagttttgattagatgcaagtttagtttcagctacttccttatattcgcgtgaatcggctaaaccacccggatgcttgatttagaaccctgactttatgtgtattagttttatcatttggcaagtgttgtgaattgtttccttatcaacttgttcttcgattgcctacaagttaagtattgttcttggcacaacaaaaacaacaataaattagagccgatgtactggttgctaaggcgcaacgccgctctggtagttgtaaccgaaccaccagcgtcatctcctcccacaaatcgaagttattattctctcactaaaagattgggaaccccgttgctacatcaaaatgtggatgtcccaacagacatgagcatggatgtgtttaatttgttccactatatttactttcagctactcatacaacctctacctcattttggcactgcaagttatccatacaacaaaaggaggtcaaggtttccacaacaatcttgctcttctaaatgatattccatcttcaactcatcctcatatcaagcttttgtctctatgagcattattttttaaagaatttttcttttcagttgaaatgaaggcgtattctccagcaaattatcagttttgtaagatacctttcagccataacaatcattttcatatctactaacaaaatatacaaattttaattgtcttgtagtaaaatttgattttatttttctatactgaaagtcgcatatatttccaatttttgctctgggccgggtacccagctaagggctccctttgaactggtagcgctaatgcgcgcggaatattagttcgagcgccacacgacgccctctccttccggtttttctattttttaccaccccacctttgctttgcatctcaccttttctcggttcctttttttctttttttttaccaccccaccttccgtgtttcttttttctcttttctatctcatccgtgcttcatcaatgggcccgctaaaatattagccatccagatttttctgtttttcgttccttctctgtagtttttctgttttcgcgttttagtaaaatatttaccgtctagtttttcttttcgagtttttcattcttctagtatttatgcacgtttcaaaagtaacgaatttaatccgacgagtttttcatttactccaagactcccacatctgctcttcaaaagtaacaaatttattcgcatgaatgcctccacatcgtatgacaccatacctagctggtcgtaaaataaaagaattactaccaacttacaacgcaagtaattcttttaccaatattataaatattgtttagatttcatggtctaatattataaatattgtttagatttcatggtctgtgagtaaaacaattactaccttcctcttgttatagcccatgatctcgtagccaccgtgtagtaatatgtttactgatgtattcaatacatagtataagagtaaaaactgagatttcgtggtctgcgagtaaaacaattaccaccttcctctcgatatagccatgatctcgtagccaccgtgtagtaatatgttcattgatgtgttcaacatacagtataagagtgaaactgatactaagagtattgttgatatgtatcacaaaatagtcgtatgaatgaaaatattacaggcttaatcacacacaagcaataaaattactcataggtgaatcaaactagaaaaaaaaatgattcagccaaaaatctatctggtggctttgctggatcttgctataaggatgaagatgatggtttgtgtcttatgacgggtagtggagagggcaaccgggtggcgatcagtagtcgacgatggaatcatggaaggatgtagcggtgtggtatagagatgagctcgacgttgcacagtagcagccatccatcatctagcaagcacgaaaaaaaaatgcaaaaacattctcgttcatgtcaatagagatgacgagcaaaagaaaaatagcaaacaacctccatcaccggcgcactccaccctatcctctgcggccagccacatggagcacaatgtgcaaatgtaggatatgtgcagcccatcaattgagtttaggtaatattggagattgcacgctaatttgatttgcaaaaaaaattagggcttcatgcgtgaaatggaaggagagtatgtagatgcaaatcagagtgtcatttccttacttgcttgttctatcaatgtcgccgacgtggagcagccgctggttgttgctattggccctggtgaacacctccttgctggttaaggtgttgcccagcgtctgacggcgagggtcgaagcagtgccttctcctcatctgccgccggccactgccatcaatcgccacggtgtcgtcgtcctcctcctccatggtgtgtcgccgatctgtgggcttttgtcggtgacatgggaccgggagtatcatgactagaggtttgggcaggagcaatcacccacgtggcctgaccccctcgggggggtcgggcccgagggtgatgtggccgcccccctctttgtctccccgaggggtcggaccgctcccgtttcggccccgagggctgaggcgccccgaccccttgtgggtttggcgccgcgtgtatgggttaggtgagcataacggggctcacctaaccgcatttattgcggtttagacgagcgcgtcacgccgcatgtaacgcagtgcagcgcgctcgtttatccggttgtgaccagtcacagaccgatcagatcgtgggttaggtggcgacaggcggtctgacgcacgcctcgccccatcccgtcaggataagagcctccaagcactcgtccctagccggagccggcgtgttagctcctggaggtggcacgttggacccggtcagatatatgccaggcttcatcccaaccattacaagcaagatattgtatgaagaagggcgaacatgcagattgctaaactgacacgtggtggacaagaatgaccgatttgtgaccggtctgacactggtcatgtcgtcggcagacagccatgttcccacgtcgcacctgctttcggcggaagtggaggtaggtatgggccgtcccatcagaaggtcattcggacggcaaccattacaaatctccgtccatttatgaagagaaggcaagtcaagtttgagaaaagagaggataagtccccacacaaaaaagagagatggtgcatgtggtatccccttgagatataaaaggaggacctcgcccacttagcaaggggggacggaaaaaagaacgatggacgaaaagaagaaaggagagaggaactggagagtagatcccacgagaggaaaaaagggagaagagggtttctagagtaagagctctcttgctctccagctctttgtagcttcttcatacacagatccaccaaaacacaggagtagggtattacgcttctcagcggcccgaacctgtatacatcgcccgtgtcttgtgttttttccattctcgcgaactttccacagaccaggagcttagaacctcacccagggcccccggccgaaccggcaaaggggggcctgcgcggtctcccggtgagaagccccacgctccgtcatctggcgcgccaggtagggggctctgcgtgtgtttttctaagctctcgcattctttcgtgtgcgccaagcttttcctgttcagcccaatggccgaacaagcaaaggcgcacaacctctctccgagcgttagcggtgacgacggggagccgaacccacaccgtcgagctcgtactccaccgccccctccacgccaaagtcctaggcgggaggaggcgctcgagagggtcgaaggatccgagacttcgacatccacaggtgatggagaagggcgccgagatggggagcgtcgcctcctcgtctacggcgacggcagcacgccccagggcgcgctccaagctgcgggcgcgctcctacgtcacccgcccgttgtccttgacccggagtctccagcccaacgttggctggacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcggctgccactccctcgtcagcacctccaacccgggaagatcagcgtggggggccagatgcccgcatcgatatcgaacgccggcgtaatggtcgacgtactgcccacgcaacggagggcgcctcctcgtccggagtgtcacctcaactcggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacgcgaccaggatcgaggccgccgggggcgatgacagggtcatggcgaatttctttcccatggccctgaaggggcaggcacggggttggctaatgaacttgccacccgcgtcggtccactcctgggaggatttgtgccaacagttcaccatgaactttcaaggcacatatccgcgcccaggtgaagaagcggacttgcacgcagtacagcgaagggatgatgagtcacttcgctcatacattcagcggttttgtcaagttcgcaacaccataccatgcatccctgcacacgcggtgatctacgcgttcaagggggtgtgcggcacaaccgcatgctcgaaaagatcgcctccaaagagccccagactaccgcggagctttttcagctcgcggaccgagtggctcgtaaggaggaggcatggacctggaacccctccggttccggtgtggcagcttcggccgcccccggatccgctgctcggacagggcggcgtgacaggaggaggaagaaaaggtccgcccattctgacgacgagggtcatgtccttgccgtcgagggtgcttcgcgggtcacccgaaaggggaggtctgcgagcgacaaaaagaaggaggccggcgctcccagcagggagcgcccaaccggcaggtggtgcaccgtctacaacacctcccttcacgacctcgcggactgccgcgccgtcaaaagtttggctgagcggacgaggaagtgggaggaggagaggaggcaggagcgccgagggggcaagtccccggcggttccttccggcaatcggcgaagtgaggccaagcagaaggcccccgccgaggacatcgatgacggcgatgatgacctaggtttccaagaacctggggccaccattgccactgtcgatgggggagcgtgtgctcacgtttctcgccggagcctcaaggccatgaagcgagagcttctggccgcggcccctactcatgaggcgacgcgccgggcgcggtggtcggaggttgccctcaccttcgaccagaccgatcacccaccgtgcgttgcccggggaggacagatcgcaatggtggtttcccccactgtttgcaacgtgaagctggggcgtgtcctcattgatgggagagcagccctcaacatcctttcccccgtagcctttgacgccatcaaggccccggggatggtgctccggccgtcccagccgattatcggtgtgacgccggggcacacttggccgctaggtcatatcgacctcccggtcaccttcggtggatccgccaacttccgcacggagcgggtgaactttgatgtggcggacctcagtctgccctacaacgcggtcctagggaggcccgcgttggtgaagttcatggcggcggtccattacgcctacctccagatgaagatgccgggccccggtggccccatctctgtccatggcgacctcaaagtcgcgcttgcttgtatggagcagcacgcggaccacctcgccgccgcgtccaagcccaagggtggcgacgagaggcttggcacctccgtccccgccgccccgaggcagcggatgatcacatgcgacgaggtcccggtcaaggaggttgccctgggcgacggcccgtccaagaccacaaggatcggtggtcttctggacggcaaataggaagacgcgctcgtctccttcctgcgggcaaacgctgacgtcttcgcatggagaccggcagatatgcccggggtccccagggaggtgattgagcaccgtctcgccgtgcggccgggcgcaaggccggtctggcagaaagtgcggcggcaggccccggaacgtcaagccttcatccgcgaggaggtggcgcgactgctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgttttctagatgcatactctggttaccatcagattcgcatggctagggaggatgaggaaaaaactgcattcattacccccataggaacctattgttatacgacaatgcccttcgggttaaagaatgcaggtcctacttttcaacgtactactcgaatttctttgggtagccaaataggacgtaatgttgaggcttatgtcgatgacttggttgtaaagacgcgcaaccaagagaccttactttcggatctagcgaaaacttttgagagtctccgctccgcccgcataaaactgaaccccgataagtgcgtgttcggtgtacctgcgggcaagcttctcgggttcttggtctctgcccgaggcatcgaggccaaccccgagaagatacgagctatagagcggatgcgcccccccagcaagcttagggatgtgcaatgcgtcaccggttgcatggccgccctaagtcggttcatatcgaggctgggagagaaggcgctacccttatttaagctcctcaaacgctccggaccgtttacctggacggaggaagctgaacatgcctcgcccagttgaaggcgtatctcagctctcccccagttctggtcgacccggagccaaatgaacccttgctactctacttagcagcgaccccgcaagtggttagtgcggcgttggttgtggagcgcgatgaggacaatcctcattccgcgcatccccaccctgtgctggcttggcctgggagagagcagggaggagaggcccccgagccgaacggtggcccaaggcccccgacgactggagctggccctctgcccgcttgtcagacggtgccaggtgcccccgacccccaggatggcccgggggccactgcgggaaggccgcacctatcgccctctgaccccgaggttaaccctgtgccgactcgacccgggagagagcagggagaagaggcccccgagccgaacggtggcctaaggctcccgacgaccggagttggccctttgcccgcttgtccgacgacgccaggagcccccgacccccaggacggccccgaggccactgtgggaaggccgcacctgtcgtcctccgaccccgaggtcgtcggcacagaagacaagtgcgccccacgtgaccgcttggacgaagagcgccccaggcatgcggcccctggcgaagaggatcggccccaccgaaaggtgcagcggcccgtctactttgttagtgaggccctccgggacgccaagacccgataccctcaggcccagaagatgctttacgctattctgatggcctcgaggaaactgcgccattatttccaagcgcatcgggtcacggtggttacgtcttaccccctcggccaaatcttgcataatcgagagggtactggacgggtggtgaaatgggcaattgaactttctgagtttgatttgcactttgaaccacgccacgctatcaagagccaggccctcgccgactttgtggcagagtggaccccagctcccgagcccgtctccattcccgaggccagctcgggcccctcgcagctgcatcacaccgcctactgggtgatgcagttcgacgggtccctgtctcttcagggcgccggtgcgggggtcacgctgacctcgccgagcggagacatcctcagatacctgattcgcctcgattttcgggcgaccaataatatggcagagtacgagggactccttgcgggactcagggtggcagctggactggggatccgccgcctcctggtgttaggcgactcccagctggttgttaaccaggtctgtaaggagtaccggtgctctgacccgtagatggacgcttatgtgcgccaggtacggcgtatggagcgccattttgacgggatagagcttcggcacgtgcccagacgggataacacgattgccgacgaactctcacggctcgcttcctcgcgagcccagaccccaccgggcgcctttgaagaaaggcttgcccagccgtcggcgcgacccgaccccttaggggagacggacgcgcctgaccggcccccgaggcccgtcggagtccaggcctcgggacccgaggggagcgctcccagctcccttagattgattgcttggatcgctgagatccaagcatacctcacagataagactctacccgaggaccgcgaagggagtgaacgcgtccagcgcatctccaaactctacgtgctgatagaagggaccctttatcggcgcgcggctaatggagtcctcctaaagtgcattcctcgggaacaaggcgtcgagcttctcgccgatatccatgaaggcgaatgcggagcccactccgcctcgcgcactttggttggcaaggcctttcgccagggtttctattggccgacggctctcaatgatgcggtcgacctggtccggcgatgcagggcgtgccagttccacgccaggcaaatccatcagccggcccaggccctgcagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtgagcttttcggtgactactgcgaagacatgggcatcaagctctgcttcgcctcacccgcccaccccagaagcaatggccaagtggagcgcgccaatgcggaaatcctcagaggccttaaaaccaagaccttcaacatcctcaagaagcacggcgattcatggatcgaggagttgccagcggtgctctgggcaaaccgaaccacaccaagccgagcaaccggggaaacgcctttcttcctcgtctacagcgcggaagcggttctcccatctgagctcaccctgaggtcccctcggcccaccatgtactgcgaggctgatcaagatcagcttcgcagagatgacctcgactacttggaggagcgaaggcggcgcgcggccctccgagccgcgcgctaccagcagagcctgcggtgctaccatcagcgccacgtccgggcccgatcactctgcgtcgacgatctcgtcctacgccgcgtccaaacgcgtgctggattgagcaagttctcaccaatgtgggagggtccgtatcgagtgatcggcgtcccccggccgggctccgttcggctggccacgggcgacggcacagagctgcctaatccgtggaacatcgaacaccttcgtcgcttctatccctaagggggatcgggtgtcaggtttcgggctcgggccaaccccgcacccccctcgggcgtgcagggttggccgggggctaccacacatgcatattcttatttctcttctatctgtatttcaataaaagcattttcaatttcctaaaggctgtatctgtgctgttgtttccttttgaagaatcttgacttgaaataggtcactcgtgctcaatcctgccctcgggggctcgggtcggctaaaatcgccaaaaggggcccagaaccgagccgtgccccggggcgtggtgaactccggggggggggggggaatcggcaaaaacccacaatcgggtcacccataaccctcggtcaccacgctcccggcctggccagtctcgacatgtggatctccccaggcactagccccgacccgagccaattgaggactgggacctgggcacgagcccttgttcaagccaagacacaaaaggaccgcggcacagaccatcctcgtctcatacacacaacaaatagaattgacacaaaaatttcctctttatttgattacagattaaattagtctatacaaaaaggaggcctgaaggcctcggaagaaagaagaaaatggcggaaccagccctgccattgcgaaagggaggaagaagacggaccgccccgggtagcgtggcgccgagcgtccctcgcccagcgtgactatctcccggccggtggcagattccggcatgaagcggcgcggcagcccgacctgtctctcgctcacgatgcgggaaggcggcagcacgctaccatcaagcggagcggagccccgtgccatgacgccggaagaagagatgtttgagagcgagcgcgtgtggcgagggtagggcacaggaaacaaggagttagggcgcaagcggcgaagacaaggggaataatggcgagaggaaggaagtaaatcccttcctcggtgtctttatacccttgccaacgctgtgctcggctcctcgcttctcgcgcccactatctcgctccctcgtttctcgcgcccacgcttccactaatcccattcgcccgcttgcggcgcatgaggtggatatgcggctgtggcggtcgagatggaacatatcgtgcgcgcgttaattacgctcgccgaccgaagcgccatcaccatatctccaggcaaaacgaaccggctcgtcccaattcgcgtgctactcgagtaatgtggcagtcttgaagagaccgctcattattgacagccgagttaccattgccgatgtgtgtgatttgcgaccgttgggtttctgcccaactgtagagaccagccccacttgtcaccaggcctaagtaagtggcgtcacgcccgaccgcttccctcaaggagggcgatcgccctggcataacgccgggggctactgtcggtgacatgggaccgggagtatcatgactagaggtttgggcaggagcaatcacccacgtggcctgaccccctcgggggggtcgggcccgagggtgatgtggccgcccccctctttgtctccccgaggggtcggaccgctcccgtttcggccccgagggctgaggcgccccaaccccttgtgggtttggcgccgcgtgtatgggttaggtgagcataacggggctcacctaaccgcatttattgcggttta

SEQ ID NO: 67012 - DNA, 585 bp, Oryza sativa
gaccgaacttggaaagttgtatatatctcttggtttaaaaaagacagaatattaacccaaaatgcacaaataatatctacttaaccattaaatctcctatcaacttaaggaacccctttaaaacacgggataggaaaaaacgcataaatcgaagcgacatgttttttttaatcctatagaatttgaaaacacatgaaacaaaaggagaagctctttgattgcaccacacatcgttgtgactggccttgtcgcttcaactctcctctccctacgcacctcctcctctcggctcttgctacgtcgatgcaacagtggatgagcttgcatggttcgcaagagttctctggtgggcgagagggcaacgaggtagagaaatgaggagtgagcctatttccctcggggtcaagcactctaggtaagtattctgattaaagatgagataatgcttcataaaatagagaagttaaaacattctttttgcttttactttcaaatatttttagctttataatgaatgcaaaaacaggtaaaacacattattgacacatagaaacaacaatgttttaaccaaaataactagccgct

SEQ ID NO: 67013 - DNA, 1221 bp, Oryza sativa
gagttttttcattcaactttgtagggttgtttattcatgtgttaccaacatatatgcgattatttttgagattttcttagtacttctgtaaaaaagttttcaattttacaattaagatgtggttttcaccgtatactagctaaatgtttatgcatcgctacatatagataaaaggagaatttcataatattgcctaaaataagcaataatatattttccatgaaatgtataagctaccaacctttttctgtagggaatacccaatttaatttaattttatattgcctattcacttagatttagttgttatgtaatattaaggagttcaaggggctaatatgtaaaatctataatgaaagtaggtgagatgtagaatccctgccattatcattagtcatatatactttcccacgtatatgcatgtgtcaaaaaataaaagatgtattctatgtttgccctgcacatgtagatgtattttatttatctatattttatctttattcagctgataggatggacaccactgatagaaatgaagaagattaatgctagcagaagggctgcgggagttcgtttggtcgggaagatggaaacataccaacctctttgttcagtcaaagacaggactgcccttgggtttgtgaatatatccaacacttttagattaaactatcaggaaattgcatattaatatttcagtatctatatatttaacaaagatacattctactccattgatctatttcattgggtcacttaatggactaaactatttttggctcatcttacccttaaatttttaaaaatggttcagtttattgcttaacagtattttttttcaagtcatgttctaagacgactcttttttaaacaatggatgacaccattatcaaagttaaaaaaatatcattttatatgattgcttacttgaacttaattttgttgtgtaaatcaatcttagttgtttcccatatgtaaataatgataaaatatttaaaaatgttgagagataagttgttatacatctatttaattctatcaattttagtgcagaaatatgacagataacaaaaagaaaaatatcacgatgagtaaactgaattgttttcaatagatcatgatataaagtgacctgtaaaatagaataaggggttaagtgctccagcaaaacatatagttcggaagagttaagtaagacttttttatcacctttaaccaaag

SEQ ID NO: 67014 - DNA, 9825 bp, Oryza sativa
cgggctcgacgacgccgcgtgctgtgaactgcggcggcggcggcggcgagggggaggtggagaggctgaggagggacaaggaggcgctggcgagggagctggcgcggctgcggcggcagcagcaggaggcccgcgcgcagctgctcgacatggagcgccgggtgcggggcaccgagcggcggcaggagcagtgcacggagttcctcgcgcgggcgctcaggagccccgacgtcctcgacaacatcgcgcgccgccacgccgcggcggtcgaacgaaagaagcggcggatgctcgccgccgccgcggacgacgacggcctcaccttcgaggcgctggcgctggccgcggcggccgacaccagccatagcacgggcggcgcggtgaccacggacatgatatggtacgagctgctcggcgaggagcaggcggagatcgacatcgaggtggaccagcttgtcgcctccgcctccgccgccgccgacacggcatcggaggcggagccatgggaggagatgggagaggaggaggtgcaggagctggtgcagcagatcgattgcttggcctcgccgagttcttgatgcatggcttgcattaggtagtagtaagctagccatgagcttcctctatattgttgtgtggcgtgttagtattagtagctgctttgctggtatgtgattgttagtatttatgtttgggaatggcttggtttgatataattcggattctgcgtttgttcttgcaggatccagtgatggcttaattaggagtataatggaaggaatgcaggaagtggatggatgtggtagctaatctgcttcatggattgatgtataaggttatgtatcaacacttcaccagtggtaattcatactacatattattcatcttcattgatgtgctacaatgaatctcttggaatttaatacattgaatatcttggaattgagtacttgtttaaagataaatcattttttgtctgataagcttgttttttttcttctatagaggaatgcaatggatgattgattattcatctctaggaaacacctggtgataacgaacaatggcgctcatgcagccttttcataagacttgtctgtttcatcttcaaagggccacagcaggcacacagtccatttcactgaagatcgacagccaagaagttgtctctcatgaacaggatccaacatcagtatcgctcagatttgttattctactattcaatgttctagcttatttcatggaacagtttcttatcttgattcttgattacgacaggtttgctatcgatgagcaaaagtggtgctctcagcatgaggctgcactgtccagatacaaaagtcccagcacctattgccatccacttcactgataaagcacgacgcaaaactcaagcttccaagggaacagggacaaatgtgtttaagtcatcaactaaacaacatggttacaactgttgtctgacaaaagcttaactgtatttgttacaagagagagacatatggccactacttgtcagcactaatgttacaccttcaggagaaaggtacagaagctatcttggcattgttatcagtcgtcatcgtcgtcgtcatcgaactcgtcctcctcttcctcgctcagctcttccataggctcatcctcttcgttaactataaaaccactgagtgtttcatcttcctcatcatcttcgtccccctcatctttttcatccccactattcttatttttatctttagtctcagttttttccttgcgaggtttctttggttcttttgatcttgtaacatactttgatctcttcacactagaacctcttgataatgaatctttatcgtcctcactctcacctatccaatcttcgtcttcacgctgcccctcattcttcttgttagcgcctttaccctttaatttgccttcctcatcatcttcatcatcggagcccttccttacttcctccagaaaccaattccaatcctttgggggacgaattcttcctttaggatagttgtcaaattcgtggcccattgataagaacccgaattctgcagccaaacaattactgtatcattcaacagggtggaagtattttcgatattacgaaaaacgccaaacgaaattatttatatgtccttcgattttgcaggaatcatcacaacttaattcttcagataaaaaaaggagtagagtataaccgaaatcagtagcactctttggtattttctatgaaaccaaacaggtcttgacatatactagcaatttagcaatgtgacattcttggttttgtacatctacatgaacatacctagatatccccacaaaaaccaacaaccattttgtatcctttttccttttgaatttacccttttgtacttcgcatcaacaaacacgagttaaactacacattagaaaagcctcgaagatgatgcaatggaaaggaaactagtcactgcaatgtagcttgaagatgactactagtatctaatcaactcatttctacagcattgtcagaaacaaaatttaactcttgtttgggttttttttttcttttttctctgaagatgaagatgaacagaacaaaggtcaaagctcacctcgaaccgggtcgatgcttgatagatcgaaattcaaatcctccgcttcggcatcggaatccccactgcacgccgcctccgcctccgccttcgactccgccgccgccttctagttggcggtgacctccatggcctcctccgcggttcgcctttccttctccttccgttccttcgtgcgcctctcccgcctcgccacggggtccagaacctccgcctccacatccccatccccatccccgcccttgctccttgtcctccgcaccgcccagaccgacaacggcgacctcagcgacagcgcaagcccgtccccgtcgcggagctccccggcctcaccgcaccggaacaccctgctcccgccgccgccgccgcccaccgagcgcacgaccacggggttcctccccacgacctagaaggcgaccctgggctcctcctcctcatccccgccgccacctaggaggcggagggccacgtggcggcgcgagacggtgcggtcggaggcggcggcgccgcggccgagcaccgcctcgggggagtcgccggagagggacaccggtggcgcggtgctcctcctcccgccgccgcctgctgcttcgagttcgagctccatggatgctaagctggcgacggcgaggtcgcccgagaggagagggacgcgtctctcaggggttggcaaatggtataggtgtccaaacgggcggcacggcccggcccggcacgggcacgggtccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccacgggcctccagtgcacagtgttttttttaaaaaaaaaagcaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttgaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggcatcgttaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgcactgtccgcgcctgacgggccgccggcgtgccgtgccgtgccgtgccgcgggccgtgccgtgccggcccgctacagtagccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctagcaaatggcaagcggcggcagcgagtgctgtgctgtgcttatgtgggccgtgactacgtgaatttgggccgggccgattttagtattcgaggcccacagtctgtccattacgtttcacgcttatgggtttctcattttcttttttttttctcccaacctataatactaaatcgcttttgctattttgcagtcgcctgcaaaattttaatccatcagtcgatcgcatcgaccgtcgattatgtgtcttgattttgtgcgcgccatcatctttcccttgctaataagcccaaagtccgcagcccacagcccacagcctacagcccacagcccacaaatagctctggagaaatccgtccgcacccgtgactcatctagaaagcgcttctgcttctcgacttcccctctcgagtagatagcgtttgtgtttttctcgagcagggggagacggagtcctgcgagcggaaggtgccggagattcttccaaggcaggaggtggaaggggaggcgagcgggggaggtgggctgtgcaccgcgagcggccgcggacggcgccggggaaggcaccgcgagtgtgccgtcgaaggcgagcgcgcttgagttgaggcacttcaggttttttcatctctcttttttgttcaaatctcacgccgcgacggcctgatcccctcagctccagattttctatcatgtggattttgtgagttgtttagggctggattggctaccatttcaagggaggggggggggggttcccgcgtagtttttttttcattccttgatgctttggagtttactgggtatatgtttttgacttgattttgcccaatgtcgagtaaagcatcctggatctgaaaccacatgatgtgtgtgctttgaagttttgttcggtgtagttggggaaaatttttttagggtttttactgcacatcgcgtatgatatagtcggcaggaggtgggctgcacctctgcctggttctaaaccttgccactaattattttctccctaacttcattttctcactaattattttcttttgatgtaaatcatttccccatctgtgaagaataactggatatatatagcccataaatttgcgaataaacatgcttactattgggtcattctcattatggagtactcatcagtcagaccatccgagctggatttagaggaataacatgcttacttcagttttttgctcccaacttgaaacataatgtatagagaaataggttttgtcattttctttagaaatagttataagcagttctgtcattggagacagagatagttgtcaatagttaattttgtctgaactctagctgcaattttgtagcagtttgttttgtagctgcaaggtacagtttctcatattcagatatgtgtactttgttaaaacctgacatagcagaggtacaagattcagaggtcaatatatttgtgtgccaattcatattatttctgttaatctagttcatatgcaggggcaagattaaatgcctcatatcagtcaaatgtaagtacaattttgtttagttttttttctcaaatacctcgagtaatatcaactcctttcagctttcttttttgccaaatccacacgccagtgcctctcctgagactagaggaaaaattaattcagcacaacagattatattttttgtcatttaatacctgaacacccagtttcctgaaactagctgtgaacctaaacaagactatatatctgagtagtaaagttaacaccaagctatggctagaggaggtcaaatagatattagcttaaatcattttactgaatttttttttcttcatgaaacatatgacctctgccgtggcattttagagaggggtttagggatttgctagcaatttgagctcaacaactaaccaatattttcattaaatccctacaaatgctcttacctttttgtccctcagcattgtcagatccatttttgtgcatagagggtttgagttaatcagtccattttagtggtcactctatacagggagatttttttgtgcttgtatacagaaaaagctatcttttgtttttgtgtgctgtgtattttttttaacagtagttgtgctcaactgtgacatactaagccacttttgcttccattccatcagtgatcaatctgagataagcctccctgaaaatgaactccaggctctgctcctatcaattatgtttaatctttttgagattaccagcagagcattgagagaggagagtaatcttttttgaaattatgtttttttgagattatctatgctagttgcactccctgactattgtagtagccattttgatttttcgtgcaagtcgtgtaataagtttgtgcaactaatgttttttgagcaaatttttccgtttactttgataaatagcgtttgtgttttaggaaaacatgcatacaactggggacttttttttggtagacaacttgttttcttagtaattatgtccaacttttcatttgtttttgttttttgcaacccatactactttttatgttgtatctttttttttctcatcaacacacgacagcaagcgtgcctctctttttttcatgtactgtgtttttcccgcttgaaccatctacataccagcagcattgtccaaatagcaaaatcaactaatactatacatttcgcgcaagttatgttataaatatatgcattttcaattattaaattgtgcaactaattcttttttagctgactactatacgatttttttcctaattttggttataaacaagcataacttcagactgattgtatgctcagatgtagtagctcactacgatttttgttttcagggagcgttggattctaccgggggggggggggtggagcttgctgcagggcaagaagagtatatttccttctgctaagattttgatttgctggtgagcttggacatgtgggtggttgaataatgtcatatccatccagtttgatgaacta

SEQ ID NO: 67015 - DNA, 6272 bp, Oryza sativa
caaatcttttttagggcagataagcaagcaaattctgacattccttttttccgtatttttatcttactgatctttactgaaattatctttgctcaactaaatactgtgttctaattcatatattaatgtctcaagaagtaatgaagataaagtttgcagtatgtggggtagcactgtagcaggacaatgtaaatgcattatgcattatcaacatttgatttttaatttcctgtgttactagaaaacttaaaagataacagctattggaaatctgccactttattatctgttatctagctataatgtctttaccgttctgtttgtgaaaacagtacaaatctattttcaccaagcaatctgtggcataagtaatttgttgttgtttcaggtttatcatggcaccattttgcccaagccacaagtgccagaagatttatgatgagttctctcgtgtctaaaaatgacaagatatctttccttatgttgctactacattagtctcataaacctaacaaggttgtgagatgtattactcctgaagaaatttattgatgcagcgtcagaaacagcatacagttgaaagtgacattttgttttcttatagtctgatcttcaataactgcagaataatatgagatcgcagatgaatctgatctttgatgtcttatcttaaccacagtagccaaaagatattctcttcttcaggaacctgttattttggcattctgaggtgataaggggtgataagagtttccctactagcaatgctgctggtttggtggtaatatctacacgagaagactgattatgaagtgagacaggttgatttgcatgcagttgtttctggtgttaacgcacataactgatggctgcaaagttttaccatctgttattcaagtgacatttatggaagtattgcgagccacagtgactccgtgatcaaaaaggtggggttgagtaccatggtttgcaattacggacctgttagaaactaagaaaattgtaattataagtagacacaaatgacgtgcttcaacttttgatattggttacaaatgtgacctgctcaaatttggggaaccattccatcctcccaatcatcaggtgagagaaattgattagtggagattgaacgtattcaagttttattactttctagtagctctctgactggctccctgtttgtgaggttatattaagttaagctactgcttttagtttttgttcgttcttcaccttaccactgcaatcttctgcttggtcagggttttatgctgaaagaactgaagaggtggtatttccagtgtgggggaggaacagttttgctagtagtgctttaagaaactggggatgatactgtagtatggccgtgcattttctggaagttcatcaatattttgaagaggtgatatattggagcactgcagtccgagaaatgatttttacggcctcggtcttttctcaggctttcagcctcccaggcaattgaatttattgaaccattagtcataaactaatactaacacacatagcacattcttaagaaatagatagaccttggtgttcgcatagactattgtattgcacagttttgtttccttaattattgattcattttccctaataagtgaaaaccgtattctttttcaccaatacaatgatgctaattcttttttttcccctgtgtaacatggattactgatcctccccaatacaatgatggctaatgcttatttcttttttacttccctctttgtaacatggattactgatcctactaaaactaacagtgacaaatagagtactattttcactgttttgttctctcttacatgatggctcatcatgtactctgcatcatcaggtagcataattttttacagataatatcattctcacatactgttctgctgatacgatatcattgatagcacttactacttcgcagtcacaactgtaacaatgtttatcttttccttgtacaaaagatccaaatgttgcaacaagtattttttgcaggtatctgcgcttgtctaggcgccccggggggggcccccgggggggaacccggttggggggacagacactttcttacggaacacgggaccggtgagcttgacgccgcgcctgaagctgagcaccatcccgaactggagctccggcggcgactccatccgcggcgaccggcggaacacgaagcggcggtagaggtgcgccatggccagcttcacctcctgcagcgcgaaccgccgccccgggcacgcgcgcgggcccagcccgaacggcacgtgcgcgtacgagtgccgccgccgctcctcctcgccgccggcgtcgaacctctccggccggaactcgccggcgtcccggaactgcgcctcgtcgcgcgacaggacccccggcgccagccacacccacgtcccctgatcagtttatatagtactagtgcggtttgggtttttcaagtttaacggtgaggttacagaggagatttataacgtgttggttaattgcctacctttgggagtgtgtagcctccgacctctacttgctccgacgtctccctcgcgatgagcggcgacaccgtgtagaacctcatcgcctcctttatcacctgcactttttgaagagaaattaggagaacaaatgtgtatttatgttggaaattgacaattcatcgtgaaacttgtaagttaatatcgctaatttatcactgaactttaaaaacaaaacaaatgtggggggtttatgatgaacactgagagttgcatcatgaaactagtaggttaaattagctactccctctgtttcatattataagtcgctttaacctttttaaaattattttaaatttcttgaaagtttgaccaaggttataaaaaatagaacatattttcatagtttctttattttgtgttgaaaatattattatatttttctatacattagttatatataaagaagtttgaaaaaaaaatagaaacgcacttataatatgtgactaagatagtaatcaacaaagtaatttagataatttaccgttaattagcgattaatacgacttataatataaaacaaatgtagtaattaagaaagtaattaaaagaatttacagttcgttagtgattaattacctggtcgaggtaggggaacttgtgctccaggtcgtctgccgtcgggaccgcgtcgggcgggccgaagcggtcgacctcgtcgagcagcttggcctcgacgcccgggtggccggcgacgaggtacacggcggaggagagcgtgaacgccgtggtggcggagccggcgaggaggtgctcgtaggtgagcgcgccgacgtagtccggcgtgagcagcgcccgcatcctgtcgctgccgccgtcgcgggcgttgagcacggcggacaggaagtcccgccgcgcccgcctcgcctcgccgccggcgcgctcccgcctcgccacgaccgcccccacgcgcgcccgcagccgctcgttggcgcgcgcggtccgccagtccgccgtcgccgggacgcggctcagcagccgccgcgcgggcccctgcagcgccggcgcgacgaggccgagcacgatggagagcgaccccgagaggtccatcttgagggaggtggtggagtggacgtgctccctgatgaactccgccgcctcgccgccgtcggcgtcggcgtcgtcggagcgcggtgctgccgccgcggcggccgtcaggccgaagtcgacgccgaacgccgcctggccgatgacgtcggtggcgagcttgagtgacaggtcggagaagtcgacgtcgcgttgctccgccgccgctatggcgtccgcggcgcgcgcgacgcagctgtgcatggtggggatgaggccggcgaggtgcgacggctggtacagcgagatgatcgtgttcctcatcgccgaccacctcgcgtccctgcaacgcaagcgttctcgcattacactatgatgacgcagtaatgttagaatttaattcttttttaaaaaaaatcgcacccatttcccatttggaacgcgcaaaattttcaagaatcactatgtaattgaaacgtttcctacaaaaattacacggaatccctgcgtctgaaacaaagcatatgctacaaaacactcacgcgtgcaaaattagtagtactgccatactatagtgttttgttgacatttttgcctttgaatggagatcttcgaagctccacacattgatttgcaccaattccaaaccatgatcaaacagtggatgatcactacttatctcttgaaacgctttgaattggaaaaagtgattatgaaatggatttgagctccatcggttggcctagtaagccaaagcaaaaaccaaaaattgaattttcgagcttgattttgaaattggttttatgatattttcaacgtaatttctttttagcgttgaattttaagtctatacgaataaatatataaaagtttcacctacagattaatttttaattttttttgttatgaccttgtgaagaagaggcccttctggtggagaggggagccggcgataggcgccggcaagctccggtttgcgatgctcttaaactgcctgatcccgacctccttgcacagctccgcctccgccacaatcaccagcggctgcctccccaaatgaaacctacaatccaatccattacaaaaaaaaaaaaaccatctccttcccaaacagatcaaatcaaagcaaataagcccagaaatttggaagccaattattagattctttttttttttgtccaatttttgttctgaatttgtgttacctgaagatgggcccgtatttcttggcgaggacggcgaacacgtcggggccatgggcggcgagcagcggcaggtggccgacgacggggagggcggccggccccggcacccgccggacgccccaccacggcgcgtagaagtagacgaccaccaccacgacgccggcgagccaggaccacggcagcagcagccatggctgatccctcgcagccgccgccgccgccgccactagagcctccattgatctgatctgagcttttgatcactcgtatgtgattcttgcaagatcactctccgatcgagtcacagccgattaattggttcttctttatatgagtgattgccactgcagattgcagttggccatccatagtgctgtgatgttgctgggaatttttttatgcaagagattgaattttagtgctgtgtcaaagaaatggggaacttggagatgatggattggacggccattgtcgcccacattctcctccaagtggggaagaacaatgccccggaattcttttcaataaacaagttgggaaggggggaaaaacactttgcaagaattttaaacaaggacggatagctgtggcatccaactgtacattcccccacgattttgtaaagggtatggtcgagttttttaagcccttcaaatttgctcaaaccaagcctttggattcaaggatttttggaggaaaagtagaggcattgaatccaagagaataattcctattagagatcatatttggtttgtaggattgcttcaaaggaatttcataggataggaaaaaaaatactccatattttggaggatttttagcatgatgtttaagctcatattttcaaattcctttgagagttccaatgcaacttgtgtatttttctctcccttcactctctaacaaaatcataatataatcttaattttcgtcggagctatgcaaacatcttttttgagcaattcccatgattttatttcttgtaggattcaacaagtactgataatctattcctaggagtacttctttttttctttcctgtgttttcaaaatcatgcgttccaaataagcccttctagtcgcgggatgaaattaggcaaaatccgtttggtaacatcgaaaaattgtccaaaagcttggttttaagttcagggctcggctgggccttgacaaacttacaaacagaaaattaggcccaatgggccttaacatccgaacttggaataagatcaccttgactccctcaactgaccaccgaatctaaatcgtatccctcaaccgcagtaccagaaatcttgactccccaaacttacaaaaccggtgcaatttgactccctgggtggttttaggaggcggttttgctgacgtggcgcctacgtggcaatattgaccgagtcttcgttccacgtggcgatgacgtggcacctacgtggcggtagaattaaaaaatacgcgtgggacccattagtcattcacacaaaaagaaatg

SEQ ID NO: 67016 - DNA, 3480 bp, Oryza sativa
  unsure (1)..(3480): unsure at all n locations
atgagtagcctatgtgatgctacagtaaacattctctaattatagattaattaggcttaaaaaatttgtctagcgaattaggtttcatttttgtaattagttttgtaagtagtctatatttaatactctaaattagtgtctaaatacatggactaaagttaagtccctggatccaaacaccacctaagtcagagaacagtagcacatcgatctgctgtccaccaagtatttctgaaatagctcagagattgtaacaaatacttttggcctctcatctatctcaaataaaaataaaaacttttaactaaaacttgtaggtctcatcaagagctgtaacatgcatataaaatttgtcttcatgcactactgcaagaacaaccataggtgtcaattgagaactggcaataggtgttggtttcccagtcagcaccaatttatcggcacctatgcaagagattatagatgccggttttagaactgacacatgtaaagattataggtgcatgttcttaactataataagcggcacctatgaggtacacgcgggacaaaaaagaaggctcgatttgagccgatgcatcgaggttctcctgttgccccaaatccaaatctcacatctcacaatcctcaaatcaccaaatcaaacaagaaggattcctgtacgaacaacaattaagataaaataaagaattgacgccgaaaaggacaccagagtcgttcctagccgctcagccgaccgccgccttgccttgctcttccctcccctgtcccttggctgcatgcactactgcactcgtactctatagatttctcgtttggcgacgagtggtaatgggcacggcggcggcaacagcaacagcagcaggtgaagacaatgacgaggccaaggagacgtactgcagaagtaggtaggaggaggcggatgcggtgggtgggagtggggcggcagggagcagttgaagaagatccatcggcccccaacctccacgtcggctagatctagtggcccacacctccacaccggcggccatagaggagaagtggaggggttttgtagtagcgatgtaacttcgtatgaaggagtgatgattttttttatgaaatagtattgctcccatttctatatgaaggttctcttaagaaactgcaattaaaaaacaaattttgtactccttttcttaagagaacaaccagcaagaatcgtttttcattggcacttttcttaaaaaacaatgattttcacaagtcctttcttatgaataacatctcaaagtagtgacagttattgaggggtgaaagggtaaaacaacaccttagaaatgtttatatttgtgtctatttgtaggaatgtatgcatttctaaacggatggggtagacaccatgtttgataaaccctgagctccactcgagacactcacggctatgattggcctgatctttcggtgaattgaagataactacgatttgggagaaatgttgacgacctgactacacccatacgagacgttgttgtgttgtgcctaaacgattaatacacctctccgtgggttgttgatcttgccggtgcagatcaaccttatccccacaagcaaatcaaagaaacgaccaagaccaagataaatcaatctaaatggcaaatataaattgaatacaaatgaaaagttggggttccgtaatgagcaaaccggtgatctaaccaatcacggattacacgacaaagtagcggagctaaactttaatctaaacaaaacccaagaaaccctgaagggacctatctatttaaggaggtgggaggacgaccaaggggtctttagggtcgtgctccgcctggttggggcgcaccccacatgagtcccacttgggcctggtcccagatgaagttacaagcccatagacccattcttggtgatgcaatacattgtttctgtgattgtggatgactgggatgaaatttggtgatgaggccagatctgttggaaagagaattccaagatgtttctatcaaatactcatagacccaaaatggagcacgtatgtacacttggcagccgtttaaaatcaacacggtagcaggtggctgaattagaatctaaaacttggtcaaatgatcttgatatgagcaacggttgtattaatagtttgcatggtcacatcaatgttatacgacaccttgttgaaataatatacaatttctctagaaaatatatatgtagtgtaaactacatatatagtagaaacagctgaaaacagccgttagatcgtaaaatagatgtatgagatttggaataaaagttttacttttgatgtcgtcgacaaatctcatatatccatttttttatctaacggtactttctaagtctcctctgtatgtgatttgcacggtacattttcactagctgctcgggctagtacagtgcatctttaagtaccatataagaaatttgtatgcgtggacttcggatgtttgttgtacattcagaccctttttttctatatttgctctgcagtatgatagaagatgctgaaaagaggggctcgatttcacccggagatacactaatcgaggcaacaagtggtaaccttgggattggtttggccgctgttgctattcagaaaggttacaaatttattgctgtaatccctaatagctatccacctgataagcagaagttaataaagtatttgggcgccgaagtaagaataactggtaagtgttaaatacgtacatatacatgcttgcagtatgacgatcactacggctggttggtacctttctgcctgtgccttagctacatcaaaacttttctagatcatattattatcttttactagataaatacatgggctttgttatggatagatatgaattatacatgacctagcattatttggaacaattgattgtaaggtttttagaacaattcatccctatagatgtctttgcatgatgaactgtattttaaagatgaaataatgttgaaccaatatatatgactatttgtaatataaaaggagtagttagtaaaacaaattaaatagagtttgtgaagatggtagattaaccaccaccaccattacattctttttagaataatatagatatagataatggtggtgtgatcctttcgaggttgctccatttcttaaaaacaacaacaacaactacctctagccacaaataaatgatattttagagagtaatttagtcaccaagacattgttttaattgttaattactagtataaaatctataaaaaatatagcaaagtcataatattttagaactactaaagacaaatntaatcaatgcaacaggacctgcttaggaggtctttacctatcacaggtatttacacctaattaatcccatgtttataaagattttggggagtttaaaaagcatggcacgtaaatgttgacattggatcaacaagggtgtttacaaatctctataaatatgttagtttaaacctagccat

SEQ ID NO: 67017 - DNA, 915 bp, Oryza sativa
ggaggcggcaggggctatatgatgagcttgcctctgtcggtaagctctctcctgcactcattgtcatacgggagcatctaccttctggaaaagcatgcctaagagttaacattgatgcaacgaaagtggggaatgtggctcgttttatcaatcattcgtgtgatggaggcaacctgcatcctgtcttagttaggagctcaggctcattgctcccaagactctgcttttttgctgctagagatatcatcgaaggagaagagctcaccttcagttatggtgatgctagacttaggccgaatggcttgccgtgcttttgcggtagcttgtgctgttccggcctacttccttcggaagagacataatgccatcatttgtaattgagaatttcctgatgtggtgctgccagaataatattggcatggcatcaggacgagtagacggtacctcagtacctgatgagtgatgactagtgctttcacaaattcagtgtacactatgcatgctgccttggccgttttcatgacccattctgtaacttttatctgacactctgagaaaacgacttgcaagctatgcattctttgctcatagcatagtgtaccgcaagttaccggagggtagagagtcttttggtagggatgttcttaaatcctactagtaaaatgcaattcatgctggcagttgggcatgcatttcccgcttcaggagtcaggaggtgatgaagatgaatcctttgacaaagaagactcctggagagagtggaggactcaacagaaaaacaaccttgtgccgttgcaatcctttatccaaagcacacttccgtttccgctttccctagcgtttgtttcctctgtgcagcaaccgcagcttatgccaatgccaccattgcccatgccccatgttccatttgcacta

SEQ ID NO: 67018 - DNA, 577 bp, Oryza sativa
ctaactcatgctccaggttctaatgattgaatatcactgcagatcttgatataaacttcttctatttaactgggatgctctattttatttaactaagatagttgttgaacagacgccgtgctaactttagtatttagatgattgcttgaagattgtgttcattatttcgtgagaaatgtacttatgttgcaactatttataagtgccataaatctttaaaatctgttgccccttctgagtaaaacttctgttgcatatttttgttttatttgtaccgaacaagtggggaaatggcgtataattcactgtgaccattcacttcctacttttaccctttttttccatgttagaacagatgcgttgttttacttctgactggtatttactcgattgcagacgacagcatctgaaagtggactttttgatcatttgataaatgtttgggagttcaagcctggtcctgttcctggaacatgtgacctttacttcttggttgattttaagtttcagtcgccactatatcgtcaggtaaaatcatccgttacgatcgtgcacatgaagcgcattcatttaactg

SEQ ID NO: 67019 - DNA, 1170 bp, Oryza sativa
tctttataacaggggaagcttcagactgatctaaaggcaactacaccagaaaataacaaaacatttgcatctattatacaaatcaaccaattaaactgatggcaaccattggcattgctacctcgctttcaggttgtaggtgcgactgaaaaataatcaaaattgtttgcaaagtcttaagttgaacaatctcatctgtcatctctgcatgctgcaaggaaaatgaaacaaaaaacaggattgagaaatcatcagctaatattgtacagaatttgtttcaagaataaaacaacaaaatatcctaatgcaaaaacaaaaggacttagtaattaatcatgttttctaaacatacgtttgttttttttttcaaaaagaaaaacactatcagactcatcaggtcatcaggataactagatgacacaaaatatgtgattcagtttatacatctattaagaccaaataaagaacaaatgaaaatagtgagaggtatatggatacagaagcgatcaaaactcacatccttcaaagtagtcagtatatccttcaatgcagaagaagctacagcatcatgagatataagcttttgcaaacaggatagtcctattacactcagcttcactgatttaacactgcatgccaccagaaacatccgcaatatatcctcattttgagctatttccatcggactagatagagaacggagctgcatgccaaaaagaattcaaatacaagttaggaaacaagtagcatgacggttaaaagaaggaaacaagttaaaaggtactttgtggtctaacataagaaattacagaacttttgttcactatgcatcatctaaattgcaacacaaaattattggcttcacttgagttatggaggagatttgttgataccaaagatttaagaacgtcaacagattagcttcagataggcggaaggacatgcttaatcattatcttgcaaataacaggtatacagttggtaaagaagataaatgatctcagaatacaatcagtcatctggtcaggtcaatcatattagcatttaaagtatctcaaacgtttgagaaaagaaaaacaaagtggaagagaggcaataaacacatcagcgcataccactcaagttcacacctcaatttctagaaaatacatgaaaacaatcttgcttgtg

SEQ ID NO: 67020 - DNA, 686 bp, Oryza sativa
atttaatagtcaagggagtaataataagtttttttttaaaaaaaaacaccattttctatcccaaaatataccgcttcgactacgtaccatttacttaattttgtagttaatttcagaggtattttttattgctttctgttaatttcaggggtatttttattgctttatgtttcttttaacctttgctttcggaccgctcagatagcttttgaaccgcttagatagtcagaatatagtctagttccagcttcattgcttcgcttattcgtagaataagccaaacatcatatttacacacgggatataatttgtgaataaaacttttatatacgtgttcttagcgatctaaaagtaaagactgaaaaataaactttaatgaaaaaacccaaaaccaactccaaatttaaaattgaaaattcaaattctagctgataagcataagcgaaaagatgatacccttcatttattcacctatttcctccgtcctaagaaatagaaaaaagggacaaagcaacgagggcattttggtcaatttctaagtgctagcgacgcaaagcagacgataatgaatattgagcgaggcaaggcaggtgataaactcgaatgtgcaaaaggaatgtcaaacttgacatcaaattgtaggaccaacggccctctgaggagcatcgtgacaatagggagtatcg

SEQ ID NO: 67021 - DNA, 1025 bp, Oryza sativa
agttcaaactctagagcccctctccctcctcttttctgcagtctaccagcttccggtcctctctcctttttttctccttccgtccgtcccctcttttggtaggcatggtcctccttgtatatctcaaggggataccacatacaccatttctacctacccttcttttgggtggggacccatcctactttgaccaaaacttggcttgtaccttcgtctgacaccgggataaccctgtcctccctcattaatgggcggagatttacaatggctgctgtccgaatgaccctccgatgggatgggtcataccaacctccactccgccggaagcaggtgcaacgtggaagcacggttgtttgctgatgacgcgaccggcgtcagaccagtcacagaccggtcattcttgtccaccacgcgtcagtttagcatgctacacgtatgcccttcttcatacaatgacctccttgcaatggttgcgatgaagcctggaatgtatctggccggggctgacgtgccaactccaggagttcccacgccggctccggctagggacgagtgtctggaggctctcatcattccgacgggacggggcgaggcgtgtgtcaggccgcctgttgccacctaacccgcgatctgaccggtctgtgaccggtcacacactgcgaccgatcacggaccggataagcatgcgctatgctgcattaaatgcggcgtgaggcgctcgtccaacccacaataaacgcggttaggtgagcgccgctgtgctcacctaacccacacacgtggcgccaaaccctcagggggtcggggcgccccagccctcggggggtcaaacgggagcggcccgacccctcggggagatagagggtggggcggcctcatcaccctcgggcccgacccccccgagggggtcaggccacgtgggtgaccgcggctgccccaaacctctagtcaagatatccccggtcccatgtcaccggcacgtaccttttcctttccgaaataatagaggaggagttttgggtccg

SEQ ID NO: 67022 - DNA, 3389 bp, Oryza sativa
taattatagattaattaggcttaaaaaatttgtctcgcgaattagctttcatttatgtaattagttttgtaagtagtttatatttaacactctaaattagtgtctaaatacagggactaaagttaagtccctgatccaaacaccaccttagtactgtcagtattgcttgtggcgtacgtctctgctgggggaaaatcgttaataggaaatggaagttgaggggtggtaaaggttgttgtctattgtttgggtagtgagcgtgaaattatgttttagcagggattaggaattaataaagtttaatatatagtagcaaactcacctttttaatacatgggtagatacaaataaatggaaggaaattctcctgctaagaataacgaactccttataattcttatctctactaataccaagcaagggatgtggagaaaaataaaactccctcacaaccaatccctaccaaactcctaatccacttctcgtgccaaacaagctaaccgttggacaaatgtcctagctagtaaggccagtcacaatgggtgtttcatttgagtgtcatgcgcatttaatacagtgacaagtcagcaaaagagcaatatttgcatgaaatgggtaggagagagagtaaactcgtttcaccatggtgacacgagatagcgccgtttcccaggtcgctgaaacggggtgaaacagcattgagagttcatcgtttcacctccgggatcccgtgcgagcgctgctcttcgccatcttcgcgcgcatcgccggattcttcccgcgcgagtcccccatcttcccgcgcagcacctccatgttcccgcccccaaagcactggctcgaagctttttccccaatctcacctgcaaccctagcgccagactcagtccccatcgccccgtccgtcccataccctagcgcaagaaccacgagcggagattgcggagctggatccacaagtaggtggtgaatcctgtccatctgccgccgtccgccgtccagcagccatggatccacaaggaggtggtggatcccgtctgagcgccgccggcagaggagggaataagcgtgggggcaagcagctgggcctgaagaggtcgtcggcgcctgctccatcaccggcaacagctcagccaccgctgcctgcaagttcccctcctgaagctccatcgccggcaacagttcagccgcctactccatcgtcaagtcctgctgttgctgcccccagttcatcccctgctgtaccgatgtcaaccatgcccccatggccaccgcaaggagcaggatggggctctgtaccccccaattttgcttttctgcaaggaaaccaacaaggcccaagttcatggtattttctccttgtcacagattattcactgtacactatgatacatgatatgactctcttcttcatgcattagtaattagttcctgtttatgctcaatgaaatttgttagaatcagtatgtcagtacattggtaatttgatatatgcctgagtaatgaatagaaaaaatgtagtattcagtatggattgcagtaatactttgttagtgaaaattcagtattcagtatgcagtatggattgcggcttgtataacagaaattgaaagcaaaagattcagtttgcaatctggacagtgtactgtacaacatgtaattcacatacgtaaagcttgttaaatatctccttgtcagtacattggtaacaaatgctttgagtgtaaatgccaagggtatcatcctaacattggtatatatttttagccttctgtatggaatgcagacatggtcttctttgcaaccacagcaacagcttgccctacactctgtgctgtcgtcatagctaaccaaataacctgttagtactgatatatatggtcttctttgcaaccacagcaacagcttgccctacatggtcttctgtatgcttgactaaacttgttacttgacatatatgcttgactgaacttgttgcttgactgaattattccttacacatactgtagtacttgcttgactgaactatgtcaggatcttattaaaaaaaatctatgtcagcactgctactatgtcaggatcatcagtatgatgcttaagtaacctgttagtatgtcagtacttactatgtcaggatcatcttctggaacttactatgtttgattttcttatgctgccatcggtttcaattggatttgcttcttatgttttcaggttgtatcctacagaaggcttcgtaaattttctccaacagaactgtctgccgcagccacaagaaggtgaaaattttcaccttgttggtcagactaccaacacaatgtctactccaccaccaacaccccaagctgcagctaacaatacagtccaaattgatattcatgaagatgcaatcaatgatgcaagtgctaaaaagagaagtttgagatattggactcatgatgaggaagagagattggctagtgcttggttgaatgcttctaaagatcccattcatgggaatgaaaagaaaggtgatacgttttggaaagaggttactgatgagttcaacagaaaagggaatgggaagcgtacaagggaaataaatcaattgaaggttcattggtcacgcctcaaatcatcgattggagaattcaatgattactggactaaggtaactcaaatgaatacaagcggatatgacgatgacatgctggagaaggaggcacaacagatgtatgcaaatacatttggaaagccttttgcacttgtgcattggtggaagatactgagaaaagagcccaagtggtgtgcaatgattgagaaggacaaaaacaaggctgaagtggttgatattccagatgaacaaaagcgtcccattggtagagaagcagcacaagccgagcgcaatggaaaacgcaagaaggacagtatgtcagaaggaattgtcatcctaggggacaatattgaaaaaattatcaaagtgacgcaagatcggaagctggagcgtgagaaggtcactgaagcacagattcacatttcaaacgtaaatttgaaggcagcagaacagcaaaaagaagcaaagatgtttgaggtatacaattccctgctcactcaagatacaagtaacatgtctgaagaacagaaggctcgccgagacaaggcattacaaaagctggaggaaaagttatttgctgactaaggttagatatctaatctaatctgagctgcactattatttataataattaaagaatgctgcaatatttagttatattgtctgtatatctgtgctgcactatgcagtcagctgcatatcacgaatttgtcaaatctgagctgcatatctgtgaatggtgcaatatttagttatattaattacccagtgtgaatgatgtattgctgtcagtttc

SEQ ID NO: 67023 - DNA, 1140 bp, Oryza sativa
tatagctagtagtttggccgtactatcactagataaaactataatattctcaaggagaaaatttctaacgaagcaacattaattcctctcgtcaactatacgttaccgtttctctcaccatctttgtcgctgcatcatgcatcgatcaactattctgtgctgaattaattaaccaaggtgacagaagcactgctcttctagctactactactactatatatactgcattgggctagctagggttcttgccatcagagtacagcctataattagctaatactagctacaagatgcattccactacgataacatccactagaacgtactactacaggttccaaccaaatgatcaaagtccgggtcgatttgcactgcagtgctatgctacgacgacgcccacgatacgatcatgtactaacatgccctacgctattatggggagatctcaagcattcccgttttcgtcattcacattaggtagagctcctgcccttgttttgagcaagcgatcaaaaggtaaagatgggcgagttatggcaacagatcaggaagaagatggggcaacagaggaagaagatgcaaggaaaggcatcccgtttctgctttcgtcccaagaagagaacatcgcctcagacatcctgcaggttgatctatatatagccccttctaggccctccccgctcgtattccatttaattaggcctttttctctaagaaatactcctagattttaggtgtgtttagttcacgctaaaattagaagtttgattgaaattaaaacgatgtgatggaaaagttggaagtttgtgtgtatatataggaaagttttgatgtgatggaaaaaataaaagtttgaagaaaaagttgggaactaaaccaggcctttaaaagaatttcacgtgaattgaactgattcctaaatatatcctacaaaattcttgcgcttcaaacaagcctttttttggggtgccttaggccctgtatagatgggactaaaacttttaaatccctatcacatcggatgtctggacactaattataaatattaaacgtagattattaaggtggtgtttggatccagggacttaactttagtccctgtatttagacattatttagagtattaaatatagactattt

SEQ ID NO: 67024 - DNA, 644 bp, Oryza sativa
tctatactctatagcagtgatgaattaagtggaaaaatcatgaagtggtattagccatcaaagcacaattgaaatgcacccgcagctaactggagggactaagctttcccaatcaaattcaaacaaaactagtatgagatgagatgatggatttggcatggggaacaatacctggttggcgagggagagggagtggtactgcatgcgcgggctgcgcccaatgtctcctaaaactactgccgctgcgcgcctcctcctccctgcctccactgccgtggccattgccactggccttcggagtttggaaatttcggacccgctcgcaaaaagtgcagataagttgaagggcctatttggtgcagctccaaatcctatatctagatccaccaaggatctgaaggttcctgaaaaggcatttagctaaacattagctccaaaaagtcctggaagggaggagtggatgaaaatgggcaattgtactcttggttattttgctgtttaccatatttatactcaattagagaatatgtttgtcaaatttgtttggaaatttcgcacaaatacaacagtgatcttttttctctaaaaattgtcaacagcacaagaacgtacagatgaaatatatcttagcgatcttatactca

SEQ ID NO: 67025 - DNA, 3647 bp, Oryza sativa
taatcatgttttatcatccaacaacaatgaaaatacgaattataaaaaaatttcatataagacggacaggcaaagttggacacgggaaacccatggtttgcctttttttaggacggagggagtacgcatgaatcttaacgtactcttaactattaaaaaaagtgactaaggctgtgtttagatcctggggtgaaaagatttggcgtgtcacatcggatatacggacacacatttgaagtattaaacatagactaataacaaaacaaattacagattgaatttattaagcctaattaatccgtcattagcaatatttactgtagcactacattgtcaaatcatggagcaattaggcttgaaagatttgtctcgcaatttacaagcaatttgtgtaattagttatttttttcgtttatatttaatactccatacatgtgtccaaacattcaatgtgatagggtgaaaaatttcaccaggggatctaaacagaccctaaaatttaagggtttttagttgcttgaaaactagacagcccaggtaacaacatgatgtttggtttgtcgaaccaggttgtgatgggccatcggtccagcctcgttccggatgaggtgaggtgatccactagttttgctcaaacgatgcaatcactatagctaggaaggatgactcgaagacggttaatacgagatgtcaggatgcaaacacaagtcagcaccagagacgaggcatcccatacaaatcatgagattgtatgatcaagcaatttactcttaacgagtggtttctaaatacaaaccaactcgataggattaaaataagagtgtaagtgggtcaacccacgaacccatttatagattaaatacgacaggttttagagaaatgggaaccaaggtccctatcacctgctgcatgaggtgcccatggacacattatcacgatactgtaactcatgtcgctatcaaccaaattcaagggactattgagatacatctaaagaggaacgctccaagagctccaggcgcaacctcttgtgggttgtgctcggggtgcatctgccataagcccccaaagcacagcccctcatgggttgtgcttggagtacaccttcaatttgcccctgagtacggccccccgcgggttgtactcggggcacatctacagccggcagccaagtacgacccctcatgggatgtgctcggggtacatctgcctccgcgctcgaccgccgagtgcctagaggagcatatatgcatggaccctacgaagcctcgcattgaatgcgaggcggtgtataccaacccggcgtgcgactgggataacacgtgataacacaacacgcgccaaccctgtgaaaagcctttatcacccctatgcggaaaggtgtgggctgtcaggtggcacggttgactgccataccacgtgtcgggcccacagtcatccagcactctcttccagccactggcgtggcctgacgaccaggctcactcgtcaagaagcaacaagaccaaacacatctaacccctgtcctggggcccatttgtaagaaacaggtcattgtatatccccttgcaactagaggtggaccaaggccactgaaaaaggggttgaactcctgagtagagccgatcttagaacatcttcatcatctccacaacgtccacactccacaccagagaaatcagctccctagaattagaacaaaggtataccaacatcttggaaacattccaacaaagaactcaaccaagaatataggagtagggtattacacctacgtgcgatccaaacttatttaaagttttaaaaccatcgcctctctagtttgtcgtcctcgtttcatccgcccgacaccatcgcctcatttccgcacacctattccctggccgagtctctaaagagggtgtgagtcctccctgctagaggagctcaggctccaacagtaggttatccacttatttaatttatgagtggggttcaccggttatcccacttacacctctagttaatagccattataagcccgaagacatggagcacgtcgccgttgcggtcatcggcagcagtgtggcagccaagcatgaccttggagttccagtagccgggccgccggggcaggggacccttgacctcccatgatcgtccttggcatgcatctggggactggaggtgggtccaacactcgccgacctttcggtgtcggtgttggttgtcaggaattccctccgctctcacatagtgaatcacaaaccaactgaaggttttttttttttttcagaatgggtacaggaaactggagaaaggttcagagagcagaggaaacagagttcggttctgcgtacagcttgttcaacaatttcgtttttcaccattatttatcccatccacaatctggagtctgttgcatgtaaacactagatctgcacattacgtcaatcatacaacgggaatcaagatgaggcactaaaactggaaaaaaaaaaacgctaacttaaacttgagcactaccgctagagtccgcctgaaccggtcatctctgaacatgcagcctatcaaacagaagactaacgccatgtttctttcagcttgggattattataatccagattattgggagtaaactgaaagaaacagacaacttattgaagtagcttattataatctggagcccagcttattataatctgataagctcatttaggtgagcttttttcagattattgggtgaaaaattacccaccatgccaccccactctctctttagacatgcaaacccaataatctaggctctaataatataggaaagaaacagctacccgcttattctagtacagattataacaatctagcttatagtaatctgactcaataatctagattataataatcccaagctgaaagaaacagggcctaaccaaaacatcaaaaataaaatttgcgcacaagattactgaagataagctatcaaattcaccccttgatcttggtgcgcctgaacctatatcagcccttcttcctcatctcctgagagcaggtacaatagcatgttataagtcagctacaaacatattttaaggagataaataaggagagagaagagcagcggctacagatttatagtcagctgtagcacggactccaagacgcagtatatgtatgacaggtgggaccaggtattaataatgtattatgtaactattgtatgaataagctattagatttatgaattggagctagtagttggctatactattaaacttgctcagaaaacgaactttgcccaatggctttgtcagaatgtcagtaagctcgtcctctgaacagatgtgctcaacacactccccgatgaaatggtagcgagtatttttgtgttctacatctatcatgaagcactgaattcttacaaagatcttacagagtagttataaattttcagaacatcacaactaggatcttcaggcatcagctctcccacagcaacctactgagccaaattccttgataagctgcagtgatggcagcaatgtattagcctcacatgaaaataatgccaccaccttctgtttctgttctccaacatgaacaaaacacctgccgtgctcttactgtcgcttgcatctccagccatattacagtcactgaaaccccag
